United States Patent 8,216,786 (GENETIC POLYMORPHISMS ASSOCIATED WITH CARDIOVASCULAR DISEASES, METHODS OF DETECTION AND USES THEREOF) - sequence listing, part 3

SEQ ID NO: 1061 - DNA, 325263 bp, Homo sapiens
tatattaagcactgtgtcagtgtgtgtgcactgctgagaagtgagccctggtggaggcttcgaagagcatcctggaaccccctaggctccgagaagtcctgaggtcagggagtttgcagagagcagccttggctcaatgctacagaagccagaggagatggaatctgcaaatctccaaattcacttccacccaacttcccaaaaagtactattatccgttgttagctacttctttaggaaaatttaagaatgatctcgcttttcaccacccaatgttataccggaaatatatttcaggaagcaagtggcttttcttccttaataaaagccaaggcttcaaagagataacggagctgaaccgaaatagctaagccattctccccatttataaatattacataaagtctcctcttcaaaagccgaagggtacaaagctcctctgctgaaagcagcctctcttctacctggtgagaatgagtgctgtagggaggaaggccatggggccaaggttcccgctatgcatcatcttccctatccccttctctttctcctctgtatcaacagtgcccccaataatgaccatggtcatggcagagccgggcaggcgcagcaaggggcaaactcagatatccaattccagaggcatctgctcagttgctgacagcaaggacccttacggaatgcaagagaccaacacacaccaagcctgagaggctaactagtacacaacctaagtttaatggcacgtattttcataaagcctacgaaacgcaaatctacgtttcctcccttttccttctgccaagacatatcaatagcatcaactccaacctctgtcccaggcaggttttcgaaccgtgaaaaccgtgaattcacagtaaacctgactctgcagttctctccatgcctaaatggctatccatcgcctttcagggtctcctgaacatctcccttcttctctcttgtcacatcctggagttgatatcccaaactcacaggcctaatccatcattctttcattttcttcattcctcaactatttttgagcatctactgtgctccaggcactattattaaaaaaatgcaagcatgaatattgcacagcttttgtcttcccaatgtcccagcagagaagagagacttctagattaaaaaagaaaaaaatcagtacaatcctatgtgagaggagtcacaaagcaatacacacgaccaccttcacagaggagggaagggatatgttagcctggtgcagacggataaggttttacacaggtggtgatgtctaagctgactcttagaagtaaaaggatttcaggtgcaaacgactgagaaagagggaaaacagaatttgtaaaggcaccaagatctgaacgagtaggctctggtccaggaagggcaacaggttcagaatggctggaatgccagctgcatggaagggtaaggttgtgttcagattcagaaaggccttgtacatcacgccaagaaacctggagcattaccgtcgataatggacaacctggagaagtgcggagagggtttaaaccaaagccacgtcagcctgaagaactgctttagctcacttatcacaggtttttcaaatattagaattagtagccaacatctaaaaattagcaaatttcacataaaaatatagaatcttggttcctttaagaaaataatctggcacattgggccaacattcctatggtgacatgtgtctgagtagcaggtgcagcagctggccccttcaagtgggacacctatcacctagttcataaccgcccctgaccgccctcacttggaggcatgtgaatctgcaatccctggttttaagggagagggtaacaccatagacaggggttacaggaaaatgacactgaaagtgacccagtgattaaactgggcagtgaaactgaaggcaagagggcaagttaggaggatttcaccacagcatgaggaggtgacaaaagcctgaaccaagttcggagaataaatactcagaagaatgtaaagattcaagaaatgcttaaaacgctccaggcacaagaatgcttattaaccatggaacttttctgtgtcatttgttcatggacaaagactgtattaggagacaggaagaaggactcaaaattaattttcaatttataattaaagtgactattaagcaaactgtggaaaatccacctcaatgccatacagcagagacaaccgatgaggcacagctgtctgtgtgattctcatcgtggactctcaggatcgttttccaggtggaacagaacaaatcctactgcaaaccctctgcgcgaagcccctgacaagtgaggtttacaagcaggggctggggtctaaaccagtacaatcgctcacagcaggaccagcagtgaattggcaaacttagaaagccttccagctcatccacgggagagtcctgcccgagaactcacagaggccgttgacatccagcatgttggagatgccccggtcactcatgtccacctcgggctggttcttctcccggctctcctccaccaacttcttcagagacttggacatggtctgcaccgaacaacaacaaagcacgtgggcgatgacagcaagcgcagaggcggaaaggcaagaggccttcgctgccactctgaggcttccccagggttggagcgggtgggcgtccgagggcgtcccaggggctggtccgggtgcggggaggggatggagtgggaagggttcagccccgctgcggccacgcagcgagaagcaaccccaagtgcaacaccgcacacactcaccacggaaggtagcccctaagacgatgggcgtgcaaccacaagcttcggcagaacgcactccagctgccctcactccctgcaacaccggcactgaacagcgaacacgccctgtctcggcgccccgcgcaggcgcacacagcgccgctgccagctccacgcccgaccctacccatattaggagaacagctctccagacgtgtctccagggccaggctccgcccttaaaagtctgtggaagaggctggctaatcacgttcgttattcggcttcgagaccccgccccacgctgaggatagtttatcccggtggcgtccaccccacggtttgggacgctgattgggccgaagttggcgcgtgcgcagtagacttggcgcaagctcagttgatgggtcgaagcccagagggctgtgggcggaagtggggaagtttgtggcgtgactgtgtaagggagggtggtggctcagggtgggtgttgcgaaagctggaagtaaattgcttccgaatgtttcgcttgtgtaatagccgctccactcgccagaagttgctaccctgagcccgtctccacaatgtgcctctgagggaccttgtggggcacgcagtttcccgccctattaagagcttctccaggcggggattccggcgcggtctgcgtttccccagcgccctgctggaaatcttttttgacaggtttctaaggctggcttttagcctttttacttgtagctagaacctacaagtaaaaccctactattttaaaagtcatttgaaaacaccactaaagcgatgtgtctttcccaactaggacttttacatttgtgaaacatgacgttctggcttccaggaatctcttgctttctcttccaaaagcaaccaaattttaaattctagagaaactgttgccctctgcctccctatttcctgacccagtctcagtcacccagcaacatcctgtgcttctctcaccaaaaaccctgtcctgagagactattttatactatggaataaaaattggcaccaggcacttttcttctactggtcacctaaattgatgataagacggatgccacacatatgcatttatatattgtagattgtagcagggatcaaagccttaaggagatgtggtaaaataatgtaattatatctccgaaccaattggataaaaaaaggatctgcactcttaaattcgaaagcaggtatttcttgcttaaaaaacattccagatgaaagagttattcctccattagtcttctttgatctggaaccgtccttggcttttatgtttattgaactagacattatttaagaatacagaccaggtattgtgtggaatatccttcaaagtaagtttgatgttccctttcaggttatgaatttttggagaaacaccactaaagcgatgtgtcttttccagtgcatgatatcaaggtacagatggcatcggtttctcccagtataggtgatgttcacttaaataaggtagtgtctgccaggtttcttcaccataaagttactatttttttctttatgattaaaaataatgctggggggaggtgctacttgattacaccccattcctcatctaatttttacccacaagttttagcatccactgatgattttctaacttcataatttcatcaatacgtattagtaggtaatctcctaatacatttatttcttgaatcattaactcttttaaagcaaaagtcctgttttgaagcaatcagaatttttcttattctatcaatttctaatagtgaatcttgcctaggtaggctgaagacatacagtacctgtgttagtcggctagggctgtcgtaacaatataccacagcctggatggcttaaacaacagaaatttctcacaatcctggaagttctagatcaaggtgccagcagatttgatttatcctgtggcctctcccctgcctcgtggacgactgtcttctcttggtgtccctccagggcattttctctatgcagtcacacccttggtgtctcttcttctaaggacaccagtcctattggactgccggcctataataacaccctgcatttgtttcatgaatgtactctcttctcaggtatcaccgaggataatagtttttaaacctctcttctgttcactcaattatgtttcttcaagggtccattcttacgtgtatttatctagtcttttccctagaaaagaaagattcttcccctctctggtgattgattcttggttgttcttttgagttcaagtgtgaagatctgaactggtttttctagatagctggagtggtctcttgtttgtttgtattgttttcctcctagatccctagactgatagtcgaatttcttcagaggcaagaacccagtattatgcctgcaggtcatcacccggctacctttgcaggtggagggaaatggtggattgtgagtgccagttagggcaactccctgactttggttttagcccctcacactgcaccagccagccccacatccaggttacacctggaacagagagtcccagccctcctgcatgtctctcttgaagttattttgagctgcatgcctccattcacttctgtttcataggaatttgttttcactcctgtttgagataggaaaaaccaaactgtttttgctactctccactggctcaacacttctgacaccagagaatcccccacacatgaaacagttctccagcagacaccagctcggtgtcttacagtttaacttaattctgacactgtctacctcaacttatagtcaaatcccacaagttaagggttcatttccacaagactttaggttgactgtcacctacacttctgactgaccagctataaatcagggttcccacacccccttctcaggtttgattaatttgctaggatgatggttagcctgtccagggtcctgattgctagcagtgaaacttcatggtgacacaatttggaatcaggaaacttatcccttggccactagatctgggaagttggctcaatgtatgtttcaccagataagaatattaaggtttttgcctcaggactggctcaggaaatcaagcaagatggagctgggaagtgtgctttgtgaagctgggagacatcagctgatagtcttgtatggctgtcttgttctctgctttatcctcagtgcgctgagtacgtatcacatagctgatgctcaataaacatttggaaacaagtgaattaaatgtaaagcagaaccagaggatatacggtgggtcttacgaatgagagtacagttgactcttttctccttcttccagctgaattactcaaaaactgaattactcaataactacttcccttggctatacacgaaaatgtcatgctcccaagcctgaccatccctaacccactaaaaaatcactgcttatttcctagatgcccagcctggaagattttgtaaagcttcattttgtctctttttttctgtatttttaattttaaaattacataataatattgactatgctttcctcaatttcaggtacacacttcccagatattccaatatgcctcctagaaaagcatgcccttctgagtggaaatgataccgttactctaatgatgcagtccatgctctaagcatcatttttttgacagtgacatcatgttaatctttctttcagaaaagtactatgtcatttcatgttattgttaaactttccctgtattctgtacttttgcaattcattttttgataaaagaggaagatcttatatctgtcacatttcgtctgttacaattggcccattgttgtagcttatcaagaccttttggatttgatggtgttacttatcgcattcactgtcctttccaatgtaattgtcacccataaagttgatatgtctatccataatacaaaaagggagcaggaattgttgttgttgttgtttgtttttttgagatggagtctcattctgtaacccacactggagtgaagtggcgcgatgttggctcactgaaacctccgcctcctaggttcaagtgattgtccagcctcagcctcctgagtagctgaattttcaaggttagagtattttatttctgtggctccatactctgtccagaaataattatctgccatttgagtattagagtaagatgaagttacattcctcagcttctctcattcacatggtcttttgttaataacccttgattttgcataattaacataaagcaaatctcctttgtaaaggcttccgcttttctagaggcactgaaaaactttataaaagcattgaattttcttatgaaaaggaagctaataactacctcacttagttacatgtctggcagcattggagataaggatgtgctactgaactttctacttcttgttaagtggcaaaccatattgtttatttataacttaacatattgtgttaaggaataggcaatggtggtgcttatggaaactttgtactcctgagcgtaaatacataatagagtttggatatttgtccctgctcaaatctcatgttgagttataaaagccagtgttggagatcggcctggtgggaggtgtttagatcgtgggggtagatccctcatgaatggcttgggccatacccttggtgataagtgagctcttgctctgagttcacatgagagctggccacttaaaagtgtgtggcacctgtcccatactctcgctgtcttgctcctgctttcaccgtgtgacatgcctgtttccccttcgccttcctccatgattataagcttcctgaggctgccccagaagccaagcagatgtcagcaccatgtttcctataaagcctgcagagctgtgagcagattaaacctcttttctttataagttacccagtctcgggtatttctttatagcaatgcaagaatgatctattacagaaaattggtaccaggagtggggttttgttataaagatacctgaaaatgtggaactgactttggaacaagataatgggtagaggttggaagagtttggaaggctcagaagacataaagatgagggaaaatttggaacttcttagagactgtttaaaagttgcaactaaaattctgatagtgatatggataatgaagtccaggctgccaaggtcttcgatggtaatgaggaacttagtgggaactggagcaaaggtgacacatattatgccttagcaaagaacttggctgcattctgtccatgccctagggatctgtggaagtttgaactaaagagtggcaacctggggtatctggtggaaaaaatttctaagcagcaaagtgttcaagatttgggctggctgcttctaatagcatgtgctcagatgtgggagcaaagaaatgacttcgaattggaacttatattaaaaaggaaagcagagtgtaaaaatttggaaaatttacagcctggccatatggcagagaaagaaaaagctttttcaggagaggaattcaagcaggctgtgaggcatccacttgctagagatatttgcataaccaaaagccaactgctaatatccaagataatggagaaaagtccccaaaggcatttcagaaacctttgctgaaacccctcccatcacaggcccagaggcctgggaggaaagaatgatttcatggaccaggcccagggccctgcttccctgcataggctcaagacagggctccccacgccctggtcactccagctccagctacggctcaaaggggcccaggtacagcttgggctgccactttggagaatgaaagccataagccttggcagcctccacggggtgttaaacctgcaggcacacagagtacaagagtggtagattcttggcagcttctccccagattttggaggtggtatggaaaagcctgggttttcaggaagcagccttctgcaggggcagaatcctcacagaggacctctactagggcagtgtagcagggaaatgtgggtcggaggccccacactgagttcctactggggcactgcctagtggagctgtgtgaagagggccaccattctacaggagagtggagaatactcagagaaattaaataaccaggagagtacagggtcctggggataaatgaagaaaaggttcggcgtggccaggagaaacagaagtttgagtcaaatgggagggaaatagagaattcagaggttacggcaaacttctctgtagttaaggcaaggtctttggagaagctcagattgacctaggggcatggcaaaaggtaaacacaggtgagacttgggcctggctttggaggagtatgggaaaagcaggtacatctgtatggtaaggaggagagtcatactactactaattgacatagaagctagcatttaccaattacttaatatgcaccaggtattgttctgagtctttacacatatatacttaattattgcaaccctgtgagacaggtaaaataatccccttatacaaatgaagaaactgagcacagagagattgtgtaagcacttaactagtacagttaaaattgaaactcaggcagcttggctccagaaatgaagctctggaagattcatatatatattgaattctttgccaaaatgtaaaaattaaacttgaaaatttatatatgtcccatagtgaaagacagagttttaataagtcaaaaaattaatgcagcataattgtgtacaattcaataatgtttattatgtgtaattgaacattcacaggaaatttatgcttctatattatcattaacttttgttgttcttgttgtcatttttgagatagggtctcagtctgtcacccaggctggagtacagtggttaattcacagggtttcactgcagccttaacctactgggctcaagtgatcctcctgcttcaacctcctgtgtagctggaaccacgggtgcatgccaccatgcctggctaattttttgattttttgtaaaaatcaggtctcactttgttgcccaggctggtctcaaactcctaggttcaagcaatcctcccatcatggcctcccagcgtgctgggattatgggtatgagccactgcccctggctattattattaacttttaaaaatgtatgtcacatatgccataatcatttccaactctttcaaagtttttttaaatttcagctcaaaatattagaatgaaatgcacactcaagactaaagaagctatattctatgttcgagaaaatgtacaaatattgattctggttttttttgtttcttttttttttgagatggagtcttgccgtctcgcccaggctggagtgtagtggtgtgatcttagctcactgcaacctctgcctcctgggttcaagcaattctcctgcctcagcctctcgagtggctggaattacaggcacccaccaccacgcctggctaattattatattgttagagagatgaggtttcaccatgctggccaggctagtctcaaactcctgacctcaggtgatcaacctgcctcggcctcccaaagtgctgagaatacaggggggtgagccaccacgcctggcctacaaatattgattctatccatggtttggtgaaaaaccatacaagttcagcttattctctgtggcatcagcaggggtcatgtatcaggatggcagagtgctgtccagcgtgctgcagagggaaagtgctgagtgaacacgagttgttacccacttagctgtcccaagttaatcggaatgcggatggacgccgtgcataatcagcatgaaattttatgaagacctgatttgaggaagccacgaagggagctatgctggtgtcctaaaattgaaaaaaaaagtatccaattatatatttcacatatttgaacgtttttctaggaatgttagcctagtaacaaagtaccacataaagaaactttatagaatttatggtgaacctgcatatatttcttgaagtaaccttgcaaagaatgaatgcaaatgctttacaaaggaatatttctgggcgtggggagttgagggaaaatggggaaggactgcaaatgggtactgggtttctttggggggtaatgaaagtgtcccaaaattggctgtgctgataatggccgcacagctctgtgaacctacgaaaaaccactgaattgtatactttaaggagatgaattggatggtattgaaattgtatctcaataaaactgttatcaaaaaacttgaacttcttattcaagttcttactgcaaatttaatttttctgaaacaaacatatataattaaaatgatcctattaagtaaaatatagtattttcatcctcagtgtttatagtttttcctcttgagatttattttcatatacttctgtggaacagtgtgtgtgtgtgtgtgtgtgtgtgtgtgtgtgtgtgtgtgtgtgttggggggatacatgggtccccgttgtctctcactttctattcattcatttggcaaatattgatcaaggcactgccacgctgcaggtattaagacattaaaaaatgagcaaaacaggcaaaaagccctgctctcatgatgcttacatgactggcttctcctgcctcagccctaccccaagtcatcaaaacacaggcttatttccaagatactcacttactcaagtgagtgtagatttttttttctgtaagagatacatcaaggaatatacaatatttttattcctatacacatctactttttactcccattttaatctgcttccaaatttcaataacttcttttattttgacaaactagtatgtcaacagacggtcaacagaagttttagaatctcctttgattctccttgtttgtcccgttattctctcatttgctagatcttcattttctgcagctgcaagggatataggatttccctgtgaacaatggtatttaccgtaatataaaatatctccaaatcagggtttgtgtttatattagcaaaataaggagctacctctgtatgtacactgtatgtatttaaatactgtatgtatataaatattacaagtttaacaaacatatttacatacataaaaagttgaattgtatacttaaggagtatacatacaaaagtatacaactttcatatgtatgtaattatgcatgtaaatatgtatgtatgtaacatgtgaaagtatgtatgtaaatattagtaaaatattacaacttacaaaaagttgtatgtaaatattagcaaaacaagagctacctctgtacttcatgttttatacttatgttttacattttttcatttatgtttaacattgataaagtgttaaagaaatcagtggtacctttaagaaaaaaaacaattacacatgaaattatatccacatttataaaaaaatgtaaaactgggaaaataccgtaaacaccaacagttaaaaaaattgatgttatctcgctatatacttcaacttaacgtggcattggattaaatggccgtcacttctctcagtgactcggtttatacttgttcagtataaacctgaactcggtttatacaagtccaggatatacttgttctttccaccttatgggagtgtcactgtggggatcaaatggggttgtatgtttgcaagccactgaaaaccatgcccacaaaaaaacccctaccaatataaagtcatggtattgttaaaattgcctcttttcctcccttttgaaatgtttgtaaatttcaattcaatgtctaagagctgattagcttctaaatctgatgtgtggcacatttactggggtctctctctctgtgggccttctgtgcatccccgtgatacagtgtctgctggtcctgtgattaccatttctcaccaagtaatgtaactatatgtataaagatatcactaccaaaaagtttattaagtgttgtctgtagttgcaaaaagttcaagagacctaaatgtccacttagaggggcttcattaaataaattaggccacactcgtgcaacggaatactctccaaaacttaaatatgatgcaacagtgtttttattgatatgttactaatgatatattggtaagtagaaaaaacacaccatcaaacagtaaaaaatatgcatgtaaaatatatgcaaatatattcaaagaaaggtgttaagaatatatgagaatgcccagggttttagaaaaattagcctattttctgatacttctgaaaacagcatttatcaattttataaatagtaagttatattttaaaaaccatctagatttccagctgatacagttctctgtctagtttgattacaaagtctaagtgattaaagggcagaaaaatcagaaacagatacccgcttgccaacagccaattttcccttacttactctcttgttattttgagatggagtctggctctgtcgcccaggctggagtggagtggcgccatctcggctcactgcaacctccgcctccctggctcaagcaattattttccctcagcctccggagtacttgggattacaggcgtgtgccactataccagctaatttttgtatttttagtagagacggggtttccccatgttggccagtctagtctcaaacttctgagctcaagtgatccacctgcctgggcctcccaaagtgttgggattgcaggtgtgagcccttactctctttaagtatctacttgcacatcaaatgagaggatcgtaagcacagatgcctgcaatattgaatcaacgtcagattctgatttttttagggaagatatcagagctttacaaaaacaaactatcggtcaccatttcttcaaataatttctgcaattttcagcaagaagtagataaaatagagccacgtgtccaaattttctacagttctatttatgcagaaataaacatgggtattcaaccctaggcagtgcactgacgtcacagagggagcttttttttaaaaaaacagcgtgctgtgactcctccctgggaaatcccgattcagtgggtttcggtgggaactggaagtctaatgtaagtaactccacaggtgattctgacgcagggctgatttttgtaactcttaatagtaatttaatgcaatgcccaccagatggcactcatgctcccataatagaaaggcaagttggaaaactgctcaatttgttaaaggctgtgcttcttcctctgcagtgtgtctgcctttgaaagtctacactaggccgggcccagtggctcacgcgtgtaatcccaacactttcggaggcccaagcgggtggatcacctgaggtcaggagttcgagaccagcctggtcaacatggcaaaaccctgtttctactaaaagtacaaaaattagctgagtgtggtggcaggcacctgtaatcccagctactcaggaggctgaggcaggagaattgcttgaacccaggaggcggaggttgcagtgagttgagattgcgcgcaccactgcactccagcctgggtgacaagagcgagattccatcttaaaaaaaaaaaaagtctacactaagtgactcattattgtctaaaaataacaaatgggaatataaaatgtttgttttactcacgcctccgcagtatggtccagaggatggagagctggcgttgggcccatcatagagtgtgagatagttctggacacagtctcctggatcgtcaatgctgatgaagtagaagttgatggtgacaagccttccagcaggagcaacaaggacccactcgcagtacgtgttgtttgggtatgtgcctggatagccggggctggtgaatgagcctctgtctccataaagagttccaccacatcctgcaaggaaaacaggacaggaagtttgattcaacagcatataagccgtccagtctggcttgttaggcaataagactttattttcttaaggtgctgagactctgcaagaataatggaggcagaaatcccttttccttttcctcttctttgggctacaccctttctcctctcttcccctctcttcccactgccacctccacctcttccatcctccacacacgtgcctttgcctgcatatcacaacccagggataacttcctccaggactgtactttgaaaattgggggttgagagcagaatggaaaaaaaaaaaaaaaacaaacttgataaagtaactgtgggagaaaatcaagttgttgtctgtgtgctttcgatggtgtagagatctttgcatgcccagagttgacgccagtgatgtgagtgaagtaaaattagaagtaaaattcagcactaaaccaagagggagtgcgttattgtaggtgacggcaggaatgacttcattataaaagtgactttaccaggctaataactgacatacttaaggtcaaatacttcaagttttggtgttaatttgttcaatttgttaatctgtatatgaaggctgtcatgatttagactatatatctgtggagatccaggtcatctctgggacaggaagaagctggctggcatagttacagagcacgtggctgggcctctgaccactgaggtctaatctcaccttcacctcagtctagtggagcattttgggcaactcattaatcttggtgggtttttttgtttggttggttttttttttgagatggagtcttgctctgtcgcccaggctggagtgcagtggcacgatcttggctcactgcaagctccacctcccgggttcatggtgggttttttttgttttgtttttttttttgagacggagtcttgctccgtcacccaggctggagtgcagtggcgtgatctcggctcactacagcctccatctcccaagttcaagtgattctccagtctcagcctcccgagtagctgggattacaggcatgtgccactacacccagttaatttttgtatttttagtggagatggggtttcaccctgtgggccacactggtctggaactcctgacctcaggtgatccacccaccttggtctcccagggattataggtgtgagccacagcacctagcttaatcttggtgttttatttgctcgttgataaaatttgagcattggaggtcacctttaagcttcctttgggtgccaagattccattacccacgattatctttatagaacgcttttcttaagatatttaaagtgagttctgtttatctttcttattttgaaggtattttggtattttgggatattttataaaggtattcctcctctcttgaattaaatgtattgacatgacttaaattttctttagttgtttgataaacagccagccaaaaatgtgagaagatacttactaccctaaaaaaagcaatttctctccagaaccgccaagaaatgtcagggcctgcgagaagcacaactactcatatatatgccagaatgtgttcataagttggatttttggtaaaaatttttctttaaattctcaaagaacttccttgatggtcaagccaaaagtcaaaaagtctaacaaaatttaatttaccaaggaatttttgaatcttcctaccttaccttatatatgtttcatatatgaatatatattcttttataaacagaaataatgaataaatgtaaaatttaaagtaatctggccgggcgcggtggctcatgcctgtaatcccagcactttgggaggttggatcacctgagttcaggagtttgagaccagcctggccaatatggggaaacgctctgtctactaaaaatacaaaaatcggctgggcatggtggcgcatgcctgtaatctcagctacttgggaagctgaggtaggagaatcacttgaacctgggaggtggaggttgcagtgagctaagatcacgccactacactccaggctggatgacacagcgagattccatttcaaaaaaaaaaaagtaatctgtactttcaatgttaaaatctctattcttaacataaactaatcaggtacacaggtagctaaaaatataaagttactttgccttttactattagacacctcatgtttttctcacagtgctttcctgtacaaagtgcaaatgtcttaccagagggtgatgaagtccagatgatttcatatccacgatcagaagttacactatcactcttaaatcgtaggtatagttcattattttgagagaagacagggtttggcagcagagttccacagtacttgcccagtaatggtgaattgctgttacttccatttctcacctttaggaaggagtcattcattattaaacttacactttcttctctaaggtatatacattaaaatggagacaatttgaatgatgacattggtcggaaaagctttgtctttttatacagttaagaatgaagcgttttctgaaaatacatgcagaagtcaccttcacttgcaaaggggaaaaatgttccacgtgtagatcaaaaaacatttgcatttggattcagaaatacctgttaacctacagcaattaaaacaccaggcagcttttttataccgtagtttgtgctgtgatcctgcagcctttgcttttggggaaacattctggagaatgtaggtaaagtgaatttttaaaaggtggagatgggcgggggcaatgttgcctgctctgcttccagtcaactattacacctttctcattgtgtgtgtgtttgtgtatgtgtgtgtgtgcacgtgtttcccattgaaaattacttggctgtaaagaggctatgaaaaaatacaatgcaaagtataataaagttcagaacgaaaggaatttctgtatgggcaaaggacagaattataaatctatacaatgtctgttgttaaatgtgttttacaaacacattccgaggccttgttgcttttttgtttcaactcatttttgagtagacacatataaaaacaggagatgagcctgtgttttatggggagagagaactacactgtgaactgaaccactttctgtcccccagcctggctgctaccctgcattcacaaccagccctgcttccaggagggctctcgacgcttcttacggaaacgttacgcgggcaatgtatgttggaaccagcctgacatgcggaaatgctgattttactgatctatgtattcaaaatattggaagttcctctgttccctatataattccatggtttaaactttggttaattgctggtatcttaagtcacaaagttaagacatcttgctgggctgtgttgatcaggtgagattccttttaggtcgatgtagtagcccatgggagagaataatgcctttctagtgctttggggattattctgctaagtgtttaaacaaagtaaccttgccatgacagagtagccagtcatccactagtagatgggagggctgccatagccagcaccacgcttttgagtttgggcgtttttccctcagggtcctctttcaaaatgccgttgctctgagaggagcagcaggatactaatttccactgacactgctgacaacttgtcttattcactttcctctcctaggaagaatggggccacctagagcagtgggcatctctgggacatcagaggatcttgaaaggggaggtgaaggcatgaaaacagattccaagcatggtctagagctcggccctcgcttggtagtaacacagtcagaattctcagtcagacatttccgttcccaccgcagttcacaagaacggaatgctgaggcttcctggtacagctgccaagaaactatgcccacagccttcccactgagagccagatggagctacattttacaggcctaagcggtggtttcctttctttgcttatgggacaggaagtttcagatccattctgtggagtaatgaaggacagctaggaggaggaattctcactctccacggctggaaagcaaggctttgcttcccagcatctatcaggcaaatggcaaacgttgactctgatcaataatggtccattcaagctggagtgagttaagagttagttgcactgtgactccaacctaacgggattattccatctttcctccagatcccactctcctcattctttctgctttacacttcatataaatatttggatctccatggtgggggaggtacacaggtccaagttgaataacctgaccggcacaaagaataactgtatttgcctcttcatttcctccctgctatatacatctttcggtctcctgtcgtggcgagtattcctttagaaaaggcatgagcttcctccgagtgttatttatggcactatatgttaaggttattgattaataaaggatttagatgaattccaaaggggagagctttccaggatgataaaactccgcatcaggaatcatgttgaagctaaacccatatgcaaagaccatatgccagaacacccttcctggccaggctgggcagaaggtgccagcagccctaggagccaaatcggatgaggggggttgcagggcagaaaagaaagaagaagaaagaaaagaaagaaagaaagcccttggtgctaagaagcagaagatgttttgttgggaacaaaggctgaagctaccaagaaactatcagctgagcagaggcccgctagaaagaatcgtcccacagaatgaaaggagcccgctgcctacaccggtacatttctttatgctacaaaggtcaaatcctcttgggcagcttattttgaatgaagacctgattaaagaggcagtgagaaaaaaaataaaataaaaaatacaactccagatcaggggtagaggaacaagcacactttttggaaactttactgaagactcttgtgtggtacaaagccagtttagagacggtcaggatgaggtttagatttaaactccactcacagaggaactcagcatctttatgctcttggtttttaggttccacctaagtatatttcctaaggatgaatgcattttcgacagagcttgcaaagctcaaaccccgtgagctctggggtttttctggcaaaacacaggggctgagttccacacactgggtccacatcacatgaggcttattcagactatctcctgcctatgagcgatgatgttcatgttccatctcatatgcccaatgcagcgatggggcagaaagagcacagagggagctcatcgggggcactggaggaccccaaagtttcaggcccacgaggcgcatggttctgcctgctccaggcacaagggggcttctctctcagtgtgtcctggggtgggagtggggggtgggtgtgtggacgatgggcaaacagtgaagtcatttctgtgcccaaattcaagctctggagttgtggtgaagaaaggacagaccacacccccctgagaccagggagcatttattcaaggaaacacttgtctttagaggatgttgacgatgccccaaacttactgtagctgtcaggaaaattaggtgagctatttagtatcattgagcttcattttacagaaccagcatgttgtccttagacttccctctgatccttttaggtctcaacttacatattgccctcttgagccttctagttcccagactgagttaggaaccccaacccatgctggactcagttagtcctttccacattgtgctgtaattggctataccccatctgtccttcctgccagactaggagtctcctgcgggccctaaggttcccaatttccggtgtttggactggtgctctgtagatgtttagggaatgaaagggtaatgaataaattaatgaaacaaataagaatcatataatattagcagcactagataaaaggtgtaaaatcttaagtgatccaccatcttttaaataattcattcaaacgatattcaaatgcatatcacctccaagaaatcgtttctgcattcaactgagttctcgatgccaagtgaatgaaaaaagagggaaatggtgtggttctggggggctgtgagagtaacggtgcaatccttgtcattgtcgtagttatctggccatccagggcttctcaggttgccaaatgccttgtgatagtctctgttgcaatcttagaggaaaaataggcataattaatgtacgcattccaatatttagtgctctttcaacttcacaggaatcattcaaaaagatcattgcatttgataaactttagaaaaaagtaatccagcttcttcgtttacctttgagataattgagaccctgagcagtgaagtgaattgctcaagcagcacacacaggtgcaatgcaacagctcgttcacacaaacacgcctacaggaagcatgacacaggaggcttctcctttaaagacgaatactcgagcatcctttgaacttttctgatcacgttgaggtggaagtagcattcagactctcttttcgacaaggatgctacctccaagacagagttttgcacaaggattttaaatccattgttgagttatttgtggcaaatcgttatttaccttttttttttttttggtaaaaaaataccaaaagtactttcgtttgttttaaccaaaggaagctttcatttgagtcaattcaaaataagtactaaataaagtgttctgtgaaaataaacttcttataataatcaggtaactctttcaaggctttttgatttttacaaaataattttctaagattttcaattttgtgaaaatactaaaaacctctgaaatataaactttaaatgggtaaattgtatgatatgagaattatattttgataaagcttttgtaaataaacatatatatttcttgtaaataaaaatgtatattcaatgtggttaagtgtataattaataagataattggcatatttttaaaatcaactacatatactttgaagaaaatgctagcattctaaccatcctggatagtattatattctctttatctctttagaaaccaactgtagtaatttgctaaattgggctgggttctagttaagagagggatgtggtttttgttaacaaatcctaatttactcacaggagtcaattctagaaataattgtaattattctacgaataatggtaatgatggcagcttttttgaataaaagatgaagttcctggcctcacctgcaatctgataggtgaaactcattctagagtttctgtttacaactccagatttgaaaatgaccattgcagtactcatagaagaataaaacactggcacagccgaagcatttctgccacagaactgaaatcttgaatttccgtgaccctgaaatgaaatgggagccaaatcatgttagatttagtcttagaagagaacaggccataacagaaattagactgcatataaaagcatggtgtaaatatttagccatggaaaccagctctgctgttggaagtgctctgcaagaagactcacgttggccttggaattgatgcaagttgcaccttcccagaggggcaggaggaagggaggcaaagcttctgctgaaaccacagacatttccctgctgaaaataagatccctcgccttttatgcaacttcctagctgaggcctgtgccattgctctgaggatctaggctgtttgagagctcactggatctctcctcctggggcttttgccattgtcctgagctccatgggactaacaaccaccatcaccctgatccagcccttgctaccccttagcaaatctaatcagagcctttggttccactgtacatcccccaagccagccggggcctgtcatgaggtaccggttcccctttgtaacactagggcagccctcatcacctctcaaaagcctggagtaaatgcagtcgaatgcccatcagttcttgggtaaaaacaagttgtaccaaagtcagggtatttgcagcctccctgtcacaggaatgtctctaatatctgcagttcttaggaacctactgaaacaccccacccgtctctgcttgcaaaactcctgtaactgctcggggcttccacccctcttccccactgtctcctgctcttggtccttgtctaactttgctgtatcctgtgaactttaactgcactgtcagtcattctcggtatacatcccccacctttccactttgtggccttagcaaaacctggttctccagcagcctcctggtagaggctgttctttacccatgctccacagttcattgagtgggaagggtggggggccagcctcgggggaagggagggaggctccacattcctcactgcagcttccatcctcgtctcaaagctggttctccttcgacggtctctacatctggccaaagatattcttaccattatcgtcactctcatttacttttctcccagttacttcccttcatttatgaaagacttgaggtgtctcagctcatagtcatctcctgcccctgatttcctttctgaaccctttagaggtttctgtgtttttatagacaagccattaaacaccctcaacttcatatttcttaaccttagggccttctatctctgcatctctgttcatctccagtgccagctaaccactgaacatcctccgtaaccaccctacacatcattccttcatgatctgccaattagggctgctctgtctactcttggataccccgagaatcccagtttctcccagctcatccgtcaatgtttgtctttcctccctacctacccagtccgaaacccttgattgtttcctgtattcattcagtggaaaacattattcagtcatgacaaacactgggtcttactcgaggctgctccagctgctgttatgtttcagacggtgtctcgtgccctgaaagtgccattctgtgccccgctgagtggtccaccctgatccccattgtcttagcttcgtgaagccagggaaaattgagagagctttcacccaaagggcctgttccacttggctgtaagtcctctagggtaccaatgggtaatagagattttgtcctgaaaaccattaccaatggaatgacgataatctagcatcttgtccaccttgggagctcatctcagcatatatgctttgcaccaaactcagcaagtccagggtctattcagctgccagcacatctcacgcctctccactctggagtcacacaacctggacttttctttccccagcaagaccacatgagaagcaggggaccccagatttataatgaaggggaccctgaaaactcagaagacaacagatactctactagtccagcatatggggctttgaccatgacattttactggaatgaactggggagggttagttgctccccaaactgcagaaagacaatccaggtattctcagatgttctcctggtatccatcctcagttcgtggccaatccctttgcatattttccccagataatctcattcttctcatttttcaattacctatcatgataatgatgatgcacaaaaatctttgggcctttggtcaacaacccactttgtgtccaactgtctcctcaacatcttattccagaggaaattcagactcagccttttttaaagctcaaaatggattttgttgttgttgttgttgagacgaagtctcactctgtcacccaggctggagtgcagtggcgcgatcttggctcactgcaacctctgcttcccaggttcaagcgattctcctacctcagcctcctgagtagctgggattacaagcgcacaccactgcacccagctaattttttgtattttcagtagaggcagggtttcaccacactggccaggctgatcttgaactcctgacctcaggtaatccaccagccttggcctcccaaagtgctgggattataagcatgagccaccacacccagcccttttctttttatctctcttatattaccatgaatataaacctatcagactagtgccaaacagcctcttcactgattctcttgtgttctgtactgaccctttcaattcaacctatacataaatcccactaactagaggtatttctccaagcatggtccatggagttctggtactggcaccaaaacaccagaggtgtttgtcaaaaattcagataaatgggtgttatatgggggattcggtctctgagggtgggccagggaggatgcacttttaagatgcatcttaatgcattcttaggcacatgaagctttgagagctctggacctgcaggaccaagttcaagtttctcgacacacctgattggagggctttgtgtatggatgaaaaacacattaagctggaagtaacttagaaaattatttcatcatgaaacaaaccactccatcaaaaagtgggcgaaggatatgaacagacacttctcaaaagaagacatttatgcagccaaaagacacatgaaaaaatgctcatcatcactagccatcagagaaatgcaaatcaaaaccacaatgagataccatctcacaccagttagaatggtgattgttaaaaagtcaggaaacaacaggtgctggagaggatgtggagaaataggaacgctttgacactgttggtggaactgtaaactagttcaaccattgtggaagtcagtgtggtgattccttagggatctagaactagaaataccatttgatccagccatcccattactgggtatatacccaaaggattataaatcatgctgctataaagacacatgcacacgtatgtttattgcggcactattcacaatagcaaagacttggaaccatcccaaatgtccaacaatgatagaccggattaagaaaatgtggcacatacacaccatggaatactatgcagccataaaaaatgatgaggtcatgtcctttgtagggacatggatgaagctagaaaccatcattctcagcaaactatcgcaaggacaaaaaaccaaacaccgcatattctcactcataggtgggaattgaacaatcggaacacatggacacaggaaggggaacatcacacaccggggcctgttgtggggtgggggaagaggggaggggggagggatagcattaggagatatacctaatgttaaatgacgagttaatgggtgcagcacaccaacatggcacatgtatacatatgtaacaaacttgcacattgtgcgcatgtaccctaaaacttaaagtataattaaaaaaaagaaaattatttcatcatggcttcattacttcaagtgttttgcaaatactggtgaaaaggtcactagatgtgactgccattcatcttataattgttacctgcggtgagtcctgaagctgtaagtaattctgcgtgcagtcttgcgaggtcagctgtaatgcccacacagttatcttgacctgctgatgcggaggggaatcaatgacccaagtacagatggaaaatgggacatctgggtctgatgaattgggtgatgaaatattttgtggggtccaagttgcattgtatgttccaccacaaggcactggagagggaggaaaaagcaacacaggagacattttattcatgtctcatctcaggcaatctttgcaattctgtcttccctgcctcccaccccggaggagctatattttcattactctattaagaattcagggtttatatccttgactaaagattgtatcaaatttgtaccacagattaaacatacagtaattaacatggtgtttagcaattgacattgagtttagatagtaattgacattgagtttagtaattaacattgaaatttcgatataataagcagggcattcttttcagtgcataaatacatgtgtatttcataacatataaaaatgcttctatttactcactgtccatgatggtgtatgtagcattaaatccttccctctctaatgttaagtcactgatgaattgaaccgtaaggaagttaccagaagagataaaaggagcaggtactgtggaaccacaaaacgttccagccaagttcgcattttcactatccccatcatataactgagaagaaaaacaattcattacttctccattacttacaaaaaattgcatatttcacactaaattggacgcgaagttgcaataggtcacggtaaacatttttacattgattttcttagaggtagtcttaatttaggaacagaattataattggattgattatattatgactttcaggaaaaacctgttatgacgcctaacatttttttcctctttgggaaatatatgatttttaaaagaaggtgttatgagagtccgctcacccactgctactttaacctctgcaccgactcacactatggccccaactgctctgatctcttgcctagatgatcactgcagcctcccatgaagcccctgattctgctcgtgttcctctttagtgtatcctcaaaatgtcatcgagaggatactgttaaaatgtaagtcacaccatgtcactgctctgctgaaatcctcctaactgcttcccatccactcaatcaaacagccaaaggcatcacaatggctttctctcctctcccacccctgacctttctaatctaatttcttattgtcttcactttgttcgattccgcttcttgagccaaaccaggtgtgttgctgcttcttgggtatggcatttgctgttcactttgcctggaatgctcttccctgtatatccacatagtttgtcctcgtgcatttcttcaggtctttactcacatatccccaactcggccgggcgtggtggtacacccctgtaatcccatatacttgggaggctgaggcaggagaataacttgaatctaggaggtggaggttacagtgagctgagatggtgccactacactccagcctgggtgacagtgcaagactgtctcaaaaaaaaaaaaaaaaaaaagatatccccaactcaataaggccttccagatgtaaactctcccaacattcccatctcctttcctgcttgatttttctccacagcaactgttaccttcttctatatactacatatttagctttttttttttttgaaataaggtctcacgctgttgcccaggctggagtgcagtgctgcaatcatagctcactgcaaccttgaacttctgggctcaagtgatcctcccacctcagcctcccaagtacctgggactacaggtgcatgccaccatgcctagctaattaaaaaaaatttttagagatggggtcttcctatgttgtccaggctaaacttgcttatttcattggctttctctctgaagacaatacaagttccatgaatgtacagatttcttttctgctcactgccatgttcccagtttttagaaaagtgtctgcacgtgagaggctctcaataaatatctaataaataaataaacaagtgctttgattcctctgtcccactagccctcccaaaactgttctcccagagccatctttacctcaatgtttcaagcctacaactttagtcatctctgattcctctctctctctcttcactccacaactactccaatctaccttcaaaatatatcccagagggctccatctccaggtgatctccatcgtccttcacctgttcccactgaaacatcttcttaataggcctaattccggagcagccatagtgttctccactgaactgcctgcatgtctgcaaactccaatgaggtgatgctcctgctctgtctaaaatgcttcggcagatccccattgcacctaaagtaaaattccagctccctcccacagtctgcaagccccagctgctctggcctgtgcctccttcccaggctgcccacacctcactgctagctgcacttccttcatcccaggaggactcctgtccacagccctgttcctgctgctcttccttcctcaggtgaagctgaacccacacagctaaggactccctgtcatgggccctcacctgacatgtcacctcctcagagaagccaatgctattgaatgttgccctcccatagcatcatcctgttttattttcctattataatcaaaactgatcttatttattgtttatttactttgtccggtctctttcccaacaaggatgtaagtcccacgtgtggggagacagagactctgtctgacttcttcactgtggtgtcgccagcacccagaacaattcccaaccatggctcccttctagaaacatccatcgaaatagtgggtgcttggatttccctgaaacacataactagaaaatgttttcttctgagtaatctccattgtacttctaaaatgagtgtctgtgtgtatctaactccaaatattcaattcataacagagctatgtgttcaaggcctcagaacagccatgaccatgaccactgacattattctaaagtgctaggattatgtaagacaggaatgactaaaaccagtcattgtaaaagaaaaagaaatgcaccactagatggcactgtctttccaacttaaacatgattttagttaattcagaatcagatgaaactcgagttttctaatcttcacccctttgtttcatggaagagcacatttgccaagttttaggtcatgcactttttctggtaaacaagttaaaatttcatgataatcattgctgtctttatgatcacatttatattagcaagcatttttattctgggacctgtatgccaggcctctgtgctagatcccaggcatacaaggacatgtaaagccctttccagatcttcaagacataagaccccttcatgaacaaaggagagtaaaggtctacaaattaaatatacaaatacatatatttgtgtaatatgcacatacactatgcatacacataaatatatgtgtatataaattatatacaaaatagagaaaaataagtgctacaataaaataatgggagtgtatcatgagaacccacgtgatggagacagacatttgggttggcccttaaatgtaagtagagaccttccagacctgcggggcgtggtggctcattcctgtaatcccagcactttgggaggccgaggcaggcggatcgcctgaggtcaggagttcgagaccagcctgaccaaaatggagaaaccccatctctattaaaaatacgaaattagccagatgtggtggcgcaggcctgtaatcccagctacttgggaggctgaggcaggagaattgcttgaacccgggaggcagaggttgcagtgagccaagatcgcaccactgcattccagcctgggcgacaagagcgaaactctgtccccaaaaaaaaaaaaaaagaccttccagacctacaaaacaggaagggtatcccagccagacagtaataaatgccaggccatggaagtgtgaaatgcatggcacgtgtcaacaacttctgacccccttcattggccctggaggccagggtgagagaacaggagaaatgacgaagtccaacaaacaaagctgtgaagttccatacatttcatccaaggagtctggatctgatcctacgtgatgtaagatcagatttgggttttaaatggataactggtaaatgtgaaggaaggtaggaggcagaagccagggctggatggaaggaaatgacatacatacctggccccaagctggtcttgtgttagttcattcattgccacagtaagatttctcctaagtgagttgaaatagcttgtggcctcgggataactgacataggaggctctaaactcctctgcctcaaacccaagatctctatctgctctcttgttctctgataacactaaaccttcactacagacttttgccaggttgccctacaatgcgttgcaggggacgccctatccaatgatgaggagggggaatcatatataaactgggatataaatggtgcctttaggatctacaccattatacgcagctacgggccacattctgggagcaaacatttcctggcacaactgcgatggacctggagcttgaattacgttctaagtcttgtggatgtgggtaagtgctgagaagaatgttatattttctcaacttttagaaatctgatcattttagaatctgctaaagatcctgaaggcattgtacaaataacttagtggcaggcaggctctgctacaaccacggcaaaatcccacatttcacccagctattgacttgagcagttagaaaaactgggaaagaaaatttttggattttaatttctatgaacttttaatgcacaagggcaatagactttgatattggactacaattcttttcaaaggtaataatttcatacattaatatccttaggactttatcttttaatattttcctgggaatttgatcacaagaggattttgatattcttactgggagcagaatcttagagtatcttcatgaattctttgatcttattgcagaacctctgatgaggtctgctgggcaacatgccagggcataatttagtatgggaagaagaatagagagtgacttttccagtttggggctaaactctgacccatttcagaatcttctggagaaaaaagttatactagtcccagatgtctgggaaaaagccacaaagaagcaatgattagaatcagctctacaagagcaggagttttcctagtattgttttctaaaatctcaatgttcttctctagttcttgcagcaatgtctagaatatagtaggtatgctaattaacactgaactgaatgaaagaatgaatgaatagtaggtacgacctcatgtggataggaacgtgatgccttccatagactgctgatcctctccccaaagatggacagcccctcctcagctccagtgtctgacacagactgaatggttaagcccggtgcattaagtcagaccttctcaatgaggtcaataccaccccatagggagtgttttgcacaagtgtggtggtttttgggtcatcactataatttgggcctataactggcatttagtaattcacaggacagttttgcaaagtgaagatttttgtcccacataacttttgaatgtcctgtcagacatttgtgtaaaaaaaaacttgtttataattatttgatcccagaacctaagtccattttatatataaacacaaaaatatttttgcacagttttgatatgcaccaaatttccagaaatgcaattattgtgtaagctgagggaagactgtactttgtttggtttagaaatgtttgttttgagtttttccaccattctggaaacttatcttgcagatggtgatgctgctattggcatgcgggttgcaaatataacccacccgtatttgtttacatttatactttttattcaccaccattctacatataaaaggaatctattttattatgtgactttgtgtagcagtgttagagtatttacatatacgaagacacactattttatatactttccttttatttctccttttcattgcctttgggatagtacagtgattttctgaaattacattatgggtaggttatagcatagatgacattcacttcaggtgggaaaggaaggattacaaaatattggctatgaaaaggggcagtgacacctgtaatcccagcactttgggaggccaaggtaggtggatcacctaaggtcaggagttcgagacaagcctggccaacatggtgaaaccccgtctctactaaaaatacaaaaattagctgggcatggtggtgcatgtctgtaatcccagcaacttgggaggccgaggcaggagaatcacttgaattcgggaggcagaggttgcagtaagccaatatcacaccattgcactcgagcctgggtgacaagatagaaactctgtctcaaaaaaaaaaaaagaaaagaaaaagaaaaagaaaaggggcacggatggggttgaggaaaaactgggcaatgttaggatgaggacctctctctgctggttccatacttcctggcagaaaaagtcagctaggttcatgctcctctcagtttcgtaaaggataacaaaagggagtgagtttctgttcattttgtaaattccagctcagccatcaccctctagaaagcctttcctagccaaaacaaagccaatcagagcctcttctgctctgcccttctatgttgtttctatttatgatttttgtcatgttatgcaacacgttatacaatgtgaaaaaaatgtccgttatttaaatgtgtttggccgggcgtggtggctcatgcctgtaatcccagcactttgggaggccgaggcgggcggatcccaaggtcaggacatcgagaccatcttggctaacacagtgaaacttcatctctactaaaaatacaaaaaattagctgggtgtggtggcgggcgcctgtagtcccagctactcaggaggctgaggcaggagaatggcgtgaacccgggagacagagcctgcagtgagccgagatagcaccactgcagtccagcctgggcaagacagcaccactgcagtccagcctgggcaaaacagcaagactccaactaaaaaaaaaaatgtattttatttgtactttaaatgtaattatttaaatgtatgttttttgtttacatgtcagtctcctacactttactagcagctcctcaagaagcttgaactcttcaagagatgtctttaactctctacatctccagtgatgctggtacagggcctggcacatacccttgccaactaactcctgcaatggatgcgatgtggatttcaaaagagactgctcagtgacatgcacaattcactacgtgattcagttaccgtaattactctccaagtcaaccctttcacaaacgatcatgatagaattatgaatgaataatggaattggtatgattttacttgtgtatctaccacagagttcagttaaattagcttttctaaaaagtgatttgattataatctctaaaaaaaaatctaaaaggaatcaaccgtcccatttatcacagaaaaatctctttaataaagaaagctccaagctccacattccaagggctattctttgatctgccagtttagtggtagttggaaacgttgccaatggaaggaaattgcttttccaagggggaaaacaagaatagttctgaacagaatttatttgaaaaaaacgatattttattttgaagcaagaaaataactccttgtttttgatattgcagtttctggcctgaatgaattgcggaaattcagacaatgacaggctgttttgatgacattatcaaatcacactccataaaaatggatcttgagagtaaatccagtcaactctcctagcagggccatactcaaatcattctataagaatttaaaattgtaattttatatgcaaatccattatttttagtttttaagaaaaagaaattccatagtgcccatgcctatttggaattactccaacggggaaaaaaagggaggtaaatttgtttacaatttatgtcaggcacagtgctaaacgctctagtacacataatttcaatcctcaaaactgcctttcacagtaggtactattatgtgatttaaagaaaaattgacgaaatgatgaggaatcggggagattaggaaatttgtctgacagcaaaattgggttagagtccccatactctccgtctctaaaccttattacctttctgtaaagccaggagagctctcaaacagttttgaattcagctttaggactgctctagtcattttggtctctcccagccttttttttttttttttttttttttttttggcgaaagtatctcactctgttgcccaggctggtgtgcagtgatgcaatcacgactgactgcagcttataccttctgggttcaggggatccttccacctcagtctcccgagaagctggtaccgtaggtgcacagcaccacacccagataattgttttgtattttttgtagagacgggttctcactatgttgccagggcttgtctcaaacttctgagctcaagcaatctgcctacctctgcctcccagtgtgctgggattacagacgtgagtcaccgcactcggccggccaggtctcattttaggaaaggagaattaaactggaattgacattccttgctatctttagtctttcatgaactcctctgatccagcttctgtgccaatactttatttaaatggttgtcatccagtgcaatgaggctgttcttcatctttccctttcttggcctctactttacaattcaatagtattgaccacccatgctttgtaaaagaatccccctgccccttgacttcagggatactacactattcctggtcttcacatttatcttttcatgacgcgtctgttcttttcctgtgccttttgccttctccagttgcctccctgggtacttttcctggagctgagagcctgactctctgaaatctatgctgactccctctaagaaagcatcctttctcctgatggaaggaaggctctttgctgtgtcctctctattcgtggagctgtcttctcaccggagccccgttccattctctgcccactgcagtctcacttgtctgtcttgctctcaccaaaccacactgttatttttctggcctcccaaccttagcccctttcatagtaaaaacaaaagcatgtaactaagtgctcaaatgggtattccctccacaaattttccttccttttcttttaaaattattttctctaaagtttattgcaatcctagaacttaagtttctcttgcacccctcttgccatcaccgccatggctgcacccctgatccaggtctaagactgaccttctcacctaggagggacctctctctggagccctcccagcctcctctccttccagttcccacagctgctgatttcaggttagtcttccctagctactgctgttgtcacctcactcattggaaaaccttcaaccactccttattttcacccgcacagagtctaaagtcattagtttgactttcaggatcctttgtaatctcggtatttctctatgtaggccatcttatttcttgctactctttagcactattctgcttcaacacagccagcctctttacgctttcgagaacatgcacgtatcaattcctatgcctttttgaaaatgttcaccttgcctgaattctctcctgacctgagtaagttttccctcgctctatcaagtcattcttgatcacacgagtttcatgaactttctttccttctaagcttgcacattgcttcaagcctgcatcgaatgcattcattagcgcttaaatgctgactatcctgaactatgcattcttaatttgcatgtgtcatcccataattttctaatcagacttaagctcctcataaatacaaatcttgccatactttttatttttcccctgagagtgcagtagtaaatactgattgatgctacttaacacttgtaatctgaacctatataacctgataggtataataatttaatattaaagtcattaaaaattgaacagaagtttcttgatttacttttttattttatttatttatttatttttgagacggagtcttgctctgctacccaggctagagtgcagtggcgagatctcagctcactgcaacctccacctcccgggttcaagcgattctcctgcctcagcctctggagcagctgggactacaggcgcccgccgccacacccggctaattttttgtgtctttagtagaaacagggtttcaccatgttggccaggctggtctcaaactcctggcctcaagtgatcctcctgcctcggtgtcccaaattgctggaattacaggcatgagccacagtgcccagcctttatttacttttaatgggatttcagaaccattttaatatctaaacataatgtgataagcaaatctataagcctaagaaatagacaaattaagaggtgattatttgtgtcactgacattgtttattttaggatttgccaaaggtcctttgagtatctctctccagaaaaccgaccttcctatagatcgtcttttgcaagacattgatgaataggagatttaaatgctaatgttggaagccagtcacacaaaatatttgagtcacccatattaaagattaatttgatatgaagatagagcatctataatattaaatgtagcatcactgaagaaaaggtcattttaaaaagcagtagcacctgtactcaaaattagcaggacttcctgtaacgatataaactggaatacactatattagagtctgggatgaatagactctgttaaaaaaataaaacagccttacctttacataatcataaaggcatctttgcctagtacttgctgcctccagagcaaatgtattgaaggtgaggtgaattactttgtttacaggtgcaattatgatccatacacagtttaaattcttgtcatacattccattcgaatcagaatcaggagaggcaaaggtattattcgagcctgtcagataaccaccacatccttgctgaggccctgcattaaaacaaagacatcactatgcagaccaaacagaaccgaccttacattgtacatggagggtttttaaaaagaacatagtttccattttctgtcacactctgagaacatgatcagatcattccctcctgggctccctcctttcctccctccctcttttcttttctttcttccttccccccacccgccccatctctccctccttccctccctctatctttccctccctcactctatctttccctccctccctctatctttccttccctccatctttccctccctccctctatctttccctccctcactctgtctttccctccctcactctctttccctctctccctccatctttccctccctccctctatatttccctccctcactctgtctttccctccctcactctctttccctctctccctctatctttccctccctccatctttccctccctgactctatctttccctccctccctctatctttccctccctccatctttccctccctcaatctttccctccctccctctatctttccctccctccctctatctttgcctccctcactctatctttccctccctccctctatctttccctccctccatctttccctccctccatcatctttccctccctccctctatctttccctccctccctccatctttccctccctccatctttccctccctcactctatctttccctccctccctctatctttccctccctccctccctctatctttcccttcctcactctatctttccctccctccatctttccatccctccctctatctttccctccctccctccatctttcccttcctcactctatctttccctccctccatctttccatccctccctccatctttccctccctccctctatctttccctccctccctctatctttgcctccctcactctatctttccctccctccatctttccctccctcactctatctttccatccctccctctatctttccctccctccctccctctatctttccctccctcactctatctttgcctccctcagtctatctttcccttcctcactctatctttgcctccctcgctctttgcttccatagcagagccttcaggtgtctccttcttattcacggagttgctgaaagaagtgggaaaacacatagggttctacagacgtttttgggattgctgatgtgatttattgaagattttcctggccttgaaaaatccagttttatacaaaatcaagtactttgcataataaagctggtggaaaatgtgcatatgttttacttttatgttccgctttcatgaacactgtcagactgaaaactgaatttatgaagaatttacccaacaaaccaagaaaattgctgccaacaaatcttttatttacacagtgtgatagaaagaggctgagaggcatttaacactgcagtccagtttatattcagccacactctatatttaactttttcttttccaaaacatgagaagctaaaggaaaaaatctttatagaagaaaaaggccttctttcagataaaaattttataattcagaataaaaatacaaaggagagataaagaataatctcaagatgattaaacggtctaccataaaagaatacaaaaaaacaatcctcagaacataagatttagttttgtctactccatggcctaagcagacagctcagaaatgatttaagaagagcataaagggatgaacaatttattgacaattttgaaagaaatggtgaaataagctcaaaatagccctagtaggaacagggattaaactggtgctgaaattaatgtctataaagcttgtattctacacaaatataggtcatggctagttccaaagttaaacttcgctgggattggccttcagtctatttttctcattccattttctgctcacggtgaaaagactgctttcaacattagggggtgctaagattttgtacttggaccttggcagtaaacatgaacaatggtggctctcctgaaccctgtctgtaaatccaatggatagatagcaaacgtgcagggtgatttttgttacaggcacattacttagtaggtcaggcttggcctgtccatagcttctaagtcaggcgaaactatagagtatttgcatagtcagacatttcccaaagttgaaatgcttccaaaggcccagtccctgatatattcacagaggtcatataggacaaaattattctgaaacgtaagcaatacgcagtgcttcaccacatgttgctaatgattctgctaatctgaaatgggcctgcaaactcaagagagggttggagtttgtggagtttgagcagctttgattccagtgtgaactgactgttacttaaggaaaccacttaagcttattggcatgcgtagcacagaagaacgatgactgagggtatgaatggattgataaatttatttattacatattgtttcaatattcaagaaagtatatttagtatttaagtagaaaaagataagtgatagtccattagtagtaagacatagataaataatgatgacgcaatttagaaaatgataggttcagtaaaagaggcagaaacgtcttacagttttgcaaaaagatgaagattactttgggctatgaggatctcaactgttccaaggaggaggtgatttggatctgggtcttgaagcataaatagaataaaaccatgtagaaatggaattggcattggcaattccagcctgaaagaatctcttgatccaaggctaaatgggcaagaatttacattatatgcatgggcaagcataactctgagaaaagaatagggcacatgaaggagaataatgagaattaggattgggaaaacaggatggggtcttctacagagggccttcaatgctggattatacagagtttggctgtcagactgtgttctttggctaatgggattcagttgaaagatttttaatcaaataagtggtagaatcaggatgcacttgctaatcaagtctgatctaaaaattgatccagaaccagcattttacatgcaagggaacgagactgaaggagatgagaccaggtgaaaggacattgctgtggtgagggctgcaggtaggagcactgaagagttggaggtaggtagacaggaaaatgctgttgctgggcattattctattaatcatcagcttcaaaaactaaatgttatttttaaacattcaagctatatttatcactacttgtttattaactgttactaataagttcataagggcaagatggcaattgtacttgggcccagtgaatgccattacacacacttattatgtagtactactgctatgactaatgccataaagcagcacacccacattccagggaaccccagaacaagcatccttaaatcactgatgtgtttgccatggattgagtggtaaattggctgatccatcctccctcctttccttccttccttccttccttcctccctccctccctcccttcctctcttcctccctcactccttcttttttcttcctttcctttccttttttctctctctctctttctctctctctctttctctctatctctcttcccctcccctcccctcctctctcctcccctcccctcccctccctccctccttcccttccttccttccttccttcctttcttctagatgaggacttgctatgatgcccaggctggtctcgtattcttggggtcaagcaaatccttccacctcagcctcttgaatagctgggattacaggtgcatgccaccatgcccagcttaactggctgatttttaattcttcagtatctctctttgcactgcactaaaatggagagtatatttttctgtgcacttgatgttaggcttagccctacgacttgctttagaatgagtgttagtggtcatgaagcagccagaggccttaaacgtgcttacgttttgttcttgtttttattgttgtctaggactttgtgctcctgtgatccactaagatatcatgtgctgagtaactgctggttcaaagaaaaagtggattcatgtggagcagacttgaacccagactcaactttacagccaactacagccaacccgcagcttggaacggaggcaggcaagctagtccgtggacccataagtgataaaaacaaatgctttcattataagacactgaattttggatggtttgttaagtagcactgtcatggtaatagcagactaatacacacaactaatattaatagcttgtttgagctatcaaactataatagagctcattgttcaattcacaaaatatacacacagaataaagaacatggagaaaaatatcatgagataatcctggccaaaataatcaaatatttgaagtgaatatcatattacatgagtgaacagttatttgtgtagtgcagggaatagcaattgctctaattccccctctttagtgcttaaatatagcaaaactgctccatgcaaaatgaaatgtaagtgtatatgtctttgagaaaacgtaatgatcaatattaacaaaagaagggttctttcccaaaaggagctattgccacattgctctttctgtgtttcaatggtgggggaatataaacaagggcgacctctgtgactatgcaatagagtcccacgcatcagaaagtcatatatatttaccatactgatattttgaaattgcattttttaatgtataagccatcttaaccttgatatgtttagcatcaccaatccatcatttcctcattactacacattttggggccacctagacagctctcatccatcagcacctgcctcatcaatcaggtgtgtcagtcactctctgatgacacaccctgcgtccaagaacaaacgtcactctttcttccctgaattggaaatatctctctcacacaaaagagccatttcttcagagaaaatacatgttttggctaaagaaatattggaaatataaccccataataaggagtgagatccaggtctaaatctacttaattaaaaatcggtaaccgaatcctgaattattaccttccaatgactaaacctcagagtgaagcttaagccaagatcaatctgataagggaaaaaatagttacattctcttggataaaacatctcgaaggcttcagtggagttagatacatttttaaatcattatttggagaattgacatttttgtggctcacattctatacggctgacattttcctgaggttgtctggatagtatctctgcctgtctctggttgaccactactgagaaggtgcacagtgtgctgtacgagcagatacagactggcttgacttcaggccctctcctgtttccagcaagccatctgtggctttaggctgcagctgaaggaagctttactggaaactacaggaagcagaatacaaagacatttaaagctggtgccttagggaaattcgagcacacctagacagcttcctttctaccacccagggatgcagggctagaaatgcattatccttttttggaatcagccttactgtaatttataaagctgcagatacacaattgctccaaagcagtgtattcatgtaaaaacattctactaggtttcagacgaacctgttttgtctttttctctaaaagtaaacagtgtttattattttactccctaatctccaatgtgtacaatacttcaggtataatatttatgttttacaagaaaaaagttagtagtttttgtaatgaggttttttattgttttgtttgtttttagttgcttcacttaatttgactcactttagttatcctaatttgaaacccagcttaatctaaattaaaatgtgtatttagtctggtaatatttaggaatcataaaactaaaagaatggtaatttactaaaagaaaggtaatttcagcaagctaatcagtagctgtagttaatagaaaaagagcaatacttgtataaagaacttaggagaaggaaaattttatcgttatcttttaatttatcttgcattatttagatatcactgaaaatgctctatgcatacatcattagccccagggcattttatgagaatcattctttccaacttggaaattaaaaaaataatttactaagcaaaatgacatgatcatgtcagttgatgctgaaaaaggatttgacaaaatccaacacacattcatgataaaaactcttggcaaactaggaatagaggagaaatttcttgacttgataaaaaccatctgcaaaaacctacagctaacagcataattaatggtgaaatactaaacgctttctccctaagatcaggaacaaggcaacgatattgatttcacacccctctaactcagcgtagtattagaattcttgccagaataaagcaagaaaaaatatatagagagactggaaaggaagaaataaaatttccacttttgcaagtaactattagctgcagaaaatcccaagtaatatggaaaaacattcttagaactaacatatgagttcagcaagaactcaggataaaggaacaatacacaaaaatcaatcaaattttaatatactaaccattaacatgtggagaccaaaattaaaaaacaataccatttataatcattacaaaaaaatgaaatatttaggtatatacttaatgaagcagatacaggcttatgtgatgaaaattacaaaataatgaaataaataaaagaaggcctaaataagtctagatacatatatgttcatggattggaaaactcaacatagtaaagacatcagttttccccaaattgatggatagatttaatgcaattcctataaaaatctcagcaaggtttttctgcaaacatcaaaaagcttaacttatttttatttttatttatttacgtttttttaggatagaggcttgctctgtcacccagactggagtgcagtggtgtgatcacagctcactgcaactttgaactcctgggctcaagggatcctcctacctcagcctcccagttagctaggaccacaggcaaatgccaccatgcctggctaattttgttatttttggtgaagacagggtcttgctattattggccaggctggtcttgaactcctggcctcaagggatcctcccaccttggtctcccaaagctccgggattacaggcatgagacactgcccccagcctttattttaaaatttatatggaaaggcacaggccttcaaatagctaaaacaacttcacaaagaaaaatgaagtgggatgaatcactccacctgatattaaggcttaccatgtagctatagtaatcaagacagtgtgatattggtgaggagttagacacataatcaatggaatagaatacagaacccagaaatagacctatacaaatatgtccaactgatttttttcaaatgtgccaatgcaattcaatgaaggaaggacagccttttcaaccaatggtgctagagcaattggacatccagaggcaaaaaactgacttccacctaaatctcatatctaaaccaaaatgagctcaaaatggatcatagacacaaatgaaaaatgtaaaatcataaaacttttaaaagaaaacaccagaataatctctgggaccttggggtaggcaaagaattcttagacttggtatcaaaaacatgatctataaaagaaaaagtcgataaattgaacttcaacattaaaaacttttgttcagtgaaaggccaatataaggcaagaaaattaaaaggcaagatatagactgggaaataacatttgcaaaccacatactgacaaaggatcattgattgagaatagataaaaagctctcaaaacccaacaatagaaaaataaacaattcaattagaaaatgggtaaaagatataaatagatatttcaccagagaatagatatatagatgacgaaaagcacgtgaaaattgttcaccattaaattaaaatcacatgagatattaatacacacctaccagaatggctaaaataaaattaaataacaacaacagcaacaataacagtactctacaatgagatgaccaggggagggatgggggtccccagttatagaaagcaatggcttcctaatcaaaataatacaagccagagcatgatggaatagcatcgtaaagtcctgaatgaaaataaatgccaaattagaactctatactcagagcaagaatcccacagaatttaagaaaatcaagtcattttcgaaaaacaaaaacaaagaacactttttaccagaagatctccaatgaaagaaacataaaagagaggtcttccaaaagaaatacattaatcccatatggaagcatagaatttcaggaagaaaagaaaaataacagcaagggtaattttacattattagtaattgtataaaacaataaaaatgttttgtgtacctattatgtacgtagaattaaaatacttggcatagatagcacaaaagacaggaagtgggtaagtgggtttaaaatgttccaaggtccttggattgattattgattataacatgataaaagtatcaactttaaattagattctaacatattaaggttgaatactgtaatctctaaggtaactactgaaacaagagtcacaggatgtataaataataattttaaaaggggagtaataaaaaagtgattaattttaaaaagaaaagatagttaaaggaaaacaaaaagaagtgggacaaacaaaacacaaatagtacaaaggtctatctaaaactaatattgttagtaattttatcagatataaacacattaaattcttcaatagaaaggcatagccaaacaaaagccaaatatattcttcaggatagagacaagttgaaaataaaagggtttaaaaacatatcacgcaaatatgaatcaaaagaaagctatggaagttatactaaatcagaacaagtagaaattaaggcaaaaagcatttaaaaacgttgttacataatggtatcagtcaatccactagaaagatataataattataaatgtacatgtgccacattatatggcttcaaaataaaaaagagcaaaactccagccaagatgtttctactgagcttctaactctcttatctgactacctactgatcactagctggatatcctaaaggcatcaaattctccagacaaaacccaacatttttattattttattctgcaaagcactgtcctctcctagtaattttctatttgaatagtggtgtcacaagacattgtccagaaaccttaggagcattattatttcttcttcccaagctgcttctctcaaatggaacactgtgttattgattctatatcttgaggatttctcctttcagtctctttctttattttcatggtaccactgctcttatcatcccatgcctaaactattgcaatacttttctaactttttccctggaatgctgcttcaaaacatcatccccacaggtgctgggatgtgctttctaaaataaatctgaccagatgatagcacgctccagctcaaaacaatgactggctcctctttgcacatgatacagagccctccatgcctggcctttgcatatctctcctctctcagcacctattgttctctgccttatgccccaaagcattaccaatgttcaggttagctggcatccattgaaatgggatgcacctgtaactttgtgcatgtgttttatttctccatagattgtccattttcccaatgaatgccttttttttttttttgagatagagtttcactctgtcacccaggctggagtgcagtgctgtgatctccactcactgcaacctctgcctcccaggttcaagggattctcctgcttcagctgcccgagtagctgggactacaggtgtgtgccaccaagcctagctaatttttgtattctttggtagagatggggtttcaccatgttggccaggctggtctcaaactcctgacctcaggtgatcagcccgcctcagcctcccaagcgctgggattacaggcgtgagccagcatgcctggccaatgaatgccttcttatccttccaaaataatactatttatagctaaaaattctcgcatgtgaaatgagtgacaagtattttctaatttaatcactgaaccctataaggtcattattattagtgtactgtttttacagataaaaaaaaaaatcaagactcagagtggataagtaaattgtccaagatcgacctcaatgagatgtacaaactgagtttgaatctgggatgtgatgctccacgtttaccctcttacccactgcaccataattcaggactcacattctctgaggtgcatcctctaacagtcctgtgtcctttcttccacggaacatccaagtaccatagatcccttctttcttgcttccagtgcccttttgcatacatttctgttaaaaagaatccctgggggctgggcgcagtggctcacacctgtaatcccagcactttgggagcctgaggagggtggatcatgaggtcaggagttcgagaccagcctgaccaacatggtgaaagcccgtctccactaaaaatacaaaacttagccaggcgtggttgcatgcgcgggtaatcccagctactcaaggggctgaggcaggagaattgcttgaacctgggagaaggaggttgcagtgagcggagatcacgccattgcactccagcctggcaacagagtgagactccgtctctctctctctctctcacacacacacacacacacacacacacacacacatcacatccctgggtatttttatcaattgccacagaggcaatgaaggcttactaagaaaatcaggagtttgggggacagtcaaactcatgttcaaagcctggctttacctcttacaaaccctttggaccacagacaaattacttaatctcttaaatttttctttcttcctttgtaaaatggggtaattcctgtctcatctggtagctctgaggattagataaagtaatatacatcaagcagctcatgctacatctggtagggcacaggttcagggacaagcagtgattttcacgatgccctgggatttcctgacaagtctttacttgtgagtgagcaaaatgtacagctaccatgtaatgttaacagacttttcacatattagaatgaagagaagaacacggtcccactattatatttcctaacagtttatttataacaaaagaatgttttaaaatttttattgctcactgcatatattttgtttttatgttcctgggaatgctataacaaagccaggctgatctgagtaaggatgttgattattatagggaatttatgggtacaaataatttaacccaaaataaccagttacctgcgacaaaactaggtcgcgtcttgtgttttagattacacataataagtgcttcttcccagcacctgttcccttcagtgtttttcaaaatgttatcctataatttaccattaactcaattttatcacttagtttggtctccacaataccatgtggttttattttcacaaggacagccccatccttcaagaccaggagtggcaatctagtcattggtgggggcacagactccagtgttgaaatatgtttattaagaacctttcctttcttcttgctgatttggtatttaactcctgtctacttgcttttgtaaagttttggtgaactaagcatttgttggtttctttatcccgttcccacattctcagctcagcaaaaaacctttccccataaaacccacaaagaataacgtgaagataaccttgtctttaggatcatcccccaagggaagtctaatcaccagtaaaaggtacagggcttaaaaagagcggaaataagcttagttgggtttttctttaaatgggtttacagtttcagctcatctcattctcagacttcatcacagggagcaaatgacattaggaaaccagaaaaatgacattccatggttgctttggagcaataccctcattattgctaaactgagagttgtttgatcagtgatttatccaattattcaagttataattcaacttccttattacatttgtacttctaacagtaacgtgagctgacaacttcaatcaggccaccaagaggtacctagagacatatacatatattttttatgccattgaatttttaagtttattcttgtattgtttagctattttagaatgcctcacaaagtttaaatttaacaccaaaactgggaaacttaaaaataactagaagcagaagtctgaattggacatgttagatttttttttccatttgttgtgaccatgttttccatctttgtggccctagactctcttcagctttctctgtctccttctttctttctttcctgtttccttcttttttatccccttcaacttccttctgccactcccactgtcttcatttaacgtgtttgagagacattttccagatgttaaggtaacaggcaaaaactcacaggagagaaacacagatgacctaaatattgagtgtgatccggtattcctaattctctgaagatgaaagtgattcaatttacctccctgtgtagagcttacccaacaattatataaaccaggattgaattttgagaatgagctgaatctagataaaatctaatgtgttctatatggtatattattatatctcattataaaatatgattttgaagtaggcacaatttatccatttattctgtaaatcactcatatggacaatatcgatggagtaacaattgtgcaaggcctggggatttaatcagaatgtagcttttgatttcagatttaggttataaaatgtactttaggatttgacggttaggtgtcactgcaaagtgggtaggaaagaacgaaaaatcactgtagcatgatgtggtcctgttgagaatgttgatccctgcccaccccaccctcagccaccctccaaccttggaaatagggttgggcggggggcttgaaaatttgggacttcaatattactttctaatacatagagtctttcactctgacagctaaggtgctttccagaaattatctgctttatccccatcacattcttaaatagttgtaatatttcaaattgatcagttttttagtagataaaaattgagattcaaaacgttatagggcttttctaaagccgtatcaccaagcaatgatatcatgcatcaatcagctctttccatctggccatatgtctttttttctttcttttttttttttttttttagatggatttttttgctcttgttcctcaggctgggcacaatcttggctcaccacaaccttcacctcccaggttcaagcgattctcctgcctcagcctcccgagtagctgggattacaggcatgtgccaccatgcctgactaattttgtatttttagtagagacagggtttctccatgttggtcaagctggcctcgaactcccgacctcaggtgattcacacacctcggcctcccaaagtgctgagattacaggcgtgagccaccatgcccagctttttttttttttttttttttttttttttgggacggagttttgctcttgttgcccaggctggagtgcaatggtgctatcttgggtcactgggtcactgcaacctctgcctcctgggttcaagtgattctcctgcctcagcctcccaagtagctgggtttgtaagcatgcaccaccatgcctggctaattttttgtatttttagtagagacggggtttcaccatgtaggccaggctggtcttggactcctgacctcaagtgatctgcctgcctcagcctcctaaagtgccagtattacaggcgtgagccaccgtgcccagcctacctgaacatatttatacatttgttggactgtaattcattctgtccttgttatatatgtgcttgggtatttttgccttggtctcttagcaaaggtctctgaactgaccttaatgcaacctgactcagtctccatgtgacaaataccccaggtggaggaaggcagacagtggccctcgtcatcagcatgtgtgctctgggcaacaggggctggctgggagctttgagtccaggtgagaggtgaagccagttggacttcctgggtcaagtggggacttggagaacttttctgtcttacaagaggattgtaaaatgcaccaatcagcgctctgtagctagcaagaggattgtaaaatgcaccaatcaacgctctgtaaaatgcaccaatcagcaggatcctaaaagtacccaatcacagggaggattgaaaaaagggcactctgataggacaaaaatggaacatgggagggggcaataagggaataaaagctggccaccccagccagcagccgcaacctgctcgggtacccttccacgctgcggaagttttgtttttttgctctttacaataaaccctgctaccgctcactctttgggtccatgccaattttaagagctgtaacactcaccacgaaggtccatggcttcattcttgaagtcagtgagaccacaaacccaccagaaggaaccaactccagaaacacaggcactgccaccacttgtccctgagggtgcgtcttccccatctgtcttcctgtgctgtctgtccccctgctgtcttgcaggggacacccctcagtctctccttggcaactcactaattgaaatgcctgcagacctcccatctaatagagccaagttccattttctacactgaagttttgctgaagtgttatagaatacatcattttagaaaaaaaaaatgaaacaatgatgctactgcacagtaaataaataagtttactgaaagcccctgatctaaccctatgtgtagaagtttgatgtgtagtgtgacatgcatattgtgaataggccaagcaactctctggtatgagaccccctcaggaagaactggaggctctgatggttaaaaatacgtttgcaagtgtgaagtgatttgtacaggacacacataaacagagtcaaggcaggagacgaccctgctggtaaaggaaggggcagcaactaaactagcagaagttaacaggacagaaggtacttaaaagcatccgttctgcctataggccatgcccacttagccaaatccacagaaccaacagctttttaaactttataggagcatagaagccattgacaatctgatgcaaactatgaactcggttaggaaaaatgctccgatttgcagattatttcagagtttcacagattgctgcagcccagtgtgatcattttgctggttgtcagccattcaggatcaattattcatatagcattggagcacaggggggagacaagcaggcacatttccattgcagttagagatcagctcatgcttgccaaatgtgctttctccttaccttgcatccatgcatatgggcctccagcagcagaagttccgaggaaaaaggagacccaatttcactacatatttagtaattagcaactagggatagttcccccaaatttgctgtgactcgctagcaatacaaatataacaaatgcacaaggcgaattgaacctaatagtcacataattatataagccaatctcttcatcctgaaaaattgaagcagatgtacataaaacattgccaagtgtataatctaaatagcaaatctgcaaaaccctacttagtgttttagttaagatcgaaacggaaatgtcatagactaaaatggtctcctcttcacatcaattatttactaagtgaagatattgttttccaggctgagcaaacagctttgtaaatgaaaatccactatctggtccacaaagttgatttccctctcttcaggggaaagacagagttgttttacataaatgagttggaggcaaaaggggcatcctattagccaagtttgtcttcatccaaagctataactaaacgaccctataaaccttacagtcaaagctattcttattgttccttccccctctcctcactacaaacaataaaaaccaaaatgaaacaaaatttgaaagttatgcagaatgatcaataaacttgtcagtgtgtggtcttgaaagctttgtaagaccactgcaatgcaaaatcataatacttaggttttcacttaaacattaccatcaaagagtagttacaatgacttgaagtatttccaagtggctgatggcatttatgcagatgaaaaagaggtaaaaatcatcttcatgaaatacaggggtaacacaatgctggcaaggagttccgtttctacattctccacttaaaccttttccctaactgtggccagaggaaaacagtaagtgactgtaattgttcaatgactcgtgcatagagaatgcttctgacagtgtaagacttttccttctgttaaatcacaataggtctaaaaatgtcttctttgtggcttggaaagacatggtaatttaatgaggctagggaaccctggctcacttgagaagcttcatgcagatgatagcagtgaggagattgttaacacaacaattaccattttcttgtgagactatattaggaaaaagaaaaacaacttgaaaggtagcaaagcaaatgcagacataggacatttggtctaaagtctgtgctaaaggcaagaatatatcccttttttgtgcaaaaaaaaatctccaaaggaaaattaatttttctttcaaaatagccttctggcttttgtatgctacttcacctacacaattctgttaaggcaacactctctcactgcccgtgagacttgctttcaagttactgttgagacagctaagtaggggaggtggcaaagggattttctgatacaatttgtcttgaggtgtgtggtttaccgggaagccttcaaaacacaatgtctaattgctttcctcaagtactgcatggaaaaattcacatgcccaatatcaagaagttgaaggtaaactccgttttgcatcagagaaacgaagtttatccacactatggaagaaacagaaagtttgaaaagtgaatcagggttattattacagaaaactgcctggatttttctgagtcttcacagagtatgagatttgtttggagagttgtgcatttttagaacattaatcacatctatattcaaaaggaaaaggatcaaaacactttccagagtcgaatattaatgatcttagactgtgtcactgatgctgttagaatagccaaacaggtaattgattaactaccttttattttaaattattcaaaattctgagttaatttgatatgggtatttctcaccagtggtgtttgatgtggataatttatttctcacatgcagtgggagtaatctggggcatattttcagtttatcctctcacctaactttacctacccccgctacatcaccctctccagtccaaattccttctcaagcatcagcttccaactagacagctccatttaaacaggtcttccaacttaaaatactccaaattaaataaaacatttctcccttaaatcttagtctcctaagccaccatcatccaacaaattacctatagaaagtcatcctcaattcatgtcctcattaaaatatcatcagagtccaaacactgtgcttccaatgtattctgccttccgtctctcagatttctgcccttccctttatctctttcccctctgggtccgttcaaggctttgacacttcccatctagatttctatcataagcttcttccttcccatgttgtaggttcttctagccttcctccactgtgctaccaaagtgatttttttttttttttttttgagacagagtctcattctgtcacccaggctagagtgcaatggtatgattttggcccactgcaacctccatctcctgggttcaagcaattctcccacctcagcctcctgcgtagctgggattacaggcacacaccaccatgcccagctaatttttgtatttttgtagagatggggtttcaccatgttggccaggctggtcttgaactcctgacctcaggtgatccacccgcctcaacctcccaaagtgctgggtacatttgttgagtgatttttttacaacattaaaatatgtcatacgtaagttttaaaaccaagcccttacatggcatattcttctaagcttcaaggaaaagcaatcataatcaggtgggggtggggggggggcggggaaattaaataaagcagaaaggtaacagtcctgacaaatagatttacaagtccagaattcttacccaatgtctgccggaaagacatcttccagccttttgctgtctgaaatgaatctgtcttgaacaccaggagcatactattattgctgctcttcacatttggtgggcgcttggaaccgcagaatttgccaagaaggggatcgctggtattggcaccatcgtaaattgccaggtagtcatgggagcaggaggtggagggaaccacatcaaaatcactgaacctgtgaaatgtaccttgttaatactgatgtttccatttggacttctattaaattgtagctttagctcttgcaaaaaaaatgacaaggaaaaaactaccagtagagcattcaaaactcacttgatatgaaatattagaaatcaaacagtactttactgatcagttcaaaagtttagccaaatttgtttttagtaattacaatacaacaaaaactgtgacagcagctggggatgtcaaagtgagtaagatacagtcttacttttcaaggaattcacagtctagggcatattaaagtccatctgagaacaacttttgacaagttgaactgatatttactatcccagcaatactttagttttttaggtctcattaaaaataccatatttactcttcccttgttattttatgagatgaagtagaacttatgggaagcatgttaatataatagaagaaatgctgcttttagaatcacagctccattctcctcacagtctcattttcctcttttaaaatgaagtttatgttaaggtcaggtgaagaacaggaaatttacatttaagacctctgtggtggtcactgacacttctgcacatggtcccagctctctgcctccccagcactggtaggattgccctaggggcacactttgaggcttgacatggctgctaggagttgctttgaccacagaaatgtaagcagaagggatacatattactttacggaagaagctttacaaatgactacttgctttgccacactgccttcccactgcagtgatgatcatggaagcaaatgtaaaaacgaagcttccatcagcctgggttgttggatgaccacgatgagcagagcttccatgccaggccacactgaacatgctcattacaatgagaaatcaacttgttgagttaagctgctgtgaggtggagttgtttgttactatgtgcataacctatcctgacagatgcatccctaacttttctctgtcttatacagtgtttaattcaggtcttattctttgtcatttcaaataacgatttctagagttcctgaacaagcaaggcttcttacatggatttactttagagttttgtggtgggtttattatagcttatttttaaaacttgtttaaaaaaataatatttgatatcctgtcctcatttttataggttcttctgctttttctttttttttttgagacagagtctcactctgttgcacaggctggagtgcagtggcacaatctcagctcactgcaacctctgcctccctggttcaagtgattctcttgcctcaccctcccgagtagctgggattacaggtgtccaccaccatgcctggctattttttttaattacatgtatattttttagtagagatgaggtttctgccatgttggccaggctggtcttgaacttctgacctcaggtgacctgcctgcctcagcctccctgtgctgggattacaggcatgggacaccatgcccagcctgcattttcaatttattttggcagtagctctaataaacaatccataatatggaataattttgaaaatatagactaaataatatatatttatatataaaatatataataaatgcttcctttcaacagccttgagaaaaaaaattgttggttttttttctaaaaggttttggttggttgaaggttttcagactgatgaggaacaagatgaaaaccgtattgattttcttttaccacatttaacatttaatgttattgtaaaagatcagggaagaacaatagctagataatttccaacaacactgtattcattttaattctctacagacaacacatttatttttcacaaaaagaatccacaaagagagataaaatctgagtttctaagaggacttaaatctgctttggctttttattttacatcattttcccaggagagcacagaagagatctgaaaagcccattgacagaaaagcttgtgtaaccacaatcttttgagagccttttattaatgtctgcatcttctaccacacctagaatcttatctgtttcctagaatgtaggctcttagtgcgcaataaataattttctaaacctgcagatgtaggctgggtgtggtggctcacacctgcaatcccagcactttgggaggccgaggcaggtggaccacttgaggtcagggattcaagaccagcctggccaacatggcaaaactccatctctactaaatatatatatatatacaaaagaaaaaattacccaggctggtggcacacacctgtagtcccagctactcaggaggctaaggtgggagaatcgcttgaacccagcaggtggaggttgcagtgagctgagatcacgccactgcactccagcctgggcgacagagtgagagctagtctcaaataaataaataagtaaaataaaataaacatgcagatgtaaatttcattatggtgagctccaggatccaggctgaaaactgaaaaaatacatttagattgtatacatacatatatatatagatagatagacagataaagagagagagaatatataacatacctctatgagttggtatgtataccatggttggaatgtttgtgttcccctaaattcatatgttccctaagctaatggtataggaagtggggcctatgggaggtgattaggtcatgggggaggacccctcacaaatgggattagtgttttataagaggcccttccagctcatgaagacacagcaagaaggtaccttctataagccagaaaacaggagctcaccagacaacgaatctgcctcgaccttggacttttgcagccttttgttgtttataagccacccagtttatgatattttgttaaagcaacctgaacagaacaaggcaataatcaatcctacacatatgagaaacaaatagtgagtcacagtagcaaatggctcccccttacactttcacgcctgtgcaggcatacttcacagaactcctgctcctggccatctgacagtttctgttcttttgtccccaagacctaaaagacactctgttttcctacaaatagtccaggtaagagctgcagttttcttcgaggtccagcctatagaacgcctgatacaggaaccaaatcaggcttgatgagagatgtctttcatcaagacatctcttgttcacttggagagccaactgatacatgaggcctctggaagtaaactgcagggagtacagaatctttagggtagaaaatgatcacagacaaatagaggggaggtaggtaggtaggtaggtaggtaggtgtggtcttagcccatcaggcttctgtatggaaagtcctacatgaccatgaacaatattactgtcagagtttcccaccacatgccatacgtatatcactgaaataggctgtcaggtgaaaacagtcttgaactttatcattctggagagtgggaggttgcattgccctcatcagtcttgttgggaataggtaagactgggaagaaaattgaccagtgactcaagctatctctcatagcatcagtttagaggtgttctgacacaggtataaaaatagatttcttaagtagttagaaaatgtatcctttgaggctgggtgcggtggctcatgcctgtaatcccagcaccatgggaggccgaggcgggaggatcacttgaggtcaggagttcgagaccagcatgaccaacatggtgaaaccccgtcgctaccagaaatacaaaactgagcagggcatggtggcgcctgcctgtaatcccagctactcaggaggctgaggtaggagaatctcttgaacctgggaggcagaggttgcagtgagccgagattgtgccactacactccagcctgggtgacaaagtgagaccttctctcaaaaaaaaaaaaaaaagaaaagaaaaaagaaaatgtatactttgagagacagtattgggaaacattgaggatgtggtgtttggaggaagcctggcatgaatacacattttgactctttatgtgtgtgttacttttggaaagcaatttgatccttctgagcctcagtttcctcatcagtgaaatgggaataatctatacaattcccaatctagaatctatatatacctcatatgactgttttaagaatacaatgagacaattacggcacgtgtgaatcaaagttctttgtgtataataaatacccaacacatggcaactgctttctcttgcccttcctctctcctttgatttcaagatgggcttattataccttgacaatccatgttatgatgctccttcacaattgttgggaaactataacgactgttttaactggtgagtgcttgttttttgcccttagttactaccggcttgtgtggagagggggagcgtcatttcccaggttgaactgtcatctaggaacatcactcctctgtgtagatttccctccagactgccgatgagaatcagtgccctccatcaataaacgaatggctcttctataaataatgctgaaaggattttcttaagaaagccaatttgtcttacgtacttgagctcgatcaccttgtcgtcactaacggtgatggtatacagacagtgcatatcatttgggtagtctgcgtatgaataggcaggacttgtgatgattccagaagagaaattgaacacaccaccacaggctgcaacagaagacaagggaatatgaagagaacaacgattagtcccagcatggaaaaatgattttaagagattctatactattgtacatttttccctaaaagaggtaataattatttttcttaaagtgacttatatctcccttcattgtgtttacacataattctgatttttccactaggaaggaagatgaaagacagcaagagggtagaaacagggaagaatatttaaaggctcatcttggaaaggaatcagtctgagtcaaattaatggccagagtgaaaatgacgagcaggaacatttcaccatcacttagctgtatttcattgacaggttgagagagggatgacaacagtaacgaagtacggaaaaggcggccagaatgatgttctgggcgtacagatctaggaaggttgtgatctggaaatctgaaataatagagatccctgtctctcctgtcagggatagaatattatatggtaaactactggaaatcatttttggagctttccagtttagttccttctgtgggctcaaatgtatagctctccagtctggtggatttgcagtcagttgtgagactggtaaggactaaacttgccccagtttgtattaatatcactgatcctcaatcctcaacaagcaggaggaggccaggcccgttcctctccaggattccagcaattaacagctcagagccttgagctagatccattagtcaataaaacgacagacataaaaatgtaataaagccttcttatccacaatataaagtgattatttttgcttgggtttacatatgaggatcagattgtacctcctgatgatcactctccctgcagtggaaagacctatctatgtatatttatgattctaaaattataatggggttaacgcattttgaagtatttccatggtttatacactatcagtggacacgttccactttacatcctcagaaatgaggaacaaattgaggctgccatgtcaggctctttatttctttactgtttttgcctcaactgagcccaccttgcagggagcactcttctctatgtgcctgtaagtacttgtgtgttcagacccccaggtccatctgtaaaagtgaattacatgtcagataagggtagcaatcactccttttcactttatacacaattatgtggtctctggaagtttatcaaggcctaaataactcccatctttgcacaatatcagcatttgaagtcttcacatcaacgacactctttaagtgggactcttatactagaatatattgaatcttgactacttccttgtaggaaaatgagagattaaagagaagaagaatataaagcaggagtttacctctccaaagcagcagttgtgccaaaagaataaaacaaatccatccttctctttattcaacaagacgacgggagaggaaacgttaattgcgtggttctattctgctagagccaacagagctacacagccatatgtagtcatactttacaaactgtgggagtcaggatgccgatagcagctaatgtgaacaaattatggagggccttttcagaagtaaatacatgtttttagtcttctctggagatgggaacaataatttattccaagggaaactatttaactttctacctttagcaatgggtttggtggagcaaagatgaaatagactcaagaaagatgttacaagatttgtgtgccagtttgactgcagctgagatgtctattagatagtgcataaatattgtcagcaaactaaccaggcaggaggggaaaagactattcaagatcaggaaatgcaatcttagaattttctgggtagcaacaaatgcctctgtccagtctattgctcctcttttctctttgcctttgatgcagagaagttgtaaattatagcatagttgaatatatcaatcttttccattagggcttttgttttgggcatagtgttttaaaaaagtctttcctatcagactgtaaagacattctcttatatttcttctaaatatataaaatattaatttttgtattagcaaaatgacttggggaaacaaaacaggcatctggataatttggaccaacaggcaactttgtgtaaggtaagaaaaacaaaaaaatagcagtagtatttatttaaattaaattacaaaacaaatgtcaattcttcatttgattttcagagtagttctagccaaagttcctgaaaaaggtcctcttctttttaagaaaaaatgtgtatatgtattttttaaccatgaacctcactgacaatctttttcccttaaattctctgaatcttcaagttagtgctgtatgaatcgcagtgaaaactctttgtatacattactcagaaaagaagaaaattccaaactctgtcattatggctactcacagattatcctataggaaaacttgaatccgaagtctgtgatttgctcgttggagtagaagttaagcagaaccggcccagcgatggtgaggggagctggcatctcatccccacacacagtagcaaatggggtggacatgacgctgtaacctctgataatgtgcacgccatcgttgacacagcttcccgtcacagcggaacgagctggaaaaggcatggaacaaccgcattatgatcagaacctacacaaacaattaaggccataaaaataaaaacaaaaatgtgatgatgactcatgcaattgctataaaaattaaaatgagaaacgagatatttaacttagtttcctgttgaaacaatgtttactctaactacaaaacaagcacaggtatgataaaacaggtaggacttcacagtagacactttccaccttgaaacaattcagaatttcctttctttagataacggttcctttaactcagtgactgtaaactggggaccgtgttgcctccccaagaacacctggcactatctgaaggcatttttgctgtcacactgtagagtggagtagagaccagggttgctcctgaagatgctgctatacacagggcagcacctacaccccggaccctctgggacccacaaaaaactacctagcccaacatgtcaatagcgctgctactgagaaaacttgctccaagcttatgtccagataagggactcctatcatggagatatcattagaaactccttaatgtttattgaacaaccattttagatgttcacacaaacactattagtgtttaaggactataaaatatatattattgttttgtttgccaattataatgtgaatatatgctccagcctaccatcccccaaagaaaaatataaaacaaaataaacaagaaattaaaaagatatgtgtccactacaacatatccagtgatttttgtaggtgaacacatactgttaaaatattaacttggatcatacctaatttgtattaataggaaatgacacccatatggtaacctaatttgtatcaatatgaaattacatccatcatgcatttgtatgtgattaaatattcttctaaaacattatattagggccagacatggtggctcacgcctataatcccagcactttgggaggcctaggcgggcggatcacctgagttcaggaattcgaggccagcctgggcaacacggcaaaaccctgtctctactaaaaatacaaaaattagtcaggtgtggtggtgcgcgcctgtagtcccagctactcaggaggctgaggcaagagaatcgcttgaacctggaaggcagaagttacagtgagctgagatcgcgccacttcactccagcctgggtgatagcacaagactccatctcaaataaaataaaacattatattattatgaaaggaaaggaaaaaaaccagcctaacttttgcaccaacataatatattaatgcctatatcaaattccaacatatagatgtgccatccacattccatcaatcccctattgcttgaaattctatattctccacatttctgtaaataaaaatattgttgaaacaaacattcctgtacataaatatttgaggaagtttttcatcatttcatcagaataagttttcagaagttagatactggcactaaggtaagactatttttcaggttaccaaatgatccctagattggtgttgccgacttactctcccacaacatttttggcatctgacattcttcccaattctacattttcattgcccataggaaaatgttatgcccattaacaatcactccagtctcatccttcctgtatatggtctcctgccctacataattactaaactactttccgcctctatggatttgtctactccggacatttcacatgaataaaatcatgcaatatgtgaccttttgtggctggcttctttcacttaatataatgtttttgagtccatccatgtagtagcatgtgtcagtatgtcattcctctttatggctgaatattttcctttttatagtgatagcacatgttgtttatctattcatcagttgacagacatttggtttgtttccaccttttggctattatggataatgctgctatgaacattcatgcatgagattttgtgtgggcacatgctttcagttcctttgggtatataaatgggagtgaaattattagcccccaaattaggtatgtatttaattttacaagaaactgccaaactatatctcatagtagttacatcagtatacattctcaccagggatgtgtgggacttccagtgctctgcagggatgccaacatttgacattgtcagtctttttaattttagccattctggtgcatgcgaaacgaaacttcattgtgatatttaattttaattgctctgatgattaacaatgtgaaatattttcccattttcatttacaagccacaagaacaaaatgcttttatttcatggcgatgctaacttgaacatatatctaatgatccacatcaccccaacacacaaaatttacttacttacaaatgccccattgggaatgacccaaactacattattttatataagcacatgctatggcacggtggactctgaaatcagacatcctgtttgctgtttgctgttagaatactcttcctacaagagcacgctgacaaaatcgttatgcacacttactttataattccaagtcccctggccatagaccttggttcaaaggtgggtgtgtgacccaatccagtccaataaaggtgaatttcaacacccttgtttgatatttggaagttggaatagaggtagtagtatgctggtaaatataacaaccaactctccgagagatttgtggcatttgccaatttccatcgtataaatactcccacgatagccaatttcaagctattaacaacaagtcattaaatgcagaataggaatagatgagcaaaattgactcttgcaagatggtgcaacccaactctagcttaccacaggatagaagccatctctctttctgatgtgggtgaggagtacccactgtgagagcagcacccctacagcaatgagaggagccagccttaggatgaggctcacactggagtagcacaaagtaaaaacagaaacagttgaatatttgatgacataattaaaatgctgaattgagagatttgaggcacacccaactttgaaaccttccagaattaaaaaccaatgaattgctcctttgtgtttaaaccaggttgaatcaagtttcctgttaattgtgccataaaacctcctaatggatatggtagatattttcatgattagagtcactgttgctattgtttatacaaccccaccatcctgaccatggttgattgattgactgattgataattccagtcaatcaatggcaaggcatggcatcagacccaatccaggccaatcagatgtgtccaaactgcaactgagtaagagtcaatggtaggagccaaagatactaaacttaaaaaatgtctgcagccatgtttcctgacacattaaggaagccaggctgccgtaagggaaaaagaagttgtgcagcaatcagcaaaaagagcggggaagagagagcatgctgacagattcttgtccctggtttcctttgttctagaagcccttcctttgatgagatgaaatcacccagtatccttcttataaaccctactttgtatctaagctaacttttgaagataacttgccattcaaagaatcttgacaaatacttttaaaaagcatctctgtgcattaaagagttaccacacattcttaaatcattttaagaatacattcagctccttcgctaagtttctattcagcctgcagaaatcttgaggtatcaattcaagatatacatttttaaattaacctcaaagaattcccttattttgaaaatgctggaatagaaatatttctaattgggcataaatctataagttgaaagagtgaaagactgaacttcaatggccttttcatgtaattagaagcaatatgatgtggaaaaagaggacaaaaaagaaataagttaaactcagattcatggtttgaatattgccaaattatgtaccttagttataacctcagtatttgtctttaagacatcaaaagctccactggaattttaaaaaattcaaagtagatgagtttgagaataaaaaaattgtgcattagttatagaaattatttagcaacaatatatcaagttataaaaccaaaatcacagaatgtagggaaaaattgctgatgctggattgaaatcttggtcccacatttgatcaaataggctgctatgcatgtgttaggtattaaagagttagttgttaagttgtgggctaatgatataaatgatcacagtggcagttgtcttagaaaacagtgaaaaggctgtgaaacataaggtatagtgtcacttatacttgattatgttgacaaatagttgattaaaggaactagttgaaatacagaaagttcattcatgaaatggcagtggtacgagacataatcaaaactcatcaacaatttattaaatgtctgtattgaacaataaggaagtttgttggggaaatgcagaggaagttgacaagggattttagattttttgtagatggcaatagaatatcaactaactaaacaaattatgtaagacagtctgcttctcaaagcctaattcagtaaaatgtagaaattataatatctggcaacttatttcatggattaaaacattcttgtatcctttctagtagtcgtttgtttaaggtaggatgttatgccctttcaaattctctccaaaagaaatcaaacatgtacataatattagaagctggtaaaattagctaaagtctaagaaaatataaaaaattaacatcaacaaagtaatatgcaagaaaatggatatgtgtgtcactagacattaagtactttacacacatatatcatattctaaagttctatatatcccatcactgcattagatcaaaaatatcagcctgattcttcagtgagaaggtgttggtgacagactaaaggcatcagaaaataattatattaaacactttctcatcattattggaagagccaattgtatgtataatcaaaatatacacaacactctcataattggggtgactgtcttctagggagagaaggaaacttagttgaggtttggaaaaacttcttcaagaagcaagatggatatcacagttgagtttatgaccaagaggcagcattcgatcagacatatgcgaacttgtgaggaagagaagcaccctgaaattgaacaatactttctccgtggactagagtccacgtcatgggaccgggaactcagtaattcttaactctgtcttcaacaagtgatttgatagacatttactactgaaatctctgagctgcaaaacgattccctatcatttgtttttatgactattttccatccttcctaaaaactttaaaacatattcatcgtttgcaatgggcaaggctctataccatgcagtaaaatttaattttttgttctatttttccgggatttattactgggcaatgtctaattccaaacttcatcatagttctaagaactatgagagaactgaaggaaaactaaggatgagtaattccacaaatagaataaacttgtgggatttagagttggaccacagtttttctccaaagtggggggagggcgtgggccgagacaccaaagaggactagagatgagggaaaaccctttgtttgggatatttccatgttgtagataagatcaagtattttcaggaaatagaaatgggttctaggggccaggcacagtggctcacacctgtaatcccaacactttgggaggccgaggcaggcagatcacttgaggtcaggagtttgagaccagcccggccaacaaggtgaaaccccacctctactaaaaatacaattattagctgggcatggtgtctggtgcctgtaatcccagctactcgggaggctgagccatgagaattgcttgaacctgggaagcggaggttgcagtgagctgagatcgcaccactgtagtccagcctgggcaacagagcaagactctgtgaagaaaagaaaagaaaagaaaggaaggaaggaaaaagaaggaaggaaggaaaggaaaggaaaggaagaaagaaagaaaaagaaaggaaggaaggaagaaagaaatgggttctaggcagaggcacatgaattaccaggcagcagtgactgagacctatcatctgtcttgttaactttaccctgagtagctgggagactggtctcctctacggaggcatgattcagaggagggggaagcatgtactagtatacagctaagttccattgcgcacgaaggccaaacaaattaaagcaaattggagtgtaacacaggcaaacaagggatttcacagaaactacaccatctgctccagtgctctgccagttgaataaaatatcaataggaaacatttcaaaaggaccactgcccacttttttctaaagtaatgtggaatgcgaccacattctgagttctttagaaacaactgagaaagcaaagagaagaaacagcagttgagcaataccagtttttaaaaaatttaaataggaggaaataaagaaaactgacaaagctcatttattgtgcttcttgatggggaaaaaaatgtcaaaaagaaaaatctaaaactaatttttttttactttttttctttaagctttctattagatataacccataaactgggacttcagttaatccaagagaatttaggcaaatattaggtgtgaatctgggcccactcctgttggggctttgaagccatctctagaggacaacaagcaaaggcatttgtccctttggtgtttccacctcacgagctaagcgctgctgcaccctccaatgcttgtcaagaattactggatctgagaaacactgagtttacagtttacggcgtgtagaatttttaaattgagaatttctaaattcctcattatcaccaaggtgaattaatgttactacccaatttttttcattttttaaattttatttatgtatttatttattttgagacagagtcttgctctgttgtccaggctggagggcagtagcgcaatcttggctcactgcaagctccgcctcccgggttcacgccattctcctgcttcagcttcccgagtagctgggactacaggggcccgccaccacgcccggctaattttttgcattttgtttagtagagacaaggtttcaccgtgttagccaggatgttctcgaccccctgacctcatgatccgcccacctcggcctcccaaagtgggggaattacaggcgtgagccaccatgcccggcctactatctaattttaatgaaagaataatcaaggtttagaaggcactggcttgcttcattttgcctcaagaagtgctttatctatgaagtaagaaaactggatctataattttttttttttttagcagattgagggcttctagttggccacatgaataatgagaacacaaaattttggactgtttaatatttgggaaaataaaataagcagttatttaataataccagattccaaaatgaggacaaacatcaatggtctgtagttcatggaatgtctagtactggaaatgtaaaagtaatgagaaagttagagaaatttagaccaacattaaacttggagcaacttactttgtggtaagcggaaagtaggtcactgagcctttgtaacctaagagttgagtgtggttcaacaatctgtatttttcccttcatggtaaaaccctccctaagcaggtgtcaatgtttagtagacgccatatagggacaagtgtgtttcctcacagtattttgtagcctgggataccacatcttttccttgccaatcccaccttttgtgctaatggtccaccaagatgacagatctagaaccttcatcaccacctaagtcaacactggctctgctgggatcctgggctcagaaatgcttagccatttgaacagagtctctcagaaacagttccaagtgcctatagcagctagaaaggccaaggctccctcaataaagctatgaccttccttcagagcaatcctcggtttcatcccaatatattgcacatgaatccctcaggctcactttagaagggctggggaaaggttacttttactgtagctagcgaatctgtagctcggtgatggtattcaataaatgtcagcattgatatggttaaggataagaagctaattataaaataaatttgattaaagtcacccttttggggaatcatcataattagatgaatctatagccagaaattactcaggcagcagtttgaaaatgctgaacacttaaacactggaaatgtcacaaggcattgttgtaaggataccatcttagaaaagaatcagtcttcaactgagtgaggattggcaaatccattagcggaagcagaaatcaatctaacattatctgactttcagaactactattatacatatataataaatatatattagacacacacatacacacatatatagcaaagtgctatatatatataagtatcagaaataaaggtgaagtaatttgcacaaagtcacttgaatagcagtaagtggctgacctggcattaagatccatcctaaatgctgtgctcactttccctgtactatactgagatattccagggctgctcccctttttctcacctgataactgagctcagggagctgtctcaggtcatgatagagtctcttataataatacatataccactggtatcagcattgctttctgtggctttatagtacaattactagagtctcctttcttagtctgagtgatacggtcttgtgagatgcactgtttatttaacttaatgaccacaaacacaaaatccaagccacatgttgttcccctgctattaaaataattgtcctaattataaaaataacataaaagctataaagaagaaaataagcatctcgaataaatctatcacacagtggtgacaactcttaatgtactggttaatagccttatagattttattcacacacattattttagaaagaaaattggatcatcttatacaaactattttaccctccctcaagccttcatatatcatgggcatctttttatggtactgggattttgggctagcaaatgctgaaaagatgacactttactttatattccatttttacagtgacatacattgatttacacttggcatttttttaagcaaacacatgtgctgaaaattacaactgcagagatgtatgaaaaggcagtgaggtcataggaaaaaggattaagtgagacaagctttgttaaatttatccatttatgagttctgacatgtcatttttataaaccatacatttcccagatgttgaatgctatagaacattttgcaaagtgtaacttttcactgccatgagagactaacccaagagtaagaaatttcgaatataccgaggtagcttgacaaatctgcagataaattgtggtttagaaatagaaagctgatatgtaacaagaaaattaatatggttatgagtggttgaaaatacccatctatttgaaggaatttcctttccactgtgtgaaagcctccattaaacaccaagtggtgtctattgtcagtcaaagcccagcccaaatcggcatctctactgttccctctgccaacggcccattccctagagtgggagaatgaacacagagggcacttgtggccaggaactcaggcactgaagagtcaggactgagaagatgaagatgaccgagatggagcagaagaaagaacgcccaatggtagtatttactaaaagcagggcacatatattaattttttctttttgagacagagtttcgctcttgtcgcccaggctggagtgcaatggcatgatctaggctcaccgcaacttccgcctcctgggttcaagcgattctcctgcctcagcctcccgagtagctgggattacaggcatgtgccaccacacctggctaattttgtatttttaacagggacagggtttctccatgttggtcaggctggtctcgaactcccgacctcaggtgatctgcccaccttggcctcccaaagtgctgggattataggcgtgagccaccgtgcccagcctatattaattttattaatttacttacttattcaatatttgtcgaacacctatgttgactcaataagacagtttctctcactggtttggttaatagtgtgtgcatgaatgtgggtgtgtgtgtgcacacgtatgtctataaactttaaatgcaagtgaataaattaaaagctatgttaacatgaaacatttcagacttattttctttaagcaatttatgcaatacttgtgttgttaaagttctgtcactatttttttacttctagatggaatacatagaataatacttgtattctttaaaaattggatgaaattttaatcacgtttacattaaatctactctgtaacatattttcaatattttctttaaatggtgagttttagacttctgcctctacttactcctcattcatttctgaagaaccaattagagtttacttaagaatgaacttatcttccaaggctattatcaaaagacaagagataagttttggcaaggatgtggagaaaagggaactcttcctcgtacacttttgatgggaatgtaaattagtgcagccattatggaaaaatgcatggcagtttcccaaaacattaaaaatagaactaccatatgatccaccaagttcatttctgggcatagatccaaaggaaatcaaatcagcgtgtccaagagattatctatactgtcgtgttcattgcagcatgattcataatggccaagacatggaatggacctgagtgtccaccagtgaatgaatggataaagaaaatgtggtagatatacacaatggaatactctttggccttaaaaaagaataaaatcttgtcatttgtgacaacatggatgaacctggaggacattatgctaagtgaaataagctacacacagaaaggcaaacattgcatgatctcacttggatgtggaatctaaaaatgtcgaactcatagaagcagagagtagaatggtggttaccagaggctggtagggtatgtgggagtggagatttaggatatattggtcacaggatacaaaatttcagctaggaggaataagttcaggagatctactgtacaacatggtgccaatagcgaataacaaggttgaatacctgaaatacttgattacttgccgaatacttaaaaattgctaagagaggttttaaatgctctccccacaaaaagtgctaagtaagtgagtgagcagacatgttaattaactggatttagccactctacaacatgtacatatgtcaaaacatgttgtacaccataaatatacaatttttgtttgtcaattaaacgtaatttttttaaaagaataaacttaccttctaagtggaaggacacaaaagtcaagaggaccactgacagaggattagcctctatgacataggtgcaattcatgttgttgtcatattgttttgggtaatttggagaaatgatgtaacctgaagggccagtgaaattacttccacatcctatgtgggaacaaaaagtcatcatcagatcatttatttctcgtgtatctattttgtccatgaaggaaagaggcattttcctaaattatctatagacatagttccctgagatattccaaatggaagaagcaagaatgaagagaataaagctctgatttaaaaacatacatatgtgcttaataagaatattatacatttttagaaaatgctgcagagttttatggactgagtcctcgtaatattaccacaaatctactgcaaatcccttaatattaagatattaagaaaggataaacgagcaatgatagaatatggttcatgcagataaagaaataaaacagataaaaaatgatttgtatctgattagtactttacacaattaatgtttttaaaatgtcttattattagaaaactgctattttcattaccattgtaatctagccacaacaatggttgctttttaaaactagctggatttattaatcccaactcttatcaaattcttacatgcatccctggttttcgaaacagaaagaaatatcttttcaccactaaaatgatttgttttcatataaccattgactagttaatccacttcactctctgatctatcaagcacgaaaatatctctatccttttaaattgacattaaaacacacacaagtacacacgtgcacacttacacagtgaaccacctgcagacctaagatttggtctagggttgtctttcagtacttcctttccagcactctctgattcagtctgaaaaacctgtctactgtattacttcctctaattcctttcctcaaacttttccctaaacagtggtttgccatgagtggctacacttgatttaactcagccaacaggcacacaccattgcttctctgacttgaaaaatgctacatttcccacgaatctaatagtgtacaatagctagaaaaggagatccatccttcctaatcaaaattaggaaagaacattcccaaagaaactggctcccaaagttgacttagcatgagaaccctctggatgacagttaaaacatgcaagaccggccgggcacggtggcttatgccagcactttgggaggccgaggcgggcggttcacgaggtcaagagatcaagatcatcctggccaacatggtgaaaccccgtctctactaaaaatacaaaaaaaaaaaaattagctgggcatggtggcacacacctgtagtcccagctactcggcaggctaaggcaggagaatagcttgaacccaggaggtggaggttgcaggagaatggcgtgaacccaggacgtggagggtgcagtgagccgagattgcaccactgcactccagcctggcgacagagtgagacgccgtgtcaaaaaaaaaaaaaaaaaacaggaaagacttcgtcatggaaattctgaattcagttgggcctggagtgaggctcaggaatctgcatgtgtttcaagccccccacgggattttgtggtcaaggtgccacaggccagccacactggttgttgctaacgaactagccatctgcgcttctgcccaatatcagcccactctggatgccaggcttatttctagacgttggttagtgcccctcatggcttttatatcacttctcaattcagttctgttctcactgctatttggaagaaaggtgtcttcttgggattaggtgactcatcctccccgtagacccccatactcctcccctagacccccaggtttagccaaccctgcctgcctgtgacaaccacactcccgcaaagacctctgggtttggttcttagggctacttacggctaacaaaggacgcggagaagccctgagctggtgcctcctgagactggaagacggcagtgaatgtgttacttggtgtgataacgggacccggagccacgttcccacagccagtggctagcagggctttgtccacctcctcagttcctgcccacacctagcacggacatacacagaactttaatgctcaagggtttcccatcaatattttaatgcacttaggtttcaaaataatggcactcacacgtatacagaactaagcataagagtaaacaaaacatggacaaatctgtagtattttcttttgagaataatttttttaaagctgtttttaaaatagcatgtcccattcttgacttctctaaggagatggtgttcctttttgcatagctgggtggtgattttttaaaaatccaccttcctggatcactgttcggtttcctcataacttctagttgccctgacctagccgagcttcccgggtgctgagggagacggagcagccaggtggaactcagccctgctcctgggaagatagcagattgtggtcacagctggacaacaccagcaagcaagaggcacatcgtggtgcatgaagaaagtgggcatgaattccaagtatacgtataatcagcatgaaatggaataaatcagaacacttcttggctgtgtggaattgtagggtccattttgatgaaaagctgacatccagtcagtgtgtgctattcaccaaaaatttggttggcaactcccaagtagacctgggctgtcacttaattggtctggccacctcgaatgactgaatttatatactcatgcaaaaaacagttgctaggaaataaacggtgagcaccaaaattccaaatcaaaccaattcttatcagtccagggaaaaacagagacatgaatcacagaatcataaatttacatgcaaaattccagctataaacaaggcattatgatggggctgttgagaatatataattggtggctttacctaactgggggaagtgagcctgccccgagcgaaccccgatggcaggaaaggccgtggctagttcagagaagagagagaaaaccaaggaggaaggggtgaggaagcctgcagagggggctgcaggacacgttagagactcgggccactgtcctgaatacagcaaggagccaccaagaagattggtttttggaaaacattacaattcggaaaataggagtcagaaaggatgccggaaaacagtcaggtaggttttgccctagttcaggtgagagatcatggttatctacaatgctgagtcactcaaggaaagtatgcatattaggtaatgaatatacaaaacttgggggaaaaaaaccccaaaaacattaaacatattaaccagagaagctcgtcctagttcagaggtctcaactaggagcaattttgggacctctggcaaggtttgtagtcatttttctattgtcacactcggtgtgatgggtagtatctagtgggtaggggccaggactattgctacacaatctgcaatacccaatatgccctttctatcaacagacaactatctcaaacaaggatgtagttggatgtgtattaatcttacttgactattcaacattttcttcacatggaatgataccaaattactcattccaaacacatctcttctcaaggatattcctcacccacagcaataaaacatcaagtcattaaaaacatttctattgggaaatcagtccatagcaagagatgtgaaatagcactgattcatagcattggtttaataattctcagctctttaaagccgtattgtttcaattgatttttaagcactgggtatccagctgttagtcatcctactgaagacaaattatattagccatttattagataagggaggtgcctggcgctggacctactgagaacaaaagtgcagatattctgccaaatgcctaagatcaataaaaatgtcaggaaaaaaaatgcacctactcaattttacttaatgatctctaattagatttccccctaataatatatccaaggaaacagtatatggcagttttttatccacatttcataaaattataaacacaatttatcaatagataatctgtatatatattttatatatatatgtatttttttgagacagtctcactctcactcaggctggagcgcagtggcacaatcacagctcaccgcagcctcgaccttctggactcaggtgatcttcccacctcagcctcccaagtagctgggactacaggtgcgtgcaaccatgcctggctagttttttgtatttttttgcagagatggggttttcccgtgttgcccagcctggtctcaaactcctggactcaactgatctgcctgtcttggcctccaaaagtgctgggattacaggcataagccaccatgcctgggccatatactatatttttacaaacattactaaacaggcaaagtaagaagggctaaaacttaataaagagcctcaagttctttaatgaaggaatccaagaatgcttaagtgcttatacttttctgaagtcattaattatagattcgacaactctaccttttggcctgggaacataagtttaataataatgatgataatggtgatgacaatggtaaagagttattcaatattcatttctgccttgcctatcaagaactcatttcattggctatatgacagaggactcatcaaaactatattgaacctacaaaatgttacttaactgtcatcaggtcaaaaactttctgatttttcttagtgttctatataattcagtcaggttgtaggttatattttatcattcaactattttttaaacaaatgtttacagacataattgcagattcacatacatttgtaagatataatatggagaaattccttgtacacatttctgagttcctccaatactgacatcttgcaaaactgtagtatactatcacaaccaggttactggcattgacataacaccaattttactcagtttcctagttttacttgaactcgtgtgtgtgtgtgtgtgtgtgtgtgtgtattaagttatatacaagttgtacacaattgcattcaagatactgaaattccaataccacaggaatccctaagttgcttttgttgtttataaccacacacaatttactcctacattgccttctctctaacctctggctctctgctttccatttctaaaacactatcatttcaaaatattatataaatggaacagcagagtatgtaatctttggaggctgccttttttcacttggcataatccctcagtgatttgtccagattgttaatctataaatagtttgtttttattcaggagttacattccacggtaagcaagtaccacaatttgtttaaccattcacctgttgaaaggccttagtgctggtttcagctattacaaataaaggtgctatttatatagattcgtaaacaagtttttgtgtaaacatagttttcatttctctcggataaatgcccagagtgcaattggtaaatattatgcaattggtaaatatttgtcttcgaataggtgtgtagtgatagctcactgtggttttaattcatacttctccagaagttaatgacgttgaacatcttttctggtatttatcatctgtagagtctctttggtggactatctgcccatgtcttttgtccatattctaatagaactgtttgtattttactcttgagtttgagacttctttatatattttacatagtagtacattgcctatgtgaagaaaatgaacagactggctacagactggatgaaaatatttcacatggcataagatttttaatttaaatggggtaaaatttatcattttattttttctcttatgaatcattcttttgttgtttaatctaagacctctttgcctatctccaggtcctgaagacatctgctatttttttttctctagaagttttatattttacttttcagtctatcatctattttgagtgaggttttctacaaaataatgaggtttaggttgagattcatattttttgcctgtggatgttcaattgctctagtaccatttgttgaaaaaaccattcttcctacattggaaagtttttgcacctttgtcaaaaatcaattgaggatgtttgtgtgagtgtatttctaggttctctgttttcatctgggttttcaaccaataccacattgtcttgattactgtaacttagataagtaagcctaggtaaatagtaaggtagaattcttcctcccattttattcttcttttccaagattcttttagccattgaagggtctctgccttcatataagttgtggaaaaagttgtctatgcctacaaaagactttggagaaaatttgataggaattgcattaaacctatccatcattttggggagaagggacatctttactatgttgagtcttccaattcataaatataattgtctctttcatttaggtttatgccagcatttcattatttttagcactcagatcctgcacatatttgtttggggcttacttggcaatgagaccatttctatatctacactgatccatctgatccttaccaggcacttcccatgggaaagaatggacgattgagggagacagagctttctcctgtttggcctcttacaccacagcagaaaatgatgaaagacaggactgttacttacattttggcctgttgttttaattagctgctccaacaattggcagctcagttctctccagctcagctcagtgcttaataagatattctgttactgttttttagttcagttttaatatactcaaagaacacactctgtatttcaattccttgacttggttgaggtttttccatgtctcaggatatgatctaccttggaatgttacaagagttcctaaaaaattgtgtattctgatgttgctgtgtggtgtattttacatatatatatttatacacacacacacacacacacatatatatacacacacacacacacatatatatgtcaatcagatcctattaactgatggttttgtagagttcttctatatccttgtcaattatctgtctagttgttctatcaattactgagaggagagtgttgaagtcctcagctataaccgaagatttgtctacttctcttcttagctctatcagttattgctttatgtattttgtgcctctgttgtttggtgcatacacatttaggaggatcattatgtcttcctggtggattgatccttttatcattatgtaagattcctctttttctgttgtaattttctgtactctaaagtctacttcatcagatataaatatatccactcctgcttttttggttaacctttgcatgacatccttttccatccttttacttttcatgtacctacgtggttgaattggaaatcagtttattatcacttagatcatgttttggcttgataacctgtattgtgattggtctaactaaactatttacaattatactgatatatatcagttctgtgtctacattttattatataatttctgtttactttatctgctttttggtcctctatttctcttttcttgatatcttggggattccattttgattgatattagcgtttttctgtacatttcttcacacagttttggtagtggttgttctgtgtgtgacaatgtgcctatgtgattatagtagtctaccaccatccacatctgaccacttgtggaaatgtgatttccatttaggtcccctttcaacttttccatatcattatactgaataacagagggcattataatttcttgttttattaaatatgattcacaagctttatggggaaaaggatattctattgtatgtacacatatttttgctttttccactttcctttttcttttctcatgctccacggttctttaataatttcatttttgtttgaagaacttctgtttgaccatctttaatggtaggtttcctagtgataattttgtttagtttaccttcatatgagaagtttttatttcctctttactcctgaaagatagttttccagatataaaatgtatggttgacaattcctttgtttcagcacttgaagaatatattgtcaattcattagggcctccatggtttcagatgagaaatctgcttttattctaactggtcttcctctctaggtaatgtcccaattctctctgactgctttcaagactttttgtttgccttcagtgttcagaagtttaattaagatatgtctgaacttacatttctttgtgtttatcttggtttaggttcactcagcttcttgaacctataggtgtgtctcttttgccaaatttgggaaagtttacagccactagttctttgattgttctttcagctgcactctctcctctccctttgagagaatgttgaatcttttgttactgtccatgagtccctaagtctgtgttgatctagtttgtttgttttttcagtctattttctctttattgtgcagactgggtgaattctattgttctatcttcaagttcactgattctattctctgtcatctccatgctactattgagcctattcagcatgttctttatttatgttagtgtatttttcagttctataatttctatttagttctttattgtaaccattgtttttttgctgatattttctatttgtttcaagagagctcgtcagtgattgttgaagcatgttaatggaaactacttcaacatccttgtcatatatttcaacatctgatttatctcactgttgacatcacttgattcttttctctttcaagttgtgatgttcttgattcctgatacaacgtgttctttctgattgtacccaggacatgtcatttattatgttagggaactttgggtcctattcaaatcttttattttagcaggctgtcaccctgtttatgtttaccacgtgccttgcacattttgtgggttacagttccagttgctcttcaatattcagaatctgtgtggtggaattctggtctgcttggtttacattggtgctaccggggctctcactggttcttgctggtgctacctgagggactctgtgtgtttctcagttgaaggcaaagggtatagtaattttcccctaccaatacccccgggtacctcaatgtctctgggtggaagaggagcaggtctggcctgtggggacaaagaggcttcccagactggcccctttctgtgactgggacccatttttccagtcccacctaccctggtgtctctgggtgggtaaagagaatctcagctttacaggtgttaagtggcttcctgcgggggctgcttgccgaagctgggtccctttactggttccgtccacccacacagcatttcttggcagaaacaagcatctcgggcccattaggagaagacgagtgcttcccacggccacttatttttggcagggttcctaatacatcccactcggcagcagcgttgggcttgcccgatgttatcagagggacccccattcaatccagagaaggaatgagcctaggccattttccacattccagttttacaactggagcacttgaaagttttacttaagtctgaatacttgatattgattcatttcatgagaagagagttcatttagttcatggaaaaagccattaagaaaagtgtatattaaatgtattttattatatgtatatatatatatatatatatgttatacacatatgagattttcatttaaacagtaagcatgggtcaatgagatataaaacatcatttgagagttgataggaagtaataacactgacaataaaagccactttgactcatcaagtgactttaaattccaagtacttagcactacctatgttattacatcgtattatctccaatgcttaaaacagccccactgaagaaggaatcatgctcttcattctacagttgaataacttaaaggccaattgtttaagtagctcagagaagaacatgcaggtggtaggtatgacagacatgaatggaggggctaacgtgaccagtgttatttccactggaaaggcacagtggaaataaggcactctttctctaaaagtcacagacttttagagatataacttggaagatgcaaaacagtacagatgaaatgaatttctaagacagtcatcatagtcacaagtcagtggaaagtgacaagccactgccacacgagcagcatttataactttagattttgaaagagctttgctctcctgatgccccattcccatcatttttacatggctttctcacggttttttcagactgtggggtcttaatgcccaaggtgaaggctggcattagctgctccttcaacgttccgtaatttttgtggcatgctttaaattttgcctgtggtagtgccctatattataaagggcatttttccctttaggatctattagaaaagtaagaaagaaaagaaattctagctcctaacagttgaggtttctcactttctcacttttcatccaaggaatccaggcagcaaaattttcttactttgagcgacaatgaatcatttctagcttaaacactaatgttcacaaaaccaacttggctccaattaaatgaacaagtgtactaaccttcacgaagctattctgacattgtccatcaccgctggggattaggaagttgttgtcaaagctgatctccaagtgtttacttttgtgagtaatggccgtccaggaacatctgctgttttcgggaaaattctgaggccagtgaggggatctgattgtaccattatcagaatgaaatattccaccacaacctgaaatattgccatgtaaaaagccatcaatcagcaaggaaagtaattttggaaactcaagactgctacagaaggaacatttccaaatgtgagatttcaattcatcattttttacaagtgatcatcttccagtcaggtgcacagcaagctctctccataaatggaaaggtgagttaaattgagagaaaatttcagctgttacagttgtgttacaatgatattgaattcaaccaagaacactaatccgtgccatagagaggatagatttccatcctgtctccaaacaagagctgtatttttattctctttgagcctatgtagtatatgtaacctggcaatgctaagttctgtattttattaccattcacacatgagaatattactctacactccatttgcaacgttactctaactggactagagaaagtgattttgagttggggaaaattcttttattaagcaatctgattgattcatattgaaactgactgatggatcaaaattaattatgtagattcaaaggaagaaaaatctagaattttcatacaaaacaaaatgaagttaaagaggcattctccgaatcttttgctgtgaaacccctggaaatcagggattcacctaaaactcccttctcacttcaataacagccagtggttgttaaccaggggaagtctgactcagtcaacaaagagcttcataataactgtgactctaccagaaataattgtcttgtgtgatatacaagatttacagaaatccctaataaagtatgtgatacaagtccttgtattttctgagaattttcacaatgtttatactttctatgcacaaaaactattcttttaaaatgaaatctgtcatattttgactcaggacccattcactacagcatttgttctaaattacaaatctcatcttgtcaccttcgttttcaaaactcttcaacagtttcccattgttcaagggataacatataaaccaaggctctttatgttgtggacttattttcctgccctcagctcaccactcagcattctgcttttaggctccagatattttcaagcacttgggattccaactcatgtttctattacttgagattcccaggttgtgccatacccttttgccgatgaaggcagcatcatgaagtgttgagatcaaagtttctggactgaattgcctttattcaaatcccgactctaccaattatcggctatgtatctaggcaaatgatcaacccatgcttcctcagtctctgcccatgcaaaatagagatgccaggtattgatattgtgttatcccaccagggttgctgcatgagatgacatgtgcaaatatttagaactaagcctgatgtaaagtaggtacaaaatgtacatattatgagttcatactatacatcactaaaaagaaaatcaaatggagcaaacatttcttttacctaaagtttgtgtgttccacgtagcataaaatccaccaccttgcaatgaatggtctgagttaaaagtcacgaccagctgattggaacctgactgtattgtcctggggtttgaatttccacagtattgtcctatgatgggtgattcaggggacccaccattcctgacagtgacagagtcccaagcacaagttgtatggggttcaatatcaaagtcactaaatgtgagctgcaggagaaaaaagaaaatggttgtcagtgagcttttatcaactgttacgaagataaggcccttacaaatcgtttaattttgtttttatttttataatttgtatttttgtctcttatttaattctcccttcccctctacttttttttccttattgaaggttctcttggaaattttgagaaaagacatttccctggtttgggatggcaacacatattaagaaactgaatacacttctctctaagacgcagaattatcttctgtgtatatctttccctatgcttaaaaaagagatttcactcttcatgaataataaatgccaatgtatgtgctctagtgagaaaatgttagggaaaaacagtgatctcattgtagaatcaaagccttctctaatcacttgcttaataaaagagctccattttcatgcaggacaggctattgtggttctattgtctcagaagcatttcacccagtcattagcactcacagtgatggtgtgcccttgtggggcctccaacagcgaagagcagtgggtcaggctgtcataagcatttggatagttggggcttgtgatcactccactgtcacctatctgtattccgccacaatctgaaatgagattggtaaccctctcaataaaacagaagtaaaaaaaagaaccgataatgccaaagtaagtagtaatcataaccatcagattttgtgattaaaaacatagtaaggccaggcatggtggctcacgccagtaataccagcactttgggaggccgaagtgggcaaatcacccgaggtcaggagctcaagaccagcctggccaacatggtgaaaccccatctcaactaaaaatacaaaaattagctgggcttggtggcgtctgcctgtaatcccaggtattcaggaggctgaggcaggagaatcgcttgaatcagaaggtggaggctgtagtgaaccgaggtcatgccattgcactccagtcagggtgacagaacaagactctatctcaaaaaaaaaccatattatatatatacaccatatatagtatatatatatatatatatatatatatatacacacacacacacacaccatatatagtatatatatatatacaccatatatagtgtgtatatatatacaccatatatagtatatatatacacacacaccatatatagtgtgtatatatatatatacacacaccatatatagggtatatatatacacacacaccatatatagtatatatatatacacacacacaccatatatagtatatatatacacactatatatagtatatatatatttgtatatactatatatagtatatatatttgtatatatagtatatatatttatatatatagtatatatatgtatatatatactatatatatttgtatatatagtatatatatatttgtatatatatagtacatatatatttgtgtatatatagtatatatatttgtatatatatattttgtatttttttgtgtatgtatattttatgtatatatatgtataaaataaatgaaattaaatagaagaaaagtaaaattgggtaaaagtttaggaataacaaaattccatacggtattagcatagaaaattgaaaattgaaaaaaaaatacatttctgaagaataatatggtctgatgttcaatacaaataatactgtttactgaaacctgactcttctttgaatctgatgaaggaaaatcaactggcaagatggttgagtgagtagataatcaatttcactccttcttcaaccagccatttggttataacacaaaggaatgttagataaaaccataactaaaacatattttgattcatagcaaactcaatggaaagaaaagcagctccccaaaatctagaagcagtaagtgtactcaaagtgagaggagtgaaagtgaaagagtgaagtctgagagggtaaagaatgcaggtttgggtcccagggttgggctctgaggttttgatgactgggtaggaggagaagatagggctctgggtctccacagaaggcaggactggaattgagacttttacaagaagttgggaatctaaacaaactggcatgctcgtgaaaagggactagaaaacctcccattgccaagggaagcagtcaagagtagggctgggttttccagcacaaactctgaatgttgcatatgcaaatccaacacaaaacactagcaaataatacccattatatgtataaaacacacatcatgacaaaataggatttatcccagaaatgcaaggatggtttaccaagagaaataaatctttcatataattcatcacattaacttatgaaaggagaaaaagttgaatcatctcaatggatgcagaaaatcatctgataaaatcctatgcccatttacatttaaaaaaagctttttcacactaaggatggaagggactttctttaacaaaagatatttattggaaacttaagagcaaccaatatatttaataataaaatgtcatagtcacatccaggtcagaaacaagatgctatcattccttctgttcaatattcgatggtggccctagctagcaaaaggatgcaagaaaatgaaattctgtattatgactgaaagcataaagaactaacatttgcagaagtttacacagaaagatcaaagagaatctatagacaacatattaaaactaataagaggatagctagatctttggactaaagttacatgtatgcaaaattataaaatttataataattatgcaaattacaaaataattttaaaattattaaataataattattattaataattatttattattattaattattaaataattattggataattttaaaatttaataattttaaaattatgcagtttattattgaataattttaaaattaaataataattttaaattatgcaaattataaaatttctagatatcagccacaaccaattaaaaaatgtaatttagaaaatctcattgataatattaacaaaactaatagctatgtagaaataaatctaacaaaatatatatgaaatctttatggaaaaaaatcattaatctttataagtaattttatcaagatcttaattataattcttacctgtaaaggaatactttgcatggaatccaatgtgttctacacgttcgttggtgacaaagtgaatccatacctgagaataaggtataaccaatggcaatgtaggctttgaaggaccacaaagtctccacatcaggggcccatcagcatcacctgaacaaaataatataccaagtgccatcattgatacagcttttgagaaatacattcaatgaatttgataaaaacaaatttcaagatattcattgacacacacttaaattctgatttagtagcagacattgcacaatatttgtgtgtctctgttaactgcaacagaaagtccctccaagggggtaaaacaaacacaaaaaaatcaaagcaattttgaaatgaacctctatgatggacaccattttgttccaatttgtgttttcatagttatttcagcatatctaaacagagatacaatgaattaaaatagcacttttggacacaccttttgtagggtgtaagaaatataataccaacagtgataaaatatatcctcaagataaagtgatcattgcctaaaatttgaaagatttcttcactatattcaatcaactgaaatggactccatattcggcattcaggccaagagctgtcagatctgagcctaatatttttcatgaagattacatttcgtgggtttgatgaacatgtacagagcaccaacagagctctcatttatctgctttctttttattctgtcagataaacatcactggtcttctaaatcaatgatatatagtattttaactgcctctaaacctgagcaaataaagagaagacagcatttagctgactgaaatttgagatacagctgttctgcttaagaccacaagccggtggttttgaaacaggcagagggggtgagggtttatcagaattccatggagaacattctcaaaccacaacttccctttcccttataagcctttttagactcttcagcctcagagaggttggaggactctctggctgaggcccttggcccgtgggtacaggctctatcaaattctccttcctgaaaattctgtcgctcacgttctcaaaggtaattaacattgacctctcagtttcccaaggacttctccaccaactaactgatgagcttctgctgctttcagcctccttttctttaaattttgggattacacagaactcagcaaaacttttacagtatggatgattacgtactatttacaatattattgtcttcctctatctacttgtttatttactgagaaaaacgtgtcagcataatcatggaagcaacctaatgaataacctacaccttgactatgggaaagaaagaaaattgattcatcctctttgaatacagagttttaaaaattcttaagagaattatggtttattgagtacaccgcaatccttttccatcacgaaaaccaagacaaatgactgctttggggttatttccccaaatagcttccatgtgtttctccatctggtatattgcaaaacttcttttaactcctaaggcctcaggagaatttcacagccccttcataaatcctggaagttcaggaaactgccaacacatgctgagcatgctaagtcccagtctccttggaaaggagtcttgatagtagtggactctcgcttcggcaaaagtcacatgccgggaaacgaagtgactgtaacacagagtctagttgtacagtgatccgcctcactcactgttcctggggttcgttttcctcagctgggcacacacagaattatggcttcgaacagagttcttttggatcgtgtgtacctatgttagagccatttgactcccttcattgttagtagtctccaagcatatgaagaatattgtaggccagccgtggtggctcatgcctgtaaccccagcactttgggaggccaaagagggaggatcacttgaggccaggagtttgagaccagcctggacaacatagggagaccccatctctacaaaaaattttaataattagttgtatgtggtgatgtacacctgtagtccaagccacttgggggactgaggcaagaggatcacctgagcctgggaggttgaggctgcagtgagttatgatcacaccactgcactccagtccgggcaagagagcaagctcctgtctcaaaacaacaacaacagcagcgacaacaacaaaaaagataaaaagaatattgtagataaatgggaaaacgcattcttagatagaactcacccactcgaaactcgaggacatcaaattgacagtcttggtgactttctaggtaaaaatcttcaaagtgaatggaaatggatgaatttccctgatttggattgctgagagtccattcgcagttcaggtttcttgagtaattcctgactccgtcatagccaggagaagtaaagtttccttcaggagtatttggaagagacccaccacacactaagaaaacagaaggcaacagagaaagtagtagtaagattcaggccacaacggaagagataaacaatacaggaacagtaactaaaacatcaacattactgctttgatttgtttttctagatgcagtcaagcttatgggtaaaaggcatgcaaattatggaagtttctgcaagtttataaaggaaagatgtgcaaaaatcaacaacttctctattttcctgttgctgtagattaagtggtgggcgtttggctctgtatcaataggtccaaatattgaggcctactgttcattaatatttactttagaggaatacataaatataatggtggcaggtcctaatggcttgattagcaattctccacttgatctaataaattattttaaatcaaacagataataggacattaatttgccattaatttgcccccttttaataaaggaacagatgcttcttgtaccaatgaaataacttagcgtttttcttttaatattcactcccacttctaaattttaaaacttctaaattttaaaacactcccacttctaaaatttaaaaccctttaaaattttgaacccaattcaggaaataggaggatatttataattagaggccatatcttgcttaattttggaatattctatatcaaatcaaacctcccatttattttcactggaaatatgtgtgtggatagatgactagaaacaataaagcctgttctgtccccagcaaaattaattactctctgagactaagttaccctctaggaggtagatggtttctttcagcacaaaagaattgaccagggactacggaacaggtcaccaaccctcatggtaacatgacctgaaactgtgctagaagctaatctaatagcattaaaagttttaaattcactatggcagtttctttctgaaatcagaaagctttttttctgtctgcagtgcgtttttcatctgcttatgtgtgtttgtcttatgtcaaagatttcaagtatcactaaagggaaaatggatggctctgctgccattggcagtagatgggggcatctgcagtgcccctgattaaaatggggggcatttacaacatcctacattacctgcatcttcactggaggtataggaagcagtgaagccgccatatggcctggatccatccgtgaaaaaaatgactttcattgtgtttcctgaagatttaatctcattgcttacattcacactactacacagtttctctagctggggtgagttacttctaatgccattgaatacctgttggaaaaagagtttaaccttcaggcacacaatccatcttactgcatatttcctaggaggtgatatttccagcccagacccacttccttttatgggaaccctgccccaaaatgaatgacctaacaatgcaggtttctatcgcagtgccacaagccactgttaccccgagcacattttgtgacttcagggtgatttcactagaatgaaagtattgcagtaatgccttcctgccatgtggtgatagattaaaagctgctatacactttgcaactggaaactgtgctctcaatgtaaaggagatgagccattgtgcttacaatgtggtctgcagagctcactgatgggcagtttttcttaacaatgcatcaggacatttgttacttggaagggaagcttaaatatcagtttctgatgatttcatgtacataataaagcagatatttttctttatttactttaatttttatttatttattttttgagacagagttttgctcttgttgcccaggctggagtgcagcggtgtgatcttggctcaccgtatccttcacttcccaggttcaagcagttctcctgcctcagcctcccaagcagctgagattataggcatgcaccaccacgcccagctaattttgtatttttagtagagatggggtttcaccatgttggtcaggctggtcttgaactcctgacttcaggtgatccacctgctttggcctcccaaagtgctgggattactggtgtgagccacagcacccagcaagcagatatttttaaatactttgaaaagtaatttgaaaaatcaatctccatctgcaattaaacataatagttctttcctcattagttatggattcaaagcttcaattttcttacttatttgaatttccaataatggattattattgactctaaaatattaaataatagctgtagtcattcacatagttacaataattcgcaaactattcttccaatgctttataaaatcaaatgaatttgcatgactggttttcacagttcaaaaaaaatctagatgaaataactgaacaataattcattgattgaatggttgatattcccatttttaaaaggatttgaatgactcaagattagaaataatgactcagactatggcactaacagttatgcagaaggagaatgcactccacaacaaaagatgtcatctctttttttttttttttttttttgagacggagtctcgctctgtcgcccaggcgggactgcggactgcagtggcgcaatctcggctcactgcaagctccgcttcccgggttcacgccattctcctgcctcagcctcccgagtagctgggactacaggtgcccgccaccgcgcccggctaatttttttttgtatttttagtagagacggggtttcaccttgttagccaggatggtctcgatctcctgacctcatgatccacccgcctcggcctcccaaagtgctgggattacaggcgtgagccaccgcgcccggccaagatgtcatctctttaaatttactataattaatcaaatttagctctctgggggcttctggtgtaaagtgtcttctggctcactggaccagaagaagagtttgctatcatttactgagcagacaaaaatgccagtctttgcttatcatccactcagcctgtcttatctaatcaacaaaacaccctcccaggcagataacagtatccctgttttccagattaagataccagaatccagaaagatgatgtaataatagaactgggattcaaaccatccctctgattccaaaccattaagtaatgcataaagaaacagatgaggaaaaatatttctataatgctgaaaacaggaatgggcaccacattgatggaatcaaaagggattagaaccaaccataaggttaatgggacatgtcggaaactgtgatcaatggctgttatcctgcctctgagtctgcctttggcatagaatcacaatgactgaacatgttatagtcatccatttatcacatggacttctgctgttagaagcaaccagaatgcaattcccatcattgtcctctaatcccttttgtacttagaaactacaactctcagagtacaaatggataggaagcaggcacgtgagatttaggatctgctatgagcagggacaacatcagacacaggtcttattgtaggacacactgggtggcatagctttttattttctctgtctgtacagagagtcagataggcaggtgggtttagagaaattttaggctcattccagctggataaggtattagctaggaagcagtgcaatgaaagttaaagctgcctcctctgcaccagcagatcttctttcttcttcactcttttcttttttttctttcatcttttacttcttcttttctctttctccctctccttctcattctcctcctccttctctttctccttcttctacttcttttcttcttctctccttctccttcttattgttcttctttttttctccttccccttctccctcttctccttctccctctcttctccctcttcttcttctccctcttctcctcctccttctccttctctttcttcttcttcctctttcatctttcttcttcctcttttcggcaagttctcaatcaaatagagtaggggcaaaggccaacccacatgcccttgtttggagcagggtaaagaggaaccaaaataaacattgaacatataaaaatacatttcaaaaaaaggaatgtggacattagaactaaagactcagaagaaaaattaattctgaaagtgattcgtcgctggagttttaacctccccaagagaaaagacctgtggatatgacatttgtaggtttgcaggttttgctaaagagtcagggccccctcatgcatacagagataccagtcatcctttcagtaattcattcttaaatacgaatgaatagccaaggatcagcagacatttagggaagtgactaatgtaaaaggcagagaccaatattagtaaacaggagataggaacatgaagaaaactgaccccaaatgagcaacacaaaacttcaaaattattattaatatattcatatatattaatatatcaaacatataaaatatttaaatatatacttttcaaagatttatggtaaaataaagataatttcaggtataccatttttcaaaagatttattgcccttgcccatttccttggggagccgcaagagggtatgcctcaccaaaagaggaaattaaccaagaaagggacgtgcatagcatcacaaagtcagctctctagcccaggagaagaatgaaggaacttgcacatttgatggcaaagggaaattctgaaatgacagctagcatcaggcttgcagctgacgtacaaaggctcaaggaaggatattactgaggaaaagaaatggaactgatatgttttactacagaaggtagagatgcacatctggggtggagagggtgtggacgaattggtgatcaatgcataaaacccaagaaaatgtaaagaggacccaattattattattccttaggaaaacaaaagcaaatgttgccatactacactacttggctcagttgtgaatggtgtttacataatcatggtaatgtcaactgaacagcaatttaagcaaaagcgtgacatacgtattttgggagacgattgggaaagtatataaacattgcataccccatgtgtgtttgtggtggcaaaggggtaagtctcatcttctagagtaggatgtggatagataatgtccaaaaaaagcaaggagtagtagaataggaatattatttagaaataatgacataaaacccaccagcagtagctgcaagagttataagttgataattaagggatagggagatgacaagtaagatctgctttggaatttgtggttgtgactgtaacttttatttgagatctaaaactatgactgttcatattctctttcctaaaggacatgtgaatactctgcttgtaaaattcctgataatcattatattcagtatgatttaaactatgaaaataatttcaaaggtaaaaaacaactgttagcacatacatcaaaattttagtaatacatgagtagaattaaaaatatctttatattttttattttctgaactctccaaatattgctcaataagcatccattatatttataaccagaaaaatagattaaaatcagaattcaagtggatttatatcacatgattacaagtacataaagtatgctttgccaagaagagatgagaaaatgaatcaaaatgtggtatagtgggagtggttagtattttttctacttcatctttgtttatataattcaatcaataataggaaaaaagtttctttataataaacaaccttagtccaaaatttcctggctctcaaataaaagaaaacacacttggtttcttattttcaagatctgaaagaaaacagttcagtccttcagatattagaacttggaaataaaatctgaaggttgaataagatcattttacggcaatacaaagtggtcataagatacaaagatatttcatatttttgaaattcactacccaacaggagacgattaaactgaaaacaaaagtggcttgttataaaagggataatgatagtacctctactatccattcattcaacaattatttatctctattatgtacaggcactggggattcagtgaatccccagcagtgaatgaaactgtggcttgacctcaaggagctcacattctagtgggggaagcagacaataaactgatgaacaaatcaaaatgatgtatggcagcaggtgtgaagtgctgcaaaacaacatggcagagaagggtcaggccagggtggggtctgtaatataaggtacttagaccttatggattaaaaggcattcgagcagagaccccagtgaagtgagggtgtggagcaggccgccatctggggaggggcattccagatgaaggcaacagccagatggggagcatctcagcacattcagggaacggaatggaggccaggtggctggatcccagagagcaaagaagagaggagtttgagataagacaaacaggtagaagagggaggggcagcagataatgtcagccaggtgggccacaggtgcaatttgggattttcctctgagttagatgagaagccattagaggattttcaaaggcagcaacatgatccgattgaggtttaaaaccatcacatgctgctgtgttgagaacgtagggagaggagaacggaaccagggggacgaggtggaactttctaaaataatccaagtgaacggtgggggtattagtagcagatatgatgagaaatagttcaattgtggatatttttaaagatacacccaatgggacttgcttatagatgccatatagggtgtgagaggaaggattccaaaatagacatcaagatttttgacccaagcaaccagaagtttggaattatttactgagataacaaacactgcagaaggggcaagttgggtggataaatttactaatattaatccaatcttcctatctacacacacatatgtgtgcacagcacttcacagttaacaatctatttgttattcacactcagggatctcatttgctttctttcactgcaggaagctgagagtgctgaagacacatgtgaaaccactggaggttggtgacatggaggtcacgtagcagtgctctcccaccaagagtccctctgtacccctggagagagcagtgcttatgcaggaccacccacctgctcagaactttcgtggtggcttgtgctgtgactctggtcccattcagctgtgtgctgctgtaggcttagcttcccacagcctctccggttttgccatttgtcgtgatcattcactcttaaaatttattctatgaccctgatgcacagagtgatagctgatagtctcttcaaacaacttttacaattattttgacaggttactgtgattttgttctttcaacaatacttagaatttgtctgagttatagttgcatagatggcaattttcctgacctagttttctgactatgatttatgggtcggtaaactctttaaatgatggaatataacatctcaggcggcagggaacacttactatcacatgctcattgttgcaggacggatgcgtggccagcctcaggttgttaaacattagggtgatccgccttccctccggggcagtgattctccactcgcagatccggccatgaggatttgggttcgggtagttgggagaagtaaatgttccaatagagccctgaagatccccaccacactctgacgtggggaaaaagccaagaaaactttcaatcaaatcaaaatgtttccttccatcaagaaagctctcaaaattcaggtatttaaaaattatccttctagataaaattagtctccatatttatttatgtgcatgaggattttagtgaacatatacattcattttttatctctattaatatttaaccctgccttccatgggtgatagtccacaggcagcaatttagttatcatcatggcccaagaaatgagagaccaatgaatgtaatgaacttaagaatcaggaaaatcgggccaggcatggtggttcacacttgcagcactttgggaggctgaggcaggcagatcacaaggccaggagttcaagaccagcctgaccaacatggtgaaatcccgtctctaataaaaatacaaaaattagccgggcgtcgtggcgtgcgcctgtaatctcagctactcaggagcctgaggcagaagaattgcttgaacccgggaggcagaggttgcagtgagctgatatcatgccactgccctccagcctggacaacagagcgagacactgtctcagaaaagaaaaaaaaaagaatcaagaaaattggccagcagtggtggctcacacctgtaaccccaacactttgggaggtcaaggcaagaccccatgttcacaaaaaaaaaaaaaagaggaaaatcagaaagttaatgttaagtacccagtttttctgaacaagatctttatttcatttgagtttgttgggtttgcagtaagacaaattctgagtaactacaggactctcttaaggtgggcattacagtataactctcatcctcttattatctctctcgtgatactagttattttcccttatagcattgatcacagctgtaatttttcatttatcactgtgaatttctgattaaggtccaagaaaataggggtcatgttttgttttgtttttcaaatattttaacactggtgcctagcatagtgtctgtccaatgcaggtgctcaatgttgtgttgaatgaatcaatgaactcaccttccatactggattcaaatcgcagtctgaatcctgaggcagtcacagagccgtctgtgacaaacctgaccacagcagtattgctagaagtgtctatgctgtcaggaatggtgtttccacagtatctgcccaagatgtttcctgtgagagacaaataattaaatatacatgtccaagtgattgatttcctttaccctctattcaaggtgtcctgtgtgtacaaagaaaataataaaaaacaagaccctgcctatgaagaaacgttaatctctgtcaagacaacaggaaaacatgaataaaaatgaacatattcaaatacatgaagaagtgaaaaaaatgcaaccaattaggggaaggatatctcagcacaatgaggaaggcttgctcatttggttgaaaaaatgatctgagacaacagtgacaagtatctgccttatgctaccactaggagacatgcatgatcccttccccatctcaagctatagaacacccctcaaataacggcatgtggcaatgggatgtctcagcagcaagaggtgccttcccactaccgttgctctccccaagtggcctccagggtgggctatatgacacctgggctctgggcatccattgttaatggtagaattgagggagagaatcaccagtactgcccaaagctcattagtctgcacttctctgcagagtatagatgtgcttttgcctttcttggaagtgaagaaacttcagaggctgaataagtacatgtgaaaataaacacccaaaagagagcagatatattttactaaccagaggtatgattgtcccagatctccacgaagtctttttcacagccagaagaattctgaaggttaaagtcttcaaaagagatggtgagatagtgtccagagagcccctggagatgccactcacagaataagttgtctctgtatggaagtgttggatgtccaatgctttcaacaacaccactttgccctggtactcttcccccacactgagctgcaaaaaataaaaataaataaataaataagaaagcaagcaagcaagaaagattgattctattacaaattttgttttcttcatttcaccagcacatttgaaaacttttaggtgccaagtgactctgaattgaagttttaaaaattctgaaaacggttagtgctttcctcattatttgaattctactgttgatgtaaacagaaatgataccacaagtccaatacaataatgggaaacagaagatgatgactaaatggaatattctgtaatgtcacattaattcttttgggacactatgtaagagctaatagtcgcaagtaagtttcatctcaagaaccaactgataggctgatctggcctgcctagtaccctgtgttgatcctaaagactgaacccaagctcagctggaaggggtactgtggggacacctgccattcctagttttactctcaactaaacagttcactacagtaactgatatctcagggccttgaaaattactattcaattatgtcttattagctgggtgtgatagctaattgaattatatgcagcttgactcaggatataacacgatctatggtgtagttaaacattgttaccactaggctttctgaactttcgcggtattaaatatttgtttggtttgtgtctaaacctattagataccaaattatgtgctattgtgaccatattatagtgaatcttcaaccgctcattttttaaataaggaaatcaaaatgctgaagaggcatatttgctttctttttttcttttctttttctttcttttttttttttttgagacagagtcttgctctgtcacccagcctagagtgcagtggcgcaatctcggctcactgcaacctccgcctcctgggttcaagcaattctctgcctcagcctcctgagtagtaggaattacaggtgcccaccaccatgcctggctaatttttgtatttttagtggagacagggtttcaccatcttggccaggctggtcttgaactcctgacctcgtgatccacctgccttagcctcccaaagtgctaggattacaagcatgagccaccatgccccactgacatgtttgctttttatccagtgactgatttggcactagagactcagagaaaaaaaaggttaattattttatatttgatgaggaattcaaagacactgtgctaaatagagttacctggttcttaaatggttttattacttaaagtaataaacatactgcatttcttccttttccttgggggatacattccaagacccccagtgagtgcctaaagcctcagatagtaccaaaccctatacagacatatagactgtttttttctctatatatggacctatgataaagtttgctgtataaattagacataagagattaacaacaataactaataataaaatagaagaatcataatagtatactgttagaaaagttatgtaaatgtggtctctcaaaatatcttggtgtactgtactcacctatttttgggcctctgtttaccaagggcattgaaaccatggaacatgaaaccatggataagagagaactactgtatttcatagtaagctgaagaaacaggagtttgatttaaccacatatatttcttcacaaataagttagagaaaatataaaatatttaagtttactaagattactttttaaaatgaaaattaaaagagaaattaaagttgattaatgactgtagtttcaaacatttacactccttacttatttctagcattaaaatatttttaaaattaggcaaatagacttatttttaaaaagtcatggtttttaaaaaagttttaacatattcattctataataactcttatttaatataaaaatgtttcccagggtttttatagtttcgtgttttacagttaagtctttactccatcttgaattaatttttgtatatgatataaggaaggggtacagtttcaatcttctgtatactgctggccagttctcccagcatcatttattggatagggaatcttttccctattgcttgcttttgtcagctttgttgaagatcagatgcctgtaggtgtgagaccgtatttctgagctctctactccattctattggtctatgtgtctatttttgtaccagtaccatgctgttttggttactgtagccctgtagtatagtttcaagtcaggtattgtgatgcccctagctttgttctttttgtttaggattgccttggctatttgggttctttttggggtccatatgagttttaaaatagttttttctagttctgcaaagaatgtcataatagtttgataggaatcccattgaatctgtaaattttggggagcagtatggccattttaataatattgattcttcctatccatgagcacggaattttctttcatttgatagggtggagggtgggagaagggagaagagcagaaaaaataactattaggtactaggcatagtacctggctgatgaaataatctctacaacaaacccccaaacacgaatttacctatataacaaatctgcacatgtacccctgaacctaaaataaaagttttaaaaaaattattacctatagaatacttggccttgaatcccacatgtgtggggctgttgtcagatcgaaatctcaaatacataacctctcctgaggaccactgactgctgggcaaagatgtcccacaaaatttggaaagtattggtgcatccgaatccactccatcccgcaactcaaggtagttggaagtacagctgaagtgggaacaaaattctgttaaatttacatggtcagatgcttattttgataatgacaaccttacttactttctttgaagatattattaaatcatcatttcttagcataaaaaactatgatagaatcagcataagccatgtcactttaaaatgctgtatgatatttttcctaataatacattcttttattagtagctcaaaagacaggttttacatgttctacattcaagaatatttacttcccttccatattctgtattggttttacaaacataaatgttgctttcaaattagtccctaggaatttcaaaaaacaacaaatattttgttccacacaatgacttgatacatttcacaggacaaagataaattctctaacagctctgtaattgggactaatggagcgtcccaactggaattttctgtgtccataaaagtagataagcatgtatctaacgtttcttcaggaagtcacattagccaattaatgctccatgagtggaaaagtagtattagacccagtgccagaaatagcaacagaagatcttatatccaagttttgcaccacagctgcattcatgcaaatgtatacatacttttgttcaaggaaagagaaaaatgttttctacgatcaatatagtttttctttctcttcaacatagtaagacttactgttttgtaatcctttcagaactcttattaaataaagactgagaaattatactgtgcatgctttagtactgttccgacagtgctgacccctggtgacacaccacacaaattcccatttgttaaacagacattttatcatttgtgacaccgaatatgaggctggtcaaataaatattcatctatcagaaacatgatatatttcctgtgggaggaagaatggataacatcaatctcaagtagccaccctcagtgtcccttgcaggaagtgtctagggtcacaagggacagtatccacgtacataaccggctcagctgatgggagagtggctggccgactgtgttttcaggcctgagccattaagcatttcccttttcccctagatttccttgcagtatgtgctactgaaagaaatggactgttttgagacatgacggttaaaaaatactaacttggggtaggaaaaaaatgaaaatggaagtgacatacttgggtgttacttcaatatcgaatcgatcttcaaattgcagctgtatgcgtgtttccggtggagccgctaagatccaaatgcaatcagcgtgcgggggataattatgagggtggttgggggaggtcacatacccagcagaatcagcatcatggatgtagacgttgcccccacaggctgtgagcaaacacacttaaatcagtctatgatctggtgaaggggatgcagtcaatggccacaaatcatcttttaaagtcgacttctctgtattttgtctccatttcctttcatctgttatgatcctcattttcttttccagcaaacaaattctcaatttgctatcgagggagctacgaggtgtgacactttttattttgccagaccatttatctattctcattggaaatttcattctttcttaaagccaaccaaatgattatggcacatggtgcacggggcagaacatcacagaagcatgaataaatatccaccacttcgataagcatgtaagtatgctagcagttacagcttcccactgagcattcagtacagcagaatgatgcagagctatgatcttggtatatttaaaagactaagcagatatatctttgcacaactcggggagcattcattcattagatttcttcaggatttagatgcatttgagaaccaagatcaatggaatgaaataatttattagtaatgttatgccagaggataaaggagctttttaatatttcttttctaaaaaaccaaagcattatcaaaaaatatttttctattatcaataaatattctttggcattttcaacaaacaaaccagataggagtaaaagtacttacaatgccaatgaaattaacctgtccaatcacttagccatacacatacttgatctgctcaactctagaacatttgtgtccactgtcactcatccacttacagtcacatcctgaattctgtcatacttccaactcccccatctctgaaactctaaattgcaaatccctttgatgagctccaactccctcgcttcgtgtctttccttcaaacttcccttgcaaaataccaactccgtggttgtgttcaattcaagccattcattcatggaaattgatgcccctgcaaatatatgttctcccatctcaacacagccaagcaattcacccattacttttcatataaactacaatggctgtttggaactttactccctaagcccttgactttccccatttcctcttgattctaagcacattacattaggctccactttacaaagaaagtagaagaaatcagatgagaatctcttccatttgttacccctaatttattactatcctcaataaattaatctgcatctctacactctatttttccctctgtacattaacttcctgtatctctggatcaagttcccatcctactgtctcctccaggatcttgccctatttaatctctctctccctatctgtctgtctgtctctctccttctctctttttgcccttccttcttcaaccctatgaaagcactcatgttctcccaagtcacctcacagttatatgcccaaagaactttttaaattcttattttatatccacagcatttaacacagttgatcacactgttcttctttacatttttgtcccttggcttctgacaccaagctcttctcctccttttactcttcatgtcattcttcctctggcccttgggcgcatctctccagggcttccctgacattgctggaggccctcaggaatcctcctgtaggcctttcatctcactctgaataattccccaattgctgtcatacatcctcatgacttaaatgataagcagtctgttgattattccgtatttacagattcagtctagatccctgttctgacctcgagattcctgttccgaccacttactgggcatctccaatggaggtaattcagagatttcaaactgaacttgtctcaaatgaacattctcatttgctcgtcatccagagctccatacctgagtctgctgatgacagcatcagcccctcttcctatggacactctgcatccactcttactgccttatttttctccttgatacctttcaccatatggcatattatatattttacttatttattgtctgcatcttaacactagaattaggttccatgaggacatggattttgtttgtttactgccacatccccggggcctgatacagtgtctgtcccatggaaagttcttgataaatgtctgtgggaagaatggatccacccagccaaaaacctaacaactgctcctaaggctcctcccatcccttccctcctgcctcacatccaactgaccgccaaattcactcaatcctgtatttataatatctttgatatgccctctctcctaccttcttactgccattgccttagttcagggagtaaattttttccctaaattactctttcatctggtctctctctcttcagccttccccatctccaatgttttcagtgttgcagctacattagtgtttttaatctgatcacgctgttcaggctttggagcaaaaacttccaatgcctcccataaccttttgattaacatcttaactaactgagggtggcatccagggccctgagcagagtgattcctgcctgcttcatcactattatgtttatctctttttgactctgatctctagcagtagtgaattctttcaaattattgaatatgacttgtaacattgagattttctatgcattcacatctttttatcactgatgggcaaatctcttcatccacttcccctggaaccctctctgatgtcctgggctgaagtaggtgtttctgttctgtgcattcctctttctagcacttattataccatataccatgttctttttttttttttttcctttgagacagggtctcgctttgtcactcaggctggagtgcagtggtatgatcgtggctcactgcagcctcaacttcccgggctcaagtgatcctcccaactcagcttactgagcagctgaaaccacagaagtgcgccaccatgttcagctactttgaaaactaaggtctttctatgttgcccaggttggtctcaaactcctaagctcaagtgatcctcctgccttggcttctcaaagtgctgggattacaggcgtgaaccaccgtgcccagccttatatcatgttctaattgtgcctttgcttgtctgtctcctttaccacactgtgaactccttggcagaactcggtggtttgcatgatgtgaaacaccttgtaaatgtttgactaattaattaacaggcctattaatcaggtgagaataaaaggcatctaccacagggtcctagaaatctcaatcaaccatagcgaaggagtgtctctggagaaaaatggtataaaactaggtgatttgatgtcaaaaaatgttcacaaaaggacctaggttaaaggctgagaagtgggagtggcatggaaatagatatggtgggaagatagccagatagacgtgggaagtagaaggctggctatagttatggaacaatcttgagttggtaagtagagagaaataacagtgatgctgttgtttcaggttgccaagaacaggttgtgaaatcaaaagacttttaagtctgatgttaacagcagtcataataagcttcaagaaagacagggagaaagtaatggccataaccatacttgcatgaacagtgaatccacaaaggaatagaagaggtgcaatgtcaaacacacccttagtgtatctcttagtgtatctgaattaccactaaatgttgactttaaaaatataaatcaaactgagtctattggctgaggacggtggcttactccagtaatcctagcactttgggaagccaaggcaggtggctcacctgagctcaggaattcaagaccagcctgggcaacatggtgaaatcccatgtttaccaaaagtacaaaaattagctgggcatgatggtgcatgcctataatcccagctactagggaggctgggtcaggaaatcacttgagcctgggaggcagaggttgcagtaggctgagatcatgccgctgtactctagcctgggcgacagagagaccctgtctcaagaaagaaaaaaaagactgagtctattataaacaaaaacaaaagagtagagttatgtaggatgggtaggatgggctgacgtctactcactagactcaggacactgctactcttgaaatgctttggtaccaggtgaaaactgcccattcatgactcagctgcaaagctcagcatcaagagatggagggatgagaaggtcccagcttagaaagcaatggcgcgggtgcccacagagctgcattaaagctccctccttgtgccagagctctgggaagtgaccaaagctccttccctggtgttctggaccttactcaagctatttgcttatttttgtgtgtcagttggtgaagactcttattcatctcttttaccaaaataaagaaaccatgttgactttaaatctcatacaatgtgcaataaaacatatgatttcatttacatatatatatatatgaatctgggattcaagtcataggatcattttgaaatctatattatctaacttctggtgggacaaaggaaaaatttattattatattactttctactgacattactccctttttttgaagtgatgcctatttatttatttatttattcaattaaacattactaaaaagcaaatgtcatcaaaatcaaatcattacagtagaattaaatgcaattataatcaagtgtaattaagtacaagcaattacagatatcatgtaatatataattaaatcagtaataatagaatcaaaaaattatgtgttcttttgaaaacagcatacaaattattacaaaataaggcaaatgtaagtcttataatgtttctgtaactagaattaacttacaattagacatcttataatggaaaggtctaaggaattccagggatcaagaagaatagtttattttatactcatggaaaatttcactttggtcactaattaggtatgtggccttggaaaagtccaagcctcattttatttatctttaaaatggaaataatgatactttacttgaaaagtagtcacgatgagatattgaatgtatcaaatataataagtacttgagagtaggcattcttattaattctattactgttggttcagaaaagaaaattttatatcaaagaagatcaagcaattgcaggaaaagcagatataattctcagtgaaaatacttacctaaactctttgcctcatatttgattttaaatccttgcccttcattactgtgatcagaaataaactgaacaaacatttgattatccgaggtgaacagagttgatgaagcatgactgccacaaaaatgaccatttcctccagggggtcccaagggtggagaacagatatcaggaccatttcttagctggaaagacaaattaaaatttcatcaactcctttacattgcaaaagaaggagtacgcaattcttatccatttatgtcccaggagagaaaaattatcattttgttttctgaatgaagtctatggaaaatgtaattagaaagggtagcagcaagacctaccaccaagtaatccccctggttgcaagaagaatctccatttggaatctggaaaggctgttcaaaatggacagcaatggtcaggccactttggaccaggacgtgccaagaacagttgaggttggatgggtaagtctctggatacttgggggacgtgatgatccctctgtctgcatgcaaatatccaccgcagccttcccacaaagaaacaaaggtcggttatttaaatagcattggcaactggatttttatgctttcttagttttcttggggggttttcaaagtggaggcaataaaaatgcttgaaaataaagccagagtgcaggaaatgattatcataacaagcatgtattgagcacatgctattggctactcagtttgtggtggtcattgagatctgggatacagaggtaagtaaacaagacaaattacctgctttcataaagatttctttatagatggggaagacatacaataaacaaatacatgatatgtgagatggtgataaattctataaagaaaaatggatgagaggagggagaagggtactttattgttagagttaagttagaaaagccacgtcattggagtaacatcttagcagagacatgaatgaaatgaaggatcaagccagatagttatgggggagaaaacattccagttcagaaaacagtgtaaaggcttgatgtgttagaggtacatcatggaagtcagaatggatgaggcagaatgagagattccaaaggtagcatggctaggtcatgcaggaaactgaaaagacttattctgaataagaagaggaagatgttgaagggttttgggcatcagaatggcatgatctcacttaagtttgaaaatgtcactctatgtgcagtccttagactgtaaggggtggaggacagggaaggacaggagcagagtgtccaataaggaggggaccgcctgaggccaaggagagatgataggtgcacgggctaggctggtagcaacagaaatggagaggcgtggttggaatctagatacattgtgagggtagagccagtgtgatttgttgatggttaagtgtgagacaaacagaaaagtcaaaaataacatcaagattttgacttaaataatgagaaaaatgtactttccatttgctgagattatgaggagtgtagaattggggggtggtggcatggaaaagggtgggaataaagtgttcaactttcaaaggtgaaatttttttttctatctatctatctatctatctatctatctatctagtctaattgggatacaagtggtttttcgttacatggatgaattgcatactggtgaagtctatattttagtgcactggttccctgactagtatacattacacctaatatgtagttttttatccctcataccccacccatcctccccacttctgagtctccaaagtccattataccactcacaggttaaatttgaaatacattctagaccgggagctgccaagtatgtatatatacatagacacacacacatatttatatatattatatacatatataaacacacatattaattccaatggttccacccttactatatacatacatgtgtatacatgtatgtatgtataatgagttgcgatacatagtaatatatacatgagagtgagagggcaggagataaaggaagaggataaaaggaggaggcattaattctccagttgtcagggaccagaagctcatcagtaagggcagacatctcacacagctagttaaattgtagaggtgaaaatgtatcttaggtctagttccaaagcccatgctcttaagccactatgcagcctgcctcccttgagcgtgaggaacacaacttatcttcagttgctccctactttataaaaggtatatataagcatggaggaaatattagattaatttttaatgttagattgagaatctactttaaaattatgttttttgatcaaaacatgagagtctttcactcttccttggactactttatcacctttcagttagtttggatttaaggctgttactggacttcacatgtcaagtttgaaaagtctcaatcatactgtgcatgatggtatcccatatatggtgcccgcttttgactcatcaaattcatatttcaagagcaacaaactcttcctgccaaccctcagatggctgacttcaaccaagtaatttatgagaataaatgatgacgttttgctccttcgatgagttatggatatgagctgtgctctatctagttccagccctcagctaggctgaaaaattgctttaaagctctctctcatgcattccctggacacacctcctttggagcgaagatgccacaccagagacctgaaggcagcacacttttgtacgacttggccccagtgctttggatgaggactcagcactgatgtaaggggagccagccatccagagcctgggcagagacccatgtcctctgacttgtcttgtgtcctggtgcccaaaaacattatattaggaagagagaaagagagaggaaaagagaggagatgagataacatgggattaaaaaatatttgaactcattactcttgtgaaaggatgcattgaagcctgccctggttacactggagtccgaggtgaagcggatgaacatgtactctccagtagaccggatgggcccagggatctctctgccacagagaactgctagctgctgggccaagttattatctcctacgttgaaagaaagggaacaacatgaaaatacatcttgagaatctactctacaatcatttgcagcttagccaaagcagctcacacatttttctcagaacatcaggactcgtaggagataatgggatcctcaaaaagaaggacccctcaggggtgatatcattctggctccagcttgcaatggtgcttcctgcccttttctttacccccaccccaccccacccccccctttttttttttttttgagatggagtcttcctctgttgcgcaggctggagtgcagtggcacagtctcggtttaatgcagcctctgcctctggggttcaagtgattctcctgcctcagcctcctgagtagctggttttataggggtgaaccaccacttctgactaattattgtatttttagtagaggcaggggttttaccatgttggccaggctggtcttgaactcctcatctcaagtgatccgccctcctcagcctcccaaagtgctgggttctttaccctttttgataaagacgtctttgacagtttccaccgtctttctaaaaactggctgccagttctccctgtcactaaaactcaaaatcagagtacctgggattgggaagcgatggagacccagtgatgatatgtctgtcgattagagactctgacctcagttactctgattgctgaaggtcaagtaggtaaaagaaaaaaaaaaaacagttggctctttgacctcagatcctacactaatgttacaatatcattcaccaaaaggtatgcaattgtatgtgccctttcttcagtgccagtggggtttttttaaacaaaacttttcatctgtgtttgttcattgcttttgtttgttttggtataaaaacaaccacacatttgtgtggagggtgagagaagagttccagcaactgtgccccacccccacagagacacaaaggacagcaggggcaccacacgtctcctttcatcttgattatcttggatataagctttgatcaaagcccctgtgccggctgaaaccaaaatggagcaaaggggattatagcagacttggatgccgtggctgggaaaatatgttgtttttttctcttttgtcctaaggcagagaattaataaatctcgagtttataaaaaacaaaaatagaatatgagacatgagtaaatatgcccttttatacaaccagccacatggattctttgtggcactgactacaacttgaaactcattcattattaaccactttagaaaataagttattttctattcttgtgattacaaatgtaatggcagagttataaatacaaaatgctcaaaatggcattctttggagggtttctgatcgctggaaacttttgcattctttataattcaaaagtgtatctcttatagttcttttgcatttatagtaagtgcacttcattatgctattttgctacacatttcacccaatattattttttgttgacttattctctgattacctgtactacaaaattttgaagtttattatatgttattagttcacgtgtatattttatcactggatgaaagtgagttgagtctattgattttgatttcttttctaaaattcactccagatcatctggtgaaacaatgcttatctcaaaataagtgcttgttgattagcctactcattagtgggaagatgacccaaaaatcacagatggtttgttacttgcccatccaccccttcagtcttcatactgagtactggggtatttctggagccttccaaaacctcaacatatagattgcagaaagattgagcctaatcttgagcctaatctttaaagaggaggggaagtcaaagaacagtaaaggctagcactagaaggcaacttggcaattctttctctagtccaacctcttcaatttacagatatagacactgaggccccaagattattcaagactgacatttattgagcaattagtatatacccctttaagtgcttcacatgtactatctgattttatgttcacagtgacactattaggtgggcatttatttttatccccattttgtatatgaggaactgaatcttacaggagttacaagccactttgctgtatgcaagggcatagagatagaagttaacagtgatgttaacctttgcagattaacctcagatgccccaaaaccatgctattaaatgatttatctaaggtcatgaagaaagtacacttaagatctggaactagattaaaggattactgatttttttatacaatttcttttctatttaaaagttttgctaggaccaatgtagtttcatggactctcagtttggagggatctttggtatacagaatgggtagatgcgtggtctggaagaaactgattcattttgaaccatggcaactctataaaatgaataagcaggtgggacagtgactcagttctcccaagaatgctgcatgaccctctctggggtagcccaggaaggttcacagcctccatacggccaaaggcctgtgatgacaggccaattgcatgagcaggaatagcctataagtatctttgtctgtggccagttggctttagatatttgcttcagaatgttacatgcttctgctactcagaagcaaaaggctggctgggcaaagaacaaataattgaagtgggatttaaaatttagtcataggccaggtgtggtggctcacacctgtaatcacagcactttgggaggccaaggtgggcagatcacgaggtcaggagatcaagaccatcctggttaacacagtgaaaccccacctctactaaaaatacaaaaaaaaaaaaaattagctgagtgcggtggcgggtgcctatagtcccagctattagggaggctgaggcaggagaatggcatgaacccgggaggcagagtttgcagtgagccaagatagcgccactgcagtccggcctggacaaaagagtgagactccgtctcaaaaaaaaaaaaacatcaaatttagtcataaaaatatattaacaatgtgtaaatgactacaatactcaccaactgacacagaccaggcactcaataactatttcttgaataaataattaaacaaatgaggaaggaaggaaccttattgagcatctactcacattgccagtgcataaaaaggaatccatacggaaaggccgcataaccactttaaaacatttgtgttgttttggcacgcacctgagtttctttagctctttcaagccgccctgtgcctgagcaagggcactgattaaacctctcttagaaatttccatctaagtaaactgaaatctaaactattccaaattcatcatctacaaaatgcttgtacttttgctaaaaagatttcatttattactttccttaatcctcagaaaaagcctgtgagggaggtatttgtctatctcacaggtagaacgggtttggagccactttgtgacctgtgcaaagccacacaggaaaaaaggactgctccccagactctctgcttccaagagaagttagtgatggaacaaaaacaactcaatggaatgtgattttaaaagaataaccataatttacttcatagatgcagttacctacttaagatttttttcaaagatattttttaaaacttctagtaggttctgaacactagaatatgtgtgcaaggatgcacatcctttccattacatgaaaagttttaaatttcagtatgcacaggaaggcttagatgtgaagagggcattctggtgctttgatactcctctgtgcaacgtgctgatagccgattgctgatgggaaaaagggggagtgtcatgctttgacatctcatcatgtgtgtatgattgatttgagtctctacttagtgttctgcctctacagaagggacataaagcaccttcaccattcgatttttctcactcggcaggggtctagggatcagggataagggagacaagatcttgcacactagcaacctgtgggccaaagacaaacacgtttctttttgctgagaacatgtacatctaacaaatgatgctgtggatctgggggccacactgagaaatactgacgtggaggatgtggcctttctgctgtcctccttcattccagtccatgcagactgtgaagcccaattttgtataaggcatacatcagcaatatttatgtctctaactttatgtcacatagcaacaccatgcctgtgtacaaaggaaagaatacaacaatatcaccccttaactctacctattctacccacattcaggggacaaagagaaatgaatacattactattttatattcttcttattattattttagagacagggtctcattctgctgcccaggctggtctggaactcttggactcaagtgatccttctcctcgacctcccaaagtgctgggattatggtgtgaaccactatgtccagtcacattacaattataagtatttttttcagccagaaacataaaatatcaatatttatctcagaggtatctcaataggacaggtgaacaatgttgacattcagactattctttccttcttaagcctctaaaaaagccttttttccttatagaaatgtgctattcctgatattctgtgaccggtaatttaatactttctatgtccttcagaagttgtagccatttctggtactgatgccttccttgaccataatatctgtgtaattccaaaccaaacggatggaggcagtatgcaagtctgatgataatggactagaactaattatgtgtcagggttgaaactcagcattctttataatgttctcaccatctcgtatcacaaggctatcataggcacacgttcggtgagattcaatgtccagggaaagaatgttgagttccacggtagagtcgggagcctggatgagccacgtacagtccactctattactgtaactgtcaggccagcccggggagaagagaaacacgggtgcatctcccgtcctcaggaagccaccacaagcacctgtagaatagaaagcaacatctttgacacagccctaatggaaaagacgctagctagcactttttcacttgaaagtgacagccctctactgaaaagaagcaaccaattgaaacaatttctcagagaaatcaatgaatatcgtatgtaacccactgattcggaaagctgcaatttccgcaattgatctttgatgtaaaaaaaatgcattgtgttctccattttcaccataattttgctatataacccatttaatatcaagtgctgactatttaggcatcaataaagacacgtagaggatcccctgtattactgaggtagaactgtattcattcctgtgtttctcatgtttctttatcatttttgcgtagttacttttgtaatttatatctaggcaattttgagttgacagattaggtccttctcggggtctatttttgggcatgtgcacagctgggctatgtgtgtggccttctagatttccagaaacatgtcggagcttttcaaagccccagtgggcatctccttccccattttttcctttcaagtttactggtcagtttctcattagctgtaactggtgtcactgccttgcacggttgtgatgtgaaacagctgttgctgattgttttcggcaaagaccccagggacagggctgtttacaaaagagtgagctcttgcccaggtcctgtgaagacaagacctgagaatgcagttttccaggaagttgctgaactggaataatggcaatgctgaggagatgcgctgttttctggacctctgcggccccaccacccacagctgttaaagctgctcattttcacagctactgtggtcatgaggctactacaaagctaggaggagagagagagatgggaataggaagagaatgccacaaaaatgactcttacttagattcagtgatttttcttgaataaatatgccgcagattgctataaggctttggtctatttccagagttctcaaaaagttgattttaacaattatttttgccatcacttttatgtagcaatatatttcagagatccaatcttcaccatttcagaagtttacaacttgtacaccataatatgtttgaatcttatcagggccaacaggaagtgaatataaaatgttgtagaactaggtcctgatttctttaccctattactatgtaggctacagatttttttaaagcaatttcacatggaaaatctgaatgctgaatgttatccagtatcttcaaattttaaggttttcctctatgtgaaatatttcttatcttgaatttgtaaaatatggttataatgactgtgggtcattagtgctgtttgccaaatatttcctttgtctccacttccaaacacatggtagaactgcattctgcaagtggctgagagaggccatttgaccagttttggccaatgaactatgagcaaaaggcatgtgttactttacagtgagcacttttaaaccgagacatccaagggctcttttgcctactgccatggtctcaggcaatatcgcagacaatggcagctccaacagcctgagttaggaagtgatggatgatgagaggcacccagttaacacgagaggaacatgtagaaggagacctgttgttttcagcacctaagagtttgaaattgtttgttaccgccatatggctgagcttttcctgactgacacactgactgcttttcctacttgacacattgaatttccttcagttgaccctagtccacagtaagctcatttttcttcccttgcttatttgctactgttaccatttgctttgtcatgtacccatttaattacgataccattacttaactcacatatgagtgttttttctttcccaatctcttttatttattatttatttttactatttatgtatttatttttaggacagggtctcactggagtgcagtgtcatgatcactgctcactggcagcatgtaggctcaagtgattcccctgcctctgcctcctgagtagctgggactacaggcatgcaccaccatgcctacctaatttttttaatcttttgtagagatggggtctccctctgttgcccaggctggtctcaaactcctgggcttcaagcaaccctcctgcctcagcctcccaaagtgctgggattataggcatgagccactgtgcctggttcccattacttttaagctcctggagagtagagattgtacctcattttcctttcttagtcttctcagtgtatccataataaattctcaataaatatgcgttgatttaaaataaatatatgtgtgtataagaaatgctgataggacaggacggatgcagtggctcacgcctgtaattctagcactttgggaggccgaggtgggcagatcatgaggtcaggagatcgagaccatcctgcctaacacggtgaaaccccatctgtactaaaaatacaaaaaaatcagccaggtgtggtggtgggcacctgtagtcctagctacttgggaggctgaggcaggagaatggtatgaactcgggaggcggagcttgcagagagccgagattgtgccactgcactccagcctgggcgacagagcgagactccatctcaaaaaaaaaaaaaaaaagaaaaaaaaaaagaaagaaatactgataggacaatgctcaataagttgacatatttcaaaatattaaggttttttaagttttaatgacactttcacagtgtggtatcattacaggataatcacttatgccatctagataattagtaaactctaaaattctcttgaccccttactttccttttttctttttcttcttgactaagaaaaataaggtttatggctctcttcttcacctgtccacttacatcatataattatgaaatttcgtaataaaatattagaagaaaatttgttggtataatattttacacaagtaaataattccttttctaccttgagggttgtaaatataaaagaaagcttaactcaagtttatttctaagagctctggatatatccatccagatttaaatgttgcctctaaattgcatttgtcagtcttgctgatggttctttgctcttagatagacagatcaatattttaagtaagagatttgtattcagtgtcatgaaagcaccttattagagaggtaggaacaacatttcagaatggaatactaagggacattaaataaatataagtacaaattatcttcattagtgacttctgctgatataagaagttagaagcaaataggctaatcttttaagtcatagaacaagttcagagttcgaatattcttcaatgagataccgtgattctgtgttccaatcaagcattcaaggacttagaatatcctccaagaaatatctgattaatttcttctatgtcaatcctgaaatccataagaaacgctcaaattcatttaaataaattgcttttcttttcttttcgaaacggagtctcactctgtcgcccaggctggagcgcagtggcatgttctcggctcactacaaactctactctgcctcctggttcaggcaattctcatgtctcagcctcccgagtagctgaggctacagacgcgctccaccacgcccagctaatttttgtatttttagtagagatggggttttgccatgttggccaggctagtctcgaactcccgaccacaagtgatccgtctacctctgcctccaaaaatgctgggattacaggcatcagccaccgcacccggtctcatttaaaaatttttcaagaaaaaagtctccccaaacaatgctagctcaatatcactttcactgaggggattaggaatgtaaaaaagtaaaataaaagtttaaaattcggcccattttactttgaaacatggaaatttacaaccagctaaggagaaactgaagcatttctgaagctacatttgaaataaaatgcagaggaaaaatagttacttttatgagttgatccttaactaactgattgtgtgtgtgtgtgaatgtacatgtgtagtatctgcaaatcaaattttcagggatttctaaagtggtctctagaaattgtaagtagacgatcttatggatatcaagcccctaattaatataaaaaatataatgggacctgcattttttagaaagaaacgtacaatttctacaaaaggtagtgtttatgaatttaaaacaacatctgaacatatggtggaagggctttggggctgtacttatttttatatctgacccctgttatgataggatcctttgaaacattggcctgcacatatcagtcctaaaaagaacttcatttattaccaaacacacctggagcaatggtaggtaaaacaccatcaggtgcatccactgcaaaccactccagaaggaatcccttccctgagattgaagagtcggagtaaaaatgaaatgtcaaagaatttccagtggagctgaaagattcagtctgggtaccacagtaagctccaattaggcgggcgtgaatgctaggcccatcatagatctgtacataaaaacagataatagagcattgtattatctatatttttcttcataaaaagataaaataaaaaagatgccttatattattacaatgttatcataacaaaaaaatgacaaatgagtaaacatttaattttagcttaaaacacatactgccagagaatataaaatattattgaaggtaatttaatgttttgaaaacatttgcatctttgttgcagaattatattaataaacatgcactgtgggaatcactcataagatgatttacagtaaaatttgtggatggaaaaataggaaccaggatggttgcctaccaacagtacttaataaatgtgctttggggcttcaaagggaggaattaggaagaaagaagggaaaataacaagaagagaaaagctttaatgagagaaagtggacaggtatcctaaaggagtccatatttccacagaaggaaagaagaattaatgacaacaaaatagccaaaacttgtagggctcaccatgttcaaagcacttagtaaatctcctacctttggttttaaaatctcaaattacctattttgaggcatattctgtgataatttttaaatagctcaggacaaattcatatgaacagttattataaaatactctaccaaacaaattatgtaatagtcattcccatacatattgggcacccatcaggcactgggatctattcatgaccaagaatccaagatgaataaggtggggtcatagcctgtaagcatccgattgtgtttctggaactgatatggtagccaatgtctggatagcaatgatcaccatgatttttatatttatatttatttttatatgatcattaaaatttttaatactctaacataaaaacaaagaggatagtaggaaataagacagaataaatacttatttaggacatacatgcatgcttagacaaagctcaacaggaaaattataataatcctaaaaaaccccttagatatgaaatggaaaataataaatacaatactgaaattgcctttgtccatgtaatctagaggcagtctgctctaaacatgatttagagcagactatcccacatgatttgcaaatgcttgaatagacgttaccttggatttatttttaccaatagcaattcaccaatatttatgaacattgattgcatgtggaaactcacccttaatttgtcataatagcagttttgtatttcttctatgtccatctccaagattctaccatggacaacgtgagatgcattcacatttactgtccattggtaattggagttatgtgggtagttttcaggccagaaaggagaggcgactttcccatgagttcccacaatattatcattgccaaatactaggagggaagacagagtagtaaatcagacccacttagaattgctctttaatcaaatgaaaaaaacaaaaggcaaagggtgttgaaaaggatggacttttaattgactgtgatttcttttctgactagggaaagaaatactgcctcctttttggtttctgggctatcacttccttagaaaaggtccttaaaacgttgcatggtgtgaaaagaggccacaacttcccatgtgaaaaggggttctgagcccctaggggacttggggacatgggaaggtggggtgagcagccccactctctaattttggtttatctattttactttgtttttcaaaagaatggaacatttaaagaaatttacaagaaaaactgatagtttgaaattacatatgaaatagccaataatggaaaagttgagctagagaataaaaatatttaacattttatactattagaagaatcccctattgttgttatatgtgagcacttaagccaatcccaaagtaatactaaatgtcttaaatgtgaagaacgtagagtttatgaaatcaaatgaaacacacttgatataaatacaccaaacccaaactataatatattaccagactctaacacaacgtcatgaaaaaaactaatttaacattaggtagaaattagagcttaaaaagaacaatagaaccattgagagtgctctcccttgcccttattgagccattcatatgcaattcagtttttctaatatgttataaggtaattcacaaagacaatgtaggaaaatagtgtagagtttaggattgttcttgcttaatatattactgagaaaattattatttctagtttgtaagacatattctggaagctatcactaaaatagaaacaacttactcttcataaatgtggcctggaagcccgtgccgctgccagaaccatctgagataaatctgacccacagggtatgtccaacgatggaagaataattgagagggaaggagtttccacagtatcgtcccaccaagtgacccgtggcatttccttcacggatctccacaaaatctctgctgcagtcctgagagtcttccaactggaaagatctgatttggggaaaaaaatatttaaagggattaaattgagagaatagactttgggattctcccggatcacatgctaggttaacccgttcacttttttaaactttctttaactttgatcacaacattatttggctgtctcaaaaaatttctttcactcggacttgttgaaatgtgtatccaatagctacaaagacgacgaatacacttccatcaaggagttttcttcctagtgggcaaaactggacgagaatacagaaaaaaaatatataaggcagaatagtgtgagtgccatcagagttataaagtggcgtttaagaattgcaaagcagaggcatcatatttgattgtggtgctctgcaatagcttgatgggaagactttttgagatggaaatatacatgtgagctggatgtaagcactatagatggtgggcaaagaagcatgccaccaaggcacatgtgcagagaagggcgggacatattcagaaaaccacgagatacctggtttgtttaaaacactgagtacctctaagacatggtgtgggttggctgaaggtaaataataaaaaaaaagaaaccattaaaacatgtaactggggcaatatgatgggatcatttaggtggcacttaaatgcgctgcaaaggtgtatgtacttaatttctggagaggcagcaaaattatgggatttgtaacaacacccgctggtgcttgaatgtgacctattcaacttgtcttatattctgcaactacgatgtgttggggagtcgaggataggaaatagtatctacctcatatgatgttcataggtaacatatctaaagagtctggaacatgtaggtgctagttgagtactttcaaaacttggccttactgcttaaaaacatgagctactcaagataaagtggtattggtgtaagggtagacaaatggatgaatggaataggaaagaatttccagaaggggacccacaaatacactgtcaatccaattcaatccatggtgccaagacaaatcaaggggaaaactcattttaacaaatggtgatgcaataacggatatccttatggagagagaggaaaaaaagaacctctacctctgcctatcttcgtacacagaaactaacttaatatttctcaaggatgtaaatataaaggctagaaacataaagatcctagaagaaaacacggagaaaaatctttgtgaccttgggatgggcaaatatttcttacatagaatgcaaaaagcactaaccacaagataaaaaattaataaatttgaattcataaataaacatttcattaaagacatgaataagaaaatgaataggctgcgtgtggtagctcacaaccataatctcagcactttgggaggctgaggtgggaggatcacttgaacccaggagtttgagaccagcctgagcaacacagtgaaaccccctctctacaaaaaataaaatgtagctatgtgtggtggcctgtgcctataatcccagctacttgggaggctgaggcaggaagatggcttaagcctgggagatagaggctgaagtgaggggtgatcgtgccactcactccagcctatgcaacagagtgagactctgtccagaaaatatatatatatttaaaaaaatgaaaaggcaagttacagaccggggtggggaaatgggagataatcgtaaagcatttatctagcaagggactcaaagttgaaatataaaaggaattcctacagataatgaaaaaacaaccaaattaaaagtggacaaagggcttgaacagatattcataaaagaagacaagaaaatggctaccaagaatgtgaaaagtactctgcatgattagtcatcagagcaatgcaacttaaataccacagtcagatatcattccacacccatcataagggctaaaattaaaaggctgacaagatcaattgttgacaagcgtgcaaagcaactgaagtcttatatattcctcgtgggactgcatactgacatagccactttgaataattatttgggagtttctcataaaattaaatgtacatccaattaatgcccagaaattccacccctaaatatatacccaaagaaaataaaaacacatgaccaaggtagtatcctgaatataaaataactcctgcaactcgaaaattaaaaacaaataacccaattaaaatggaaaacaaaccgaatacacatttctccaaagaagatttatgaatggccaataaaaacatgaaaagattttcaaacattattagtcattagagaaatgcaaatcaaaaccacaaagagataacactacaaaccaccaggaagactattatttaaaaatagaaaataagaagtgctgatgaggatatggagaaattagaactcttacgcattactaacgggaatgtaaaatagtccatccctataaaaaagtttggtggttcctcaaaaagttaaacatagtattatcatatgaaccagcaatttcacttctaggtttataccccaatgaaatgaaagcatgaacaaacaggaaaggggaaagggtaaaggaaaaagggaagggaagggaagggaaaaggaagggaagggaagggaaaaggaagggaagggggaaggggaaggggaagggaaaggaagggaagggaagggaggggaacggaaggcaaggggaaggggaaggggaaaggaaaggaaaaatgtacttctctgtcatgtgtatctttctgttaatgctcaacattatccatggcaagattttactttatgctaagtatagtgctcccctggggctctatctcagctaatggaggagaatagttagagataaccagcctggaggctctgaccacctcaagccctaccactaatcaatataccaggcacatctctggtcactccctgcctaccagaccacaggggtgaagtaactggtcagctctgctctaacctagctctcaagccagatactagcattggtaggtctctaaccaaatcagtaagcctggtggtaagctggtggctctcagaatcccaccaaggtgggtcactacagtatagaccatctggactagactagatggaattttcacagcaagctataactgataattgaaatcaggatatatccacatcagacaaaacaaaccacatatttgtctcctttgacaatctgatgatttataacacaatatttctatcttcaatcttttttttattttgcaaggaattggtctaaatccatctttgggatggctgccaacttttgtgtatacattcaggctcaattttattactcataatatgatcaacaatgtgaaatacgcaaaattgttttcttctgcttctcagaaagcagaaagggaagaaagggagatcattttcctcagaacgtaaattacacgaagttgcctctaaaatctttctatgcaaagtgcataatccagcaacatcggcatcaccggagagcttgtttgaaacaaggaatctggccccaccaaccaactcagtgagaaagtgaatttcagcaagatcctagatgatcaacatgcacattagcattctgtccgatgctccagaagattacaaagtgaaggtcttttctaagtacttgactactgcaatccagtgctagatggcagaaaagacattccgttggacatggtggtaggcaaatacctagaaggattaaattaaactataaaaaaagctttattatgcttggaagtctttgctttaggctggtacattttataagcaactacaccctttggcttagatctgttagtaaatgtaggatgtggaacaaaaatagtacaatcactgtttcttattatctcattctgattcttgaactgagacctatcactttctaaaagcactctgcaagtataaaatacaatttctgtcaattccctgcccaccaaaccgcaggggtgaagtaactggtcagaaagattgcactgcactttgaatagaaagattttagagacaactgcatgtaatttaccttctgaggaaaatgatctccctttcttccctttctgctttctgagaagcagaagaaaacaatttaccatattcacatttttggtcatattatgggtaataaatggttaaatatatgtcttacaaaaaactcctttttaggttttatttctccccgttcctttttgttgcagattcaaccataatttctccagtcttcttccctactcagtttcaccacaatcccagccccatgttttagaacttgatgtgatacacatgcttctcatacgctctcacacaccccagggtaatgtttccaagcatccatctggatagaatttagaccagggcagaaataactcacaggccttgccttctcattaatcaactgcaaaaaaagaggcatcttgcagcctaaaacgtccattttaaaaataaaactcaagcaagtaactcagaggaatcaaaattaacttcttacaggcgagaaaggaaatagctgagtcattacgatgttctatatggtaattaaaatgtaatgtctattaagcactgaaatagatgaaacttgctttctgtgtgtgtaatctcccatcctctggaaggagagcctagtgctgcccgtttggatttatttgtgagctatcacagaagatacttcagaaatggtaaagattgagagaattaagtcaccaaacatttgctatgcactagctgtgtggtatgcgttttaaatttgacatcttctttaaccttcacagtcctagaaatttgaaattactataaatttgtttatagaaacttgttattattatcccacagaaataaaatgaatttaattaaatagcttcttaatgttggcttatgagtaatttgtcaagacctgaaatcttatctgtcttgaacacctagctcagttcctggcaaccactgaatgagagcagtcaacaatgtgaatgtggtagagacaaacaggaaaagaccaaaaaaaaaaatcattttatttggcaattctgataggcctactaaagctgtgcgaagggctttggattttattctaaggacaatgatggtgttttattgatcaatatatagaaggcacctcataggagagtagcatgtgccaactacatgcctagcacatattaggagcttaataaatatctgttgagtgaaagaataaatatatgtctggtaaacattataaagtatatagatttcttcccatccagaacgctgtgctcttagtgaagacaaagacaaaccaggccaggcacggtggctcatgcctgtaatcccagcactttgggaggccaaggtgggtgaattacttgaagttgggagttcgagaccagcttggccaacatggtgaaactccatcactactaaaaatataaaaactagcctgggatggtggcatgtgcctgtaatcctagctactcaggaggctgaggcaggagaatagcttaaaccccggaggcgacgtttcagtgagctgaggtcactccattgcactccagcctgggcaacagagccagactgtgtctccaaaaaaaaaaaaaaaaaaaaaaagacaaaccaaaacctccttcctgtgaggcagcttaaacttgcattgcctttcggcatgcagagggtgtctttgttttaacacaaggccacttataccctgaagaggctctgtctgattgatggattaaaaaaagcaacttgagatgtttgaacttggtccacaaataggatagttgtcccatatttttaatcagttcctgatgcacagattagcaagtcttggaagaaaagtaagacttttaaataaacaggacagggtcctcaaaacaatcctcttctctcaaccataagttacttatattcgcttcaaaacagaattagcaatcccaaccacagcctagtaatatgtaaaatagactggtaaataaatttcaattcaaaacggcaatttaaattccaggatcttatctctcaatatataataagcatccattatcagtgtgacgtgtcacatatacctctctatcagttgattaaaatgtgtgctttttacatctactctaggacatattattgttgctgtctaatttaatctaagaccactcagaatgtgataggatcctactactaattccatatttatagtccatttcaaaaagtgttatagtgcaatgaggaatatgaaagtgttctaaaaaattaagtttaaagtttaagtaagtttaagtttggaagttaaaaaaacttccaaaaccattcctttttttttttttttttttttttaagatggagtctcactctgttgcccaagctggagtgcagtggctcaatctcagtgcaccacaacctccacctcccaggttcagggcattctcctgcctcagcctcccaagcagctgggattacaggtgcccgccaccactcctggctaatttttgtatttttagtagagacggggtttcgtcatgttggccgggctggtctcgaactcttgatctcaagtgatccacccgccttggcctcccaaagtgcgggattacaggcatgagccactacacccagccccagaaccattcttctgacagaaatagaaggaaaggtggattgaggtagggataagataaaagcgtaaagaatgcttaattgagatgggagggctctgctggaataaacaatactagtgattccctggaagaaccttaatgtgtctaattccaaaaaaaaagataagattcctgtactctgaacatgaatgcgccacagattcattcattcaccaaggactcaagaatgtacttttggaaatgttagacaggacccaagaaccatggtcgagagaaacttcatgctatttataactcaaactatgactgaaacagaggaaatttggaaaaatacttcctaaatttcacgtacactatgagttgcccatcctattagcaccagaacttctttcctacagattcattagcactgaaacaatacaccataaaaaaggatttacataaaagacagctggagccggttgccaggggaactgacgatgttccagacacattccacattagggggataaatgtctgggtagccagggctgttgaagatgccttcagccatgtagaacgttccaccacaagctggaagaaaatagaaataaagtgagtatcagagcaaagactgcatcagacactataaaataaaggagaaagaacgctagagccattatcaatgtaaaagaatagatagtatttccatctcacattttaaaacattcatgtcatataaaataagggaacaattctgcaaactgaagaccaagggccatgcagtgtggtggattagaaggaatttctgcaatgtcttttctcaaagccgtttcttcctgtgaacggtaactttgaagaataaaagacttgtttaccatcctacagccacttggcttttgtgaccaggattctattcaaccctggcctagaacccaacgcagcatgcttgctttccctctcagtagagcaccgaaatgcacacaccaatcttctaggtgttctgtagcttttaaccactaaaaacaaggaagatggcagtgaccaacagcactctctgggctaagaggctaagaaacccagtcctgggtagctcctcgttcctctcctccccaggttagggctgccttaacaaacaagccaaaaagaacaccagggtgagcgaggtggctcacacctgtaatcccaccactttgggaggccgaggctggtggatcacgaggtcaggagtttgagaccagtctggccaacatagtgaaacctcgtctctactaaaaatacaaaaattagccaggtgtggtggcaagtgcctgtaatcccagctactcaggaggctgaggcaggagaatcgcttgaattggggaggcagaggttgcagtgagccaagaccgtgccattgcactccaacctgggcgaccaagtgagactccatctcaaaaacaacaaaagaacaccaagtcatctgatagcatggcatgtagctgaaaagacagctacatttccaaccaatcctccacacttccagagttcattattgctagaattgacaacacgatcacttaattgggaagaaggtaagatttggcccagaggtgatctcaggaaactggctcccaactacgaaggtcagagtccccaataacaaaccaagaatttctaccacatcccttttaaccgctagagtcaggtgctagggtttcttacccgacactgatgcggtgaccgtggtgtggaaacccccagcactgatgctagaatcagagacgaatctcagcgtcagggcgctgctgaaggatgtgataggatggggcatgtcggtgccacagtaacggcctaaataatgaagataatgacaaggagaatgaatgacaacatggcagagaccgctgtttctaggaaacacatctttactcgaattacaagagaccaaaacaaagtgaagaaattgccactaggagaaccacttcattcagggtcaatgtttgagacaatacctgatgatttaaaataaactatatataggagctatatataggagaggtgatttataaacatgatcaagaacaataggaccagaggaaaaacttagatgaccaagggacacatgtacctaaagcaaaaatctccagcccagtcggacccatacaaataaatgcactaatatccactattttgtagcacagaaaagtgtggatgctggagccaggctacctggattcagcccctggctcagccatttgctagttgtgtgatcctaggcaagtgacttacgtgcttggtgcctcagtttcctcacttggaaaaaggggcatattgaaaataatgaaacctatctcataagattacaaggattgacctactatttataacatactgagaacagtactcagcgcaaggtattgctatgtaacagcttgttaaataatatacccttatccttggtcaaatgcttactaacaaatgctgtgagaggtgtgcatagggtgtggagagttcattgattgttcactattgtctcagacactgtcctgggcactgggaattaggcaacaggccaaacagtctcctctctgacagaccttgtcttctagtgcaggatgagaagtttttacaacaaaattcaaaagttaggaaatttacggagaaagcttaaatggcctggtgtgtgtgtgtgtgtgtgtgtgtgtgtgtagtgtgtgtgtgtttgtttgttttgcctgagagcatttcagaaactagatagcggcactctttaattttattgggatgtctaacaaacaaaaagacagatttttaatggaattaattaattaattatctaattaagtgctttttttttcgcttccactaaggacaaggctgaaagaaacatactccatgtgaatgtaagaacttggtcaaatattaacaagaaatttctgatagaatgctacctaatgctgggatgggttgcattccactattctttaaagcagctgcaatttttaaatgttttaaaacatatacacaaactattcacacgtttgaatatattaataaacaggctgagttccctgaaccccacattcaagcctgctttcttaccctctaatcatctttatttggcttaggctgctctttctatttattggaaacattgcaacctagaatggcagcctataaatatgcggatctataaataaagcacagccaagaccacagatgtagatgagtgaacgctgaggtacctcggaggggcgcgtcttcgtggccgccatccaaaatttctacaaagtcacgtgcacacgttgtgcttctttcaagttcaaagtgggtaaaagagagggtgatatgatttactggaagaaaaaagagaagactctctcgtaaagtactggcaaataaaacatacagggagatggggcaagacggggaggtggggatggttaatgactataaaaaatagaaggaatgagtaagacctgtttgatagcacaacagggtaattgtagtcgataataacttattgtacatttaaaaataattaaaagagtagaattggattatttgtaacacaaaggataaatgcttgaagggatggataccccatttccatgatgggattatttcacattgcatgcctgtatcaaaacatctcatgtaccccatacatatatacatctactatgtacccacaaaaattaacaataaaatttttttacaaaataaaattaaaattaaaaaacatacagggagataaattttacttctggtaatttcatgtaagggttctccagcagagaagtaatgaatgaggcggatttgcacatggttgaagggataaagcaagggaaggggacaacttctatcctagatggtttcctttgaagagtaatagaatagatggtttcctttgaagagtaacggaatagatgcttttgaaactgcctgtggcatctgaaacactggcagtggtaaataagaggactcctgggtaggttcattccaggcactataagggaatatcttgttggaaaatgccgtctttccagtttttatatcaccattgctgtgttcctcgcagaagcatttttctcaatagactcatttccttaaattcggattctttgcatgtgcttgtaaataaggcattcttttctccctggagcccacattttagctcactcagttttattttcaggctagagctagtgccctaaggttcagagacatttatcaagaaagttttgaattacttgcagaacagcaagcacctggatacattttctttttgttgttctttaagctccctaatcttcagaataggatcttttcctattgctgttcttgaaccagtgagatctttcatctaaatgctttacaactcattagaaaataatcctcaggcacaaacttctcagttcaagggagggggcttctttatctacagctcagtttctggctggctggcaactttctttggggctccacctccccgtttgaattggctaaggatgacatcatcggctgccacatcttatgcatgtcaatgaagatactagcaatttgttaactcctgacatcccaggggaaagtgctagagaatatttaagccaaactcttcattttgcagattactttttcatggcctgattagcttaagtgacttccctattttcacacaggcgattaattactgtgcagagtgaagaacttaaagactttcctacattatgcctgaaactgtattttcctgcaaacctcaaaggagggcagggctcctctgaaacaggattcagaagggccccagcatcacccgctttgcagccattctgtcatgtccttgaggggcatttcctgatgttctctgtctgtaaaatgaggacagaagtccttaccatcggactgttaccaggtcagaaaataagattctagggttccaaaaaagaaaagaaagtaagcgtttattcaatgtttcttctaggcctgtgctggaatagtaccttgcaggagagcccaggttttatgaatgtttgctttgatggataggtgcgcgcattgcattctggcccgtgagtcactgattctccagtctgtgactcttcttcatttgttcactcagcaactgtcttgaacatcagctatactcaaggcacacatgtcaaaaactatttatcgattattttggtttacccccaatctcatacgcctgcatacgcctgttaatacagcaaggttgtaggtgtgttgtgttgttgtgcgtgtgtgtgttttttaacctttgctaggccttgacatgaaaaaaaagaaattgtttttaaatttagaagcaactgtagaaatgacttccctatcagattaggaaatgcttgttcttaagcacatcaggaattgggacttgcaaaagatgaagaggaaggccatcgattgttagcactgagataagaaggttactcatagactgaccttcccacagacaccttctctcctgtgtgccttttctttttcatttttgttacttacatggaggttgcgcttgaatgatccagctgcagttctgattgtttggataattggcagggaaccgtggagaggaaacagtatcaaatgagctggtgaggatgtggcctccgcaggctggggaacacacaaacacacatacatgtcatatgcttttcatttctactgaccgtacaaaacaattatttgatgaataaaaccatcaatgatttttcttcttatttctaaaatgcacgccaagaaagttctccataaggagagctgtacataaaccatgagaaaacaggagcacagtttatatttttaacaattattcttcaactacaggaagtaggaagtggcaaaaagcaacagattaaatgtctatgaattgcctaagtcattcaaacaaaattcttgcatggattcacttacactgcccactcataaatcataggcatagggataatctgcttataaatgacctctttttttcaggaaaataaatactcaattgaataaggcttcataaggatgactgtagattactagagaagagcaaaattcgatgtgagtcttgaagagggagaggcggtcaccgctggagggcgtaagaggagtcttgctgaggaggaggccgaggctaaactaggacttggagggtgagaaaagggaggccagggaggggactgcctgagcagacacagaggagcatctatagaggctcagctggagcatggggtgccccagggatgtgggtgactgacgctggagagaggtcagggtgggttctggggctcttggttaacatctgcaggagcttgagctttattctccaggccaggtggagacgggacagacattgagcattccaatggcatgatcagagcagggcttttacaggcgactttggagagagatggggtaagggtaggtgactttcaggaggttgttacagtccggatgaaagctagcagggactttttactatgaagcaacaaacaagtgaataataacatgcaaaagaactattaggaaactagtttttctttaaaatcaacaagaatatagtctgtcttgctccaaagtctaaaggtctatggtgcgtatttgggagacctcgatccaggcactgtccccatccagagctctttactacagaatataagcgagttgactaagatagacataatgactacacagactaaatgtatttgtagtgaatgttctgagtcatctgaatacaagtcatctctgactatgggataaggggttcatctcttagaacgagcagatgaaaggcaatgggtaaaaaggtcttggagaagtggtgatttaagaacaaaaatggccaggtatggtgggaggctaagacaggagaatcacttgaggccaggagtttgagaccagcccgggcaacagagcagatcccatctctaaaaaagaaaaaaaatagccaggcgtgggggtgcacctatagtcccagctactcaggaggctgaggtgggaggattgcctgagcctgggaggtcgaggcttcagtgagccgtgattgcaccactgcactccagcctgggtgacagagagagaccctgtggaaagaaagggaaggggagggaaagagagatgaggaaaaggaaggggaggagaggaaggggaagaagaggggaggaagggagggaacaaagaaagaaaaataaatggaaaacaacagtgactcctcagttggacaatggcaggattcagaaatgagggaaaccactgcttccaggggctggcatctgaatacattacaagcaagtcttgtaattgatagcagtgtatcccattctagtgtaaagccttgggtagtgctagatcagtgaatttggataaaacttttttatactgtttctagtcttaaaagcacttttaaacttgttagagatgcgggtccaaaggaagtcagagaaggagaaggttacaagcatcaggagttgggataattgtaagtcacagttcttttgttctatttaattttttacatgttaagtagaaggctgtgatcaatttctgagcacaggtctcatttcactgttgcaccaaacagagcactgaagatttctcttgtgcctgggaagatccacagggtacttgccttgcctgaattgagctcggaagcctctgttctgtctggaagggccagactgaaatctcaagaagaggctgtttcctgaggagacgatggggttagccagctgctcccttccacacgtcctggcaaggcgggacattgtggagcttaagccatcgtatgcctacaagaaaggagacagggcaaacagtggttcagattcacatctagaaggcctgtattccacgaactgtctgcacgccgatatactagtggataatcacacgtttgctggatctagggaaactggctttattgtcctttctcacagctgtaacaagtctttggtcatttctagggatgctgacgtgaatttcagcaggacttcctctgtcagagccactattagatttcttgatatcttcataaatgccgtcccttccacactccccttccttcccaaccccagtgtagtcacctcacaggccatgcccacaacatgtgctggaaatgtgtaatgcaagaatagacacatgagaaaacagacgagaaataatgatgagtgatgagcatttgttgtcagaatcccaacatttgttggacctgtttgttcttcataagtttcgtgatagggtaatgctcaagagaagagaaatggcagaattcttttcaaacgataggggtgatataaggctgatttagaaaactacctctctctctttttgcccgtgcatggtggctcacatctacaatcccagcactttgggaggctgaggcgggtggatcacctgaggtcaggagttcaagaccagcctggccaacatggcgagacccccgtctctaataaaaaatacacaaattagccaggtgtggtggtgtgcacctgtagtcaaagctactcaggaggctgaggcaggagaattgcttgaacctgggaggcggaggttgcagtgagctgagatcccaccactgcactccagcctgggcaacagagagcgagattctgtctcaaaaaaaaaaaaaaaaaaaaaaaaaaaaggaaaagaaaattacctctctctttttaactgttggtctctgtcttgcctagtgccatgctgggacctagctgaccctccaggcatgtaatgaaatggaatctatgtcacatatacctgaaatctctgtattgatttgtaaaatttgaagcttactaatttgcttggaactcagtgtctggatgaatttttgaatactcttatgtgtaaatcaggggggaaatgagttcctttgcttggatgattaataataactcccattcattagtgcttactatgtgccaggaactggattcagcccttcacgtacactgtcccattttatcctcccaaatttctttctgtttttaagaacaggacaacagaggcacagagagcctaagtaatgggcccaagtcacacaattcctaagagggagcaggtcacgttgaatcagaccactagattccagagtccagaattgaaaccctttcctcttgttcactgcaaggtatcaactgagcaggacgcatgcatcaacctgccaaccattagaatgtgactgaaagtatgaaggtaaaatatggccatttcattaaaaacaaattgccatttatatttcataagaaaatcttggggaaaaaaatagaaagttcggagattcaatgtaaggaagttactcgcaagtgactttaaaaatctggtgatgattataatcagtgttctgtttagcacacaggtatgattctgcatgttctctttagccacaggtatgattggcaggatattctcagtttggcttatacaagcccatgaatcaaatatcaataggatttttaactttctgaggagctaaagctcttacaataataagtttaaaacaaatgtgggtctgttctggagcagcaaatcttttcttttttattatttaatgttcaaaatttaaatatatatatatatatctccaataaatgaaacctgatgactgattttcattcaacaaagattgattaaaaactaaattccatttttctaaccaattcaaattataatttccaatctagtatgaatccttcctttgaacacgttgaacactgtaaacagtagacaaaatgacatttaaaccatcactacaaaacctcttactacattcatacttgagtctactctcaaatatcaccaccattggtttaattcaagtctttattatctctatacttggttttatgctgtcctaaggttatagatacagtgtcctaagcttgtagtaatattctattaatactgtcttagttttaatatcaaaggataatgaataccttcttagaacatctgtggttacagagtatggagaatacaccaattgaatcttaaggcacagactatttacttctctcaagataatttattcatttatttgtttagaatagcattttttcatttttataaaagtttaagattcaattttatgaatatatacagtttatatttattttttattttggttttaagtgatgcataataattgaacacatgtatgagggatagtgtgatgtttcaatacacatatacattgtgtaattatcaaatcatggtattcagcatgtccatcaattcaaacatttatcatttatttgtggtgagaccattaagaatcctctcttctagttacttttaacacactataatatttataaaccagaatattgtttactgtgggtgccctactgtgttatagaacatcagaacttattcctcttacctaactgtaattgtataccctttgacaaatatctccccataatttcctccctgctaccgtccccagcctctggtaaccactattctaccctgtacttgtgcgagatcagcatttttacactccacaaatgagtgacatcatgcaatatttatctttctgtgcctggcttatttccatgaacataaagtccttcaggctcatccatgatgccacaaatgacaggattgtgttcatttctattgctaagtaccatcccattgtttatatatatcacattttaaaaatccattcatccattgataagtctttttgtcttcaagagaagacatacaaatgaccaacaggtaaatgaaaaaatgctcaacatcactaatcaccagtgaaatccaaatcaaagccacagtgaaataccacttaatcccaattagaaaataataagggctggtgtggatgtggggaaaagggaacctttacacactattgatgggaatgtaaattgatacagccattatgaaaaacagtatggacatttctcaaaaaatcaaaaatagagctaccatatgatccaacagtctcactcctgggataagcagacaaaggaaattaaataagtatgttgaatatatctgcatttccttgttaactgaagcactagtcacaatagccaaaatatggaatcaacctaagtgtctagcatttcttaattttttaaactagtggaacaatgggttctatggtgtttatagacttctcaaaaaaaaaaaaaagaaaaaactctaagattttgcaagtccatggactcacaaaataagactcttctggttttaaaaaaattttctccgaaattcaaaggtccaaggaataagtacatattgtttcttccctctcacagtccttgttttcagtctgagtggttggaatcctctcaagggacaagaggaaataaggggaacaaaagtaaactaaaatattaaggctgaaatcttcagaaaatcacccgaatcacccatttccttgggggtcctttgaaaggggcacacctagaagctttacagacttcccagctatttcccctacccccagcccctgaggtcctggaattacaagacctctgctaaaattcatctggctgaagtaatacttcacaaggaatggatcaaaaatagaaggttttctcaagaccagcctggccaacatgacaaaaccatgtctctactaaaaatacaaaaaacaattagccaggcatggtggtgggcacctgtaatcccagctactcaggaggctgaggcatgagatttgcttcaacccaggaggcagaggttgcagtgagctgcgattgcaccactgcactccatcatgggtgacagagtgagactccatctcaataaaaagaaggttttcatgtgtcccggaattcaaattatataccaatgacaccccaaatgtgatgagcatgttataattttacaagctccatcacaaacatcctaacctgtgtgattttctataaaaataaagacagggaggcaagtgctaagctattaaactactgtctcattcaatgtaggctagtaagtcatccaagttcacatcactagtgagtagcagcgtcttctctctccaaattctagatttaccatgttacttctctttaaaatgctcatgacacacctcagtctgcttctttgtgataccatagaatacctgaggccaggtgatttataaagagcagaaatttatttctaacagttcagaaggctgggaagtccaagaacaagctgccagcaagttacagccgggtctctctgcttcaaggtggtaccttgaatggtgcatcctcttgtggggaggaacatcatgtcaccaagtggcagaagtgcagaagagagagaacctgttgttgcaagccctttttatagcaacattaatccattcatgatggcaaggctttcagtacctgaacaccacccaaaggccatacctcctgacactagaggaggtattaagcttccagcacatgaacttggaggggacacattcaaaccgtagcattatagttattaagttttatgtacctaattgtcattttatgaaattttgaaacctcaggctatcaaggagggagaatatttttaacagattttgaaatataaattctttcatttgagtgtttttaacacttataatatcaaatcattattctcaggcttcgtgtggtggttcacgcctgtaatcccagactttgggaagctgaggtgggcagatcacctgaagtcgggagttcaagaccagcctgaccagcatggagaagctccatctctactaaaaatacaaaattagccagatgtagtggcacatgcctgtaatcccagctactcaggaggctgaggcaggagaatcacttgaacccaggaggcagaggttgtggtgagctgagatagtgccactgcactccagcctgggcaacaagagcaaaactccgtctcaaaaaaaaaaaaagacaaaaaacaactcacatttaaagtttcaatttataaaattccacaagaaaagcacttcaaggaagaaaatatgagaaaccttgctcccattcatttacaattctaaagtcataaaaattatcgatatgaatttcaccttaacttccatttagttcccaaggcaaagctagcaaatgatattactattggatacacatatattaatataacatataattcttacttaagtctactgccaagagtttgctaggcctcagcattgattttctgatcgttacttaagtggtaaaagtcagggcaatatacaaacaaaataaaactttgtacatgtcaactaattcatttctagatgatagtaataaaataaaaatttgaagttgaagccacaaaataaaaagtggccactgtcccccagagaattctaactgccgaagctcttaaaacagaggcagatctaatggagtggtcatttaatttctacagaaaagttgaccagtctttttgtaaaatatccagaattttataaaatgccaagatactaacacacatattcaaaatacatatgaggccgggtgcagtggctcacgcctgtaatcccagcactttgggagaccgaggcaggtggatcacctgaggtcaggagtttgagaccagtctggccaacatggtgaaaccccatctctattaaaaatacaaaaattagccaggcgtagtgacgtgtgcctgtaatcccagctacctgggaggctgaggcacgagaattgcttgaacccaggaggcagaggctacaatgagtggagatggtgccactgtactccagcctgggtgacagaataagactccatctcaaaacaaaacaaacaaaaaacccccacaaaaacaaaaagcttaactttattatataaaaataggagactttttaaaaagtacagaacctggcacatacaggcaataaatgtttgatgaacaaatgaataaatgaatatgtatgacagttgctggtctctaaaaattgagaactagggttgaggaaaaccctgagttaagaaacagctgtccttgccctcatagattcaatgctgtaaacacatagtagacacaattgtgggtaagaggttagtcacagggggacggaggtcagctcggctgctttctgggcaggcttcctatatgccaggtctgaaggagaatgaaggggcccaaccacagggcacagccaatgtcatgcactccgctcccaggggcccttcaccaacagggtgagagaaggcagaggcagaatgtgggcagaggacattggacccgtccccaaggcccagagtattctgaacacatgatatattatggtgctatcaagtcccctccacatcctcagctctagccagaagtgagaactaagccaaacatttatgaaatttcttttaattagtattataattgttatttttgtagtcagggtcttaccctgtcacccaggctggcatacagtggtgtgacagctcactgcagccttgacctcctgggctcaagggatcctcccacctcagcctcccaaatagctgggactacaggtgtgcaccaccacacttggctaatttttaaatgttttgtagagaggggattttgctgtattgcctagtgtggaactcctggctcaagcgatcctgccacctcagcctcccaaagtgctgggattataggcatgagccacagtgcccggccttaattttcatacctgatgcttcgataccttgaggagatttgcataaatgtccatcatttctaaagttaacatgtgttcaactttgtcacatgtcaagtgacacaggaggaaaaccattcaagtgtgagaccaacatcccttcctggtggcatttctagttctggaggcctgtgatcatagttctaaagaacggtaatgtgggaaaataaagaagccaagcaaagggaactttttaattctcatacacacctttgtcttataaataagcattatttaaaagcatgttgcattatttaaaagttggtggcaggattccttttagagggaaaagcaatccctttttttttttttttttttttttttgagacggagtctcgctctgtggcccaggctggagtgcagtggcgggatctcgactcactgcaacctccgcctcccgggttcacgccattctcctgcctcagcctcctgagtagctgggactacaggcgcccgccactacgcctggctaatttttttgtattttcagtagagacaaggtttcaccgtgttagccaggatggtctccatctcctgacctcgtgatccgcccgcctcagcctcccaaagtgctgggattacaggcgtgagccatggcgcccggccggaaaagcaatctttattgacgaaaatatcttcataggctctcagaacatgagtatagtaggggaggtgttattttatgttgttggggacaagttgcccccttctctttgctttctcatctgttgctaaatttcttaatctgcaaaattggattaatatgaatatatagctcatactgttcacaagaataagttaaaagatacaatacttaggagagtggctggcatgtagtaagcatgtgatagatgttagcctctagtatcaaagtgagacaaagtgggagctaaattgctgtgtaagaaatgaagtagggaattagaaagctatggaggcaaaaaagaaaagagaaccaaggggtggggtgggggttgtccagaaatatgggtaggtaggagtgggagagataagaagtgaaaattttccaactggagattgtaggggtggggggtggtaggcaacttctgacccagctctcagtgagccccacgtcctggtattcatgcctctgtgtaatctcctccctggcgtatgggatagacctcgtgattggttctaattaacagaatacaatggaagtgatagtctgtcacctccataatgaggtgagaaaagatggttcctgccctcttgctagcactttctgtcttgttggactctctcttgtcctctctattgcttgccctggtgagcaaggtgccgtgttctgagatactccgtggagaggcctgtgtggcagggagtcaagggaggcctcagccaacagcctgcaaggaactgaaccctgtgtacattcacatgagtgagccaggaagcatgcaggtgagtggcacctggcttcctgacccacggaaactgtaaatgttgttgtcttaagctggtaagttctggggtaagtctgcgggtgtggaatgaagaacaaaggcttccgaagaatgaggctgtccagtgctgtattcaagtcacatgctgtactgctctttgcagtaaccacctcagagacctcatctaaaaatgagggtaggtaaactccccttgcagcctcataaggttattgtaaagatcaaataagacaatgtattgaaagttttgtggaaactgattacaagtatgaaggtaagtttttctcatttcgttccagaaattctcatatatacatttcttttttcttttcttttcttttttttcttttttttttttttttgagacagagtctcactctgtcacccaggttggagtgcagtggtgctcactgcaacctctgccttccaggttcaagtgattctcctgcctcagcctcccaagcagctgggattacaggtacacaccaccacgcccagctaattttttgtatttgtagtagggacaggttttctccatgttggccaggctattttcgaactcctgacctcaagcaatccatccacctcagcctcccaaagtgctgggattacaggcatgagccactgtgcccggcctcatatataaatttctaacgaaatttaacatacagaaaagttaaaagctagcaattccacttctgcaggtttacactagagaaagtcttaggtggttacatacagatattgcttcaagaatattcggtacaaaaagttgctaaggaaaaatattgcaagcaacttaaatgttcattaacaggagaatgggcaaatgacttgtggtgcatatataaaatagaatgtgtagtgactaaaagaatgcattagatctgtatgcattacaatgcagaaaatgtgaaaaacagaataatgagtgaatagagcaagttgaagaaggatatgtagcgtgtgacatgatgtacataaagtcttaaaatatgcaaaataatatttcatagtgtgtatggatatatgcatataatgaaaaaactataaaaaccttcatgggaatcacaaaccagaaatctcattagcagtttcctctgggacggggaacagggcatgggatcaatgataggagcatgtgggacttcacctgtgtcttgaacagttcatttctgtttgggagaaaacaaaagaacttgaagcaaatgtggcaaaatatgaagatttggccagtctggacagggagaagtttttgtatgttatatactttgtatgcattatatagtcggtatttctctacatacttaaaatatttcatagtagagtgttcaataaagaaaagaaaagctatataaaggaaataataggaaatgtactaagattcacatataaagatactcctcatagcattgttataacaagaaaagaaaaaacccattaataatccaaatggttaataataaagcgtggctaactgaattacagcacgtccatttcattgactagccaaagaaactatttaagaaaatttcaaataatatgaagtgaaaaaggcaagatacaaaattatatataatattatcttaactatgcatgtttgtgtgtacatgagtgcgtgtatatatttgtatgtgtgtgtttgtgagggaaataaaccaaaatttcaatagcttgtatctatattgtaatactaaggatggcaataatttcttatttcttcttttctgtattctacaaatttaatatgaggagcatgtaaggtttaaaaataaaatctatattaaaagttctttagtgtttcatcactcggacgcataagtgattacatacagacatgaaagggcactattcatataacagcactgcagcacccaagccagatggctactaacgccagttaatctagcctcttgctgccgccaggaatgtatcaagtttaatggacgtggcttctgttttaagatctccaaagcatctgttcattgcctaatatctacaactgtgccccagtcctctcccctaagccctaggcttgtatagacaactgtatcgtagacatcatctcttccatgttccacaaaccccgaaaatcagtgtctcaaactgaagccctcttcctgtccctctcatttctcccttacctacatttcttgccacagtaaatgccggaagcatgtacccaacggccagaccgtttggggaaccgcccccatccctgctacatgtagtggatcagcatgttctaacatctgtttgtccgatgtatcgcttggctccttccctctacttcatccatgtccctctctggtgtcttggtgtggggcctcattacatcttgcctaggccactacaacaccctgaaatttcccctgccttccatttgtgtcttccttccattcagtctcaaaacaactcagtgcacagcgtgcgctttctaaaatgtaacatcacatactaaagtaaagctgagcatacatttttaaattgcacgaaataaagaccagtaatcacgcatgctttgcctaagcactaaagaccacgtgattgacgtggacgtgatgcagagcacttcagcggctgcccctctctgctgtaatcaaaaccctggggtgattaaatggctcgtgaccacctgactgaaatgtcagtcatcgtttgcacccctcatgactgagggggaaatgaattgtagcttcctcagtaatatctgtatttttatttctaaaaaaaaaaaaaaaacaggaatatattccctgagattgttggaaagtaggaagtgaggaatttttttctactggattttttatcttgtttactaagtttcatcttgctcagggagaaaatttttttaaaagattccttaagatctttaacatagcgttaatagtaatagaagcaggagtcattgtaatagaaaaattaggaatagcagcaaatacttatctgaaccagacactgataggtacttaaatacatttgtttacatttgattcttacagttccactttgcagcagggaaaactgagctctgaaaacatacatgacttgcccaatcacacgcttagcagtgcagagccaatatacaaaccccatctgtctgacgtccgaccaagtatgattaaacctagagaaaaggtgaaatcaagttgtattcattcagttagaatgttgagagaccatgattctgtgaagctaagtgagatattcacggtctccaagaaagaaaaccacagcagctctggaaatagggtgggagtcccccatcctttgcatctgaacctgcaatcaagcatcctcagtagcatttgagaaagtcttatattgggctcccgtggctttccaagtggttggcatctgtcctgcattccattccagtgaacgtgcatgggattcccagcatggctcacttagcagaatgggtaacaaagagcacagtgtctggggtcaatacataaacccagaacttctatcgttgccacataaacttgattctattcctggattcagatataaagctcctccttgtccttctctggtccaaccgccattctctggtctagtgtggcctccttctcacctggacccttatgctttactacatttttttttttctgagacagagtctcgctctgtcgcccagaatggagtgcagtggtgcaatctcggctcactgtagcctctgtctcccaggttcaagcaattctcatgtctcagcctccaaagtagctgggattacaggcatgcaccagtacacccagctacatttcgtatttttagtagagacagggtctcaccatgttggccaggctggtcttgaactcttgacctcaaatgatccacccaccttggcctttcaaagtgctgggattacaggcatgagccactgtgccagtcccgctttgctacatttttaactccagatggtaacacaggtctcctgccctggattgcctttgatcttagcagggtgcaaaaatgtggtgaagaataagacatttagggcacaggagagataattcacatggaggtgcaaagtgattttgaggatcgagagtccatgaggtattttcacatgttataatatggcggtatacctgctaatggaattgccactttggaatacgaacttctccaaaatagaggaaacattaagtgatagggagggaaatccctcaggaaattatacaagctgttacagtcataaatgtgaatgcggaaggaaatgaaaatattactcattatagcatctcttcttggggctgaggaaggaggaagcatcagtttcctttgtcagtgatttttttccagttacgctccttggaaattcaatactaagttcaattcacaaccccacatctcatatcacgatgcgttcacccctatttctttgttctacactctcccactcagtcttcacatcttacaagagactataaactctaaaaacttgcagttgttgcgagcactgactcaaagattcctggaaatgttgacatgagaagaaatctaagatgctcgttttactttcacaaataaacatttaaggagagtctgagctgaaatggaaaccaagccaaaccaaacccgtgtccacagattgagagctgtggcttcaactcaactcttccttcatcttgcagattcaaagcactggctcagcatttggttgttaataagacacccgcaccaggaagcaaagtagctaagcatgttaatacaaatgcaagtcacaagataaacgtttgaaaaagatcatcctcaagtatcagatggaaacaaaaattcctgtggtggggcgtaaaggagggagggaagaaagagagagtgagagagagatacagggaggagagagagaaagagacaaaaagggagagggagagagaggaacaaagaaagggaaagataagaagagaaggagggagaaagagagagaaggagagacggagagagaaagaaggagagacagagggagagagagagaaggagagacagagggagagagagagaaggagagacagggagagagagagaaggagagacagagggagagagagggggaaagaggaagagagggagagagagcaagaggaagagggaaagaaagagggacagaaagacagggagagagagagaggaaaagagagagagaggaaaagagagggagagaggaagaggaggggagagagagagactggtttctgtcatggatttgtttgtaaaacagtaaatatttaaagaagacttgtttccatcatctctttgaaacccagagttctattattcctgtgtctgtttgctctgctttggaaaccatcagtgttttaaaaggaaacacatcatgggtggtgtattacaaaaatacaacaaaagaggatgctgcgttaggtatctgccctgttccaccctgcattttattgtcgaataatggaacaacaacagacattgcagctttgggtgggagcacagggaattttttttttttccggatcacatcagacacttttctttctttctcctagatagccacaaaaagcttcagaagttactaatcatattgcttttgcttttgctttttggtaccaggctctgttagccctcgtttgtgttttcctccaaatgagaggcaggacctggaccatggtcggcttgctttgagctgctccttgctgattctcacaaagcagacattccaatgatctgagcaaagaggatgctggaagcagaggtcaggaatctccaggggccagctggtgctgctgaacggactttcctcttcctgctctcacactgagctacaagcagcctttctaggagatcaataagagcttgcagagctacatgaatcgaagacttagaagaaaggctctaattaagcaatttaactgtcagtcagaggtcactttaatactcagccttcgtgaaaggaaacgtaatgaagccacttgtgtgctgaccagacaaggccatgcccagccgatgggtcccacagcttccttagcaagaaatgctcctgatgtgtcattgaggagagcccaaggttaattacaccagacacttgaaggtgactgagcagaaagtgcaaatatattaccaaatgtgttgaaacctgcctgcaagtccagcttcctgattagctcccctcgatgccatcacaatttcaatagaagtcaaaaaatccagtttttcccttttctcattatagcagcatgcaattctagaaaacgcacttctgtgatgttatctaagtgctcatgtggctcacaacacgaagattgtatatcaataacaatgccagggagtgaactcagtacagcacattcccaatggtgtcctctgagattttccaccaaagcactgagcattgcaggagcagagatgacaaaaattcatttattcagctatgcatctattaacaattcatgcatcaaaaacattggtgctttggcgatataaagactactgctgtgggttctgtgaaagaggatggaggctgtgtattactgctccatttttttttttttagatggagtcttgctcagttgccaggctggagtgcagtggcacgatctcagctcactgcagcctccgcctccggggttcaagtgattctcctgccttagcctcccgagtagctgggactacaggtatgcaccacaaaacccagctaatttttgtatttttagtagagacggggtttcatcatgttggccaggatggtctcaatctctagacctcatgatccgcctgccttggcatcccaaagtgctgggattacaggcgtgagccactgagcccagtctactgttccatttttaaatgttcatttgtttcttctacttggcgaattttgcctttgtttccatgacaccaagagtaatggctgttacatgtgggcttagcttgcctcaatttggaacctatagggactaggcctactctaagaagagctttctattgtattcccagaagagtatggggatagtcttgtaacccagagatcatgtgaagcctggtggctgcctgaggttgacttcaactttgaggatgaaaccaccactgacgtcactgggccctcagtggccatttcatctgccatcttgtcctccttttcttacccacaaatgcaactcctaactgaatcctcttccttagttttcttctttctgcttctgttccccaggcacctgattttctaaataagcaaactaagaaccccaagccatgaagagggtgaggggtggtacacgtccagaaacaagcacctggcagtgtctggtacatatttggcaccgaaggggaaagtaatgaaggaaaccctgacctcctgacttcaaagcaaggacactttccatttcatatttgaattcttaacacttttccttctattgacaaatgaaggctgggcttatcagatatagaagtgaaagtgggctgggcacggtggctcacgcctataatcccagcattcacacctgtaatcagaggccgaggcgggtggatcacctgaggtcagaagttcaaaaccagcctggccaacatggtgaaaccccatctccactaaaaacacaaaatattagccgggcatggtggcacatgcctgtaatcccagctacttgggaggctgaggcaggagaattgcttgaacctgggaggtggaggtcgcagtgagctgagatcacacctttgcactccagcctgggcaacaagagtgaaactccatctcaaaaaaaaaaaaaaaatcaaagtggctccagcctgaccctaaatttattttctccctctatttttctagtctgccattccgtatcctgtacataactgcaatttttatattttaccaaaatacttattcacttcgtaggaagcataaggctttcgttttagtgctgatcctgctgttaatttctacttagccttgaccctgacatttctggatctcagtatcttttttattttttaattaatttttattttttgcactgccccacctccacctcaatgtctttttttaaaaaattaggtgacaacagcaaacgaactctaagctttcttcttccaaccttaacattctatgtatctataggtttatgacagttaatcatatgtgaaatcatatttaacatacagctaaattactatttcttcttctaacaacccaaattgttatagaagttttgaaaaaacaggatggctggtcccattccagcataattttcactggtatttaaagagtacacttgaactctgttaaaaatctcctgaaccccaacattatctgacagcatcactggcaactgaatatttttctctttgctaataactctgtctaagcaacaggaccaggacattaacttgaatgtctccaaaatgaaggattggctttatatgaactgagactgcagagatattatgtaagatgttggactttggggtacgtttcccgtccagtgtccatctggctgtaaagatagagggctggtgcttcaactccggccttcatgaatccctggacaactaactaacaagcttccagccttgccagggcattgcctggtctggttccaaacctctgcagacctcctgtccccttaagtgggcacatttggcaaatatatagcagatctctaccccaacttacctggacagtcttgttttcttttaaaacttccttatctttttgtaaagttgatttataaatcatccaagaaaaaatgacttagtttgtatacaatttatgcaatttttaacataatgaatttataaatcagaaaaatcttgtgccaagccatgggtttcaatttcttattctaaaaagtacaacattcatagaaccaatctggcgcttcttggtgtctctgtcctgaaaacatgattttctctactgttcgcctggctctcacattcagctgctctttttccacctgccctcttcacacaacttatatttctccattttttttaaaaaaccaactctccactgattttggttaacccattggttactgcccattttctccttatgccactcatttccgtaactctggggaaaagctcagaagctcctgcacctcctaaccactgtgaccttgagtcttccaccaccacccgccacaatcctgctccttgcaggttattaaagacggaatccaggggctttgttgcaatcctcacgctcgttggcatcctgcatgggatttgatacctttgatcacccacccttgaaattcagcttccctcgtggtttgaatgctaccactctcttctggttctccaccaagcactcagcgcacctcctcagcctcctctcctctgatctttcatccacccgttacatggcagtgtttccccaggagttggcttggcccctttctcttggtaaaatactcctaaaagtgatcatacctactcccacaactttaataaccacccaatatacagaaattatcctcaattgtatatgtctagctcagatcctatcccaagctctgaactcttatgtcaaactatataatatttaaacccaaaagtttacaagtcaaactcactatcatctactccctttactcagttaatggcctcatcattcacaattttttttttttttgaaacagggtcatgctgtcacccaggctggagtacagtggtgtgatcacagctcaccgcagcctcgacctcccatgctcaagccatcctcccacctcaacctcctgagttactgggaatacaggtatgtgccacttggccaggctaattttttaatttttttgcagagatggggtccaggctggtgtcaaactcctgagctcaaacaattctcctgtctcggcctcccaaagtgctggaattacaggtatgagccatcactcccggccattcattcattcttcaagcaaataggcttccccccaccatctctatcaccagccccacccaccaccatgtaattagcctctaattctagtgactgccaccgtgacagttctccacgtgtccctgcgctctccatgtgtcccaagaccactgcctactatgagaccttatcacctctgatccaagctttttccattgcttcccaaacagacatgctaccatctttctttttctctgccaagccattcttcacacactgctgcctgttgtcactgtagaatacagctctgagtatgttattcccgttttacagaaaattttcactgactccatactacctataggataatttcaaattcttaactggagcagaagagagctcagatgtcttctgtagccccttggtctccacatgctccccggcatttcttcacgctccagggacaacactctcattttttattcccaaatgtgcgtgcaccatttccccatccttcccttgcagcctcccctcgtggcctcactgctgcatttctactggcgagactctgccacttaaatgtcgcctccagtgtgaacgcttccctggcttccaggcccaaatgaatgatgtcggccattttcacaatgattccagagcactgagccctagatatgctaaatcctaggtgctatactacgaggaagattcgaaagtgggctcttctgcttaagagcttgaggcccagaattacagacggcaagtcctgaccctgacttctttttctaaaaacctttcaccttaggttcaagggtccatgtgcaggtttgctatagaggtaaattgcctgtcatgggggtttggtgtacagtctattttgtcacccaggtaatgagcaaagaacgtgatgggtggttttcaacttgctccctcctcccagcttccaacctcaagtaggccctggcgcctgttgttcccttctttgtgtccatatgtactcagtgtttagctcccactcctgagtgagaacatgcagtatttagttttctgttcctgtgttacttcatttaggattatggcctccagctccatccatgttgctgaaaaggacatggtcttgttcattcttgtggctgtgtcacattccctggtgtatacgtagcacgttttcttcatcccatccaccattgatgggcatctaggttgattccatgcctttgctatcgtggacagtgccgcgatgaacacgggcatgcatgtctgactctgacttctaagtgcatttctgctcctagtattccgcgctgtctcttcttctagtcctcattaaatgaacctcccccaaaacactcaccatcagcagcatcataatggctagcacaagtggagaactctctatgtgacagcaagcaggtcatctatattatctcaaatacctaacaataaatctgacctaggtcctcttattatccccatttccattaaggaaactgaagctgaaaggttaactttcttccaaagaacacagctagaatatcacaaagtccaggctcagccccagaaccaccctatattagagctagatttcttagctgaagcactgtgctgactcacactatcggtgtggctcacttcttattttaatgtcttgcctgggttcttagaggtatttgcttctaatgtctcttctgcccactggctgggattttccaactacaattaactcttttttttttttgagagggagtctcactctgtcgcccaggctggagtgcagtggcgtgatcttggctcaatgcaagctctgcctcccgagttcccgccatgcctggctgctttttatatttttagtagagacggggtttcaccatgttagccaggatggtctcgatctcctgacctcgtgatccccccgcctcggcctcctaaagtgctgggattacaggcgtgagccaccgcgcccggcctacagttaactcttgaacaacagaggtttgaactgcctgggtccacttaaacacagattttcttccgtctctgccacccctgagacagcaagactagcgccccctccctcttcctccccaacccactcaatgtgaagatgatgaggatgaagacctttatgatgatcaacttccacttaataaatagtaaatatattttctcttctttacagttttcttgatagcattttattttctctagcttactttgttgaaagaatacagtatgtaatatataaaacatataaaatatctgttaattgactgtttatgttaatggtaagccttctgtccgtcataggtattagtagttaagttttgggggacttgaaagttgtatgtagatttttcactgcacgacagggaagcagggggccaatgaccctaatcccagcattgttcaagagtcaactgtacttcatacagcattatctgattctgacaacttgtttggactattattacattttatattttgccttacctaccagcccaaactcctcccagcacttgtttttgagtttattttccatctccgtgcctaagacccgatcacatttgaggtttcactcctgctgtttcctcctgctgcactttgttaagccaagcccagctgcatgctgaaatatggcagtgttcatagaaaaccttgtctgtgtgtttatgtcccatgtaggtggaaaaccctcctcatgaccacaagagggaaaatcctagccatgctggcatgctgttgacctaggctttggtttggtgacacactttgtatgttaaattccatggattctgcactgtatcaaagaaaagaacaccatgcagacgagggaggaaacaaggggtagagcaatacccaccatggtcaaaactataagtagctttgtctctggcccattcaaacttctcttaaagaccttctttttttttttttttttttttttttgagaaggagtctcgctgtgtcgccaggctggagtgcagtggtgcaatcttggctcactgcaacctccacctcctgggttcaagcgattctcatgcctcagcctcccaagtcgctgggattacaagcacacaccaccacacccagctagtttttgtatttttaatagagatggggtttcaccatgttggccaggatggtctcgacctcctgacttcatgatctgcctgcctaggcctcccaaagtgctgggattacagttgtgagccaccacgccaggccaagacccttcttttgcttcaatatttatttcacctttattcctttttttttttttttttaacagacagggtcttgcttgttgcctaggctgaagtgcagtggcaagatctgtgctcactgcaactcctgccttccaccctcaagtgatcctttcacctcagcctcccaagtagctgggattacaggtctgtgccaccatgcttggctaattttttaactgttttgtagagacagggtctcactacattgcccaggctggtctcaaactcctgggctcaagtgatcctcttgcctcatgctcccaaagtgctgaaattacaggtgtgatctaccatacacatcctcaccttcattcttaaaggaattttaggagagcatagagttcctggccggtagttacttttttttctttaatctgaatatatcagtctattgtctttaaaaaaattttttttacttccaatcctggttgaaaagtcagcatttagtctctactttctaacaagcaatctgttccccacctacctactcctctagctgactgtaacattttctctttatctttgttattattattttttttttagaaaagtacgtcattctatttatcctgctttgctgtttgggttccttgagattctatttttttaatgatgacttccaccagttttggaaaaattttagtcagtagctcttcaaagtttgcttctgttccatatatctctcttttccttgtgagactccaattaagtgtgtgttatatattttctgagtgtcctctatgtgtcttaacctctcttatatatttttcatcctttttttatccatacttttttctgagtagattcttgacttatcttccagttcactgtttctctgtagtcactatttatctcttcatctctgcctagtccccccaaaaagccttctgctgaggtgttaattttagctatggtatttatcagttctcaaatttgtagttgggtcttcttcatattgcaatgtcactttctatagtatgcagttccttgctgaaagttctcagtttgacttttatttccatgagttgagtaatcacagttgtatagcaagtgtgccaggtaactttactatctggcatattagtggatttgtttctattgtctcttactcatattacatctcatttttgttatattgtcccctcaagtacatgactatctttgatagtgtgttggtgatacacacaggatacagggaaatactaggtagaagagggcagttccccagcaaaggccccactctcaagcctggaaacccatggccctaaatgggaacaggcattcctgtttccacacccaaattttgccttttggcctgccacacccccttatcctgtattcatataaacccctaaacccaggcttcaaaagtagacaagcagatgagcagataaatagaagagcagaggagcagaagagcagtacagcagagaaagagagaagagaaggagcatctgaacattgagaggagttcagccagggtcagtcaaagaagaaatcggccatgggacagtgaactccagggggaggatcatcttccctttccaccccctttccagctccccatccatcccactgggagctgtctccatcatccagtaaaacccctgcattcaccatccttcaagtccatgtgtgacctgattcttcctggacaccaaacaagaagatgggtaccaagaggacactgagctggttaaaacttaagccatctgaggatggcagagctaaaagagcactgtagcatgcccactagggctctgggagttgtaggcacccacccctagatgctaccatggggcccggagtccagaagcactctccccggctcctgcacccctgtctgcatgtttccctgcccataaggggtttgaacctgcagcacttgaacagatgagacacacccctgttgaatgtcctgtaacggaggtcagggaactctcttatttaatcggctattacacatgaaaaattataggtagaaatgatgtctagaatgttaatatctctctttgaagaagattttaaattgcttttgctggatgtccagtgcctagatgcacgagaaatacaagattcactctcattatttcatggcttcagattttggggattcactcaggtaactcaaatattgaatgcagtctcagtgaaggctgttttcctttcattttacctaagatacgaatggcttaccaagactgccactctaacaaagctctggactcaaactttggtcctctttgtcctgagaggctctcagaagagctgctaaacctttgtggatcagtaaaggccctgcaggaaaaaatggtcccaaagactggactcacacctctctcagatattcactcagaaacttcacactacctcatgaaccattggctacttttagaaagatgtttgtaaatgtcatccaaaatttcaaaatggtctttgtcaggagagtagctggatgttctacgctttcagtctgcatgatgcttagccaacttagactctgaagactcatttggatggttaatatacagtgataaataaacttaactttcattaataacctaatcttgtaaaataatattgaaatcataccattaaaatggactacttggaaaaatgtaaacaaacctttgagttttcttgggttaaatttgaaagaagctagccagttggatcttgtgtaggaaactatcaggacactaacattgaaagatccagtaaccaagagaatctggtttgtatttgaatgaaatgttgatatacacaaatgaaagatgaaaaactttttgttagaaaatcaggtagcccggaacaagacaagggtgccctctctaaccactcctattcaacatagtattggaagttcaggtcacagcaatcaggcaagagaaagaaacaaagcatattcaaatagagaggaagtcaaattgtctctgttgcagatgacatgattgtatatttagaaaaccccatcgtcgcagcccaaaatcttcttaagctgagacagaggcaacttcagcaaagtctcaggacacaaaatcaatgtgcaaaaatcacaagcattcctatacaccagtaatagccaaacagaaagccaaatcatgagtgaactcccattcacaattgctacaaagagaataaaatacctaggaatacaacttacaagggatgtgaaggatctcttcaaggagaattataaaccactgctcaaggaaataagagaggacacaaacaaatggaaaaacattccatgctcgtggataggaagaattaatatcatgaaaatggccataatgtccaaagtaatttatagattcaatgctatatccatcaagctaccattgactttcttcacggaattagaaaaaaaactctaaatttcatgtggaacaaaaaaagagcctgtacagccaagacaatcctaagcaaaaagaacaaagctggagacataacgttacctgacttcaaactatactacaagcctacagtaaccaaaacagcatggtactggtaccaaaagagatatacagaccaatggaacagaagaaaggcctcagaaataacgccacacatctacaaccatctgatctttaacaaacctgacaaaaacaagcaatgaggaaaggattccctatttaataaatggtgttgggaaaactggctagccatatgcagaaaactgaaattggaccccttccttacaccttatacaaaaattaactcaagatggattaaagacttaaatgtaaaacctaaaatcataaaaaccctagaagaaaacccaggcaataccattcaggacataggcatgggcaaagacttcatgatttaaacaccaagagcaatggtaacaaaagccaaaattaacaaatgggatctaattaaactaaagagcttcttcatagcaaaagaaactatcaccagagtgaacaggcaatctacagaataggagaaaatttttgcaatctatccagctgacaaagggctaatatccagaatctacaagaaacttaaacaaatttacaagaaaaaaataaacaacctcatcaaaaagtgggcaaaggatatgaacagacacttaaaagaagacatttatgcagccaacaaacatatgaaaaaaaaagttcaccatcactggtccttagagaaatgtaaatcaaaaccacaatgagataccatctcacgccagttagaatggcaattattaaaaagtcaggaaacaacagatgctggcaaggatgtggagaaataggaacgtttttactcgttggtgggagtgtaaattagttcaaccattgtggaagacaatgtggcaattcctcaaggatctagaaccagtaataccatttgactcagcaatcccattactgggtatataaccaaaggattataaatcattctactataaagagagatgcacacgtatgtttactgcagcactattcacaatggcaaagacttggaaccaacccaaatgtgcatcaatgataggctggataaagaaaatgtggcacctatacaccatggaatactttgtagccataaaaaaggatgagttcatgtactttgaagggacatggatgaagctggaaaccatcattctcagcaaactaacacaggaacaaaaaaccaaacaccgcatattctcactcgtaagtgggagttgaacaatgagaacgcatggacacagggaggggaacatcacacaccggtgcctgtcgaggggtggggggctaagggagggatagcattaggagaaataccttatgtagatgacgggttgatgagtgcagcaaaccaccatggcacgtgtatacctatataacaaacctgcagcttctacacatgtatcccagaacttaaagtataataataataacaataataaaagaaaattaggtagccaaaaaatttaaaaacagaaagaaaaaaaaaacccttcaaaatagaacttcattcactcttatatgaagcgcaaagcattagtttcaggtaggaatgcattaaaagtgttggtagtagtgatgggccagaaggcaggaaaatgcttggtagaagaggttgaggtccctggtgagtgctccaccctcaagcctggatctgccactcaaagtgagaaccatccctgttttcccacccaaatgttgccttttggcctgccctgcgcccatctggtgcccataagaactccaagccccagactcagcagacacacacacacacacacacacacagaagagagaagtgtctgaacgtcaagaggagaagaaggagctggacatcggagactatggtcagagaggagttcagccaaggaaggccagactcctgcaacccacttcctccaacctctttcaagctcgccttcctgctgagagccacttctacctcttaataaagttatccacattcaccacccttcaatttgttcgtgtgacctgattcttcctggacactggacaagaacttgggtaccaagaggtcagggtgtaaaaggctgtcaccctgaccctccactgagctggttaacacttagctgtccatggacggcaaatgctaaaagagcactgattgcaacacatgccctttggggcttttggggtcgcagacaccctctccgagatggcagagctaaaagagcattgtaacaagcttggacgctgccgtgggccgtgcacagagcctgctcccaccagagatgagggaccagccagttctagggttcgttcaccccggttcctgcattcgtctattcgtgtgctccctcctgaattcagcgaggcagccaagcaaataagccacccccttcgcaagtcctgtaaaggagtcaaggaaaccctcccatctcagtagcagaaactctttttgtcatctgaccaattcatagccatattccttctcctccactcccatctcccaacctgttctatcagaacatggatttgttcaagtagcaaatcaagatatccttgtctcaagagaagcagaatcctgtgaaaatcccagatgcttaataataataattgatctaaaacatttatgataaatctattccatgatactttctggatctcttttgtagtcagttctggctaatgatatatcaggggcttttttggaaaatttgctttccttattaaaagaaacacaaacaaaacagaaatagttaacactattgcttcttccttttttcagaggtagactcaggtaggacattcagataaaaaccactgcagccattttttgacaatgaagtaacaacaaaatgaaaagccaacaggctaataatggtagcgcagaaactgacttgctaaaaaacctagagattatctacttcctgatttgtttttaggtaaaaaataaatgtccttatattttaagttgccaatagtttggtttcctatgaatcgacattaaaaacacccataagtaatacattcactaaatatgcttatatggcagtgttttgaccgaggtttgactggagacaatgcttgaaatttatgtcacttaccataatacaagagtcttgtggttcaagatcaaagtcagtgaagttcaagagaacacgatgatttctgtcaacccgaatgacccaagaacagtctgtgttgctcctataaggactggggtaatttggagaatgaatctctccactgggagcctggaaaatcccaccacaacctggaagtggggaacacaattatttcatgagaggaatcatggatgctcgaaaataatccattacctggttgtatagatcaatacattactttgcttgaatcagttagtcgatgctaaaaacactgaagaatttgatatccacattaagccatttatcccaacagaataagaagggatgacatggatgatactaagaaaatacttcaaacactttaaatacagatgccaaaatttattttaaaaataattaaaaggaaacgcaaatgaaatcacgttttcacaaagccatggaatgctgcttcttcactgtcctctaaaaatatagcatactggaagaataacatgtttccttccaagaattgtgataatctagtagtgcatgcatttaaaaataatttaatatctaccctttaaaaatttaatattcggatatagtacagttacttaggttttttaaaattcctttgatgttatcaaatacctgttagttcaatgtcttctctatgacccaccatttcttggatttatgataatataagccaataatagaaaactttggcactattttctaataatggagaatcattcaggggtaatctaaacactaaatgtgtgtgtctgtgtgtgtgtgtgtgtttatttaaattcctacataattaactttaggggagagctcttatatagataccttggttatgatagagttgaagaagtgtggccataaggtagtctggaatcacatatgtgctttgacgttttctagctgtggaactttgggcaagacactaacctttctaagcttcagtgtccacactggtaagatgaggatatgaagcggacttccctcacagggtggttgtaaggactagagataatcctcataaaatagttagaaaagtgcctagtacacagtaagcattctgcaaatgtggctatctctagtagttgcatatgctaacatctgttacactattttgtgccatagatttttgctatagtttaaaaatatacaataggcaatttatttagactgcctaaaatcttgggcagaaagtcaccatagaacacacagtaattccttgggattcacaaatttaatgtttgcaagtttgatatttgccaagaatctaaaggtctgtactatggcatgaggtatggaggctggttaagaggtacgagcccttggagagtgggtctggcctatcaccctagttctgctctcaccatggacttacacacttacattcttgctttcacatatgtggtgacccttaggaagttaaactttatcacgtattttagggaagggtatatgtcaggtctcagtaggctgccctttgggatgtcactaagttataagtgtgtagccttcatacgttttcccaagcatttcatgaaatttaacgagggctcggcttaagtactttaggaaacctccttttctcactcacctccagtgactgcttgccatgacgcattgaagcctctcccatttatggacaagtcggtcttgaatcgaattgctagctcatttccagtgctggagacctgcatggggttctcaggtgatctctgggtacacagttgggctattctgggagagtggaaatcggggcctccatagatctaacatgggatgtaggaaaaaagactttaaaaaatattttaagcaattacaggcccttgctctggctcattttgacccccggctccttgggttctatgattattagagattgaaatctcagcctccctgggtggggatgcactataaacttgagctgagttttcaaaggcactccctgtgccttaggaacacacaagttcaatcacccataaaatgcctgcttgtttcatcagccagaattgcagaggaggacggagtagattattccagaatcttccctatctcctctttttgtctttttcatgtctttgtgggctttcctgctttctctagcagaaacattacagatcatacaatattaagtcgattttctgaattttagggggacctttaaaaaaagaaatgtctgattttctaactctggcacatatgattagtcttagcataaagccattttgttatgaaagttgagttcactgaaggctaccaatatcccagttatatttttaggaatttccacctaccctgcaaactgaatgttttctaagaccacacattgaatataacacgtatgcttctttaggaggagtggaaataccagctctctgggtgtgttttggagcctaaggaaggggatgctatgcaccctccctgtgcctgctcccagcacgcccatgcccaggaacctgactaagtgcatcccacttttctgctcagggattgccctagactctgccttagtctccagatggctccttctgatatagacagcagacagggaaacactgggtagaagagggaggttccctggcaaaggccccatccccaagcctggaaacccacggccctaaacgggaacaggcattcttgtttccacacccagatgttgccttttggcctgccacgtccccatctcctgtacccatataaacctccaactccaggctccacgagcagatgggcagatgaatagaagagcagaggaggagaagaacaacgtggcagagaaggagagagaaggagcatctgaacgttgagaggagtttggccggggatggtcagacagttgatcatccacagcacagcgaaactctatggggaagatcatcttcacactccatcccctttccagttccccatccattccaatgacagctacctccatcgcccaataaaatccccacattcaccatccttcaagtccgtgtgtgacctgattcttcctggatgccagacaggaagtcgggtaccaagagtcactgagctggttaacacttgagccctctgtggatggcagagctaaaagaatactgtagcctgcccatgagggctttgagagtcacaggcacccaccactagaccgtactgtgggtagcatcttgcctgggttcctgcacctgccaatctgcatgctccccctcccataaggggtttgagggcaccacagccgaacagatgtgccacacccctgtcacaggtcctgcgacggggtggtcagggaactctcttgtttcacttctagatctatcacacatgacttcagaccacgtaggctcctccaaatctcccaaactgtctgtctgactggaatccaataccccagtgacatagtcctctggaaagagtctccttgggctcacggagggcatcttgcaggcaaggatagcctaggccaggcctccaggaggcctcacagacaggtttctcagtctcctctgggtcctgtttatctcctgtgtgtatgtgtggggctggggagggtggcgaaggcaggatgggaatcaaatagaagatgctgactcctcatcttcaggtcttttcaaacttcgatttgtaaaagaaagaccatctttgggagacagttttcaaagagttggtatctgagaccttcataactgcaactgcagccatccatgtacaggcactcaggaccagagccaggaaggcggctctcagggggatctgggcacagcgccctcccaccctccctctgtgcctttcccccacctcgggacactctgcccccattcctcagcacccccggcccttgcccaccctcaggacccactgctgactgataggaaaatcactcaagtgttctctggggagagggagtgagaacaagaagcctactttggggaggagtgtgtgatttgaatctataatgatttctttgtctgattaattccccccagccatccggtaaaggccaaaatgaatgaaacggctgttacacagagggctgagcacaaggacagtaattgcaaaggaatgaagcataccgactgcttcaggcttatttttattaggaggagctgatgtttgtgcactccccccaagtcccatcaaaagcagggctttaggaagagccctgtgtggcccctgacacgtacacatatgcaaatggcagaagcaagcttgcatggtgtgtagagccagctttctttcccattttcaagatctccctaccccctcgcctagggcacagtccccacagcatgaaactgacagcatgtgctcccaatcacccaagcccaatcaacagcacatatttggaaagaccactgaacgccaagtgttaagttctaacaaagaaaactcgcacgtcggcaaaatattctttgttttctctgctcaaacatccccttgagatcacaaacataatgggtatgagttggctggacccagaagcctctagaagaataaacactgccactttggacattatttacttcccttcttgcaaggctgagctcacaaaagcctatcgcagagaggccagactgaggtaactgtccacaccaagcaattgtcctggtttactgctccaaggagtggatttccttttctgcctaatgccagttcagaatctctctaaagactttctcagagattaaagtaaaatcaggcagagtgtttccatgaccgaaacaatggtccttctggcttccacaaataaaaccgatagtacatgactcttcaaaagaagaaaaagatggaaagaatttcagggcatggttcattcaactacagcatatgactaaactttgggggaaaaagaagtggtctgatgatcagagatttaaaaatgtgttttagcaaatgctcaggatggaggacatttcaaagcctatggttttaatctgttttgaacatttctttctgctctgttagctccatttattgttacaatcaagtcagcattccggggttatgagtaaccaaacagctgctgctttttgcaatgggccactttccggactctgatttttcaagggaaaaatggcttctgaataaattttgtgaaacccaggtaagcccaatacttagtggctgtaaggccccacttgactacactcacatgcaggctgagaaagtcagcaaagtttttagatcacatgcccatcatgggtaacaaacttttaaacccactactaacatgttatcagcagctagggaggggtgaaaaaaaccattccaccaccattagcccaattttattacagcgttttccaaatgaacatttgcagaaaagcaaaacaaggcttttgaacaaaatgtcagagggttgctccttttagctttcagaaaaaaactttccccaaatatttaagagcctcagaacagtcccccaaaccctgcttttggtggaacacgggaggccactgcaatgtcagcttgtcataataaaaataagccccaagcagactgtgcgtcttctcacagccatttctgtcaggcatagggctctccttgaaagccgcttctgcctggagtccctgatttcgtccctgaggccccaggcctgcttgtagggaacagcccctgtctctactttctcccgtaatgggtatgacacaacccgaaacacaattggcccatttataatttgccaagtgggcaacaatcacatgcactttggagtatgaaaataaagggtttggaacattgcacatagctgtggaagatccacctccagccctttgtaagtgataaggggtcttatgcaaccaagcaatatccttgcaggcgagcgaggccatctgaacattctgcacatggatgctagtcctactttgtgctgtgagtgtgaatttcaggaggcaccttgtttctcctctgagatggagtcatgacttggcaacagtccttccgtgaagactttccagttctatctgatttcatttacaattacaatagtaaattgtctgtagagctacagtaaatgaaatcagagatagaaatggtaagtcttttagagccactaaaagtaattccttgtgactctcactgagaaggatgactttactaaattactaaaagtgatgaattactaaaagtaattcctagtgactctcactgaggggataattccatttcttttcaaggtaagaacttgttttataattaaagtttttgttaaagtttcctgtaacgtccatactattcatatcgaccccttgcaccctgcacccatctatggtctcaggatttactggagtgttgagcagtgactggcttcagttattagctcttccactccccttccatgtggtcatggaaaagcccattaatctttttgagcgttagttttgaccactgtaaaatgggaataaaattcccctcttacctcatggaacgatttaatgtttaaatgagaacatggaggtaaaaattcctctgtacagtgccctaaatgtgcattattatggtgtgacaatcagagacgttgatgctttcattcattccacaaacatctattgagtgtttactctttgccaggtactctgtggagctgggaatatagcagtaaaacaaagcaaacaaacatctagcctcatggaatttaggttctactggatatagaatccttgtcatgctgtgctacagcagtccctagagctgaggtcacaggatttttgtgtgtatttggaagatattaaagtttgcagacaggtcaaagttcaaagtatacataataaatgtgttacatacatgtaactatatataacatattacataatatgtagtgtattatatacttacattaaaatatataatataataatctgttataataaatattaattattgtaattattaattattataatttatagtgtaagtatataatatactacataatatattacatatatctgggacatatctatatatgttataaaattatataagaatattacataaataatgtaactatatagtacgttatataattataatgaattatataattttataaactacaacaaaatattttaaagctatatatttaaaatatatatatatacacacacacacacatattctaatgactaaattcctgcaattaaacattgattataataaacttttgggctcaagattctcaaagactgttttaatgatccaagacacacccttcgcagaagtgctgggaaaattttcatcttcaaatgcctcatgctacctaggtggccatttttttacaaaagcgctctgcggcagatggccctggcggccccttgaagagcagcggcagccctggtaggccatccctgtgcttgttggcagtgcccagtctctatgctccgccacacgaatgctctttctgggggagctttctcagactgcaagtgtgaggtgttagccatcccaagtgcagtccttaccaatgggaaccagagttggcggaccagtgcctccactgtggtccttcagaaggtcccagcggatggagcccaagttgcccccaggggctccctctgctggttccccctcctcctttccttcactcactcgtcctgggctccggcttcctggcattacctcctaactcagctgctgcaaggccctcaggcattgcttcaggaaaacccaaaccacacattaatcccatgtctaccaaatgatcaccgaagggctgatgctcattaaaatgtctaagaatagaacactgctgactactggaaagaattcggaatcttggcagagtgatttcctgttctaccccaaactttggaatgtgctgaaaaaaccatctcacttcctacctccaagacatcaaagttgcaccttgaatgatactccacatcgaagtcatggatggtgagctgaatgctactcccggggtccgtcctaatgtaccagatacactccttgtttggtggatacctgttggggaacccggggctgctgaaggagcctgtggccccagacagctctccaccacaacctgttaaaacagaaaggttcagtcagttcaaagtgggcaacagcacatggaaaataattccaaattcaactcaccgaaaggccatcaaaaatatacaatgcttaatttaggagaaaaccgttaagttacaataaagttataattatgcagttataaaacaatgagaaaaaaatcatggctacaacttattaagtttatcctttcaaaaacactggattatatataatttagtacaataatgctcgatcctttttcttaccatatcaaaccttcgtactttaaaaaaaagtcattctaattttagattttctttattataataaggtaagaattacataacatagtcggaagtacaatggaccgtgtgagccgtggtcgtgaacttcaggtccctgggccttcagtgtccttgtagctaatacattattctgcagtcccgtgcagatctaagaactagaattttaagggctaaaaatccttagctttgtaccaaagactgtaagaaataaacaagtaaattatatagttcctaactcagcaaatttacattaaaaaaaatacaatggatatagaaaaatccaaccaaggaaaaagacaacagcatgtgtttcagaatcttgatatgtcatgccttagaaagccattcaggcagaccatgacaacaaataatcaaatgctgtagcctgcggcacacagtagaataatgccacctttcattgagtcctcatatgggctttccatgtgttttctgtttccgtactcataaggaccacatgaggtaggtactgttaggatccaattcttaaatgagcaaatcagtgcaaacagaggtggtgtggattttccaaggttaattgatgctaggatactaactgaggtgatctggttgtatcttaatacttcattactataccgcacaggctctcaaatcgtttgcaggaattcagacagagatttcagtatggagaggaagagaaaactttgcagaagaggtaaaatttgaggaaggcttatgagagacacaattagaaaagaaattatcttgttttccaacagcaatttttggtgattaacaaaacattttttgctcttaacatttctgggcctctttttctgtttttttttttttttaaatattctttattggttggtaaattcttccaattaccttctcttattcttcatcaaggctttttatgtgcgatcatcaaaaagtcaggaaacaacaagtgctggagaggatgtggagaaataggaacacttttacactgttggtgggactgtaaactagttcaaccattgtggaagtcagtgtggcaattcctcagggatctagaactacaaataccatttgacccagccatcccattactgggtatatacccaaaggaatataaatcatgctgctataaagacacatgcacatgtatgtttattccggcactattcacaagagcaaagacttggaaccaacccaaatgtccaacaatgatagactggattaagaaaatgtggcacatatacaccatggaatactatgcagccataaaaaatgatgagttcatatcctttttagggacatggatgaagctggaaaccatcattctgagcaaactgtcacaaggacagaaaaccaaacaccacatgttctcactcataggtgggaattcaacaatgagaacacttggacacagggtggggaacatcacacaccaaggtctgtcatggggtgggggaaggggggagggatagcattaggaggaatacctaatgtaaatgacgagttaatgggtgcagcacaccaacatggcacatgcatacatatgtgacaaacctgcacattgtgcacatgtaccctagaacttaaagtataataataaaaaataaaataaaagtaacagtgcctcctcactccattatgagtaaacgtgcatttttcacataacattaaactaccatggcttctaaagtaagacaccaagtctgagatcttgtctactgtccactctatgcaaattcctcctgtacagtgagttagaagaaaagcttttaaaagttaaggagttaaaaaaaaaatctccgtgcagaattccccactgcactgagaagcactgagaattctaagaatcttgattcggcagagaaatctgactctagctcaaagcactactatcttcttgacttctcagtctcctttcacttgaaaacctctgcgttttcagactttaaatgtattgcacagagcaatatctttcctgtgtcctaaaaagttccggcttttatttctaaagcctacgaaaaagctgtttaaaattagatgtgctgacattgtttagagactatgatgaatcttaaaaaaacacaagtaccgtaaaagatgagaaaatatttgtccgactacaacaacacatggcaaatattcctgaagccaaaatcatcacagattgtccgtatctcctgtaccaatgcccaactccagggagcaccgctcacaggacattctataacaggatgcttccggagtggtacaacacagtgcctcatgtaactcgtgttaagatgtaccaccttttactaaaatacattacaggtaagcaaagcctgttactgaaatttttttctcaacttgcattttcagctcagatggttctttctatcagtagtatcaaataaattatccaatggaaaaaatctagaggaaaataactttatggccacatgatataaaagataagaaggaaatgaaagtttagatagctcatttctgcatttttatttagcattcgttcatcagccaatctgattcaatttttttatcttagttgattcacataaaactctgtgtaacatttttccattgtcttttccaattgttttacatttccttgtgaattccttcgcaaataacaggatactaatacccttaaattgtcgctgtaaactggaatggtaatacagattcggggcattcagtattgctttaaaaaaattacagtatagttatatggacccacaatgtcttttttcctagtatttaaagcaaataatccacaaggttttctttaataaaaagagcaaaattttacttttaagtatatcttgttaatagcacatatatgtatgcttcttaaagaaaaatttctttttcttttctttttttttttttagtagagatggggtttcatcaccatgttggccaggcttgtctcgaactcctgaccttaggtgatccacccgccttggcctcccaaagtgctgggattacaggtgtgagccaccatgcccagctgagaaatttcaattttataagtgatactctgtcaggaaaaatattgtatgatcatgagaaagagggaaagaaacagttagggcttgaaatctctgaagttttctttttctccttcatgctctcactacctctgaggattaacatatcaaaaggaaacatttgaattaaaagttcacagcaaatgcaaaataggatagattaatttagtggtactttctggtcaaaattatacagtactaggagggtgcagcacaccaacatggcatatgcatacatatgtaacaaacctgcacgttgtaattctggtaattacggtagaaacttaactgtcttcgtatttctaaaatttgaaagaggtaaaatagcttcccaattccatttatttattccttcattcactcataagtgtttattgagcatctgcccataatacaagcagtgctatagaagccaagcatatttaatatctcttgaaaaaaagaaagacatttatagacataaaaagtgttattgcccacatgtcttcttgcaagttattaaaccctttttgcttctccttcagtttactaagagtaatttcaataagtttttatttgaagaaaacaacctgaatactattctatcctttacatgttaatcactggtaagttacaaataagaataaataactcatcctgccattaccagtcatatttgcgactctggatgcatgacaaagggataacaaacagggaagggaaaaagagatggagaatacacaagtctggagaggaaagaagttatataaaccaatacccatcaggaaataacacaggcagggatgtttagaccaccaacatccttgtcgtcatccggttacctgtctggttgaatgaacaataaaatgtaaaagaaatacagaagtttttaacaccggtcattcataatctaaaatagatgacaatgatttagaaaagcctttcaaaagaagataaaagaagataatttaaaagatgaaaataccagccaggcgtggtagttcacacctgtaatcccaacactttaggagaccaaggtgggcagatcacctgaggtcatgagttcgagaccagcctgtcccaacatggtgaaaccctgtctctactaaaaatgcaaaaattagctgggcgtggtggtatgcgcctgtaatctcaactattcaggagactgaggcaggagaattgcttgaacccaggaggtggaagtcgcattgagccgagatcacagcactgctctccagcctgggcgacagagcaagaccccgtctcaaaaatgaaaaagatgaaaataccaaccaagaaaggaacagtgacatgaggaataaagagttttgagagaaatagacacagtggctctttgtcactttggtaagagaaagttttcatggagtagacacgattttagaactgcttaattggcatgttagattgcaaaacttttggaaacattatagtgtaacagaggaagcatgggctgtagttcagacaaatgggttcctaaactggctgtgatagttcctaggtaagtaatctaacctttctttcatctatagctgtatgaatacttacttcatagggttgttacatagaatgaatgaaacaatccaaagtttttagctaaatgttgtgcatatcataatcctttcacacatgctgtgtattctatctttacattttttttttactcttttcttttgaaacaggatcttgctatattgcccaggctggtcttgaactcctaggctcaagtgatccacctttccctcccaaagtgctgggattacaggtatgagccaccacacctggccgtgttttgtatcctcacaagactttatccccagatttgagacaaagacttggagctagaagaggaattactggttaaaaagctatcatgaatagctagagaagaggtaagaaattggtttttcattaaggtgcacaaaaattttttaaaagacaatccatatttttatggtagttcagttctcaagtgcttttattttatttgaattatttttatttgaaatgcattattttatttgaaattaatcatgacaacgggaggcaggtaacaatgatgtcaggcccattgtagaggtgagcaaagtgaggttcaagaaagctgtggaacatgctcatatcacttagtgaatggcagatgtgggtacaaaaccctattgtgacacccaccctccccgatcctgacctccacttctgtgttctctctcccccatgccttgccgagaacttcagctcaaaggcacggaactaacaatgttgaatgctgccctcattactgtcctgtccctccactgaagacaatcaccatagcaacctggaaaacgtaaacaaagcaaaaatcttttaattgactttgaggcaaaatctaacagaatacatcattagacatcagctgaactggaataaaataatgccctgaagagaagcctatgtttttcagttttaaagagttaatctttataaaagttttagagctggtgactgatcatctgtttgccttgattttcctccaaactctcactcatctgccgaaaggaagtgcttgctttatctgcaggaagcacattgatctgctgaactcataacaaccaagagttacaagctgttgctaaacctgcttacttgtgtagataacttaaaataccttcataaaagaacttcactaatattgttttggtttttgtccaaaacaagccatgagttataaaattccagtactgaaacatttaataataatctcctatgtaggtactatctttaagttcgtatctgtgtgtttttaataagagctttaataaaagcaaaccagtaatgaaacagctaaatggaatccaaggcacaaaatttaaaaagtaactgctgtattgcccggcgactgctcaaatgcagtcagcgctttgctggctggcattttcctgaaactatatgccataaactgatggcatcaggaggaataacatcttgaaatacacatggctaaagcccaaagaggatggcagaaaaggaagagagaagtgattcatcaccgacaccctcccacccttatcccttcattcctaaaggaaatgcctgggaaatcaacagttgctgttaaaacgaagccaaaagccaaggcacagtgaaagagaattaaattttaaaagtaattagtgaggatgttcacgtgcttcattaaaatgctcaatttatattttaatagctttttttctataacttaacaataaaaactctttctgctctataagaccttgagatgtgcttcattggcaaggccagtttgccttcattgtgtaaaaaggcggcttgtgggctgggcgcagtggctcatgcctgtaatcccagcacttagggaggcaaaggcaggccgatcacaaggtctggagatcgagaccatcctggcaaacatggtgaaaccctgtctctattaaaaatataaaaaattagctgggcgtggtggcaggcacctgtagtcccagctactcaggaggctgaggcaggagaatcacttgaacccaagaagtggaggttgcagtgagctgagatcacaccactgcactccagcctggcaacagagtgagactccatctaaaaaaaaaaaaaaaaaggcagcttgtggaggaagggaggacacagaagagaaactgccagcaaggacccttttggtaaggcaggtgtgatgtgaattggtaactaagagctcagaatctggggaaggcccaacccaaggcaaagtgaactatttcctggagtgagtatacaggcctcacttccgatacatctatgaaacataaaaaaacgtaattacaaggattttgaacagaaactttcaggtcagggagggtggggaagtggacaggaatatgtgctccttaaaatggccaaagttgtccaaaggtgactggcatgtaatgagaaccacaaaaagtcagtaattcctggtttgatgttaccagttaattccccaacatttcacaggtatgtggccaagtgataggcatctgtcctactagggtcactagtcctctctgaacacaaggccaagggtggagctcctcaaattcataaggacatgaagcatgtgcagatggatttttctgagggatttagtcagatagcatgtattctgtgaggaaggggacacaaactggagtgatcacgagatgaaatcaaagaagaaaatcaagtaatataaaggccaaggaacataaaatttccttgagaaaaaagaaggaagaaagaagagagtgaaaaggaagaagaggacaaaacatcgtgactccaggagaggagagagttgtccctgtattgggttgaacactgtcccccgagacttatgcctaccaggaacctgtgactgtgacctttttggaggaaagggccttggcagatgcagtcaagttaaaatgagatcatactggattggggtggaactgaaatccaatattcttggtatccttatacgaagagggaaatttggtcccagacaccaagaaggaagaaggtcatgtgtggatagaggcagaaattggagttatgcatctacaaggcttagaaagccaaagacagccatcaatcaacagaagctagaagcagcaaggaagggtcttccctagagccgtcagagggatgaccctgccaacaccttgactttggaattccagcctccagaataaagagaacaaatttctgttgtcccatgccacccagtttgtggtacttagttacagtagccctaagaagctaatgtatcctcattctttccctgataattgaggtggccaaactcccaggtaggtacaaaatggtaacaactatttgtgtggtattcaaggagtgcacatttgtaaactttctgtattccatcttgtaattattacttcctatttgtcatcttgaggtttagaggatggttggtcaagggtaagattttcatgaaaacagaaaaggtctattgttgagaaaactagcagcaaatacagggccaggtatcacatcaggaagaaacaggtaaacccaagaaccagggagttaagtcataacgatttttagtgttggagagtcaatgaacgtttagaaagtttcatgttccatggagacttcatccttgccccatattttgtgataatccattttattcgactaatttctatacagcagtggatataaagtagagcatcgggtttcaatggtagagatacaataaaaaacagtgaaagaataagttattgcatgaagtcagtgacttggaaaacagatacaagaagcttagaaatcaatgctgtggaccgctatataatgacctttacattcctattcaagatgtcatataaatactcaaagttaagactgtcatagccatctgactatctaagatggcctagatctaaatactgatgtgtttccctttagtacatcatcaaagagaaagaaatccaaagaagccataattttggagtttctgtgtaatataaattttaatttcctgtatacaaaaggatactatctttcgtcttaacctagagaagttagccaatcttgtcatcttttcactttgattaactttatcagtttccttttaagctactaatttcaatcaaattaaaaaatggtttcccagtagaaatcccttgcttacaattcttcaggagaaatcaatcatttgatcaatctcttttccctctccttggatgtttttgaaatgattgaagacttctaaacaaagtttagtataaaaaggtacaaggaaagaaatgagactaagataactgtactaaccttccctgaaataagcagtcatgcctaaggctactgaaagcttctttatgaaatccctcaaacaaacaaagacagagaaaacatgttctctgtaggcagtttccaagttcaacagtcatacttctatttagaaatattattcaaacctgcattccttcaatttcattattttggtacacagggctcttgcagggaaaagctcaaagagcctccagggacctacattgcaggcctctccctgattccttccctcacctcctccaacctctaaccttccctctgcagggagaggactccacccggagaaatggacacaggtgggcagcaccacgtccatggcagtggtgttctgtgaccctttaaactctgtccaaatctgagcctcaaggttgttttctctgattacaacatcccatgctgcaggcccctcgcagggcaaatcctgcatccagccagcctgggtccttagcttaggggaagaaaaacaactaaattacccaaatcctcacatgctccaccccattcccatggtccactctagcccggccaagttgttctgggagcagctacccttttactcttcactttaatataacttctccctcttgtaagcgagtttgtataactaaaccttggcaactgaccagatgatctccgtggtttctcccagatcggtggattccatcagcaacatatatagcagctccagaacagcactttataaatgagtaataaagcagaaattgtgtttaaggattgcaaataacatcagctatttcgaacttgtcttttgcctagcaatgcgcccctccgccccaacccacatattattgctacttgaacctaaagaaagaatgaattgtgtcacttagtgggaagcctttgaaactggatcaccatttacttgggtaagattgcacacatctttttaaaaacatttattattacgggaatttataaaattacctactataagctctgaccttctttgcattgcaatatcatttgacctttttttgcaatgaaaagctgtggggaaaaaatatttgctttcaggcaccatcgtgctacttattgcacggcctttgagtttgacatcacacactgagttttgtgttctgattccattgcttagtggatgtgtaagtttggacacatcacttaacttgtctcaggcttcttcctcagttttctcatccataataagggaatgataatgctcatttaagaaaattattgggatgagacatgagattgtgttcggaattggtttcttccggtgggttcttggtctcgctgacttcaagaatgaagccacggacctgaacagtgagtgttacagttcttaaagatggtgtgtccggagtttgctccttcaaatgttcagatgtgtccggagtttcttccttctggtgcgttcgtgatcttgctgacttcaggtgtcaagctgcagaccttcacagtgagtgttacagctcttaaaggtggtgtgtgcagagttgttcattcttcccggtgggtttctggtctcgctggcttcaggagtgaaggtggagacctttggagtgagtgttacagctcataaacgtagtgcggacccaaagagtgagcagcagcaagatttattgtgaagagcaaaagaacaaagcttccacagcgtgcagggcaaccccagtggattgccactggtgcgcaggaggccagcttttattcccttatttggccccgcccacatcctgctgattggtccattttacagagcgctggttggtccactttacagagtgctgattggtccgttttacagggtgctgattggtctgtttttacagagtgctgattggtgcatttacaaacttttagctagccacagagcgccgactggcgcatttacaatgcttcaagctagacagaaaagttctccgagtccccactggacccaggaagtccagctggcttcacttctcaagatcatatttttaaattacacatgttgagtcatgttttaaaatgataacatcaacaacagtaatagtgaatgagatgtcaattaaaccaatgcactaagcgtttaatcatattttcattcactctttacatggcaagatagtttatttttatcataatatcttcagacaaatttaagattacatttaggtggtaaaatctatattatttatcctgcattccttcaatttcattattttggtacacagggtcaaaatagtctatatttgagtagcctgtggaactaggaggagaaaaaaatcagggacagagtatattattgtcattactgatctacagattatcaaattctactaactcttataagtggtagttactgtcctccaccagatttgttctgtttgtgagacaatgctgctgccacctggcactgcttcctctgttcctctgagtacacagtgcattcacacaaaacaagtccttggatatgtaatgtttgaaacaaatatggcaacatttaagtcaatggtcgaaaagagaaacctctggggacaaaaattcaggttctacgctgaacgtcacatttgttctgagttggcttagaactcaagtttctacacttcatttttggctgctatgatatttgaaactgaaaaaaaaaagtgtggttttggtttttgtgtcatacgaaaaagtgtggaatcccctgcaaagtacatgcattcctctattggggatattgttgccagggaaccagaacacaaacagaagtttcgagaaagccctttctttggcccagatctcaaggactgttattacaaattgtgcaatctgtgatttgggaaggtcatggtggtttgagggttatttttttttctttttataactgtttcaaagagtggcaatagaaatagaactccaactttttcaaacagtggcgacatgggaatggggaggcgagactcctgagaggcccttgctggtgaagagactcagagccaacatgagatgaaggtcaactgtgtggatgtgtatttactgctgtcgtcaaggaggcagaaatgtcaggagtgagcttttccactcattctgaaaggtctgcatatgcacagctttaatgctgcctctgatcattgggaccttgctggagaaactctgaagtcaaggccaaaagagctgtgggattttcttagtcactatcccaactttacaacaaggagttatttagaaacagatttcttagaaatgagcatcgtccattaagaatttctttgcagaaaagatataagtgaaaatttgtcataaatacaaatcagactcagtatcacgatgcagaaacctgtgctttggttccacactaagaaggaactcatttccagtctccatgcttaaaaatattttaagagtatcacaaagacaaaagcccaaaatatcaaataggctgaaaaagccatcataaacaggatgggatatagcatgtataaatgtgagagaaagaatagtcagcatttagggaaatatctcttaacttaaacagagctagttgtttttaaaagcttctcttttacttaaatttctaccaaaaccaagcaggatttccttatctgacatcaaattcttgaggttactttggaggcggatggatgggtgctttaccatttctctctgtgtgacattatgtctatcacagcctagcaggaagcgacactgtgaaagcaattccattaccaacggagagaaggtctgcgcctgagattagaaccagacagtgtgattcacagcccagccctgtgaacctgcgctagaatctttgctgaccacaattcataaatcactttcattgccaacatcatacttccagattgttgtgaattttttcaccacgtggcagcaaggacacacaataataaaaattttaaattgaacattttttgttcaataaaattttttcgttcaacaaaagttttttgttcaataacaaaaaagagccctaaaatcattttcaaactggaaaacttaggtaatcatgagtctgtatttcaaagttataactttgaagaaattattaggaagagagaatgcggcaattgatctaatattttctgtgccaggatttatcacagcactggccacatagcccttgagtgtctttgctgaggattcatcagaatgttactcaccttggatcatcagttgtcttgtctctgcagaccgctattcctcgctcttagtaaccaggacccagaatggtcccctggggttgcctctgtcactgtgatctatgatgtctccagttgtaatctcctcccttgacatttcccactccattgtctaaaacaacagtggttcccttttccttactacgttaagttcacactagtctagctggctttgagaattctaaagaatctagcccaggaggtctacgaagcctcatatcccactgtcttcattacatcaggcttgtttctctctctttcttggctcatgcttatccaggcaccatctgtcatttcttgtcctgatcattcttcaagggctctaaaatctcacagagtccgtgaagattttccccaatgacttccagcctccttactagccttgcaataggcacctcacagttcagcacttctgttagttttctacacctgcttcctaactgatcatgctcagcttgaagacaaagactaacgtggtatttctttcatatgcctaaaaataccttgcacagttttggatatatatttcatcatgctcacaactccaaattcaccaacatgtagtttattccaaagtctctttctctggcccaaaacctcacctaatttttatactgacaccagcaattgctgaaaggatacatcccctgaacatctcaaattcagcatgttcaaatagaagctcacaattttcccccaaacatggtctttatctgggatttcctatctatgaataatggcaccaccatgcaccaaatcatacaccgcaggaaaacgggagctatccatgattccttcttctgtctcccagattgacacacatctactccaccatcagatctgcccatcctaccttctaaatagctctttttttttttttttagcagaatctcactctattgcccaggctggagcgcagtggtgccatcttggctcactgcaacctctgcctcccagtttcaagctattctcctgcctcagcctcctgagtagctaggattacaggcacgcaccaccacagctggctaatttttgaatttttagtagagatggggtgggccaggccagtctcaaactcctgacctcatggtccacctgccttggcctcccgaagtgctgggattataggtgtgagccactgcacccagccctaaacagctctttaatacgctgcctcacccactactcatttcctttctccctgctctgactagtcaccaaactctcagtctcttcctcttcttgggcatccctctacttgccagaactcttattctaaagtgtacttctgtttgcatcactaaatttcccacttaaaaatccattggtggtctttccctgatggcaggataaaatccaaattcttgtgatgtttcctatcagttggtttctgataacgtgtcctgcgtcaacttctatcactccctttccctagtgtttctcaccttttgttcattatcagccccctaaggagattgttcggacatttttttccaaattctcaaccatgaaaatttaataccacaagtatattgcatatctgttatgtactgtatatctttatgctttatacattaaagagtaagaatttcttaatccccctaccaagagccaattttacctccttggagttgatactgccccaatggagaatgcagagaatgtgtggtctagctgaaggacttgctctttgcaaaacttttgtgccctcacaccttgctgcttctacttagaaaagccttcctctcccagatatttgtctgatcaattcttgcccattctttaaaactcagttcaaatgtcaaagctgcctggaggtctctttgaacttccgcaggctgtcctagctatttttttctgtgttcccatggcgtcctggattatgtatatatttctacacttggtttacctgccttgcctactctatgactaactccccaaagtcaagaatgtgatctccttcctttctggtatgggctgaattgtatctctgccaaaattcatatgttgaagttctaactcccagacctcagaatgtgactgtcctcggggatagggcctttaaaaagaggcaattaagttaaaatgaagctgaatggactgtaatccaatctgactggtgtccttataaggagcaaatttggacacacagagctatcaggatgaacacacacagagaaaacaccatgtgaggacacagggaaaaggcagcatccgcaagccaaggagagaggcctcaggagaaaccaaccctgccgacaccttgaccttggacttccagcctccaggagacagcacacttctgctgcttaagcctcccaatctgtggcatttttgttacgacagcccaagcaaattaatactctctatatttagacaacaagcccaaaatatgtgctggatggttggttgaatgaatgaaaaacttcttctcaaaaaatatctgctggcagaggttatgtgtaattgacatgtaaataatcatgtaattaacatgattcacagttgtagctgcctgttcattataggctgggtccagcagatcttctcctagagcccagcttactcaccctcacaccctaaggcattttctctcacacaagacaagtggataacagaattacaaaagataaaacctttgtctttaaagggtgaacctcccagaaatcgtactacatgtactctaagtcacaaaaggaataaaatttttgaatgagaaggaattcccccgaaagaccagtgataaacaaaggctaatgaaagaccactcgagagaaagagacctggagcaaagatctaactttaagagaaacactgccgacctcatggcggttttctgccagtgctctaaagatgttttttaaaagccctttggtacagtgcctcatgcccacaggtagtcaagaaggcactggcttacatccaaaccgagccagtcataaaagatgttgacacggtttttaaaatgttctcttctaatttctgaaacttctcaaggcttgagaaatctccttaatagctaaaaggaagataaaatggacccagcccccatttgagaggctgatgtcatctatcttcccaaagaaaaggccactttttcctttgtggaaatcctgggtgacatcacctcctgatcacatgccccttagccctgctcctgcaagctcccagctgaagggttcgctccctttgcaaatgtcactctctcgctcacaaagctccttgaccttgtttgtatgctggattccatcactaagtgaaagaaggcttctgggagcaacgaccagaagaggcgagggggtctgtgcagctggttgggaggccacttttcacacagcctgcggaaacttctgtattccccacccctatcccccaccccctccccctgcaacccagatggaggcctccaaggctgaattcagccgctggacaatgctgtcaaggctgaataccatgaaccgattagagacagggcaactgtggccatttctttatttccagggtggggccctctttgaggacccgcataaaaggccctgcaatgttactttgtctcatgtctgcatggccatgttcagaaagagcccacagataaagcctcgttgtagatccgttttcttaaagccaatagaaggtttgtgtcgttcacaaagaagcatattttgtaaatgcgtttgtgtatgaactggggaaatgaatgaagtgtgtaggaactcttcctcagaagcagtgctcaggaaatgatgtcgctgccaagtttgaactctctgcttggtgtttggagatcgtactgcacagtttagaaaagagtccagtggggagggtggggcagggggaagggattgcaaggtgataggattctgaggaaaagaggctaggagtttaaagccacttgacctggccagggcacgaagagcaactccaggaccagcgttagcggggctgtcctgagccctccacctgattctgagaacatcccttgcggggctgtgcaaggagaagcctttctaattattttccttctgatatgttacacacactcacacaaatgcatttaagaatgttatgaccagctcagtggctcatgcctgtaatcccagcattttgagaggccgaagcaagcaaattgcttagctcaggagtttgagaccagcctggaaaacagagaaaccctatctctacaaaaaatacaaaagttaactgggtgaagtggtgcacccctgtagtcccagctactcaagaggatgaggtgggaggatcaccttatcaaaaggctgaggctgcagtgagctgagattgcgccactgcactctagcctgggaaatagaatgacacctcgtctcaaaaaaaaaattacaattacacttgagcattgagagtaatttttacatttatttagccccatggctgtagagtccctgcccgtgtgtggtgtgtgtgtgtgtgtgtgtgtgtgtgtggtgtgtctcttgagcactgagagtaatttttacatttatttagtcctgtggctgtagagtccctccccgtgtgtgtgtgtgtgtgtggtgtgtgtgtgtgtcttgagcattgagagtaatttttaaatttattttggccccatggctgcagaatccctgctcgtgtgtgtgtgtgtgtgtgtgtgtgtgtgtgtgtgcgcgcttagccacattatgtgcttagctctgcagccaccttggcagcgctgtttctcttcgactcagttccatcctcttgacttctcaggtccctcgggctctccccactccctcctatcacagggtctttcttctacctggaatccttttccttatcctgcttgcctagttaactcctgcttattttttaggttttggttcagaggtctcatttgcgtggagatcatccctgacctcctgctgggcccaagtcagatgccctgtgtgtgcccgcttggcactactcatggttttgattttctatttatttaagtgtgtttttgcgtgatgtctgcttctcccacctagcctagctctgtagagtagaaaccaggcctgctggtctgagtcactctgtgtcccccgtctcagcacagtacctggcacaaaagacatccttagtgtctgtggaatgaacaaatgcgtgaatgatacatcatgatttacgtcttgcatttaactccaatggatcaaaaatggcgggacctctcccatggaagagctcgccctctctgtgggctccccttctcaggttatctcaaactaaagacctacttcagatgcagagtattgaactctgtgtacctgtggcattgcatacctgtagaatatgatagtcaattttgcacagatctaaatgactaaaaattcctttccagaagtttcctcccaagtataatttacatattgtgagcagcacagagttaaaaaacaattttatatttcggttctggtcccagctggcaacattttgttgcataactctggctccaagtttccagcaactgggagaaagttttgaaatagtaaacaggaaagcagaatagacagagggtgcctttgactctcccaaaggaagacagattccaagtagaactggtagaaaaaaatgttcccaacataaaactcagagatttcaccagaatattcagcacattggctggaagagcccattgatacagtaatctgggcacagcctgccatgaccgttcaatcaagctccttagagtggccttgggctagtaaggctagaacagcctggaggggagaggaagcagccacttaggagaaagtaatcagcaaaatcactgccctcccaaactctccatcctgactgtacggatgaatcacttaaggagcatttagaaattagcaatagtcagggccccactgcagaccaactgaatcctgtctctggatattggaacccaggcatgggcactttttaaaactcccaggcaattccaatggtgcatctaggactgagaacactctccagggccctgagcccaggcttcctggttaacatttcttaccttctacacttctgtccctgggggaaagttctctctgctttagatcttgctattatcctactgtcattaaaacaaacagtacaatgtgccctttcaacatctcagaaggattctccagtctctagggatactgtctttctaccatctcatttctccagtctcaacacttgctctcaccttgttcctcagagcggtccatagagcagcaccagcagcattacccgggagcttgttagaaatgcagattcacgggccttgccccagaccccatcctctatccaacaagatccccagggttcatgtgcacaggagcatctgggtagcacgtatgctctggagaatgccccagcccttgaaattctgggccatttcccaggattctcctgacctttctgtctcttttcacactgtctctagttagaatcatgtgtttcagaatcacggaatactacagatcatctgtattatagagatgaatcaatccaatccctgcatttaacggatccatgagttgacttaggttgaatctacccacttgggccaggtgcagtggctcacacctgtaatcccatcactttgggaggccaaggcaggaggactgcttgagctcagaagttcaagatcagactgggcaacatagcaagacctcaactctactaaaaaaaaaaaaatgccaggtgcagtggtacacacctgtagtctcagctactcaagaggctgaagtgagagaatcacttaagcctcagagctcaaggctccagtgagctatgaccaggacactgcactccagtttggatgacagagcaagatcctatcttgataaataaataaataaatatataaatatctactcacttgatgaagaggaaggtccagaacttctacaagcttagttatcacaactcatttactttgggaattcctaatgtacgtttcaagctgcaagtagctctgtggatgaccactgactatttttaaatactgaaagccccatacatattttaacagacatacactcagagcccagtttataatctcagaacgcctagcactcctaagtgtataatagggctattcagttataagtagctctgacattcctataatgagtgcaccagaatgtgaacaatgttaagagtcaaccactgcacacattcatgtgtgctcagctagagctcagccctgattttgacagcagggccacagcttagatgtctatgcttggttcctggtataatcttggaactccacttctctttccagttgattgaaatacaccaatgagctctagcatcatggttgagaactactgctatgagacccacaagcactacatgttccagggctagatcactctaagacagtagtgtgtctggaatttattccttctggtgggttcttggtctcgctgatttcaagaatgaagccacggaccctcacagtgagtgttacagttcttaaagatggtgtgtccagagtttgttcagatgttcagatgtgtccgcagtttcgtccttccagtgggttcgtggtctcgctgactttaggagtgaagctgcagaccttcaccatgagtgttacggcccttaaaggtagtgcggagttatttgttcctcccggtgggttcgtggtcttgctgacttcaggaatgaagccgcaaaccttcacagtgagtgttacagctcataaaggtagtgtgaacccagagtgagcagcagcaagatttattgtgaagagtgagagaacaaagcttccacagcgtggaaggggacccgagcaggttgccgctgctagctcgggtggccagcttttattcccttatttggccctgcccacgtcctgctgattggtccattttacagagcactgattggtccattttacagagcgcagattggtccatttttacagagtgctgatcggtgcgtttacaaacctttagttagacacagagcgcagattggtgtgtttttacaaagtgctgattggtgcatttacaaacctttagctagacacagagcgctgattggtgcatttacaaacctttagctagacagaaaagttctccaagtccccacctgacccagaagctcagctggcttcacctcttaatcccccctctaaacaggacaccccaactgctgctgggaattgggtgatgaccactctagctacttcccgctggataggggcaaagaaggggccctgaagttgtagtgtcctccagaggggaactctttaggctaatgaaagggccagtgggtcggtccaggggtccttgatagaagttgttagttgagctcatttggggttccatttgtaagaccatctgtagcctgatggccttgattctagaggaaacaaatttgacaaggaggttaaaaatacagggcccgaaggcaagtaatagcaagatggctgccatgggacctagaaaggggagaagccatattgcccaactccagaggttggtataagagtttgaaaggcattgtctgatatcagaagctttttcctgtaaatgctgcgtggcatctcgtactatccctgactggttagtgtaaaagcaacactctttcccaaagaaggtgcaaagtcctcctttctcagcagtgaggagggtctaggcctcagcagttttggagagtcactgctgccgaagagtctatttgggattgtagttactatccttactggacagattttgttatttcttgcaaactgtctgagaaatgctttgagagtgtgtggtagtaggataatgcatgttacactgttaacttttagcaaactctacgttagtagaaaaccttgtaagtttgggattttaatttttctttgctattaataaaacctcattccatccatattaacttagaattggtatagatggctccttcctgattctgtaagtactttaagatttggctgagtgaaaacaacttgcacatttgagcagaccaattattgggcaattttcctaactctgcttccataagagtttcctgaatacccattgtgtctttttccttaatcacctgggaggaaccatctatatcctgtcctgaagggagctcctcctatgtctggtgggacctttgtatggtaattaagatttagatcccctgttaggaaacttgctgggttaaggatgtttgataggaatgctatgggttgtcagtggcctcagtgctttcaggttatgcccttgtttacactgacaacaaggtggtattggagtgttacagagttacagagaagaccttcaattatctattataggttttaaatttaccctggcttttaaaggaatagggtacactgttttttctttactacttctatccctttctctctctttgactcctttgtctcttcctctctttccttctctgactttgtctgtctcttcctctctctctctctgactttctctctgtctcttcctgtctccttcttttgacttcctatctttctctttctctctctgtctctctgtctcttcttctctctcactctctgactttctatctctctgtctccttctctttctttctctttctctctgactccctctttgtctctctcttcctctctctgtctctctgtctgactttctgtctctttctttcctttctgctggtctttccctgcctctgccagccacttatgctgctgttctcctctctccttcccctttttgatggcttcagcagtgtaagactgccacctccttgggttttggcactgagtgcaataactccatgatttccttgtggtatttaataggggatcccccagaggttaggaactccctttctttccatattgcagcacgggcatgtaggattagataagcatacttgctatctgtatacacatttattctttttccctttcccagttctaaggctcgagtaagtgccactagttctgctaactagttgctggtccctgggggaagaggcttacttcagtatggttacatcactaactatggcacaacctgccttttgtatcccattttccacaaatgaactttcatcagtatataggttaaggtcaggattagctaaggggacttgtaaaagatcatctcaggctgcataaatctggactataatttgttggcagtcatgctcaattggttccccatcctctgggagaaaagtggcagggttgagggccgtgcatgtacgtatctgaagcactggtccctcaaggagtagcacctggtatctaagtaggcggttgtctgatagccataaacttcctttggcacctagtatgccatttacatcatgagtagtccagacagtgagatcctttccttgtattattttgatagcctctgactattgctactatatcaattttcttacttaggtatgccactggttgtggggttgtcccatgagtctaaggaccccaagagctattcctgctctctctgtgatgtataaagaaaagttttgtcctgtgggaaagcttaaagctggagcttttactagggtctgctttaaggttttgaaggctgtttctgcccctggttcccattctactagatgagtatttgccctctgggtctccttgattagagtatagaggggcctggctatctccttgtatctggggatccacagtcagcaaaagccgatgattccaaggaacccccacaactgttttaatgtcttagggtgagcataatccagtgtaggctgctttcgttccttgctgagggccctggtccctctggctaagattaggcctagatatttggcctgctgtaggcaaagctgggtcttcgacctagatgccttgtacccttgattagctagaaatttcaagagatctagagtcgcctgctgggatgaggcttccaaacaggtagccaaaagtaaatcatccacatattgaaggaccagagtgcctggacttgagaagttacctagatcttgggccagtgcctgagcaaacagatgaaggctatccctaaacccttggggcacaactatccatgtaagttgggacgtgtggtctgtggtatcctcaaaggcaaagagaaactgggagtcagagtgcaggagaatacagaagaaggcatccttgaggtccagaacagcaaaccaatctgcctcccttggcatttgagagagcagggtacaggggttcagtacaactggacatagaggaaccaccacctcattgatgagtccaagatcctgcactagtctccaatgaccttttgattattgtactcctagaattggggtgttgcagggactgctgcatttccttactaagccttgagcttttaaatgtttaacaatatcctgtaatcctttatgagcttcaggccttgagggatattgcctttgataaggaaaagtggtggggtcttttagcctgatttggactgggtgggcattttttacccttccaaattgtccttccagtgtccagactccagggttgattccctcctcaagtaggggaaaacaaatgggtaaattgttccccatattcatgtagataatagctccagctttggctaatatattcctccctaataagggtgtgggactttcaggcataacaagaaggcatgtgaaaagagcaaagtctcccaattacaactgaggaggtaggagaaatacctggttacaggatgtcccaggattccttggatggtaaaaccttgaggacagtcatccaggacaagagattaacactgagaaggccatgccagtgtccaggaggaagtcaatttcctggccctcaatggttaaatgtaaccggggctcaataagggtcataacatgagctggcacttgccctgggcaccctcagtcctgttgttggatcatctggttggggacttcttgcccagagaaccactgcactcaggggcagtgcaccttccagtgattgcctcagcatagtggacatggacgagggggcggcttgtttctcactggacaatcttttttaaagtgtccttgtaaaccacactgataacaagccctcccaggtgattggcctgctccattttttgtcctttctgaaccaccaaggtttgtttgtctgaggaccatgactaaggctgtggcctttctctgatctcacttttccttttgggtctgttcctcttgatccctattatagaacaccgaggttaccaggtttaataatgcctccagattttgttcaggacccagggctcgcttctggagccctctcctgatatctgcagctgattgggtaataaacttatcttttaggatcaattgaccctcgagtgagtcaggtgacaggggagtatattttcttaaggcctcccatagccacttgaggaaggcagaaggattttcttcctttccctgagttatggtggacatcattgaataattcatgggctttttcctaattctccttagtccttctagagcacaggtcattggatgtttacaactccagtccccataatctgagtcgaggtcccagtggggatccatactggggaaggctttttgaccagtagagaatttgtccctttcttcagctgtcatcctatcatttacttcactaagacaccaggtatctccaaactcttgggctgcagctaaagccacattcttttcattaaaggccagggtttgatctaacaatagcaagatatctcttcaagtgagatcaaaggtttgccctagaccctgtaggacatctatgtacctatcaggatcatctgaaaacttccccaggtctgcgttgatctgctttaaatcagagagggagaaggggacatgtacctgggttgggccaaattctccttcccctacagcttgaagggtacataaccaatatcccgggggtttttgtggtcccttggagatttctttgcttatttccttctgggtgggggagattagaggaggcttatcattaatagggagcggagctatagggaggctaggatatgggggtaagctgaaaggtcctcctgtgggatgtaaattgcaagctttgcatagttgtgtattcaccttcaatgaaaagaaagcttggacataaggtatttcactccatttgccttccctcttacagaaaaggccaagctgcaggatagtattgtaatttatacttccctcaggtggccatttatccccatcagagagagaatattggggccaggccatagtgcagaaaaaaatgagccacctctttttcagggtttgcgggtcaaattggtcccaatggcttaggacacatttcaagggtgagcctgttgatgcctgagtgtttcccatctgaaagacaaaactgcccgtgcttttggtttgttttgtttctccctctgcccaagaacccgcaacagtccctggaccctgctgatcagaatagttgcactcaccaacgcagcagcagaaacactagttttcctcctagaccacaaggaggactgaggaaggtcagatttagtggcccttatcaatgtattctccaaaacctgcacccttgcctgtcctcctagaccacaaggaggaccaagaaaaattggatttagtggcccttactgacacattcttgaaaacctgttagagtcctaagcattctcttgttagtactgggaccttacccgcatcgtataaaggtgttatgccccaaaaatgaagcagagggccatatcctgaggaagggaagggatctccagagttggaagagtgatgccttttgtcctcacttatatgaataggaaggatacaatttctgatgctacccatatcctagcttcaggaatagctattgataggcctgcttgtctgaggagggatcctaaaattccagatagtaccccctacaatggggctttgggcaaagattatgtctttctgattggtgaacccaggtgcctaaagaaggtaacagagtcctggagtttatattagaaatcattcttacaggagaacctagaaaagcaacagagacagggagtggtttttagaagcgggactagcctcagagaagagaggcgagaggaaatttgtctgacaggcattaggacccaggaggcaagggtcaggatagataggatagatgggcaagtcttgcttgggtgacatgactttgagagttttactcatggctgcagggccaaccaacttgttgttgggaccccagagctgaatggctttcctctctgtcaaccctcagctcagcccagaagtacaggaaaagcggaagctggttccaggccaaccaacgctcccaactccgaagagttgggggttgttagagagccgtttcccagaaagcctgacacccgtgtctttagtctggcggccatgctagtcacttttaactggccaagaggtgcccggtatatagcccccaaattctaaggaaaaataggacagaatagcaagcgaaaggggtccagtggtactcaccgcttggtgattgtcccatctgggtcaccaaaatgtgtccggaatttattccttccagtgggttcttggtctcgctgacttcaagaatgaagctgcggaccctcgtggtgagtgttatagttcttaaagatggtgtgtccggattttgtttgttcagatgttcagatgcgtccacagttttttccttccggtgggttcatggtctcgctgacttcaggaatgaagccgcagaccttcgcagtgagtgctacagctcattaaggtagtgtggacccaaagagtgagcagcagcaagattcattgtgaagagtgaaagaacaaagcttccacagtgtggaaggggacccgagtgggttgccgctgctggctagggtggccagcttttattcccttatttggccctgcccacgtcctgctgattggtccattttacagagcactgattggtccattttacagagcactgattcatacattttacagagcactgattggtccgtttttacagaccgctgattggtacatttacaaacctttagctagacacagagcgctgattggtgggtttttacagagtgctgattggtgcatttacaaacctttagctagacacagagcgctgattggtgcatttacaaacctttagctagacagaaaagttctccaagtccccacctgacccagaagctcagccggcttcacctctcagtagtttccaaactttaatcaccagggagaccagttaagacacagattactgggctccacttcaaagtttgtgattctgtaggcctgggatggggcccaagaatttgaatttctaacaggttccaggtaatgctgacgctgctctctagggaccacattttgggaaccactgctctggggctctccacttgcagattggcccacctgagatttgaagacatttcagatctcttgttaaagaagacctttcatcttcagaggaatgatgatccctacctgcttcctgaaccaccaattcgtaggtgggatccagatgtgccccttcctgtttgacaagtacaacacatgcccctggctttgtgcatcgcagctcaaattctcctcctctcaggccaaccctaccccttccttttccccatccctgtctgactttcattctttctagtctatccctaccctttctctgcttaacgtcaaggtgagccttaagtctcattctattccattgcacctgagatactcccaccccaacttgcagttagcttgctatacccaggttcaactcttcatccctagaaacttcattctgcttctttctttatctaaggcaatttattactacacctacaattaaccaaattctttccactttgatgtcacttcctctcttaatcctaacagacttaactctccaagttccaccaatatctaagtatatttcttaaacccttgcatgagattactacctgggttccattatttgttcatggtattgtttctaagtttggaactgaaaaagaaaaaattcttggccaaatagcaactgcaaatacaactgagatcagcacctggcttaccgtaaacaaaccactgcatctgaaatcctttctcacggcggccaaccccatctgtaaggagcagcacttgaagcttggagcttgtagtactccctggagggggcaggtctactccacagtagcgtcccatctgccgtggtccatcatagagctgaaattgaagagaaactttcccatataaaaacacatggtttgtgggatggaaaaatccaagtctacacaagtagcaaaagctgttccttggttcaaaagttagaggtaaatctgctgaggtgggttgagtacacagaactcaacataagaattaaaaattgataattgcatagagagggtattagagatggatctgattcctaagcccaataaatttggaaacccaactagtaacttttggttttatgtcaacctagcaagtccaaagtataattcaggctcagaatacggaaatagtaggcattcacatattaacaacacataggggggctcaatgaatagcagctattataattgtaagatataatttaaaaatatttttaaatgtttatgggtacatagtaggtgtatatatttatagggtacatgagatactttgacacaggcatgcaatgtataataatcacatcatagaaaatggggtagccatcccttcaagaggtaatttttaaaataaatgctacctgtaaaataatcagacattttagaaatatatgaaaaaggaaaatacaaatattgattcgactaaagacaaacactgttaatatttcattaaatccaaaaatttctcttgatacttttttcatttgtatatatgtgtaatatacctatttgtgcaggtgtatatatgtgtttatacatttgagctatgtatttaattgtgtttcttgtttttcattgaacatatcacttaattgtgtaaaccttggtgtaaaatgccacaaatataatgtatttatattataattctattgttgtttcatttaagatatttccaatcttttgctgatataaatagctgtttgatacttcaaatgtttcttttaaaagattcctagaaagggaataacaaacagtataatcatatggctctttataaaatattattaaatttcttaccagaaagtttataccaacctatcctcccacaagcagttaacagaggtgtttctttcagtggagctttgtcaattatgatgacgatcatgttttaaactagtactgacagtgaaaaactgcctttttgtaattgtcttaacttgtgttattttaattactttgacattgaaggattttttttttcatgtttaggggcatttagatttcttctcttgtaaattgtttactgatgtcttcgtccatttttccattgaggtatttatacatcttcaaggagaaatggagggtgcaaggttgtgtccccttaacctacctcatttaatgattttatcagctgtatatctccaaactgaaaaataaaaattaaaaaacacaaaaatctctctactatatctcttcacttgagaaagataatggcaatccaacaagactggcttcctcaggactaaggccattacattttcacctaatcgccttcatgttccctttaaacactttgttccagttacccttgggataagctgcccatgacaacgaaacataaaatacctggtaatggactcatggatttcctcgaggatgcccttggagagtacatctacttaagagtatgtgtgagtgtctgtgtgtttgcacgtgtccgtgcataaatgtataatctggattcaatgaattccagactgatcaaattattttcattgaaaaaaaatgttatgacatgaaatattgtttgaaacatattgatttgagtgtggagaactttaccaccaaatgttacaaagcacctccatggagccgcccctaatccctgcagtcaggcataaattagtctgcctttgaaagcccttgcttttcatctgtgcttcttttgtggaaatgatcacatccccaggcattcttgttatgggcttgtgtgtcttacctcccctactgattgtgagtcgccttaaagcacagaccacctctggccttcccctcactgcccagagcagggctttgataaaggcaggttccccatgcatctccaatgaatgaacgcagtgatttcccccgccagctgtatttattttacttaggacccaatctgcacgattatttgcactctgtacagttagataggtagtagtgccatacaatcctcaatttcaacaggctcctcttagaccataaaggatttggaccctttgtgccactccgtagaagggagaaccaggtgagggccttgtttaaggttatgataaatcgcagatttttaaaccttggcctgtctcgctgagttctcaaatcggctgctcatcataagtgcttgtgagatttcagggaaggtcagcagatatttttaaaaagacaagctcagaagcctattatgtcattcaccccaaagcactaaacctaagcattttaagcaaatgaataaagatgagttttatttttcaggcttactgctgtagcttcctttttttctgtttttcgtactgctgctttgaatgtgtatatttattatcaagtttctaatattctacacatttatcagaagcctcccctataatgaataggggagaataagagaagaataaagcaacagaaaatgaagagggaaacgaaacggaacagaagcttttcaccttagcgttcagtcccaccctctcctgcaggcggagaaaccggagggcgagaggccaaccttgcagcctgtgcttctaaatccctgcttccctgcaggagattcatctcagctttagagtttttcttaattctagggcatgaagtacagttctaaactaattagcacagaaacaaacatactgctcccaagtagtggagtaattagcaagcaaatgctctaccatctttcactccccaaatcttaacctttggattgtaatttagtgaccaaagcataaattatttcatttctgtcaggcctctgagcccaggctaagtcatcataacccttatccaacaaaacataggtaagatttctccataactataatcaccctaagctcgatgtgtcttacggaatactaggtcgcagcatgttgcggaattatatttcaatcctgcacaaggtcatgaacagcatagcatttttgcctgtcagctctgcaagattaagaaatgtggcattttcacgtgacttaaagagatttcttttttttccttccttctggatgggattacgcattgaaggagacccctggatctcagctgttcagtggtctttaataacacattgtaaaagtactgggtgggggtggaggggctaggcagtaggtttggggggcaacactgatgaatgacaattagtttctttttgcctttggggggagaaaattatgcattaaaataagcatcaaatagacatttatgaaaatgcttaaatataatgtccaatctagtaataaatgtgtagaacaatgtctcgaaaaggaaaaaaaaaaaaactcatacctcgttttttaaagtttgccgttaataaaatcaggttttttgtttatattcacacagatgggtaacgtcacctctacaattcattcccgcgcaaattgaccacccaaaaccacacaaaaaggaacagtcatttttcaaagtatacaaatacaggttaccatggaaagccgtctcactgattctgattctgttttcagagcagaatgttaaccacaggacgttccagctgtgactcattgcaactactgacaagcaagctggagtggccctgcttttagagagcctgaagatctactcagagtgaacaatacttgaagttctaattgagttacagaaaggaaactagtaaaaactaagaaagattgcgattctcaccttgaatatgcagatctaatttctataactgtgtttaggggtatttttctaaattactaaaataatgcttacattttcaaattggccattaaatatatcttcagatgcggagatgtgtatattacaaaaccttcctctgtgaaatcttttgttattctcttaaagagattattcatttaggattttcgtggcttaggtccccccacccccaccctacccccaaatatctcaactcctcttgacacactcagagaggaaggaaatctcttgccttagccatacttaccagtttctacttcctttgtgcgggtttgataatttggcacatactttacaataccattagtgaattcagactccagttgcaataggaagtgatccgtggacttctaaataggaaggacccataacaaaggggaggatataacactaaagacaccacgtgtggtcaatcactgatagagatccaatttttttgtaagattgagggtacttaggagtcactgaaagtcaagttctaagtgagcagagacccagacaccccacctgtcccctcagtagaaatcaactttatgaactgcaggatctccaagaacaaaaatatgtctttcaagtgccttgcttgctaaattgtttcatggctaaaaatttaaaactgtaataaattaaaattacaagtaattatcttatatatatgagcttgggatgtagagattaactttttttcttaactatttttttgtttgtttgagacaggatcttgctctgttgcacaggctggagtgcagtggtgcaataaggttaactgtagcctcaccctcccaggctcaagcaatcctcctgcctaagcctcctgatggctgaaactacaggcatgcagtaccatgcccagctactttttttgtattttttgtagagacagagtttcgccatgttgcccaggctggtctcgaactcctgggctcaagcaatctgcccacctcggcttcccaaagagctgagattacaagtgcgagccaccatgcccagccccaaactcattttagaatcacagtgagtgacaattaaaactcagccctttctgttttagattgacatctaattcatactgtttgtaaatgttgtttcttttatttcctggaaggtcttctggaagaaaattcttttttataggagatcaattttaagaattaattaaatatagttcatgtagaaaaagcaactcaagagtttctttaggatgatatcattaaaacatggagaaacttctggagaataatttggtccatttccaattataaatctttgcaaattccataaaacctctattctttagagcttaatatgtaattgaaataattcatctgctgtgaggagaaattttgggtgtagtagagaatcccctattctttctatagaataaaaattctactcaatgaaaagatgatcgttcaatttttgagaactatactcaatcagtttatagagtggcattttgaagtgagtgtcactaatagaagattatatttcaatcacaagcaggaaagcaattttattgtagaatgtacttgactaatgtcaatgtggccagagccaggctctgtgttcatagcccagctctaaaatttagagaacacaattttgtgaaaattattgaacttcttcaagctaaaatgtctttatctataaatctggcaccataatggtacttatctcataatattgttgccaacagcaaatgagataaaccacgtaaaaggtttgctatgaggcctggcatgtggaatgtgctcaaattgttactctaactctttgtcagaggcaaagggaatcaacatttttttccagagaaaccacccaaaatagctatgagaaaagaaagatgttggggattagagaacaggagctgactcacataaaagagttcacagaaatcgtcactggtagggcagatggggaagtgatgaattcagtgaggaggtggaggccaatcctcgcagtgtgttgctatgacaacttgggcattgtggagactgaggcatcccggacagccatgcagaaaccaaggcgaatcatcctgtgtggggtggagataagcatgctgtgtgtgtggaagggattgcgggaggacagatcatgcaggggacagcagcaaagagagttaggaaaccagaggctgttaaggctgccacggtgaggtggatagagtccactggcaagcaaagtggctctcatgctaaaagtgagcagcatctcttcctgttgcagcctcccttcccctttgggtcctacccagccctgtagttcctgctgctgaatcactggagatccagaaggatgggacctagggaattctcagggcatctgctcagatgttccccaccccaaacaaccaccacagcaggatctgtggagaggcctcattagggtgattgttaaaaatgttgttgctgaggtttgcactcacatctcctggaaaaacttggaactttatccaagttcaggttactttaaatttgaagggctttgaaatgttcctgtaacaacagtagaaattgcaaagcaagaatcacagaggctggttgtggtggctcacgcctgtaatcccagcccttagggaagccgaagcgggtgatcacttgaggccaggagttcaagaccagcctgggcaacatggcaaaaccctgtctctactaaaaatataaaaaattagccgggtgtggtggcgtacgcctgtagtcccagctacttggaagactgaggcaggagaatcacttgaaccccaggaggtggagcttgcagtgagccgagatcgcaccactgcactccagcctgggaaacagagcaagattctctcaaaaaaaaaaataaataaataaataataagaatcacagaggagatacagcgcttccattgtggataagcaaagcccaagggggcaaatgcaaaatcaaatcatggtggataaatgaggcaaatgtagaggaaggctgataagcagagcatggttgatcccagccgactccaagatggcccttgggaggctaagtcccctccataaggcacatggccactcatagcatgctccctgacataggcacagaaaaagccgccttgccatgtgctgacagggtggggcaggaaatatgaaatatcatctaaaagtaacaattactcataatgttgggctttgcatgagagcaaaaaacccatcgaaataccacattttgagttacttggtgtcaccctgagttacaggtctgtctcatataaaaaccagcgtttcctttctatgtggtggctagttgctgtctgctcttactagaatttacatttttattctgctttctatatattactcctattagaagccacaatttgagtctttttattttttaaatcattgtccaatcatgggtgtgggaaaacatttaactacaaagatacttatctcagaactgtttctaatggtgaagatttgaaaagattctaagtgtttcacaacaggaattggtggctgtattgtgatgatgggatgagcaatgttgaaaatgacataataaataacatggggaaatagtcacaagctattgttaggtgaaaaaagtcattatgggttagtatgtactgaataatctccttcgaatattaaaataaaataaatatacaaggagcgatgacaggaaatcaataccaccaaatattagtaataatgatatactttaggattttttaatctagctttttctacattttcccaatttcctataatgactataaattcctttgtgatctgataaatttatttttaaagcaatatctttggggacctattgacatggcagtagagatatgcattagtaatgcttctccaatctcagaatttcatacccttttagactgtcaaataaacacctggcctactaaaaatattaaattgtctatctccataatcttttcttaagtatctcaaggttatatgtaaaaattaatccactgaaatgttaccatgtaaggtaatctgctccagcattaatttaaaatcatattttgcctataatgcttccttttatcataactagatttttattattaattaggctaattatttacaaaaaattatttctttattcccatgatgtgactatcacacattgcacgcctgtatcaaaacacaccatgtaccccataatatatacacctattaattacccacaaaaattaaaaattttaaaaataataatgtcttcagatgttcagggactgacggtttcatgtaaacatatgtttcgatagtcactgatggagcaagggctcctaaatccctccctagtggtaagtgaaatgctttgaaagctaagcatactctcctgtgtatacatgaaaatttaattccataaacctcagccttccctctgccaattatcctgctacagtaaaacactaaacatttattattattattattattattattattattattatgcctcttaaaattctcaccacctgctgcagatggtctcaggaacagagaagaacctggttcatagaacaacgtgaaatcatagacctttgagctggaagaagccagaggactgccatccgggctctccctgaagacagtgagatcaggaaaagaaagtctattaaataaagagcctgccgggtgcgatggttcacgcctgtaatcccagcactttgggaggccgaagtgggtggatcacgtgaggccaggagcccgagaccacactggccatcaaggcgaaaccctgtctctactaaaaatacaaaaattcgccaggcgtggtggtgggcgcatgtaatcccagctactcaggaggctgagggaggagaatgacttgaatctgggaggcggaggttgcagtgaactgagaatgcaacactgcactcaagcctgggcaacagagtgagactctgtctcaaaaaaaaaaagaaagaaagaaagaaaaaataataaataaataaataaagagccaatgtaggaactgcagggtaaagacgtgtttaaacaaaattctgtaatgttgcaattggaaatctttcccattttaaaaagtagaaagtcaatatagttaactgaaacccacaactgtgattaccagtgtttaaaatttagcattttgctcaatgcatgcttattcataccatgagcctgtctgatagtggaagagacctttcggttgccctgcctttcgccagtctgaggagcagagcaacctgaggtcaaccaggaaaggcagtgtgcataggacaattcaagttctgagcatctaatggaatttttactgcttcagggtagttcagaaattattttaggtttgattattattcatcctaattctgtccttcatgtttgaagagaggaaacacgcagagtttcttttgaatctgagagcagaggctcttttgaaggttggaacgttggttcattaactgctgcaaattaatgcaatcatacgaaaatccttcattgtgaaagatggtcagaaaagatcagcatttctttttaaggaaagggattctgatcacactgaaataacatttcttctttcaattttttataactaaaaaatcacattttactcaggcaatcttaaaaccaaaatttcttctaaaatgcctcatgctaaactcaacgacactacaaagcatctggcttcgctaactaatggatatacttcattctaaactttttttgaatccaggtatcatgcttagtacggtgctagactcatatctggtatcaagttataaattgaaatgtttggtaaactcttcccagcttttatgcatgtttttgaatagcagctgaacttagaattgtaatagcttatctctaagctctaagcaaaatgcaaaagtcccagaagcaaacttcctctgacagacagttccaggaagcatgactcatctgcccaggaagcgttggcggtggagccataatcaaagtcggctcagatccaccgctgctcagacaaaatctcatctgcttctctgcatctcgccaactggaaaacaggattttatctacaatcccagtggcttttgtaggaaaactgggaggcaggagaagcagcactgctttcaacacagtggggccaattgatgttaattacaactgggaaggctgctctggaaaccacagatttatttaccacaaaatgctatagagcaagagccccagtccccagaccagtactggtggcatcaaactctcataggagcatgaaccctattgtgaactgcacacgcgagggatctaggttgcgtgctccttatgagaatcgaatgcctgataatctgtcattgtttcccatcaccccccagtggtactgtctaatgcaggaaaccaagctcagggctcccactgattctacatgatggtgacttgtataattatttcactatatattacaatgtaagactaatggaaataaaatgcacaataaatacaatgcacttgaatcatcctgaaaccaccctcccaccccacccccggtccgtggaaaaactgtcttccacaaaaacagtccctggtgccaaaaagattggggtctcctgcttcagagcacaaaaaaataatccatgagactatgtttatgttaaaataaccatagataatatgtattagcacttattccatgctggtcattattctaatttaaaaatcctagcagctctgtaatgcaggtagtattgttatcttcattttagagttctggaaactgaggtaggtagaggtttagtaatttaatattttgaaaggcatcaactactgaagaagaatttttcctatttccttctgtggcagttcttttcttaagaataagcattgttggtcgggcgtggtggctcatgcctgtaatccctgcactttgggaagccgaggtgtgtggatcacctgaggtcggcagttcgagaccagcctgaccaacatggtgaaaccccatttctactaaaaatacaaaaattagccaggtgtggtggtgggtgcctgtggccccagctactcgggaggctgaggcaggagaatcattggaacccgggaggcacaggttgcagtgagccaagattacgccactgcactccagcccgggcgacagagtaagactctgtctcaaaaataaaataaaataaaataagagttgttaaactccaggatacagaaagtctttattctctgtaataatagagagtaaccaaaacaatttttaaaatgatagggacaatacgaacactcctgttagtcactgaaattaaaatttttttcattatttttcttaacggagctttgagtaaaataagtggacaaaaattgttggttttatcatttgtcatttatccttagtgagaagtgtcaaaatgcattaaccatgcaggctgcaggcagaaaacaagaggaaaattaaatgtcttgagaaatgaatcattaattatatctcaacctaaagaattgaaggctctctatttgtgaatttctctataccttactgagatgtttctcttacatcagcatcagtgcaaataataacagtgaacatttatagatttgttctctatttgccagaccttgttttggctctttacatatatggattcattgactcttattactccgttttacagaaagggaaagtgaggcacatagacactaaggaacttgcccaaggtcacctagctactaagtagtggagtttgggtttaaacttcattctgaagttacctgcttcactctgaagcaggtacagagactaccaattcagcacattctatcatatgtctgggtgcctagaagacattctcttgcgaacgagtgctagaggacttactacatctttgtcattagcatcccatggtagtcaccagatagaagagtgctggctgaggcagttctaattccagtgactcccctctagaacaatagaaagcacagtgcctggagctgttttcaatagggagctaaagactggcgtttacctttaaaccaagcaatttggaaattgaagaatcatccttggcacctgtttggaatctgttatgccatcatgtgaccagcagtgacgtgcactgcaaacacaaacactgatttacgcttcacttattagagcggatgcaaggtctttccaaggacagaagaaatttgcctttaaacagattcggagagcacagagagaaagcaaagcccttatggagaagtccatggatcgagttagggaactcggaagagaaagaaaacaaaatgtgaactctgcctggagaggaagatagacctcgccagggaggagccactgctcctaactggcagggcacaaggaatggagatggcatttgcaagagatggaggtcagctggtgtaagggtgagaaaccatttcctgaagtgtcccaggaagaagctgaatgaccaggcaggagctgggctctctccagaaggggcgtggaggggagtaataagcatttcctgaggactcaatattttccaggtgtgtggattattatcttcattttacacacgagagaaccaaagcagccagacgttaaattccttgcccaagatcacagctggtaaagagctttggagccaggtggactccagagcccacactgtattcgtgcagcactgagtgtgaacgtagtttcatcacttcatgtagtgatgacacttcctgcactgagtatggttccccatctcaatccctgttctcctgtgagcatacttatactcagttactggactactatgaggacagacaattatatctatcaaagtattggtagtagtgtctagcacatgatgggcattccattaatgacaaatattactgtaattctcaaaataacatctgagatgcgaataactctctaatgcctcatgaacttcaaagtttgcttgtttgtatgaggggaaaatgaaataaacttggaaaatatctctagaataatgttttcctcagaatgttctatggaatacaaatgtccaatagatgttcattaatcagacttctgggcaaggataatctctttgggactaatctcccctggtggttttccctgcgtccagttctatctatcaggctatattctgatgtctccctttccttcatcctgttgttatccatctctgtcaattgtacctcctaagtgctctgaaatcattcgatctcatgcttcctccccagcaatggtgaagacctggagttctctctcccttggcctatagcaatccccttactgggtctccaccgttactcttacctccctccagtttattctggtagccagagtgattgttttaaaagtgcagatctgaccacatccttgaaagacctcctgctgctctccaggaggtctctgaaactcttaatgtgcccaccctgctctgcaggccaggtccctgtccacctgagagcctcacactgctctccttccagtccctcacatctcaagcctcctggcacctggtgtgttattcatcctcagggaggcctttcctgacccacaaaggagctcagttcccatctcatgccttctgggtgcactataattgtccctcccagcacttaacgctgcctgtggttaaatttttattgtgtgataaattgattaaggtgtgtttcctccatcatgacaaggaaaactgatgctaaaacagtcacatgtccatagcctaagtgtctaaaatatatcctactgactggatacatggataaaggaatgaagaatgcatatttaggatagtgacagcctgaggaaataccacagcaaacgcaaaacaaaacaacaaaccctgcttaattgtgttttaatttggcatatcgcagatttattagaatataggtctctatttgtgaaacatctaccaacatttgtggcagagacagttatgtggcttctgcaaattgacttccccttcctttggtttcatgaactaccacatggaagccaggaacacctgccttttactctgatgtgattagaaataacctgtgttgcagtaagcaactgagaatgtatgagttctccataacagctagcatcactttaagtattgacaatatcccatgagcccgatgtttctcagtcgtggtatatggaaaatgttgtttaggctgtagacatggagaatatggatgtgacactgcaagattcagggatactggtgatgttttttatccattcttcctcttggaatgcattattttgcaactgaaaggaggatacgggagtgcaacaaactgtgatataagcatctggggtgaacaggatgacatcagcaaggatttggcaagagatgaaatgcatgttataaagactggagggaaatgcctttgactgaagtcccccacactatcacgaggacttgaaatggactttagtggaaaaggggaaggaataaggaaatgatttaatggaagatgatagtggtcaaggtgcccgataaggaaaagggggagaaagtttagaatcagaatacaaaaactgtaaagtgaatctgacatttttaatataatgaggtaaacataatatcaactgtatgaccaggccttggtgagataaaatacataactcagccatagcaatggaagagtaagtcctcactggaaagtaacatttaatagcaggcaaatgtatgttaacaagatgcctattaagatacttttccctccccaggagagagcattgaagtgaggataaaacaggctatcttggtggaagtgggctatgaacagtggtctcaagtgctggaccaggggcttgtgcaaagcttgctcttggggaatcctcaaggatttggttaagtctgggatgaggactaggaataaatttttctaacaagatccccagatgattctggaatgcagccagatttggtagccagttataaggactttatcctcccacctcagcttcttttcagtagagactgcaatcttttgtaaaggaaatctataaacactaatgtaccaaaagagatctacaggagtggcgacggggagactgtttcaacaatctggacacctatgagatgtcttgttcccccaaaaaatgtagcatttgttgaattctttatatgctctcttcatataaaggagacagtgaagagaagtgcaactctggactaattctggctagcaaagaagtggttgttaatatggaagtcaccaagacaataggagacagtgatcaccttgccttaacttagagcctgtgatggctgaccacttaaccggactaaggttttggggattcaaacttcaaaacaagatataaacctatggataaaaaaaaaaaataaacaaatgaaaacgcaattgaaaaaggaaagaacattctagaaaattggcaaattctgaaaaactaaattctcactacaaaatcaggaataattttggggggtgcaaaaaaggagaaccctctaaagaaatcaatctaagcagaaatccaagaggctccatggaactttctgaccattttatgggtacacatacgaactagctaaactttgggaaatggcacagaaaaatattgttgaacattagaaaaaatgtctaattttaaggctgtgactagggcaaatgaaagagggaaacacggatggcatggatgctttcagaagagagtgtgatgtcaatgaagaggaggtagaaacatgcctagtttgattttgaaactggaagaagagacatggaattccagtttagaagataaaagagtcaactcttttcaatgaacttttccaggcttaagggaattatatgccacagcactgaaaggtatagtgattacagagctgattttgtaatcttggtgaattcatgggtgcatagttcatggttaatgttttcaacgcagccataaaaaagagcaagatcaggtcctttgcaagaatgtgaatggagctggaggccattttcctcagcaaactaatgcaggaaacagaaaaccaagtactgcatgttctcacttatatgtgggagctaagtgctgagaacacatggacacaggacagggaaacagcaggcactggggcctacctgagggtggagggtgggaggagggagaggatccaaaaaaataatgagaactaggcttaatacctaggtgatgaaatgatctgtgcaacaaacacccatgacacaagtttacctacataataaataagttcagggtatgtgtactactatcagggtagtgcacataccctgaacttgaaagttaaattaaaaaaaaaaagttttagcattccagcggaatctatgcccctgctcacaagttctgcttctgcccagaacataatctgtgaacatcaccggctagagggcttggctacactgccctaatgagtatcgtccataggcaggctagacccatgcatttgctgtcgagctcaaacacatgagctccctgtgctggggatttgtcaccaagggaaagtctggttgtatgcaagcacttgaggtaaatgatcctgtagggtcaaggctggggtggtcatgttgttgaagctaaaattccgaggttgctgaaactcagaggaagcctttggggagagggatgggaatggatgggaacagtcagggagcaggagcagagccttaggaagtgggagtggagaatctgcctcactctcttggcttcccaccttctccaggcttctcagcctctcctgtgtgtggggaggtgtgagccttctcaaagtaaccagcctgtcacatgcgcctgtcctcttcatgtggctcagattgtgtttcggtgccaccaccaagagtgcgagcccagacaaggagaaccagcagggctgccagggggctgaagggaaaacgttccagcttccaagatggggaaagattcattctagaatctcgtagatcagtaagattaacagtaatttttggaaaaattctaaattagacactaaaaataatttgtcaacatgaagcaaagaaagaggtgattataataaatggcacctgcttatctatggagtcatgcaaaacattgatttctctttgcggcagtgtcaatagaatggtagacttgggggcagcaggaacacttccccatgatccctgtgagggtgacaggacactgtgagagtgctcccggggtatgtggtgttatggctgagagcatcggtgtggagttacagtgcctgctagaaagccggccttgacacttataatctttctgaatatgaacaacctatatctgcctcacttttctcacctaacgaatggggataatatttcttataatacagggttgctgtgagaattacctggcaaataatacatgctgaataaatattagcttttattacctagtagtttgaatagtgctattccaaaagcacttaataatagatcaattttaaccaaaagaacttatcatttaagagtatttgaaatagatgcaatcttgtttgacatttttatcaattatttttgaagaagtactaggtcagtggccaatgagtctgtatgcaaatgaataatgctctgaaaagcaatgaatgaagatttagggaggtcatgatgtgttgggattctcagacaaaatcaaatctgatttattaggaaaaatatctctgtttagattcttaaaaatcatataatcataaattcataataattcatgtaaaagtgatatggagattataaatcttgatataggccaatatcatgacttagctacaataaaccccatttaacttcagcatagaccaccagaaatatatgaactggataatacggttccaacctacttgggcctagccaggtttagttgaactgttgcatccaattctggggccacatttaaagaggcactgacatacaagagaacatgcaaaggagtgtgtcccacacacgtgaactagatgaggaccagttagggaaatgaaggataaggattggagaaaagaagccatcacttactctggtttgttacagagagcctcagaattcagggacctagacttcagtctacactcactctcctctttgtacctctttacactgtctggttcctgctctcgccccacaaacactgctctgaccagagtcacattgatctccaagggacccttctgaaccacaacctctctcgactgctcttcccttggctcccatgacacagtcacctttttttttttttttagacagggtctcacttcgtcacccaggctggaatgcaatggtgcgatcccagctcactgcaaactccgcctcccgggttctagtgattctcctgcctcagcctcctgagtagctgagattataggcctgagccaccgtgcccagccacaatcacctcttagtgttcctacttcctcttctcactacacacatgctccctgttgacttaacaaataccctgggcttcctatacatctccatgttgatttctcccaaatctatcatttccatttctatattcaatcactcgtttgaaatctccttttctgcatggagactcagactcaaaataaaaatggaagactgaaatcaagttgtaaaatacagccagaactcttcaggttgattccccatgtttgcacgggcaaatggtctcactcctttaagcaaatggtcccttctcccactgtatattttatttccagatctgaaatattttgttttgcccagagggtgaaataataaaggatgcatttggtttccaatgggatcttttcaaacccattcctctcatcaaggcgggatagtgtctgaccagcacgtaattaagtctttttgtagtttccattttattaattcagaataactaaattctggctctagtaacaggcatccagttgggatttggggaagtcagctgaaaaaacccagaagcgattaaaataatggaagctagatttctgtgtgtgtgagttttctctctgtaaatggttgtttgtgtgttaaaatttccatcatagaccagctattgcagctattgctctggtctggcctcttggctcacagagatggaaaacaatctcctccctctggcaacagcgccgtttttttggaaggcctttctgaacttctggttctcattttgtatttttgctctttcaccgtcaatgttgcacaagagaaatggcatgaccataacatgacagacacgtcatccataaggggctctaatgagctactctgcagttgctggaacaagcattttttaatttgagtttttaaacacctttttgttgccatttcatcctcaaatgagtcgaaagaaatggagttcaggtcctggaaatgtttcatctctttcctcccccctctttctgccaaagcctcctttaaagcccaattcaaaagcatcctcctttctgtggctttctccattacgctttaccaaatcacgattatggtgcccagcacactgttatacgtgcaacgctcggcaagatcatgagtcctattttggtttgtgctccaatttgtaggattgcactgcgtgtgtaggaggtcgtacaaaaacgccagtttggaattcaatctttctcattcattagtagttatcattagactgatactaaaatatggctgtgatattcaattcaacttgaacttactgaactcctgtaatgtcccacctgtataataagtgcctgggttacaaagttagtaggagacagcacagaccttcgagaagcccacagtccagtgggaatcagaatagtcctaactggtaaaaggaggtatgaccaactgctgtgttcacggtataaacaaagggctttgaaagcaacttttctgctttttctaaaacacaaacaaggtctcaccatgtgaagaaatggatgcctattctagtagtatcttaatgataccatcctggtatcattaagcttgtgaagaccagttgaactccaggtcaaggaaggtggactttaaaaccattgccaagtacgtgcttgtaagtttgtttcatgttgtgtcatattttcttagaatactggtaaacaaaactttctaatgggtaaacactatggctaatatttctgtaatattgtacttttgtaaatataaggcaaaattttttcccaaaaaattatctctgaaaaacaagggaatctccttatagttaggacctcacagagtctctcaaagtgcagaatgctttgttgtcactctttgttttcataaacaaaagtgctatttggaaaatatatgttaacctcaaccaacctcaaccaatgctagttttcctatacaacttgtaaaaacacaattaagaacattttacaagaataacatattttttcctgggaatatgaccccagagttgccagcaatggatgttgaagtctttgtaagtaagacttctaaaaatcactgaccaccttaaaaacaactaccttaagtcactaggctgcaggtaggagggcaggtgggaaaaaaaatgtcctgttatcagagcaagtacttatcacttcagaaagggtatctagtgaaaacattatatgtggattttttgaagtattatatattaacaatatagacagaaataaagataatgccttagatgactcaaaaagttattttactgatgatgaaacgtagatgccaaaataacctcccaatttgtagccctaaaagttacatatgcaagttatcaaaaagctttttaagttaaaatttcttattgcaaaaataacatattaccttatattcaaggttgcctaatatttaagcaagatttattgcctgaaattgcatacagacagttgaataaatgttactagtggtcatgattataacaattgaaacttcaattttacaaaaataaaaatatactgaaatgaacttacatttaaaaataaaaacaacaattaaaaccatgatacctcatactagaaaaatgacatcttaaataaatccaagatacccaaacattttctgatctcttatacacagagaacaaacataaaaacaaccaacaaaaaatagaggttattactctccttccatgtaagttaagtaatatgaggtcaatgagtccagaagttacactgaaacctaaaaacatagatagttctctgtattcacaatttaatacattaaatatgaaatatacctgttcaaataccatgggtggttggtgtgttatagatgcgtggggcagagttagggattttattctaaaaagcatgatggattctaacttgacacatctcccttgatctgaaaaagcagtgatcaatcaagctttataatacatacctctaaataatctgtggagcagtttatgtgatgttccaagtcaaatgctaaaaatgtgtagttcacagtgttgcctgttgttgcccggatggtccagttgcaatgctgattttcagaataaggattcggataccctatactctctaagatgccataggtttgattgactattaccacattctcacatgctggaaaaagaaatgactgttaagaaccactattatatacttcataagtgctccaagatgagattttcctttaaaaaaaataaataaaaatcatctgtgtatgtacacacacacatatatgatgtgtatatatgtgtgtgtatatatacacacacagagacacacacacatatatatttggtgcagtattttcatagtgaaaggatttccatttagaagaaatgtgaaataatactgaagtgaattcaaactaaagagtcatgaaaattaaatagtcatgttaaaataggcatcaaattcccttgaatttgtggagagcagaataacttggttatattcagggatcagtctgatttgtttgttagagaagcgcattcgacgttctgtgctgctgtttttttaatgttaacacgtggaagggacagaaattctgacttttaaattcaacagtttaaaaacccaaaatcctatgggaatgctaaaaaccagtaacaacatggctttgttgaacattcaaaagtctgcatgaaattcacaataaaggctccgttctccctctagttagtcatcaggaagtaccaagcgaatagatagagtagaaaggatttaaagaagaaaggaaaatgtgaaattacagaaaaaaagtcttcaatccaatggtggcattttcttgagctgagttttcaacaaaaccaaaccagatacctctaagtatgtctaatcctgggtgcccagttcagccaatcctaatgacttaaacaaggaatatattatctctatgatgtgcaataaaagagaacgggaaataaacattatatggaatgagctgtctctgaaagtgtgattcatagatgtattcctactacgatatgctttctgaaggtgggtagaacaccatttataactttggtttaaaaaagtgtacatttgtggctcttcaaaatattgctttgttggagcagggagaatacttaaacccattctgtttgaaaatctttaggtcacagttttgtccataaaggatttttaaagaataatcttattgttttagaagactgtgagaaggtacacctattaggcagataggcatcacgtgcctcgatgactaggggcaacacagggcccaggaaaatacattccagtaaaccacatgggccactctcagcactcagaccttacactatttgtaaatctccaatttcccatggcaaattttacagataatctcactagtttgctctgattttgcctcttatgtgcactcatttacactttcaggattctgaaattatgacagaaaaatatctcagaaatgaaaagaaaaaaaagaaacccttaaacaatctgattataaccagaaatagattagcacagcagtaataaaattagataaatgattacatagtcaaacagatgtatctctgatagaacttaggagacctttttatgtactagtgatacatttctgaagaacaaagctatatattaaaacttaatattcaaaactatctaggattcagcctaatccccagatataaatcaatgtgaatcttaaaattcatacataatcaaggttaaatgttattactctttcagttaattcaagggatattgtgtatacagttaataattttgtgacttttaattccactttcagataattacataaaattatggataaattttgattctgtgggaaaagataattgtgtaaaattatggataaattttgattcagtagaattatgtttccaaaacctagactttactttgataaagtaaaagtctctatcaaataacaaattcaagaaaatattgttttcttgaatgtccattttggaactaacttcaaaaagcatttaattctagagctagaaggcaggtttagagaccatctaatttaatctccttttctaaaagaagaaaccatgggaccacaaagaaaagtgactttctcaagggttaggagccagaacaaaccccaggccccttgacattttgctcagtgttcctttaattccatcatgttgctatctgggaaaagtagatttaaaatggcatctgtacaatggccagatttttctactgtaaagaacatgcttattccatgcatgactcacatggaccacagctttccctaataaaattaaggtactttttaaggtagagactagtgtgatagaatactatgtacattggaataatataatgtacactgcaagattgcaatgtgtgaggcaaatgaaaagctattagtcattagtctggtacactgatctttcactgaattgcaactctctcagcatattaaatactcttctaagtttctatagtttgccagatgttttagttatatgagattaaatttaatacgtatttctccctcaaatggagttaaacgattcacagaagaaactaagatgaagttcaattgctcacaccaatgcgttacacttatttcagtttgtttcaagaatttgaaggcccactctaggcactgaacagcgagtatacatacttactctgccagtattcacacttactctgctggtattcacacttactctgccagtatacacacttactctgccggtattcacacttactctgccggtattcagccttgaagccacgtccttgctgaccttcatctgtcctcagttttataaacatgctgtctccactagaacgaataagagggggtttctcatccccacaaagctgagttagcagatgagagttgctacttgggccatcatatacctttaagaaaatattttgaatgttagatggttgagactataaacattatgtaaaggactataatccagaagaagtgaggaagaaaaaatatatatatttattatgtatatatattataaataaatatatgtaattatatataaaatattataaatattcattatatataatatatttataaaataaatttatttaatacatatatttttatatatgtattcaacacatatgtttatatttgcattaaatacatatatttatatatgtattaaatatttatatgtaaacataaatatatataaaataaatatatctttatatataataaatatatattttttgttatatatatgacatcacaaaagaatagccatgaaataaaataaccttataaattatatttaggtatttataaactcaggccataaactcaggcaattaagctgtggacatgtgcagcagtaataagcgtgtgagcttacactgaaggctgaatattgaaaatgaaagcccaatacatattgtaatgccacagctgatgtcaactgtcctccttgttttttgattccatagtttatgattcatgacacttcaatacatttttatttagatttttaacaaatgaacaatggtgaattgctgtactgtgaaaaatcctagtggaatgactcatattatcttctctacttcgccaaaactgtcttctaaattgtgatttttcaatgcatatgtggaaaaacataaataatgattataataaatcctgtaatccctttcaggagattttcaccatatcttaatagtctatcaatatattttaaatacttagtgtatcgagccattgagtacttcgaagatggtcactttcaccaaatttcttttatgtttttattttgtttgaatttttatatggatgttcggtttagatgctcccctttcctgaatctcgaaaataaaaataagtgcattgtgcgttgggtgagatgggagcagggaacaatatgatggaaacattatacatacagccaggtaatctaaagtgcagtttggatgatgctccaagtgaaagtctttgaattccagttcaaatgcgctgccgtggctagatttcaaccaccagtagcattcagagctgtggtaatagggcatcgggtagttgggagatatgaacgtgccgcttgaagtggtgagattacccccgcaacctacaggagaaagaagtggaatgacacacacccctttccttctggggaaattgaatctttttgtctgcattaaactggtgccattctactatcctttaaatcaaattgcacagcaaaatggcatcatgaaagagtagttatagcctaaaaatccaatttttatttttttctatttttttttttttttttgagatggagtctcactgggtcactcaggctggaatgcaacggcatgatcttgactcactgcaatttccacctcctaggttcaagcgattctcctgcctcagcctccctagtagctgagattataggcacctgccaccacgtccagctaatttttgtatttttagtagagacggggttggccagtagagactatgtttagtagagactatgttggccaggctggtttcaaactcctgacctcaggtgatccccctgcctcggcctcccaaagtgtttgtgagtacaggagtgagccacagcacccagccccaatttccattaatgcaatttccttattctaaccaggattcttatttattgataaaaagaaactagaactttctccctttgtctgttaaaaagaaatggctgctgttaatttaaaattatttgcaatattgaagtttaaatacagctgggcaaacatggacaagtgagggacagagcatgacaatcccagaatcaagaaaccaatcagattggcttctccagtaaaagacagctctttgctatttacctgttgatgacccatcccagtaagctgagaatccagaccttgtgtctatttggtcactcttaaattttaaccatagtttgttactatgagagatgattgttgggggtagatttgagccatagaatattcccagcaatggtgatttttcatagcctccatctctggcagaatacagaaattaaaatttattgggttactgacaatattactgtataaacatttaacataatttgaactttgggattgcaaacattagcagtttattggatgaagtaatttctctcaaacactacacttactctaaaaaacacgattttcacttttaaatttttaaaaatcatatttgaatgacttaacaaagaataaccatcattcatagctggtatggtgttttatataaccaatcacaaactgagagaatatgtttaatcttcaccctttcgaataaagcctctggcaaatgtgtcagagaaaacacgataaagaaactatactattaactatataaacatactgctgtattttacagagaatctttcaacgttttccttctgatttggaaatttttgaaatgtaatatatcatatttgatatacttagcaaaattctggaaatagcattttcctaaaaacttctggggccttaattctagtttataatctgtagctttttgaaacaaacaacaaaaaagggatttattcaacatcaaagtccagtgagtaactgctgtaaattaagaaaattatgtcattttagcacgatagggtccaattatgatttattattttaataccttactttatattatagaataacatttataatacataagattccagatttaaaatcccaaataaaacatttgatatagatgcccaccagaatgattagcctaatttaactcaaagtagtggcatggagagatagtaacatataagctaacttacttttactgcaaatataactttttaaacacattctttcaaaatgatgataatgaaagaataatgccttgtactgaaattcacaagcctagacttttattacctgaacatgaaaactttgtgaaaactttaagattgctatcctgccatcattttataatataattagattaaatgaacagcaaacagcctaaaatttacatcgattttacataattaaagtaggtattcaacagtagcaagttacatcatttcagagtagtagcacatctgtttctttgcccacataaaatctggagtttattttcaagtatttccaataaaataatcacttcaaaataaccacagaatcttatgcaattcctgtatttctcctaagtcaggctccaaatgacaaactttatttcttgcaagaaagtgcacagcagggagctttgcagagaatttccatatttttttccttaatcttcctaggaaagattattaatgagaataaataatgaaaagattataatgaaataaataaaagtgctgacctgatttccagaaaatctgtataatagtttccaatggcttcctccaaggagaagtttgtgaagtgcactgcaatcagttggccagttctcactgtgatccgataaatgcattcccagttgttgggataattattggggaagtttggagaagtgaatgtccccaaatcatctgtgtagtcttgcaaacatgctgtgaacagaaacagaccataagagagaaaatagaaaatattgatatgtttataatacatccagtaatatgtatttcattaatttgtgcctatacttgattttcaataagccattctggaatgtgcaaataaagacttcattctgaaacaaagtttttgtaatcttaaagacaaaataattaccaacactaaatctaagctatggagaggaaattgttatatatatcttgagtaaacaaccctttaagtcttgaaagtgttacgtttttctaatccttgcaaattaccataaacattaaaaattaggatccactgcaggagggcctagaaataattcagtcttgccttttcataagctccctttaaagtggttttcaccaaagcatgcatttatgagaaatgacaaagcaggtacctccaccacggggtgaagaataagggcccaggctcaaggatcagagtgatctcgaatgaaaaccctctcaaacactgtcaagctctgcagccttgggagagttactgtacttctctaagccttagttctcacatctcgcaaatgaagaggattgctacctttgactgaaggtttaagagttaaagataatgcattacaagggcttagcccatgatatgcactcagtaaatggtggtcatttactttataaggaagacattaggtcatttataaaacatttagcatagtacctggacaattttgaagtcctaaataaatatcttctttaaaaacttttctagtttaacagttttaacgttacctattcagtcgattctgtgtttattaccacccactcaatctcctatgccctccaaatctgaaatattttacaaagaaaatctggtttgaatgcttttgtttttgtttttgcttttgagacagggtcttgctctgttgccaaggctggagtggagtggcgggatcttggctcactgcaacctctgccccccgagttcaagcaattctcctgtctcagcctccccagcagctgggactacaagcatgcaccaccatgcccagcaaataaatgcatttttaatgtatttccaattgcatccagccataacctaaatctagggtataggagtagacagaggtctcctactgaaaggttttggatacaataaactattgtgtttcattgtgagtcaaaataataataataataataaggatgtttagttatgctgtttccctagttgctgctatataatccccaagctcagaaaagaagaatcattggtattgaaaacatagagatgcatagaacatattataggttctactatctgtgtgtagctctcaaaggaatgggcattcgccagatatttgattttactctattttaaacagcaagcaatcaaggctttactttattgaaggaattcacagtgacatttaacaccaaagattatgtttaactccaaaagtatagaaaagtatgcttctctgtagtctgccaaaatatttccacaagtggaaaggaaggtagagaggaagggaataagacagacagaagggagacaacaggaaaggcagaaaagagggataaagagagcggggaggagtatagcattggtctattaatatttcagacccagtaatgaaacttactaagctaaaaaaaggacatcaaatgaaagcaatgacccagtatccctgagttgacagaacagacagactcattgacccacacacagagagctttggccagtaaatcaaatatttagaggaaattatctgtcgtcacttgttcttgcttactcactgtactcctggaggggaaatacaattgtcttgcatatctctaatgcaacttgtctgtgggagaatgttaagtgtgattaggtctcaggtggaggaacctgaattaatgacattttggggcaataatgatgggtagtttccctttatcttgcttacatgaatgtgattattctggaacaactggtgggagtctgttaatctgtactgaaattttgatttactcaccaagcttcttttctgttgctggcacaaaagtaaactacagttcttgatgtgttccaatgatatttacaccattcactttgtctgaaatgctttaccctttacctaacccgccacccaacaacccctgccaatacacagtttaacatatacactcttacccatcatttaaggttggctgaaacctttcccaaccaagcagaattaatttatttagcataataaaattttatgcaaatagcaatttgaaccccaaacatattttgtaattgtttttatgtgagtatatttaccttactaaaccttgggatatgactaagactttattaaccattatttactatcactgtagtacctggcccagatgaggtcccagtaagtagttgttgaaatattattacatgatgtgttggaaacgaaggggactggtacatgcatctaagttcctcccactctccctactccattcagttcttctctttcaaactacccctaaactccaatcctacgacttctatttttctcacctcatttttcctctctctctcttcttcctgtactctatcctggttggctgaggttctttaatatttttttaattccagctatgacaagcaactgtactaaactagctgctctccttaagaactgtaaaactgaacaaaatattggacaatctgcagtacaagattgtgattcttgacagaaaggaaactcatgatgtacgactcttgatttccttggctttctacctgtgcagaatttcctgaccacagaagggagctgaagtccaagtagtgaatgacagtcctactgagctgatgatgcaaagattagagttgccaaagcagctggaactatatggaaattctacagagaagaagaagtatatagagaggaaagccgggcatctgagtagggcttcccatggattcttagctaagcctgggctgagaatacataaggtgagacttcagaaagcatgtcagacaggagctgctactaggctggaagcggaaacaagatcatttagagttctctcccattccagaatggggatacctccttaacacctcaggcattcaaatgagacacctaaaaggccatatcttacaagtgaagaccatggccaagagtagggctctctagaacttccgggccaaaggataagtcttaacaagacctgcaggaatcatagaagttggaggtagagacctagcaagttagaggggctcgagaaacagggatgttcacaaatattctttagcaagtacagatataaacctatgcagatacaaagtaatcagctagatatcaaactagcttcagaggaagataagataatacagagtgtctacaacacataatttacccacatgatatgggacccccatatcatgtcccaatctatcatgtccactataaaacccaaaactattacaaatattaaaaaaaaagagagaaaatatgggccaggtgcagtggctcacacctgtaatcccagcactttaggaggtcaaggcaggtggatcatgaggtcaagagatcaagaccatcctggccaacatggtgaaacaccatctctactaaaaatacaaaaaattagctgggtgtggtggtgggcgcctgtagtcccagctactcaggaggctaaggcaggaggatcgcttgaacctgggaggtggagcttgcggtgagccgagatcatgccactgcactccagcctggcgacagagtgagagtccgtcttaaaaaaacaaaacaaaaaatgagaaaatatgaatcaaatcaagaaaagaaatgtcatcagtagtcaagaaaaatgtggtcatagttgagaaaaaaaatgtcatcttgtgattcaaagatgatccaggtgttagatttaaaagagaaagactttaaagcagccattaaaaatatgtgcaaagacttaaagaaaaagccttaaaaagtaaacagatatgaaattttggcccaaaaagggagaaaattattaaaaggaaccatgaaaattatataacttaaaattacactaattcaaattaaaacttcatgacaagtttaacagtaaactgtaggcagaagaaaaaaaggtcagtaaactttaatatgtattaatagacataatttaatctaaagaacaaagaaaaaagaactccaggaaaatggacagatatttaaaaaaacaaagaaaaaacaacaaataggttaacacacatacaattagagaaccagaagaagaaggtaataaaaatgggccaaaaaaggagaaggaaatagcggctaaaattctcctaaattttatgaaaaatgtctagtaagatataggagttcagtcaatactaaacaggagaaataaaagaaaactacacttggacatgtcagagtgaatctattagaaaacagaaacaaggaaaacacagaagccagttggggcgggggggaagccacatcacatacagggacatcatgataaggatgacagctggcttctaaacagaagcaatggaggcaagaagaaaatggaatacatctttaaaatgttgagatggggaaaacaggtttaaatatccagcaaaactacttttttaaaaaacgagagtgtaacatttttagacaaacagaagctgacataatttgtcactggaagacttgtactgtatgaaataataatatccattgggccaaaggaaaatgataccaaacagaaaatatctccaagaaggaatgaagaacactggaaatgataaatcattgtataaatataaatgataggctttcttttcattatctccttaaaagagaattagtgatttaaagcaaaaataatagtaaggtgaatttataatatagagagaagtaggctgggtgcggtggctcatgcctgcaatcccagcactttgggaggccgaggtgggcagatcacctgaggtcaggagtccgagaccagcctggccaacatggtgaaaccctgtctctactaaaaaaaatacaaaaattagccaggcgtgctggtgcatgcctgtagtcccagctactcgggaggctgaggcacgagaattgctgaaacccggaaggtggaggttgcagtgagctgggagcttgccactgcactccagcctgggcaacagactgagactcagtctcaaaaaaaaaaaaaaaaaaaaaaaaaaaagagagagagagagagagaattagtgatttaaagcaaaaataatagtaaggtgaatttataacacagagagaagtaaaagatataactaaaacagcacacagaaggataggcacatggaattacactagtatgacagtatttcacttgtgaagtataaaggggaatttgtgtaatatgaagtgtcaggtatgaattggaaggtatgaaatgtaaagcagctgcatattaactctaagaaaacttgcttataagttaaggagtatatttttagacctaatgtaaaaatacaaaaaaaaaggtatcattaaaaagacaatgaaggaaatagaatggaatactaataatattctgtaaaccaaaatgaagacagaataatggcaacacaaaaagagatgaatggaaaacaactaccataatggtatgttaaattcaaccataaaaataattacattagttgtaaatggtctaaatacttcaactaaaacacagaaaaagcaggacccaattatatgttttttactatgcatgcacattatatataatgatgccattatatataatggtgaaactaagttgtaactaaaagaatgaaaaaagatataccatatgaacagtaaatataagaaagctgaaatcactgaaataatatcaaacaaaagtgacttcaagaaggataatattattagatttatagaaagacatttcataatgacaaaggggacaatttatcagtaaaacataataatcctaaatgtgcatgcatgaagtaatagtttcaaaatacacgaaggaaagtgaaaaggcaaaaattaaagaaaaaaataaaaccatgattagagttgaagattttaacacctttctctcagtaaccgaaaatgaaacagataaagatgaataggggtatagaaaatctgaccaacactcagccgacttaaagccaattgacagagagcactacacttaataactgcagacaacacagtttttcaagcatacatgaaacattcagcagcatagaccacatgcagggctgtaacacaattctccataaattttaaacaattgaaaacttagaaagtatatcatttaaccacaataaaactgaaattataaatcaataagacatctagaaaacctgcaaatatttgaaagttaaataatacatttgcaaataatccatagaacaaagaagaaatcacaagataattggaaaatattttgaactggaagttactgaaaataaaacattaaaatttgggaggtggctgggcgcagtggctcactcctgtaatcctagcactttgggaggccaaggtgggcagattacgtggtcaggagttcaagaccagggtgaccaatatggtgaaaccccgtctctaccaaaaatacaaaaattaaccaggcatggtggcgagcgcctgtaatcccagctacttgggaggctgaggcaggagaatcacttgaaaccaggaggcggaggttgcagtgagctgagatcgcaccactgcactccagcctgggcaacgagagtgaaactccgtctcaaaaaaaaaaaaaaaactggggaggtgaagtgaagtagtgcttaaaggctatatctatatctatctatctgtagttaatttttatctaaagaaactagagaaaagctaactaaggcaagaattaaatgaaataatataagaacagaaatcaattaaatggaaaatgcaatagcaatagagaaaataaacaatgtcaaaaattggttctttgagaaaattattaaaattgatagaattctaccaaaactgatcaaagaaaaaagaaaaaaaacacaaattaccattttcaggaatgaagaggggatgtcactatagaatcttcagacattaaaataatagaaagacaccattacaaaaaactgtgcaaatatatttgacaacatacataaaatagatgaattctttcaaaattcccataactgactcaaaatgaaatagaaagctttaatagtctctattaattgaagaaattaaatttgtaatataaaaccttcctacaaagaaaactacaggctcaaataatttcactggtggaattgtatcaaacaattaagaaattgtttatattccacaaactcagaaaatagaggagaagatattttctaactaacaagaccaatattactcctataccaaaccagacaaagaaattcaggaagattacagttcagtatgtcttacactgatgcaaaaatccataagaaaattttagcataacaattctgaatacacgtaaaagttataatagatcagaaccaggtggagttctgatgtattacacaagattggtttgacagtagaaaactaaatcaacataatttaccacctaaacagaataaaaaaagaaaagctttgaaagataccaaaagatgcagaaaaattcaacacctatccaggataaaaactcagcaagtatgcccagaagggaactccacaaactgatgaatggcatctatggaaaatccaaagctaacatcatacttaagtggtaaaggactaaacgctttcctgtcaagattaagaaaaaggccaacattccaacctcaccctttctgttcaagaatgcacagaaagttctagccatcacagcaatacacatacacagagaaagagggacagagagagagaagggaaaaaataaaacttatttaacttattcacagttattgtcatctatgtagtatatactaaaggatttatttaagtcattagaactaataactgagttaaacaagactgcagaatacaagatatgtatacaaaaatccatttatgttgcatatatcagccaaacaaccagaaagtaaaattttaaaatagcatatataatatggcatgtcattttataatagcataaaaacacgaaacacttgataacaagtttaatagaaacatgcacaaactctacactgaaaactttattgctgaaggaaatgaaggaagatctgaataaatggagaggtaaaatatgttcatggattggaaggctgaatttaagatgacctttatccccaaattggtctgtaaattcaatgcaatctcaatcaaattctcaagtttttttatatattgaaaagctgattctaaaatgaatatggagacacaaaaaatctaggatagcccaaacaattttgaaaaataagtaccaatctagaggttttatacttccagattttaatatacaatatgaaattatgtaacattaagtaatataatgttctattgttaaaggggtaaatatgtacagcagtgtgatgaaatagagattccagaagcagacctacacatgaacacaggcaggtgattttcaacaaaaatgcaaaagcaattcagtgggagtgggggtgaaggagaatcttttcaataaatggtgcttgaacaattaaataccatttgctaaacacacttggacacataactcacaccatatagaaaaattgatgcaaaatggatcatagaacacgtataaaatctcaaactataaaacttctagaaggagccgggtgcggtggctcacgcctgtaattccagcactttgggaagacgaggcgggcggatcacaaggtcaggatatcgagaccatcttggctaacacggtgaaacccgtctctactaaaaatacaaaaaattacctgggcatggtggcgggcgcctgcagtcccagctactcgggaggctgaggcaagagaatggcgtgaacccgggagtcggagcttgcagtgagccgagatcgcaccaccggactccagcctgggcgacagagtgagactccgtctcaaaaaaaaaacaacttctagaaggatgcacgtgggagatcctgataacttcggtagtgaaatatttctcagacaagatacaaaatgcactaaccataaaagggataaaaggatatattgaacttctgttcttcaaaggataccataaggaaaagaaaagtttagccacacactggaagaaaatacttgcaatacatttatctggcaaaggacgtatttgtatgcagaatatacaacatatgactcattaataagaaacaaacaaaaatgaaccatatggttttaatgaacacctcacaaaagaaaataaatgaattgtcaaaaagcacgtgaaaaggactcagcactattagtcatcagggaaatgcaaaataaaaccatcagatactgctatgcaactgccagtggctaaaaatgaaaagattggcaatattaaggattgggaaagatggagaaaagaactgctgcaaggcaggcaagcccccatattgggactccacccaggaaggttttgggctttggccaggaaagaattcaagggtgagctggtggtagaaaaaatcagcttcactgaggtatcagtgttccagctccgtgactgctcctgcagagcagggctaccccataggcaacgtgttgagggtagcagcttggcgcagttgtgcagtcatatttacacccacatgcaaattaaggggtgagttatttggaaatgtctagaaaaaggatggtaacttctgggtgttgtcatggcaatggcacactgtcatggcgctgttgggcatgtcttatgcagaggtgcttctgtctcttccctgttttagccagtcttccatctggtctggtgtggagccccaactcctatttcagaattgtcaatcatataggtgggaatataaaatggcataaccactttggaaaacaatttggcactttcttataaagttaaacatatcattaccatatgagacccagaagttctactcctaggtattttacgcaagagaatgaatacgtccacaaaaaacctgcaagtcaatgttcatggtagctttttttgtaatagctaaaaactgggaaaaaaaagctcaactatctaacaacaggtgaacagataatcaaattatgatatatcgatgcaatggaaggctagtcagcaatagaaagaaaaaaacacatgaatacagcaacatgaaaaatttccagacacattatgccaaatgaaagaagccaagccgggtgcggtggctcacgcctgtaatcccagcactttgggaggccaatttgggcagatcaagaagtcaggagttcaagaccagcctggtcaacatgatgaaaacctgtctctactaaaaatacaaaaaattagccgggcatggtggcgcgcacctgtaatcccagctactgggcaggctgaggcaagagaatcgcttgaacctgggaggcggaggtagcagtgagctgagatcgcgccactgcactccagcctgggtgacagagagactccgtctcaaaaaaaaaagaagccagacacaaaagaatacatactatgtattcctgttcacagctgccttttgcacagttaaaactattctatattggtagaaaccaggtgtgtgtttgctgacatagaggttgttgaggaaactaataaaaggaacacgaggatcccttctggagggacagaagtattcgatagcttgaatggagaggtagttaaatgggtgtacacaattctgaaaattatggataaatttactgaaattacagggaaaaatccatattatgttaaaagcttgaaagttctgtgcacagacaggttgcactctctagagaaagtccaataaataattcagatatctaataaagaatacataaaattgaaatagagaaataaaacatcatatttgaagggacccctgctacacgtattaaacaataggatatttaatcttaaaacctgatggtagttttatgagattcaaatttcatagagagaaaaattactattctctgaacttaatgcatctatttcttgaaagattaaaaacccctcttaactatcactgaactctatagatgtttacatttcttcccttgacaatataaatggctccttctagaataatagtaatactgaaaaatatcaatactaagttttggtttcctcttgtgattttcaacaaagcacaaatgattaaattagaatgtgtttccatacaaggatatttatgtgttggcatgatgcttattattacatcaatacaaaatgcaaagataaaaatgtatctatgccttttattttatcttgtattgccaaaggaaaattcatatccaatatcagtttagccttttattatggtctaagaacatttacaaagaaatgaaaaatgaaagtacatttttcctatcccctaaattcaactgaactagcaatggaaaagcacatctctgaggatcaaagacaactgttggcaaaactcacatatttttctctctgaccaacctcaaaaaaaaaaaatgtaaagaaagaaatgaaaaaacatacaaatgccttctgtggaccattacaaaaatcacaaaactagacttttctaaaactcacaatgtatctttgccttcactaaacattttcaaataagtttttgtaacacaggacttggctcattatcaaaggggaaaatgagaaacatctataaccttccaaaccacaaagcaacaatgatatcagtcccataaaatttgagccacagaaataggataagctgatcctctggagagaggaatgcatctcatagggagactctagattatggggaactgctccagctccttcctgctttgcattatgggatgatttatgtgactatccaattacattgaggctcaatctttaggctatgctttctgaaatcacttatgaaatgtttggtttctgaatgaatccatatgacctctgatattctaggaatgtgctaaataaacagctaacccaggagccatcatctgcttccacagacatatttggtttagcatccttcaaagtgaagacccaagggaagatataattacaggttcagtttctcccttaagaaagaagaagccttctcaatcaaactcaacattttgctacaattttctgctaggcggtcatggtcattgctttttcttttccctctcagatgaccagtgcagattcatatagaaataagcaaagtagctattgtaaaattgtccttggatattgagaatcatattttatatctggcaaagtcatggtcctttacaactctaatgtaattttcacattgaatgtctcattttgtcttcctcaactttgcaaaacagccaggcattatcaccacactttttagagaggtgtagatgagagatctcaggttcctggagattaaattctaaaagacacttaacttcagacatggccaagataaaatatgaacccaagttccctctttccaaatcctattctctttaacaatccctggtttttcttttctttttcttttttttttcatggagtttcgctcttgttgcccaggctggagtgcagtggtgcgattttctctcaccgcaacctccgcctcccaggttcaagcaattctcctgcctcagcctcccaagtggctgggattacaggcatgagccaccacgcctggctaattttgtatttttagtagaaactgggtttctccatgttggtcaggctggtctcgaactcccgatctcaggtgatccgactgcctcagcctcccaaagtgctgggattacaggcataagccaccctgcctggccacaatccctggtttttctacacaggaaatgtcaatttaaggatgaagacaagtagggaactcagaatatcatgattaagcattttgttgcatttttattctaaggagtaagaaatataacaaacaagataaacgaactgagcagagaagtgctgggacacctgtacatacaaaattatgagaaaacactagccagtaagaaagtaaatctttaaaagacgaatcgacttactacaacaccttttccagagggaaaatatctgaatctctcatagcaaagaatacagaattcaaggtcgatagaaataatcagagaggcttgtgagttgtccaaagtattccaaattatggctgggtgcggtggctcatgcctgtaataacagcactttgggaggctgaggcggggggatcacctgaggtcaggagttcaggaccagcctgaccaacacggtgaaaccctgtctctactaaaaatacaaaattagccaggcatggtgaccatgcctgtaatcccagctacttgggaggctgaggcaggagaatcacttgaacctaggaggcagaggttgcagtgagctgagatattgccattgcactccagcctgggcaacaagagtgaaactccatctcaaaaaacaaaccaacaaacaacaaaaacaacaacaaaaaaaacccaaaaacaaacaaacaaaagtattcctaattagtatcaaggctgagagtaggaccaagacttctgacctccctacagcatcccctttccctgtgtcatgaatagtactttccatcatgagcagttacagtccaatccactattgtatctcccttgtaattctacagcaattcacatgctaaggcttgactttcagagtccttgataaactacaaagtttcattagaaccccttgaattgcttggcgaacaagcaccctagacctattttaatcagaatttctgggtggggcccagatgcctgaatttatagcaagaaaatcccccatctcaaattccttatgaacactagaatttgagaacactacactcccaaactgaagttttaaaatagaaacagaactctctttacccgtttagtgtaaagaaggcctctttgggcatgtttgtcatcatttcttaactttgcactgctagatgcctcttctgagctcattccaggatcactgataaaaaacagcactaaccacccactgatgagtaggtgggaaccctgccctgggaaggagggaggccaagaaagcccagtagggctcatctctaatcctgtgttgttgttgttgggatcatccttggccatttccctggacaattgtgaaggttttcgctttgcaggaaatatgaaaaatccaccacagtttgatgatagccctgaattaaatgttactagctgttatatgcagttcatttagagcgtttctaagagctaacctagacatggcaaaagcaatggattctaagacgggactcagttgtttagtctgactttcaaaccaatcagctatgtattcttgggaggataaattcaacatcctagacttctatctccctcatttaaaaattaaggtaactggaatagatttgtgcttcaaactttcttgacataccctaaaaaatacatttacgttagccacccatgcgcggagatactacaaacagttctcatgaagcggcaccttactttgtatgataaactctgatactttctctcctattcctttctatcctactccatacttttagcaatcacaagtagcaaccgaataaattaatttcatgactcacgaatgagtcatgaattgcagtttgaaaagcactggactagatgttacataggttttcctctaatattaaagttgaaaatgaatccggtacatttatctgtccctgtttatacttttaaagttccctcttagcaggattatatattaatgtatatgcaatacatgttaatagaatataaaattttactttaaattgataacattagtcaattatagtctctcaggattcaaatattttgtagtttgaatgagcaaaatctaatacgttaaattaaagcttagtcttgtagtttctaagaacttcgtaagagttttaacctgttaaacctgtacttgttagttcttttctttctgttttcccaggcacatctggataaaggcagaaacaaagtaacaagggaggaagtcccagtaatcacaagaaaccaatcttttttctcccaaacacatattttggggctgacatcatagccacatggcacaaactacagatggaaaagtatctgaactcaaatccggaaacttaacctttatcagatgaagacaagaaagacttcagcaggcaaactcacacctgttgggctgaggagctagaaatcaacaaccaaataccaacattactgctctggaaataacttctgttagaacaataaagtaagatgagggcaaatgactgagcttcccttgatgcttttccctgatgctattttattctgcagaaaatatccaacatacgatgacacctgaaaagaatgagtcctagcatctctgtgtttccacaccagcagctcactctgactctggctgccttctaggtctagccactgccttaaagtactagcccaccacctggtgtcaccagcccaacaccagctcagtctcctgacaccagcccttccctaaaaaatgctgcaggaccccccctcagcaatgcatgagagccgatctctcaggtcttgatctatgggaaactgtgacaggctccagaattataaacagaaggtgtgttgtgtcttcctggatctcgtcatctgattgctatttagaatggcttgactgtgttagtcagacctatgagttcatccaacaacaagcgggcacagtgaccagccgggctcagcccagggacagaaagcaaacactccctcgtctgtgatttcagccttatgcagaccaaatagaggccaaagtaatgattatcacacagggaagccagctggagaatcttttgagtttctatgaaaacatcgtctccccttcacttttattgcttgctttttcttctctctttctttatagtttcctttcctgtccagtttgcttctatctcttttcctgactcatttttattttacgtgtatcttatctttctgaaaacttttagaattaaaatctaatatcctccctgcccaattattttaactgctctgggttctttctgcacaaaatattgccttacaagctaggatggtaatagaattgttttacaaaggtatgtcttactttgcatatcattacaaagatttccacattttcaggaggccctgcctgtattatatgttatctaagatacagccagtttattcatgcaccaaattaaaattatgttcatagatgattaaagccagaagtcatctctcgaagattaccaaatccaattccttaattttacagatgagaaaactgtggcctagagagttcaagtgacttgctccaaatcctgatctaatattcagtgtgctttggggccaaacataccagacagataaaactacaacagcatgaaaaattgtgtgcaccctataatttcttaagaaaccaattttggtcactggatgttaaccacctgaatgaagtccagtgaatacgtcaatcacacaccatagcctattgtaactgccagggattccatttcgcatgtgcttgcacttgagctggataatgaactgctcctgcagaggttcctacctgggagaaaagtattgattgattctctcacactcaggattctggagcaaatctaaagccatgcttttgaacatagaacttgaactgctgcagagttttgcctgaaatgaagagtagtggccagcccctctgaaggagaaataaatgggaaattgggtaagattttgagtgggagatgtttaaacttttatttattttagggagtggggactttaaaagataagcatctggggttctcaggatgccagagtgtgtcacagggtgcatgtcccaacataggaaaagctaccagttctttctggagggagctcagtgaattgtaccatgctgctggggtaatcccaaagcggagaaatgcttggaagcatggtcaccatatgcctactatgggtctatgctggatgttatttgggtcctttaatacaatgatgcaaaaggaaagctcagagtctctaaaaaacaacacatcctagggaaacatgagcctaacgaaatatgactccttcatcaatcccatgcacaggctcttggggctgggagcatctctggttcacatcttacctcaaagactgtgcctgcaaaagggatttgtttcctatacttcatttgcaaagggcatagtaataatgagaaattaagtaataggaaaaatacaatgaaaggaataaatgctgaaaagtttaacttcattaggtcaaattgagaaatgcatattttgccaagaaatcttccattcctttccctggaatttcatgcggtagtctctaatttttatacattgttattctgtttctaatttcttaacataagtattcagtctctttggtaacttttcattctgatagaattttaaaagatgcaagaatgagctcctgaattctttttacccagatttattatgtatttgtattctgctcccattactttatcatttctctctctctctccccccccccccacacacacatgcacagacacacaaatattcacacttattatctcagccaattcagagtactttggagacattatatttctttaccgtctgaaaacttcagtgtattgttcctaagggaagaaaaaacgttcttttaacaaaaccacagtacaattaccaacattagaagatttaatattgacacaatattcttatctagtcactacttttaataaggaaggtatttaagtcactaccctttattctaaatatagctctcattgtgtgccacaggtttgcggatgatgtattctcattgtgttttagctattagcactgttttgcaatggagtcaataaaaccgagtatgcaatgctgttttgttacctgttgctgcactgattgcttcatagtttattaagaagccttcataagcgaggtcggagtcagtcacaaacaccagcatcaatgagttaccactgcttgtgagagatggcgggatcgactttccacagtatctattccaaaccaagaaaggacagatgtgtgtattttagtttggtatactgaaaatgatgtaacaaaaatttggacatgtaaatataataataggttttgttctctacctctcatcaaccttaaaacacaaatatatttcaggcaaaaaagatttgcaaacttacgaaagattgtcccgttcatgattatatccctgaaatggttttaggtatgtgactggctatgtgagttgtcatgtatgagaagtttaataaaagctacactagattgccatatagcatattaatacactttttaatagaaatgtaataaacttatacaacaaagggaaacaatatatcataaaatcatagagtcatctctctaatctaaactcatagatcactcaatccctgtgccttgccttcctcatccctaaaatgggaatgatgacagtacctacttcatagagttgttttgagaatgtgatgagttaataccctgtatataaagcacttagaacagtgcctacaatcgtaacccctatagagggaatctattgtccttaaacagctcacttataaagagataagagtgatgattcagccatgccatgtttctgctgaacaaaagcagtttagctcagaaaaactattctattaatgttaaaaagagagttgtgataaaagacagaatgccatgagcttttatctggagaaatacctgtaggaagaagtgacaataaaataggaatctcaaatcaaagcacacttggtaaaattaaccaaaagaaatgataaagaaaacaaatatagaaaccaaaaagagaggaaatgttgagtacgggaaatggatacgtcaattgctaaaggagaaaaagaaagaaaatttggtgtataataccattgcagtgtgaaaaaaaatttaatatcttcatcaaaataaaggtaggtgaactaattgatattttaaatgccttcgtatatgcccatgtatatgaaatttggggaagatcattatagtttatgccattcagcaaacgttctgtattttgcagtggtgatgtgttaagtaccttcccaaaaaagaaaaagaagaaagttaaaaagatgaaagattaggataagaaggatatttaaaacatgaatgagaaataaagaaaataaaatgcaagataaagacattttaaaatatcaaaagatttccatttccaacagaaatgtaataacaggctagatttaactttgcacctgaaacaacaaaaatcctggacaaaaacgtataaaacaatggctctcaaaacactggatatcaagcaatgtaggacaacaaaccttcagagacaggaaacaaatgagtttaaaggcaaaactgaaatggatcaacctgtttccaagtagcttaactgctttccagaacaacgctcatgaatacttacaggaatatgacaatgtccagcagccaaaaacataaaattgaaaatgtctggtatcccactgaatattacccagacatgaaaagacgtgggaaagtataactcagaaagagaggaaaaatcaatctataaaaccatagcaggaaacaatccaaatgtctgaattagtagataaagtcattaaaatagctacaactatatctcacagattttttaagctagagaaaaaaaattcatgtgtaaagtagagacatggactacatataaaatgactcaaattgaacttctaaaatgaaaactacaatatctaagatgaaaaatacacttggtaaagttaatagcagattagacattgcataagaaaagatgagtgaacttgaatatatagtaataggaactttccaaagtaaaacacacagagaacagaggcttgaaatcaaacagactatcaagagagttgtagaacaatttcaagtgcctaatatacatgaaatcagagtccctaatggggaggaaagacagaaaaatattttaagaaccagtggccaagaatgtttcaatttgataaaactacaaatcttcggatccaagaagctcaacaaaaattatgctaattgaggaaagtcagaaaaacattcagtacgtatagtatgattccatttagatgatatgcaaacgaatctacagagatagaaagtagatttgtggtttcctgtgggtgggggtgaggaacaaaagcaaggaattataacggaaaggaagaaagttttgtgggtagtggatatatgcattattttaattttggttttgacttcatgaatatatacagatgtcaaaacttaatgcctacaaggccacaactacagagtagttatgtagaaatggtcattaagaagcatgaggatctcacctggttttcataacacaacgtggtcaattttaagatccttcactgaagcaggaaatcagtgaagttttattgttaaacaaacaaacaaacataaccttaccttccaagggatgtctcagagtcggtgtcataaacttccaagtagtcgtttgtgcaattgtaatgaaactccagatgaaatgtttcgaacattaaatgaatcaggtgattaggttggactaatatatgccaagtacagttgataccgtgggggtagacatttggatggccaggactttgaatggtccctgttgattctgtaagaatttctccacatgctgttgaaataaaaattataattactgcagcaagtaaccaagctacctggatttcaaattaaaaggctctgataataacctcttcaaagattaaaaggaaaaatgtttcttagttgccacttaagataacctgatttttctcttattaataagtaacaattaacttttgatataaatgttgattagaaaatatacattctttgtctttgagtgtactttaaaatttttcacagtacagatgattttcatataatttatttctatcattcacttattctgatacaagcccaagaggaggaaaaaaaaaagggaacagtctcttacccaaatcctcagcactgaacttagccatgaaaccatggttttcagtagaagaacttttcacgaatgtgacataaagaaaattgtacacagatgttataaatgaaggtatgtctgtaccgcaatactttttattttcaggagaacccaaaatggaactgctaccaatctaaaattagagaagatatgttcaaatatgttgtatatcaattttgaaaactgcttcaagaataattatttctgaaatgtttttaatggagtacaaatcaatttgagaatacaatcaattttagcacattttagtcaccccccaaaaaacactcatatcctttagcagtcactcctcattcccctgaaaccacagccccaggcagccactaatctactttctgtctctgtagattgcccattttggacatttcaaacaaaatgggattatacaatatggggtcttttgtgattagcttctttcacactgtataacattttcaaagttcatccacgttgtagcatggatcattatttcattcttttttaatgccttgtaatattccactgtaaagatataccacattttatttatccgtttaccagttgatggacacttaagttgtttctacttttaaaattaaaaataatgattgcattttgctatttgtatatgttattatagatgatgactgtagatatattcacatacaaatttttgtgtggacatatattttcattccccttgagaatatatctaaaagtagaattgctggatcagatagtatctctatgtttaactttttgaggaactgccaactgtttttcaaggtggctgtaccagtttacatctccaccaggagtgtataaaggttccaatttctccacatccttgtccacaccattatctgactctttttattatagctatcctatgggtgtgtccttttgtttttggcatttcttttttttgatacagggtctcactctgttacccaggctagggtgcaatggcacaatcatagctcactgcagcctctacctcccaggctcaagtgatcctcctaccacagccttctgagtagctgaggctacaggcgtgtattaccacactcagctatttttaaaattttttgtagagatggggtctcactatgttgcccaggctggtctcgaactcctgagctcaagtaattcatccaccttgacctcttaaagtgctgggatgaggtgtgagccactgtgctcagcctcctttgcccattttaaaaatcaagttattcgtttttaattttgaggaagttatttttcttttttctttttttgtttgtactttttgtgtcatatttaagaaggctttgcctaaactgaagggcatagagactactcctaggtttctcctaagagtttcatggttttagctctgacatttaggtctataatccatttttagttaatttttgtgtatgctataaggaaggggtccagcaccataattttgcatgtggctattgagcaccatttgttgaaaaaatgatttttctccattgatatgttttggcatcattttcatatatcaattggccataaaagtatgtgttcacttctggacttgcaattgtgttccatagatctatatttatatccttacttcaataagatactgtcttgattattgtagctttgttctaagttttgaaatcaggaagtgtgagtccttcaactttgtaatttttcaagaacattttggttattctggttcccttgcatattcatatgaattttacgatcagcttatgtatttttttaaaagagcccgctgtgatttttatggggattgaattgaatctttagctcactttagggagtattgccatcttaacaatattgtcttctaatccatgaacattaaatgtctttccatttatttaggtctttttaaatttctttcaaggacgttttatagtctcagaggacaagttttacacttatttttaaaactgtattccttcatgtttattattttttaatgctattgtaaatggaattgtttccttgatttcattttcaaattgttcattgctggtgtatagaaaaagaaagatttctatattttgatctcataacccacaacttgctgaatggattagttctaatagttttttatgtgtgtggattccttatgatttcctatatacaaggtcatgttatctgtgaatagagagaattttactcgttccctttcattctggatgcattttatctcttctccttacttaattgctctagctagaatttccagtgtaatgctgaatagaagtagtgagaacagacgttcttgtctttttgtgaccataggggcaaagcatttagtgtttcataattaaatatgatgttagatgtgagtttttaaatgaatgtccattatgagattaaggaaggttccttctactcctagtttgttgagtgtttcatcatgaaaggatgttgaattttgtcaaatccagcaaaatccagatctcacatctattgaggtgatcatggagtttttgttctttattttattggtaccatgtatcacattaactgattctggggttttatatcaacctagaattctcgggacaaatctcacttaatcatggtatataaatcctctttttgtgctagattcactgaaccagtattttgctgaggatttttacatatgtatccataagacatattggtctacataaactactttcatttcctataacagatttgaagacaacaacccataatattttttataatatacaaccaaatacaaattcaaagattttttccctcttacctcaacataatctgtttcacagtgggcagaacttccaatttcaaagacagtgaagttgaggagaatgacttggctttggggctggtggatggtccacctacaggttctttctccaggatacacgttaggaaaaaaaggcgagcgaatgaccccttctccagttaattcatccccgcaagctgtaagcataaaaattatagtagtgcttgtccagatattaataattttatctcaattttattgcaaaatctaatactgcctgaggagataaccgaatataacatttctatgagaatattttccacttaacacttgaggacataaaatgactaaattattttgaagaattaaaatattacaatcaggcaaattagacatttaaaaattatatgtttccttaccgacttgataaacagctctgaaactagctttttcaacagaagcatctattttaaacctgatccagacactattagtaatggatttaatgtgagagatggttccgttgccacagacttttccaagtaaggtttcaccatctcgaacctaaagagaaaaataaaatagagatgtaattcaaataaagaaacttacgtcggcaatggtggcgttacttggagatgaaaaaatggcagattcaaaatgaatgataatccaatttgagttacatatttctattattttctaaagcagtaggtcatttttaagcacaatgcaataacatgaaatgctgataaaatcctaagccaataaagtccaaaagcacaagaatttaaagaatgttctcctaataattttcacaatgtcaaagaggaaataaattcacaatttagactacttggaaaacaataaaaaatgagaatattacctatgaaaaaatacacgtgttagccaaatctgcaatcaaagaaagttatggactaaactacttttgccattgaaagaaaaaaggaaaaaaaagaaaagttgatgaaagagagagaaagtaaaagaatgtaaggagtcaacttaaaaacttagaaagaaggccagggacagtggcacacacctattatctgagcaccttgggaggccaaggtgagaggaattggagacagcctaggcaacacagtgagacccagctctatgtacaatttttttaagttagaaaaaaatccttaaaatgaggaagaatacagtaaaaagaagagcaaaacttaataaatgaaatacaaaatcatgtggtattcataaatacattcaagaactgtttttttgaggaaggttatgggtggggatataaaagacaaatctctggcaagtctaaaaagaaaataaatatataagcacaaatatacaaaattgaaaatgacaaagacacagatactaagatttttttaaatgtgaaatctatgtacaactctatgaatgtttttaatgggttattttcagaaaaagtataacattaaaattatctgaaggagaagaaaaataagatttgaacagacataagtcataaataaaattgaaaacattatcaaataattattcccatcccaccctcaacccccaaaaagaaaaatctcccataagatgctctacttagtacattctttaaaacttttaaggaagagataattcccatgtataatttattctaagccatcctcaaacatagaataatttccaaataatttttgttagaacgctgttaccaaatcccaacatagattatagaaataaaaactatagactgatgtcacctattaatatagatacacaaatcctaaacacagttctagaaaaataaattcacagtccattgccagcttatataccagatcaaatatgggaataataatagtgcaagaaaggttagaaattataaactataaattaacttcctcagtacatcagataagataagccatatgataactccataaattcaaaaaacattgttagcattcctgttttattagaaaaaaaaggaatttccttcatataatagactactgattttaaatcaataaccagctctttttttttttttttttttgagatggagtttcgctcttgtcacccaggctggagtgcaatggcgtgatctcagttcaccgcaacctctgcctcctgggttcaagtgattctcctgcctcagcctcccaagtagctgggattacaggcatgtgccaccacgcccagctagttttgtatttttagtagagacggggtttctttatgttggtcaggctggtctcaaactcccaatctcaggtgatccacccacctcggactcccaaagtgctgggattacacgcgtgagccactgcgcccggccaaatagccagctcttatagtatagtggccatgaatacagtctatggacttgggttcaaaacctacctctgtcacttacaaaccacctcacttaatagccttgagcaagttactctatctaagctcatgggattgttgaagcaaacagatgaaacaatagtgtgaattccttagccaaatgtttggtaatggaaaatgttgactaaggatagctgttgttattctggacatttttggaggtgaaacactggaggcttgctactatgagcaggaattattcgatggatatatataccgccgctgttcagtacaattattctgaaggatacagacatccaaatattaattcattcacttcattaacattatcaaggcatgaataaatgccaggaactgtgcaggtgacaataccatgaaacagtcactgctcacaaggaacttacaataggcaggaacatttttgaaaagtatgatgactgcggtttttggggaagcgcaggatacttcattgttacctaaccaatggttctcagcagggaccacaatctagcatttgggaaatgtgtgagagtacctttttggttttgtgttaattattatcacagcaatcatggggcattactggcatttagtaagtagcaagggaccaaagacacgaggcagcctgaaatgtgagcgtcacacacaacaagaattctcctgaacctgtgtgacattcacataagtgaaagttctgttattgggtataaaatctcgctctattttacatattaagcgcaaagtagttttgtgcaattttaatgcatactgaattttccaggattacaagtagagtgtaaattgaagattctttctcctggaaatctgtcaagagttagtcactatttctgaaaaattagtcaccaacccacataactgtgtcagcctgcatttgtactgtcatattcatagcaatttggggtccagacaatcaactgctttattttgtcttcaagtacagcttgcctaggttttcagatactgaaataaatgtgattttattctgttactctattttttcttaatgttattcttacaactttacatatttttaaatataatgtgtctagtggggttaaatcagtgtatttcatttctgaataatcaaggagtgatattaaaaagtcttaaattgtagagaaccactgggttaaccaaagactctgaactcacccaggggattatggaaaactcagtggaaataacatttaagcggagacttgaaagctgagtaggagttatctaggccaaggcaaacaggtagtaaagagaagatttttctttgttttcttttttttttttttttttttttttttttgagatgaagtctcactctgtcacctaggctggagtgcagtggcacgatctcggatcactgcaacctccgcctcccagattcaagcaattctcctgcctcagcctcccaaatagctgagactgcaagggcacgccaccacgcccagctaatttttgtatttttagtagagatggggtttcactatgttggccaggctggtcttgaactcttgacctgaggtgatctgcctgccttggcctcctaaagtgctgggattacagatgtgaaccaccgtgcctagccagtaaaggaaagattttaaaaggatgatattcaaagttggtagggatgtggcgacagttactctcatccataactggtggaagtataaagttctggaaaataaactgacaatatgtattaagggtatttcacttctaacactgtatcacaaggatattcaagatgcaggaaaagacatatacagatccacatcaaagtctgctctataataacaataattgaaaccattctaaaggcctaataatagtgaggtgattaaataaataatgattcagccatatgatagagtctgacacagacatgaaaaatcacatgcctctccactgactcaggctcatactagttcctttctctgagctcttacaacatctgtaacacaaatttcacatattgtagtaaagctatgctaaatttatctctaaccaaacagtaagtctctgagggaagggaaaaatttctgtttgcccttcagcatctaataaaaaaaactttgcaaataggtatttgacaaattcttgttgattcattaattttaaggtacagtatgatggttcagtttttgttagagatacagacatactgcagttcttgaaaactagaaagcatgaaacacaaagttatcttcctgctctctaatcctccagggttctatttgcttcttcgaagattgtagtctctcttttctatttcgcccattagaagatgacaagaaggaaaaaaaacagccaaatagcatcactgcaagctaaagtgggccattcccctgggccccaactaatgaaattcaaggattttaacaaggagaaaggcagctgtagtccaaatgttttaagaggaactcatagggctcaagggccctgaacctagaaggtgcaattgattttggctctgtttctctctctctctgtggaaatgaaaccttattaattctgaaagcctgtattctccctggattctagacatggcaatactttaactacaactcctttgaaagagacactagaataaaattcatcaaatgttctaaagtgaccctagctacctctgaagcatgtattgcgttcaataatctaggacttgataaatttgcacccccaccaaaaaaaaaaaaaaaaaaacctctttcctttatgctcatgaactgggatggatggcattattttacatagttattcacttcccttcctgtaaaaggattgactatctatgctttttgccatgtgacttgcaatactgccatacggagaattaatacataatcttcccattgactatgggcttagccataggacttgctttgcccaacagagtgtgagcaaaagtgatacaccaatttccacatagaagctttggaagtcactgcataattcaaccatcttttacttttcccccagcaagctctagagcctgggtctcaggacggtgaaggcacaggaaactgacataggaaacagaactgcaatggatccaaaactaacctgctattgtgagcaaagaataaacacgttattgaaagccacagacgcttttggtttgttattgtttttgatttttctggttgttgctactaattgtttgttattgcagcataacctagagaaagatgaccaatatctgagtctggtttgtgcagaaaaactgaatttttctaagtcaggtgaagccatgccgtgatcacttgcagaggagtcacagtgaattcattctttttagtgaatcgcatttgcaaggaaacaacaagaaccaattcaaaattctagtgtttcacggaccaggttcagatttcttgtggattgccttattcgtccaggaaacactgaaggtttcaggtcccaggatgttcagcatatggtgtattccaaatggcttccaatttttacattcatcagattaaactagttccagaagagaaactactcataaaaaaaaacgagtttttgtaaaggaatgattttctatagagagaactaaaatttactttgctgagaaacaccatttacatgaaattttaaatgtgggcttttgagcctagtgagtcgtgagctttaacatctggaatgagtcaagtcccaaagccatgtcttaatacgcacgctcatttgtcttcctctgctatgaatccagatttggttttatactataatttctaaaataataagcattaaattttaattcaaagcaattcaaatatgctggcacttacgcttagtccatctgagagctgaaaagagaaccacaccgtatggtagtgtttaacatgtggctttctgtgaagtgagcttcaggctgacatacatcttagctaagtaaagactggaccttagggaggagccttgggctaatctgggtgagcaggagaggaatgaggccctgcccccagtgagagaataaggggtgaggaggataagagatgagagaagccatttaggatctcaaaatcatttactttggttattatcctttgttctttattagtatgtttcatgatttttagagttggtattttaaaccttttcatgccttgtgaaagtgtcccttctaacatctctattaataaatataatctgatcttttaagatctgatattctaaaatcaagaacacatgaataagttttacctagaagtgccttccctcatgattgcaaactccagtaggtcaccttctcctgccctctcttctcctccccatcatcatcatcatcatcgtcattatcatcatgatgttaactttagtgagcattcattgtgtgacaggcacaatgtgacaaggaacattctaattgtttgtccttgcatatagaatataacccaggctctttatctcggtctacaagacccttcagggtctagctcctgcctaactcatatttctcttttccatccctgtgtgattccagccaccctggtctatttccaattattttagtttattttttctgacttcagtctctagggctgggttagcaccactacctggagtcctccttctctcagttctttgcattgctcactcctcatctgcagatcctacatacagggtctacagatgagaatgagctagccatacaaagacccttgagaagcaaactcagactgctccactgaagtcagtagctctgttcttttctcttacagtactgtttctttcctgcccatacttatctcctcttgaaattatgtagtgtgtgcttacttatttaatatctatattacatacccattccctagcatggtgactgaaacctaagtggtttgataaatatttagagaatgaatagataaatgaatgaatggtctctttctactagtactactagtactatccctattacacatgaggaagctgtggcttacaggtatcttgcctttagtaacacagagagctgaagggttttatcatgtttccatgcaatattgtttccattttatatcagaaaagtaccagccataccctctatttgacctaggaatttgtaatgttcttgataatggtccatccatatcctcttattcctgcttactgctctacatcacgcatgttcaatgggtttgcagcttctacatgagcatgcaactccttcaaacacagcaaaaatgtattctctacaagttctcacaactccaaattaggtgttctatcatctctcagtctgtttcctgcctcccactactccaacctacagaattatttcactagaggaatggcctatcttcttccttcactaaaaagcatcacgatggtccagcagttgtggaaaaactgtgctcacaacaacagagctcagagtctaaccaaatgttcctagtctctgtcaaaaccctaaatccaatatgctcaagaatgcaaactctttttttttttttttttttagatggagtctcactctgtcacccaagctggagtatagtggcgtgatttcagctcactgcaacctccacctcttggattcaagtgattctcctgcctcagcctcccaagtagctgggattacaggtgcccaccatcacacttggctacttttttgtatttttagtagagatggggtttcacaccacgttggccaggctggtctcaaactcctgacctcaggtgatccacccacctcagcctcccaaagtgctggagttacaggcatgagccaccatgcctggccaagagtacaaactcttgaggatctcccccttttccctttatcctaccctctctagaaagatatttttctgacctacaattaatttcaatatgtacttaactgaaaaacacaatactattcagcctatgtggtgtgtttgcttgctccaggccttattctttttctgacatttaggtgtgtagtctgtgaattgcagccatgagactctgagcagcaggtccacttgagggaagcaagtgcctcatgcattccacaagtcctggctctcccccacccaatcccaagctcatagtggaatcatctcaatgcctaagaagtcacaaaaggaggtcctttgtgaatttgcattcatctaaagacatgcaggagatgcgggagggctgcttaggctgaagcaggagtgtagcggggagggagaagtagagggaaggatgcaggggaaggtggtgaaagaaaaggttcagacggaggacagaccttcctgcctcagcttctgctctcctgctttcccaattattttggttctcttcttttaaatcttaaagattttaccagggagttgagtttcatcacatctcacaggttttgatacacagcatttcctgtttgtcattttctatgtagtctttcattttttatttctttctcaagccaatgattattttggagagttcacatacttccacacacttgggcattttaaaatgtttataaataatcttgggttatgttatattgtgaagagatgtacaatttctgctttgttaatttactgggattgccatagaggtctaaaatatgatgaattagggttcaacgccacttgtagaacaggtatattccctagatttcagaaataaaattcaatgtaaattactccttcctgtcttattgattatatttttcaacttttctgtttgtatttgctttccacatctaagaaacaacaacttctcgaaagcccttctctttctccagaaggcacatcgctctccctgcgtctcttgtagagccccctttctggttcctcagtgtctctggggagaggaggcagatactttgggattggtcaaggagatttgatgggtgaacaattctactcatttcccttcgtatcctacctcaagccttcaccttaacatcgtatagccttctgaatttattattcagcctacaacttcccttctctgggatttaaaattaaactttcattactacctatgtgtccttcactcagagttctgatggcttaaatcacttatgaaatattaatgagaggtgctgctttttattctggaaagatgcttccatcaccttcattgaactattctatacaatttaaaagctctcttcgacaaaaacagatgaactaacaattgatctgttcttgtattcattcatttgtagccatgtcacatcttccatgggtaatgtatatctttaaaagtagaaacttcacttaagagagatatataaatctaagaattaacatgttaatgtgtgttccttgtgttaaaaaaaaagaaagatatgctacactgggtcaatatcattcttatcttttgcagttaaaatctattctttaatgagtgcttatggaactctcttactgagcaaaagtaagtctttcaaaaccacagtatctgtgaaagatacacactcagcaatggtaccttaatcttcatttgaaggatatgtttgcctggcaaccaaggcacctaaaaccacacaaagagaagatctaggattcttaaaagtacacctattcacatgcaaagtaaatgtccttaggatcattctcccacatctctgtagaatttcttttctcttctccactctttctaaaattttgggtggactgcttttactcatcaatggagtcagtaaaggacaaagtcaacccccctctaaaccaccaaagtatttgaaataccaacattctttttttaattctttttcataaatatttcattttttagagatagctttaaaaaatgaagacatcattttagggaacaatatattgagtcataataatgtcattagaatttggttcctgtatcactttcttgtatgaccactatctgaagaacaacaagagaagtgaatatactttttagaaaacgggttcagttcacaaattttcccaatggatagagatgatttaaagacaagagctttaaccaaagtcaatgtacgtccatctagaatctcatagaggtacatctaagttttactttgacaataactagagtttgacctttgtgagcctcaattttctcatttgtaaaattaaggtccttgctgatgccaaaattctacaggttggttgtattcctttaggttggttggtcaaagatataatataaaaatctatctattaatatttaaatcaccgtacatgacctctccttctgaataatacagtttttttttccatcaacaatccttgagggaaatttggtcaagactttgaggatatgtggttacatcagaatgtagatacctcgctggccaactgtgacagccacatcggctgtctctgaactgataaattcaaggctagagttaaaactttgttccagaaaaaccttgcatttgcattattttttttaacacttcaagcttctttttatcatttatttccttgattctacccccaaagtttagagaaatagataggacatcttactgaagtaggaactgaaagatccagataaagaattgtccaaggttatacggtcatctgacaaatgaactaaaataagaagttaggtgaactaactttaatccccttctggctacaaaacattccaccattctggtttatgaaattaaaacttccaaagccagttttatgattttttgtgcaaacttttcagaagaattcagaggagttcatggaaccgctcactgaaattcagttctagtgttctgcaaagcctgagaggatgaaccattcagaggtactgatagttctttagaaccagagaatcaccatgaaggctttaacagaaagggccccaaatttccctgaaaattatagttacattcttgcgtatctgagaaaatcatgatgctcggcttcatgttttagtctcgtgatcggagagccaggtatggaattgggtaattcacaagaccttcctccctatggaagatgagacacctcttgtagtcaacgtcacacaattgcatttctgttcttactgaagataagtataactagatctcctaaatttgaatcccagctccattacttgctagacatgtaaccatggacaagtaacttctctgggctacagtttcctaagattaaaacagaaataataatggttgttgagaggattcaatgaaataactcacgaaaagcacttaccacacatggcaggcagtaagctgacaatgatcattatctatttaatttgttatactattttaaagtcttataatagtgcctggagtacaggaagcactctctaattgaaagctatttttgctgttctcaaaagttaaaaaaaaaagggttaataatttaattttgatttacataaaaatatttgaaattcttccgtagtgtaaaactttaatatactttataagagactttagaaaacctaaattgaataaatatacccattctgaaatgatcttaaataaaaatttctggattaaaaaaaatgcaggccggttgcagtagctcatgcctgtaatcccagcactttgggaggctgaggccggaggatcacctgaggttgggagtttgagaccagcctgcccatcatggagaaatctcatctctactaaaaatgcaaaattagccgggcgtggtggcacatgcctgtaatcccagctactcaggaggctgaggcagaagaattgcttgaactcaggaggcagaggttgtggtgagctgagatcatgacattgtactctagcctgggcaacaagagcgaaactccgtctcaaaataaataaatacatacatacatacatacatacatacatactgctgtagtgctatggtcaatgcacttcaactaagtctagctagatcttatgctaaagttctgtttcctctgtctaaatgtagaaagaagaggacaggaggtcacataggtttttcctggatgaataaatggatttaacttgcacaaacaaacaaaattgtaaattcttctctagtttatgtaaaatgattatgcccaaaaaaacaatgttttatcttgctcaacactttaatttgtggcttgaccaataatttagcataagaaataccaggcccagcaaacaaaaacagcctgtctctgtttcaaatattccctgtattacaatcattacccacacttaaatcaaaattaaagatttctggaggagagcaagcagaataaaggaaggaaaaaccctaacctccaaaacaagggtcattcaacacttaaactttattaccacttgactagctgggtcatctgggcaaatcccttcacttccctgggttgagttctttcctgtattaattattctagataataaatctgtatcttattagtacatcctatcagccttatttgcctgcaccttagtcattagagcttagttattattgtatttctaacaagctctcaggtattctggctgctggtggcccaacaatcttttgaagaccaccactctgcagaatataaaaatgttgatgaatgtcatctaagggcgattgagtagtgaaagttacctcaatgtaattctgagaactgtcactctggcattgcagctccacgtgggtgaagttgatttgtatttgttctccctggggctgcttcatcatatagacgcattgcctggtgtgagtgaaaggcccagacaactcaggcaagaagagttcaccctctgggtccgtgtagttcccaccacaacgcagatccgctaagaacagggaagagacgaacaggtcatggcaatggcattgctctggcttgcaggcattggatccaatttctaaaaatttacccacacacacacacacacaagcacatatccattttattcaccctctataggcttgtgcctctaattttaagattttcagtttgatgtgttgtgggacatctctgtagtggcttaaagaaatagatgcagagatgtgtgatctagcttccaatctgccattctcttctataagttgctttttaaatacattaatgctctgcttcatttcaataagatttgagatggttattaaaaacatgtaacaaaataaactacataactgtatacatgaagcagattaaagaaaaaatgaatacagaatagcaagatgtagccagggggagttgatttgcacggaaaacaattgaaaggggaacaggaggttggcaccagattccgtggaaagaaaaggaaatgaagaaaggggacaagtaaagatgttctttgttactcttcctgatattgaaacttaaaaggtactttttctgagaacatttattaagggcacaataatagatgtcataaacaaaatcctccacttccctaaaaaaatccaaatcatagagtatttcctgtgttttgttgtttgtttgttttaaggtatcaaagcaactgaggtcctaacagctaatagtatttggctggaagtgaagctctagagtctgggacactgtgatgctggaagccagccccagcccctgtgcagctggacttgacccgaggataaaatccagagagactgcactgctcgcatgcacaaacctctctcacaactaaacatcaaacaccacgagggacctggtgccctgaattatttaagtttgggtgcctcatacatctttatcatgatgtggatcccataatttagggatcaaagggtattgcagtattaataatagagcattgggaagataaagaaaaaatatgaagctatgagagaaatatttataaagaaatgttcttggtctaagacagtcagtcatcctctgaatcacattaaaatataaaacagatgtaagcatagcattggccttcaaatccctcttaagcccccaactggtaggttacttacaaggtgatgttaagtaggtgatatggaagccttggtcactaatctgggagtctgaatggaagtgaattctggcaaaggggccagtagtctggagcggtgggacagagaaagtggtgcagaacttcccaagaagggggtcctgatacaaaggaccatctcgaatctaaaacaaaaggatgaatcattaagctcaaagtggtcagatttttaacaaactaggtcactttggatattaacttcataaaatctatcatttaaaagtgatcgctcaaggaagtttccccatcacatccaaatgtaactcatggctgaggttcagcaaagtgtgtctccttctcccatcaccccaatgccttctctctgtctgaatttttttttttttttttttgagatggagtcttgctctgtcaccaggctggagtgcagtggtgcgatctcagctgactgcaacctccacctcccaggttcaagcaattctcctgcctcagcctcccaagtagctgggactacaggcacctgccaccacgcccagctatttgttgtatttttagtagagacagggtttcaccatgttggccaggatggtctcaatctcttgacctcatgatctgaccatctcggcctcccaaagtgctgggattacaggcatgagccaccgcgcctggcctgtgactggatttcaattccaaggctggacatatagttagaatttttgtcatgatgttactaatcaaagatctttcccttttgatttttttcattataaattcttagtgatctagaagaaaatgaatataagcaaagaaaacagaagaaggaacaccattgatgccaactgattcataacttggtccaggttttcagaagggtcagaggtagagaggaagtgccatcagattagacacaacagaaagacaggttagtgaatttaaaaatgcaactttgatagtaagtaagtactacaatgataatgacgtgaccttagaaatccttttctaattgttggtttttaatctatgatgtaatcatgtcaatctctctataattttgttgtaattgcaaattctatactatataaaccaccgaggagtcaatgaactaaagaatattttaatatggtcaattttgtctattcaaattacttttcttactgggatcaaagttagatggcagcataactttattctaatatttaactggttctttgaaatactgtagtttaaagagaaatgagagacatttcaatattgtcagagtggttgacactttctaccatatggtctccagaaatgaatgtgtaggaattttttaaagcctctaattttaacttgatggaatttattgaaaattaatttcaagataactcacttttctgtcaacatttaaatgaccattttgcagaaattttccagagagagacagatcttccagtcattcccaaaggtttcaaatccattattgctgaattactaatgacttttacttgcagagcccctttttgacaccacatccttctatcctttatgaataattgcattgactctattcctctctaatggacttggaaatgcgtattgtctttttcacactgctgcaaggggctgagatttatggtgataaaaaatacaggacaacctgggaactcaatcttctccattatcttgtcagtctacaaatgaagagcaacactttttgatgcacctacgtacaaacggcatttgaatataagagccttttctcctcctccatattttaatcttttactaatgggtaggcagaaggagcttcggctgatacctctcctctcagtaataatgattactttattccaggaacctaacccagttcaacacaatcactattatttttctttttcttttttttttttttttttttttagacagagcctcactctgtcacccaggctggagtgcagtggcacgatctcagctcactgcaacctccgcctcccgggtccaaacgattctcctgcctcagactgacgagtagctggggttacaggcacccgccacctcgcccagctagtttttgtatttttaatagagatgggttttcaccatgttggccaggctgtctccaactcctaacctcaagtgatctgcccaccttggcctcccaaagtgcagggatttcaggcttgagccaccacacccggcctcttcgtggaatgctacagttaagctgtgaaagaccttgccagtttaccacagacaactgaaggtttgaatctgcattgaaggagatggctattactgagtgtttatttcataaattctgcattctcatggcaggggtgtgagcttccaggtaacaccatagcagggcaaggtaatctgtttcccagattcaaatggaacccagaagaagaagcaacaaacaggcacagttaaaaatagagactttgcaagagttagatattgactgactattgagaaacacacctaactacagctaatattttggggtcatccatgggcatggctagaccatagtgccctgagtcctaatcatattgtgatatgttctatctaaatataattatttacctcaaggtaatctttgttgcagtcatcatggtgctcgaggctcaaggtcccaaaagtaaatgttaccaggaggtcaggactagttacaacaatccagacacaatctcttcctgggggatagtttccaggataccccggagacttaatagaaccgtaaggaccagtcaggatacctccacactctaaaataagagggaaaaataatgttacatttgtatagatgctataatttatggagaatgatcagagcccttggcgtaagaagccaaactttgtttaaataactatgagcagttttagacaccctcataaattaaaaaagatttacattttccagttttataaagttacaagtctagaagtatcaattgataaacaaatgaatcacccatgtgtcaagctctgtgcttgtgagccatcacatgctgacactatttaaacagggctgaaccatctgagcgatgaataccaggattgtagagtcatctttttcactttgatgatattaatttctgtatgtgaaattgtaaagaattccagaacttctgccaacctctgtgtgtttcagcaaaccagatcactttgcatattaaaatggttaagtgtgacataattttcatttgagaaggtttcttaatactatcatatagttaaaacattcatttaataaatgaaaaaattcaaatgtctgtagtgatcgagccactgttccaagaatggagcaagtgagggactgagccaggctttctgatgctgaccccactaccatcctcattataccacatcggccccctaacgttgctgactagtgactggaagaacctgctcttcattaatacccacatttatttaacaaagaatctgtagtggcttagatttctatgagaaatgctactgtaaatcaaatgacagaaacactaaataataaaaatccagactgtagtaatacagacattagaaataagtgagataggtaacattttagatgtgtaagatatgaaatttacatagctatacaggttgttcaaataaaaattttcctgccaaagtaaaaaatgaaacaaattagttccatgagtctcattgttcctactgagaaaacatctcagttcttcagaaaaagaggcatttcccaatgtaatactttaaaagttaccagttttaaatgcataaaatagcataagcaaaggaaaagattaatgacaaaataagaaaaaatgcaatatgcaacaaagagttattatcctaaaatataaagaacttctaaaaagaatagagacatgaatagagtgcactgaaaaaagttcagatgtctcttaaacatatgaaaggatgttcaacctcactcatcacaaagaaggagcaaataaaaccttaattgagatgccatttcttacccctcagaatgttaaaaatgcagagttttgaaaacaaattattggagaggctgtggggacatagacattctcacacattgctagagaatgcaagatggtacgatcactacataagagaatatagcaatacctagcaaaaacctatgcatttcattttcttttgaccaaacaatactaccattggaaagatatcgcaaaggtacattggcaaaaatacaatacgacaagtgaataaggtattttgttgcagtaacatttggaattccaaaagattggaaacaagactgggtgtgatgtctcatgcttgtagtcccagcactttgggaggctgaggcaggaatatcatttgagcccagtttaagaacggcctgggcagccatcgctacaaaaaataaaaaaataaaaattagctgggtatggtggtgcgtgtctgtagtcccagctactggggagactgaggaaggaggatcacttgagcctgggaggttgaggttgctgtgagacacgatcgcaccctgtctcaaaaataaaaaacaaaagactaaaaagaaaatggccaaaggactggaaacaagccaaatgtccgtcaatagagtattgattgaacagaaaatgagacatcacatagcggcatactatgctctgattatggagtaatctccaggatatatgatgtgaaaaaaagccaactatagaccagtgtgtatattatgctcccttttatctaagaaagaggaaaatacaattatatgagatcatttgcttaatttttaaatagaaggataaatcaaaaactaataaaaactgttctctaatgggggagaaagaacagagtggaagggacaggaaaaaaaaaagctagacctctcataatctaccatgcccattgatttggctttggaactataaatatattttacataattataaagcaaaatttgagaaaaatgaaagaaatatttaaaatcacaactgaagtgaaactggtgaaataattgcattgagctgacaaccatagagagtagaaatattccaagggaccttaaacactgtaatttgactataccgctcaagcaaaacatattttaaatacacaaaaaagaacaaagaaatcttaaatggtttccagttatcataccattagtaataatattagtattgttattttgaaaatatgtacagtaggactaagtacataaataatatgttcatgtcattgggaaccaggatttttactgtatgagagaagaggtagaaatgtaaagtaaaaaaaaaaaaaaaaagcaactctataatctcaatattccaatatagtgtaagatcactatgaatatatagggtattttttctttaaaaaacaacaaaaaagttttttctaattctgtccactgaaaggtctagagacgatgacacacccagtaccaatagccatccgtagcacccagattgtgagatctaaataccatttcccacagaaaaagtcagagctctttagggaaatcagggttttcagtcctgaggtaaataatgtgcaggaagagcctagaacatcttttctgaccagaaagcaaaggagctttcaaaggtaactggagtttggttaaaacaagttcagaaactaactggaaaattttccagagttttgaaaacaaattattaacaaacacaacaaacaaaacacggaaaagtgtttcatttttaaatgcctagaattgattaaagcacatcaaatgtgatataatatataaatgtacagatatcgaaaacaaaacaaaataaaatggaataagtgaccattttgaagaatgctaaggaaccaagttattaatttgaatactttttaaaaaaaagaaaaagagagaaaatcaagcatttatcctacctttcctacatgatctctgtatgagagcaaccaaatagctgatatgagtaacttctattccattaaagaacttcaaataataaataaataaagaagaaataataaaatcaaactattatcatgttgtaggtctcaatgaataactcatctaaatactgaacctaaagaatgctaaaaccattagagaaagtgcaaaagaggcttttaatgggaagttcaacctgaggagatcagaacactctgaccaatgttaacttcataatagaaaagcagatttcatgtatctcctgaaaagattattttttaccacataaaaccccctggatttaaccaaactttttggtataagcaccagtttacaaacaacatgacaaatggcatgtagaatataaacagcaaaatccaagatgtgggatgatctacagaacaaacaatccatttctttcacaaataaatttgaacaatgggccactctgcctatggagtagccattcttcattctttcactttcttaataaacttgctttcactttactgtatggactcaccccatattctttcttgtgaaaggtccaagaaccctctcttggggtctagatcaggaatcctttctggtaacatcttcctggcaaaccccacagggacgatacggagaaaacccctgacccataggaaacagactgtagcaccaactggcagactgtggatatcaccttttatcagagttatgaacgggtctcaccatactgacgctttctgactaagctcctctctaccctgaatacaagagaccctaatagttaggcaggaatatcatcacccctattcatcctgaaggagttacagaaaatggactgacatccctctacaacccttaggattaaaggtccccttgtaaaagggagtggggtaataaaccataggcattcaaaccagagcaactccatcttgaataggggctggataaaatagggctgagacctactagactgcatttccaggagtttaaggaattcatagtcacgggatgagataggaggtcggcacaagatacaggtcgcaaagaccttgttgataaaacaggatgcagtagagaaggcagtcaaacaccaccaaaaccaagatggtgaggaaagtgacctctggtcgtcctcactgctcactatatgctaattatagtgcattagcatgctaaaagacactcctaccagtgccatgacagtttacaaatgccatggtaacatcaggaagttaccccacatggtctaaaaagaagaggaaccctcagttccaggaattgcccacctcttacccagaaaactgatgaataattcactccttgtttagcaaataatcacaaaataactgtaagtatactcagtcaagcagtccatgccactgctctgcttatggagtagccattcttttatttctttactgtcttaataaacttgctctcacttaagaaaaaatgaacaatgattaatgattgataatagtaaggaattattgtttgtttgttttagtttttatcattttcaggcattgagaacaaacagcaaaggactgtaatctctgaaaagagaagcatataaagtatgtcccatacacactcaagaattcaaagaagtgaagcccaaggagacagcaatacccttgctatggcaaacaaacaactcacgatttagggctaccaaagcatctggcggttttggagctgcatactataaggaaagcagctgcatggaaatggcacctcaaaaatgtacaggcatttccttgggtccttagctcattcccaagctgcaaatgcacagagaagacagcaggtctaactaacagagaacagtttcggaggggagggaagttgctaagaattgaagagagactgcataataaatactgaagggatgtgttgcctcattcagtcagaaaggagatacttttatgaaaaccctgagaactgaattgaaacgtgagaaaagtatgctacaggagtaagattcatattctaggaaatatggcaatccaccaggattcatggaaaatttgaaataggtcccctgtaaattcaagccttgattgaatgaaagtgatctgccaggaacataagtgcctactagaaaaaaacccaacccttctgagaggaagataatataatccagaacccctgcaacatatcacgtataatgtcctgctcacaataaaaactgactaggcctgtgaggaagtagtaaaaaaaaaaccaaaacccaataataaataaaacaggcaatctcagcaaagccagaaacattccagatactgaggctaccaaacaatgactccaaaataattatgataaaacttagaggaaaaggttgacaaaatagttgaagaacatttcaacagtacttacagactttccaaaacaaaataaccaaatggaatcaaagcaaaaaaagaaggcaagaatataaaaccataagaactattagaaacagtcaaaaccttcagcatatgtgtaatttgagtctcagaaggagaagaaagaggaaaaaagtggcaatgcaatatttgaaaaaatattggctgaaatttctcaaaattgtataaaagaaagcaacctatagattcaaaactctcagtgactctcaagcaggacaaacacagagaaaaccagatctagatacgccataatcaagttgtggaaaattaaatataaacacacaataaaagcagtgagggtggagaaaaagacacattatcttcaggagaacaacaagaattactgctgaggttcctctccccaaaaaaattatggaagtgacaagacactgatgtggtattcttagagagctaataggaaatggtcaacctaaaattctatgtgtaataatatccttcaaaaattaaggtaaaaaatgcattcttaaacaaaagctgagggaatctgtcttcaacagacatgctctgtgagaaatattaaaatatgttcttcaggctgaagaaaaatgatcccattagaatgtaaaatggtctgtttgcaaatggcatgatctttcatacatagaataccctaaagactccactaaaatacttttagaactaataaatgaacaaactaattcagtaaagttacaggatataaaatcaacatataaaattagttgcatttctatacattaacaactaactgtacaaaaaggaaattaagaagaaaatcccatttacaatagtgtcaaaaagttaaatacttaggaatgtatttaaccaagaaagtgaaatatctgtattttgaaaactataccacattaatgaaaaaaagaaaatatttggtgttcacaaattgaaagaatactgttaaaatgtccatactatgcaaagcagtctacagttcaatgccatctctaacagaattccaatggtatttttcacaaaatagaaaaagaatcctataattcatatgaaaccacaaaagaccccaaatagctaaagcaatcttgagcaaaaagaagaaacctggaggcatcctgatttaaaaatacatttaaaataaaaatacactacttgattttaaaatatattacaaaactgtagtaatcaaaacagtatggtattggcattaaaaacagatatctagacctatggaacagaatagagagcccagaaataagtccatatattatgctgaattgatttttgacaaacatggcaagaacatacaacatgtaaaggatagtctataataaatggtgctaagaaaactggatatccatttgcagaaaaatgaaactgaacccttatcccacaccacatacaaagtcaactcaaaattaaagacttaaacataaggcctaaaactgaagaaccaatccaggaaaacatacaggaaaagccctatgacattagtctgagtagtgatttttttggatatgaccacaaaagcacaactgaaatatataaaaaactcaactcaatatcaacaaaacaaactaacccaatcttaaaaatgggcaaaggatccaaatagacatttctgaatagaaaacatataaatggtcaacaaatatatgagaaaatgctcaacatcactaatcatcatggaaatgcaaatcaaaaccacaataagatgccacctcatacttgttagaatggccattatcgagaagataaaagacaacaagtattgatgagatgtggagaaaagggaacccttgttgaaagtatactggtacagccatatttaaaacaatatggaggttcctcaaaaaattaaacacagagctaccacatgattcagcaatctcacttctggttatatatccacagaaaattaaataaatatctggaagagctatctgcactttcatgttcattgcagcattattcacaatacattcatacattcaccatagccaagatatggaatcaatctaagtgctcatcaacaggtaaatggataaagaaaaagtgcaatatataaatacacaaaaacacacacacagacataaatgggatattatttatccttaaaaagaaaaggaaatcctgtcatttgtgacaacatggatgaaacagggagacatgctgagtgaaataagccagacataggaggacaaacactgcatgctctcgcttatatgtgaaatctaaaaaaagttaaactcatagaagcagaaagtagaatggtggtggccaggagctgagaggtgggggcaatagggaaatgttggtcaaaggctaaaacgtttatgttctctggaatgaatagcttctagagatctaatgtacagcatggtgactatcattaacaatattgtattatacacttgaaaactgctgacagtagatcttaaatattttcaccatattgactaaaatggtaactatgtatgatagatatattagttacattgtggtaatcatttcacaagttatacatatatcaaaatatcaaaacattacattgtacatcttaaatatatataactttcatttgtcagttaagctccaataaagctgggaaaacataaatgcttgaaatattgggaaaagaagataaaaataatgtaagaaaataaataaagcaaaagtttcagaacaaaaagctggcaaatctagaatcatagtttgagattttactataactttctgactaagtaataaagcaaatatttttttaaatcagtaaagaaatttaatatttgaaaaacactatttaccaacttgactaagttaatataggtagaggactacatctaaccattacagaatatacattctttcctgtccatacaataaatgcaccaaaatagactttggtctataaagtaaatcttaacaaattttaaagattgaaataatatactgcatgattagtgatcacattggtaaataaacagtataattttaataaaacctatggtcacagagaattcaaaataaaaatgacaaaatactttcagccgaatgctaatgaaaacatacatattaaaacctgtgggatgcaaataaaagttctccaaggaaaatgcattagtattagtgcatatattagaaattctaagaagttcaaactcatttgtcaatgcttccaagtcaagaagctaggaaaaaattgttaaagtaaccatacattaggtgcaaaataacacaagggaagaaaatgataaaaccatgaggaaaatcaatgaaataaaaatcaacagaaaacattaacggagccaatagttggaattttgaaaacattagtaaaactaacaaatccttggtaagacttatcaaggtaaaaaagataacataaattatcaatatcaggaatgaaaagagacgacatcactacagagcctacgaacactaaaacatagtaagaaaatattctgaaagtacagatgagtttcttgagaaaaaaattgccaaaactgaaaaaagaagaaatgtaaactctgaatagatctatattaaatacattgaatcataatttaaagccttctcacaaggaagcctgcaggctcaattaactttatggtaaattatttcaaacatttaagaaatattgtcaatcttacacaaatccttccagagaatataaaaagagaggacacttttctattaattttaaaacattgacattacctgtaacttgacaaaattacaaaagaatatcacccaaatatagatataaaaatcctaaaaatacatattagcaaataaaatctagcaatgtataaaaagcataacttgccatgaacaaatggaaaatatttgatgaatgcaaagttgattcaccattcaaaatcaatcaatttaactcactatatttacagaatagaggacaaaaaacatatgatcacctgaatagagtcagaaaaagtattttatatgtttcaacattcattcatgattttttaaaattcttggtaactaggaacaaaaggtgtgggtttttttttaattctttataaattctgacacctctcccatttagaagtgggcctatgtcccctcgccttgaatttgggtcagcttgtgactaagttaacccattgagtatggcagaaataacacaatgacttccaaacataggctgaaaaattcccacgcagcacctgtctggttctgttgtaatgcttgctctgagagaagccaattgccacgaagaaagtttcactattctaagacaaactttttagagtagccacatgtaggcactcaggtccatagcctagttgaactctcattgaaagccagcatcaattggtagccactggagtaggccatcttggatattcagcccagtccagcctttagacagctacagtcccagctgacacccgcttataactgctgaatagatttcaagtagcaactgtcatgttaggttctttccaaattcctggcccacaaaatcagaaacaaagtcaaatgattaatgttctacaacactaaatttgtgggaaattagttatacagcaatagtagttgacataggaaagaacactcttcatctgataaaaattatctgtgaaaacttacagctaacatcatattcaacaatgaaatattgagcatttccccatgctgctggggaaaagacaaggatttccttttcaccacttttattcggcttggtattgaaggtcctagccagggcaataagtcaaggaaaagaaataatagttacaaagactggaaaggaagaggaaaaatatccttcattcacacatgatgtaattatgtacgtttaaaaaatccaaaagaatctacaaaaaataattagacatgatgagtgaatttaacaatgtatatggaatcaaaatcaaatatttaaaaaatacatatttttacataacaagtgaaaaattaaattttagaaaattaatatttcactaagcataatatatcaaatatctgtaaataaatctaacaaagatatggaatacttagacactgaaagctataaaacattgccaggataaatgaaaagagaactaaatttaaaaatagtttatgttcatgcattggcaggctgaatatttttaagatgtcatttcttccaaagttaattatagtttcaatgtaattcccataaaattctttgggaaaactgacaagttgattcaaaaacttatatggaaatgcagaatatccaacatctttgaaaagaacaaagttgaaattacactctcagatttcaagcatcagaagttaagcctaggtagcatcaggatagataaaaacaccagtaaaaaagatgagaaaatgctgaaattgatccacagatgtattgatgaatgaattgggggcatggtatactgatctctttactttttatttgtttaaaacttgcatagtaaaaacttaaaagaaaatagaataattaaaacaaaataataacaaaaagaaaaaattattgagtgatcattaagatgaaggaatactacatgaaggggtggacaatgtcctcaatattcctgcagtaaactactagtagagcttataaaaaggctgttcagtaatttgataagggaccaactaagactcatgttttttaatcccttctatttcatgcttattttgttgcctttagacacaaaataaattctaattaattctaggttgatttgattttaaagtaattatggttggtcacagtggctcatgcctgtaatcccagcactttgggaggccaaattagatggattgcttgagcccaggagtttgagaccagcctgggcaacatagagaaactccatctctataaaaaacacacaaaacattagcctggagtggtggtgcacacctgtagtcccagctactcagaaggctgaggtgtgaggatcacttgagcaaaggaggtcgacgtttcagtgagccgtgatcaggccactgcactccagcctgggcaacagagtaagaccttgtctcaaaataaataaatgaataaaataaaataaattataaaaatattatatatcttcagatcccaaaacatctcatgtatccaaaagtctaacactgattaagaacacttaataacctcaaaattttgcttgcttttttctccaggttcacacatacctggttgctgtgtttcccatcttactgtaaagcctctcccatttcttaaatgttcagaatagagatgaaaatagagagcattgtcactgctgaggagttcatgagggaggctggagccacaaaatcttccaagttgaaaagcagaagaggaatctccatcataaacctgaagaaactcgtgtggacagttgtccatggattctaaccggaaaaaagtgaaagtgatacgcaggacctaaaaatacaaaggccacatatattatcttttacttccatgtaaattttaaagtatttctcccacttcctaggcagcattcatactgaggcactttcaagagctagacctatcattccctaattatccaccagtacatatggcaatctatatactaaataacttgtgctaaatattgttaaaaacaaacttcaactaatatcaaaatatatcaaaaaatcttaatgttaataacatagatttaccccaatttcattaaacttgtcaagtccaccagaccaaggtatgtcaaatatataactgacattgtttctaaagcagtaaaataaattggagatttgaaaatctacctgaattaagttgaactggctaatattaccattcacaagaatgtacaccctaattccctgaataacctgtggcctgttatcaaacacacagacgttcatcactgcccgccagggatgttgattccagaggggctaagattctgacgccagcccagaccgacacgctcaggtgtgggcggagtaggcgggatgtagacaagcaaggcctggacggcttcagggactggatataattaaaggatgagtaataccaagagtagagaatgagaggaagaatactgagcatacaagaataacaggaaaaatactgagcatacaagtagaagagaataaacacaaaaatgtgtccgaatggattagaatacagacttcaaatatagtaatataacttataaaacgtactgacaacctcatttgagataaacaatcaaaagaaggctgtcgaatttaattttcatcagaacctaaaatcacaacaatattcagttaatgaaaaagaatataaggaattttttaaattctgtgctagggtattttaagatcagttacctattactacatgactttcttaaaacagtttaaatgaaactcaaatgttcactaattgaactatcctgatttgtatatattttctaccatattatgtccattatgagtgagaagatatgaaatcacaataatcaagaaaaaaacaagatgaattttcttgcgaattggtaatgaaagtattacaagtttctcacctaagaatatttttttttcaaaagaatgttttcaatgccaggaaatagaattcatgaaaactaaatggaaggaaggaaattcacatagcatacccactgggaaatttattttggagtttattttagtgtgaggttaccaggtcgcaaatagtcctccctcctcaaaggaaaaaaaaatgttttttgacccttgtacaatgccctctgtaatagtttgctggaaaaagttaataggatttcaagggaaaattttatctattcagacataccattttatttttatgaatccaggaggtggttgagaaacaatatttagaaatgcctgggtaattaatgtcgggtataagagcactaaaaaccttggacttggatcttaatttgaagagcgttcacggagcggctcagagtgacaggctgtggaggtgactggcctgtgtctgagtcactgcatgccactttcgaaccacatgcacctggacacacttctcaatggcactaggctctgtttcctcatgtgtaaaatgaagataataatttctatctttcagggttatgagagttaaaaatggaatgctgtaatgtatatggagcacttagtatagaacatggcagagcaaagacatttgataagaaaactatcttaatatcagtggccatttttgcacaataatcaacataaaactaagcaaccatcttctaaaatactgtctcagtaacaacatgattttacagattaactagtggcttgcagtcagtcaaccagtgtagagaatcattcatgctggagaaagcatggactttggaaccagacaaacttgactttgaaattcaactattacaattacaagctaagaagtgttaacaaaaaatgtttagcttcacctacttttcattatttcatctataaaaggaggatcctcctatttatttatttatttatttatttatttatttatttatttatttatttttgagacagagtcttgctctgtcacccaggctggagtgcagtggtgcaatctcagctcactggaacctctgcctcctgagctcaagtgattctcctgcctcagcctcccgagtacctgagattaaaggcacccatcaccatacctggctaatttttgtcattttagtagagctggattttcaccatgttggccaggctggtcttgaattcctgacctcaggcaatgtgcccgcctcagcctcataaagtactaggatcacaggcgtgagccaccaggcctggccttgttactctttttttttttttttttttttttttttgtgagatggagtcttactctgttggccaggctggagtacagtggcactgtctctgctcactacaaactccgcctcctggattcaagcaattctcctgcctcagcctcccgagtagctgggattacaggaatgtgccactacacctggctaatttttttttatttgttttatttttagtagagacagggtttcgccatattgaccagactggtctggaactcctgacctcaggtgatgcacccacctcatcctctcaaagtgctgggattacaggcaagagctactgcacccagcccctgtgacttatttcaaacaattaatgtaaggttatgaaaaggtaggtatatgtctagccaaaataatggcactccgtacttagtaagcactcaatatatgatagttgaattatcattgcatgtattttatgtaataaaatatacacatactccatatttatatatacaaatataatatgcatttgggcaagagttactacatttacctttcccatttcagttttgataacccagaagcagttaacatcatgaacataaccaacatccgggctcctgtagctgaagcttccatttattcctgagagggactctccacaaactgcaaaggaaaagatgaactgtgcttttcagaggttcctaaaaggaagaggttgggcaactgtaaccctgctgctgataaacttagagaaaatttgagtaatgaaggttggagataaaagccctgccattccctctcctctgtgccctttttctgtcaacttccatagaaatcccacctcttgttcaaagctcagctgatgcctcatcacctgctccatgaactgccatgtcttatgttttcactgattcccattctctgtgtccctgtgacacccaatttcaccccacacaacatagctcatgtctttaactcttgtatctgttctcccattggggttggtcttgtctcctcagctgcaaggtgagcagttcataagtggagacagtattttacactttcatatttttccatagggtctactattgtcctaaacatataacaacaacctctcaataaatgtgttgattccaaatcaggagtttaagtgaggggcagaagagtcaaaagtgactttatggaagaagttgagagggaagtgctcctgagggacagacacatctggatgagaaacaaggaagatgtgtgaggaggtttatcgggagaaacattccaaataaatgaacacagtggaaaatactcatggtggtacatggggtccggtgacgaaagaaaacttgcttgagtgaagttatttctagggaactagtgaaaaaaaaggttagatggattgagtgagacttggttatagaagatcattgaaaattaatcccagtctctatttaacaggcaacgggaagccactgtgtatcctggaaagggagagtgacttgattcaatgcagtactctagggaaattaagtggctgctcctcagaaaacttccctttagaaaaccataaaagacaataccttagcatgttttatattcaaaaaggacatagtgaaaatggcaaatactaatgtatttattctttggaagaaaagttcttggcttacagtgagatttataaatatttagcttgtgaattttataccatttctgcaaggaaagacttagttctcagtatctgagcaactggacaagaaagtgggttcagcagaggaatctgttgagggactcactaaaggatgctgctgctatgctgtgagcatccgtggcataagaaatgctgactgtaccttgctgaggaacctgacagagagctccagtccagagacgtgtgcattcacaactgaaagaatcaacgccatcaacacaagttcctccattcaaacaggggttgctcaaacactcattgatgttttctgtacagttgacacctgtccaacctgagtcacacttacaaaaataaccagagacagtgtcctaaggggaaaaaaaacacataataccataaaacaaatggatagacactaaactttaatcaacccaaataataggaatgtagtgccatggagatatataatatataataattatataattattatatataaaataatatataattatatatttaaaaataattattatttatgtaataattatatatgtataattatatatatataattttttttttttttgagatggagtctcgctctgtcggccaggctggagtgcagtggtgcaatctcagctcactgcaacctctgcctcccgggttcaagtgattctccggtctcagcctcctgagtagctgggattacaggcacgcgccaccacacctggctaactttttgcagtagagacagtgtttcaccatgtcggtcaggctggtcttgatctcctggctcgtgatgcacccgcctcaccctcccaaagtgttgggattacaggcatgagccaccacgcctggcctactgatatatttaacaggtgctacaaatatatatgtgtttatatgtaagtattttctagtagtctacttgttattaataggtttaaatggtaattgttttgtatgtcagatttatttagatcaaactgcaggcgtagttttagtacttcataaaccactgagacaaaaaattaactcaatgttttttcctaagaactaaaatcattatctatctttcatctgagagttctcgacagttccttatctgaaacttgactcattatcttgacattcctgaatcctataacgttacattttataggcgtgaaactaattctcaggtactctctgtccacaggaaaaacaaaggactcacgatgcattgtccatttagacaggggtgacttaggcaaatattactgagctgcacacatccatttggcccataaccatttccagtataacccgggagacacgtgcagagaggtaaggaacctgttcagaaataaaaacaaacgtgtaaatacaggtctcctcctctgttcggatgcagtatctaaactcagaatctgctgtctagacaaggatccaccaacatccagtctgtgtattttgacgggcagacaaaacaaggtatgaggagaaaatattagaatctttatttttgtatttcttatcttaaaataagaaagccattaaatgccttccacacattattgacgtactgggttgacatgggtgctgtcagcccatatgtcagatggtcctgagctgtgcacaaaggtgagctgcacctggggaagacagacattcctcatcatggaggagttaatgcagaaaaggagattcttaggatgaaactatctgttgcaagcactggacttactctgactgatttaatcctcccaagagcccaatagagggccaggcacagtggctcacgcctgtaatcccagcagtttgggaggctgaggagggcagatcacttgagttcaggagttcgagaccagcctggccaatgtggagaaaccctgtctctactaaaaatacaaaaattagccaggcatggtggcacacgcctgtaatcccagctacttgggagggtgaggcaggagaatcacttgaacccaggaggcagaggttgtagtgagctgagatagtgccactgcactccagcctgggtgacagagtgagactccatttccaagaaaaaattttttaattataataataataatactaataaagagccctatggaatctgtaatccctgaactttgggaggccgaggcaggcggatcacctgaggtcaggagtttgagaccagcctggccaagatggttaagccctgtctctactaaaaatacaaaacaattagcggggcatggtggcctgtagtccaggctaatcaggaggccgaggcaggagaatcacttcaacccaggaggtggaggttgcagtgagccaagatcctgccactgcactccagcctgggagacagagcaaaacgccatctcaaaaaaaaaaaaaaaaagccctatataggtactctcttataatccccactttacagatgaagccagtacacagacagcctgtcccggccaaggacacacacacacagctagaatgaggggagcccagagagcaagcactcccctcgtgtgtaggctgcctacagcacacctgtacaggagtgtggcttacacaggcaggccacatgtccccagttatgtggatgtgcagattgcatgctgccagttttaaacaggctaaatagctatcacagaatgaacttaagtctctaaaagacgtttgcaataaaaccacagattgaagataatatagtaacataaatatatggggacatcaacaaaataccagcaccaaaacttctcccacacttctgatgagctcctcattgccaaggtacaaggttaaaacaatggcaatcgaattaggttaggaaggaacttggtcaaaaggaatttgaaatgatcgtgtctatttaaaacatgaattaacatccacgattaattatgatgtacatgaggtaatagctaacaatagttttagagcatccagcatcttgacagttttcttacgcaatgttaggttaaaaatactcgtcatagacattacaaaattttactaaatttaatatccagagagttttccagatttctcacttaatagcaaaaagccacatctcattgcagaaatatatgttctttctactactgcacaatggttgaaataatacaaggaaatcaatgtggcagttaactacattcctccatcagcaagaactgttaaagatggatagaaaaaccctgctgaataatttaaaaaatagaacaaattacacaatgtgacagatttacagtagaattgaatgacaatataagttgttctttttttttttttttttttttgagacggagtctcgctctgtcgcccaggctggagtgcagtggtgcgatctcagctcactgtaagctccgcctcccgggttcacgccattctcctgcctcagcctcccgagtagctgggactacaggtgcccgccaccacgcctggctaattttttgtattttcagtagagacggggtttcaccatgttggccaggatggtctctatctcctgacctcgtgatccacctgcctcgacctcccaaagtgctgggatgacaggcgtgagccaccgcgcctggcaaaaatacaagttttgttatgttctcagcttatattacttgcaagattccacttcaatattaaaaaacacaaatatttcttttaaataaataattgcctagaaatgcatttttttatagttaattacttcttttaaaaatatttatagggaaaaatggagtaagcaagctctgaaactgttgaagctctgagtagaaattttttaagtttcccagggtaaacttacaggttgcagtaaagaagggcagcctaaaagtacacaaagtgttattaatacttcatgtcatcaacattatgactgtcctccatattaaaaaacagttatttttgtaataatatttgttacaagcactttacatataaggactcatttaatcatctgaagcaccctgaggtaggtgctattattatcctcattttacagatgaagaactaaagcacagagattaagtgtcttcactgaggacaagcagctaaaatctggtggagcccagggaaaaatgcaagcagtctttatctagaaatcatgctcctaaccactttggtatgttgataatcatttaataagcatttagtcacaagtatatgtgtgtgtgtgtgtgtgtgtgtgtgtttacatacacatatatgttcttttctatatatgcaagtatatgacaaattaataaaaaataaaggtggtatcttgaaatagcaagagacatgattattcaagaaatggaactgggtccacttatttgagcaaaaataccaagccagatctctatttgatgctacggataaaaaatacattctaaaaatataaaatatcttaccataaaaaaagaaaccatagaagtataaaagaacatgtacttgacaatttttaaagagttcagtaaagaaagccttcctaaacatgactgtgaagggagaaatagtaagagaaaagatttatctttttgactacgtaaaaattctaaacttctgaatagcactaccactacaagattaaaacaaaaacaacatgccaggaaaaacacttataaaacataagacagataatgagataatgtccttagtacataaagaaactttaccaatcagtaagaaagaaagagagcaaaggggatgaacaagtagaaagatgcccagtgaaaatgtggaaagtattaattattagtaatcaaaaagtataaatgaaaataatggaaaaactaattttgcctataaaactgaccaagatgaaaaataataataatatctattattgtcaaagatggagtaaatatgtatttttatacactgtcggtgaatacataaattgatacaatctttcttggagaaagtttagcagtatatattttgttaaattacagggttaaacccttctatgcagcattgcaaacactgttggttgtcaccctagatctattttctacttccttctttctgaactccttatttcagctggactcaggatgcctgaaatatagagtgtacttcccaaactccctttgcagcaaagctcagttctaagcaatggcctagaaatggaagagtccttcaaaagaaggtggcattgccttcttcctccttttctcctgcctgcttgttggaatacagtcgttaattaattaactggcttaattaccttatttcctaaatcagagcagaccattaaagagcatagtttattacatatttaagaaagccaaatgtgtagttttatggcatggattaattttaggtttgaaggtcaaaataacaattttgagaacagaggattttgtgtttaagatgttgaattggtttagaaggtcatattacaatacccaaagccaaagagagagatgagtcattacctagagttgaggagcatgaggcatctgggtggcagcctccattactgactgagcagatgtctgtgagtgtgcacactcttccgtcaccctggtaccctgatgagaacaagagccaggtcataagaaacaatgtcaagaagatgggaggacaaagcctgtctaggattcaaatatcatgaaatggaccaatcagggatcctctatcatcgaaacaaaaaatataagtataaaatgtcatcaacaaatgaaatttcataaataagaaaaataacaagaattagtaacctgatttcataagcaatgttctgggttgtttctaatgaaaaaaatatgtataaaactactggtagacttagaaagtgctgacactaagaaagttaatatttttatattacagtgactctgatgttcttagaggtcaattattatagaagcccaaagtactgtagttccatgttatttaaacatacaaggtttcagtttatcccttagtactccctgaacttcttgggtagtaattcgatttagattagagaatagcagaaaagacttctttccagaaaaggagggaaaccaacaattacgatatatgcctactgtgatgcctgtggtttagtaaacttggtatatgcaaaacaactcaggagtgcatgatattaacaaattattcgtgagggcaatggaacagtaagtctgtgatccactcagaaaacttttcaaattctgcattatctctgtagctatttgacagtttgtaaagtttgttgttttctactgatattcaaaatgttttttctttcttatcatagagttgtactaatgtgtcctgaattcacaagataagcaaaactttctgtactatttcctctcctaagacagaaataatattttattttttatttttttaagacagagtctcactctgttgcctaggctggagtgcaatggtgcgatctcagctcactgcaatctccgcttcccaggttcaagcgattctcgtgcctcagcctcccgagtagctaggattacaagcatgcaccaccatgcccagctaatttttgtctttttagtagagacagggtttcaccatgttggccaggcccgaactcccgacctcatgtgatctgcccacctcagcctcccaaagtgctgggattacaggcatgagcaactgcactcagccagaaatcatattttaaatggagcactagattccgtattcctatgtctgtgttccctgtgctggggtcaggaggttgacattgaaccgaggcagcacctggtggacaggcctggcagtgggaagacccaggtgtattcacacactcaacgggtggagccacagaacagccgccgttatttatctcacattcattgatatcttcgcaaatatatccattgccttgccagcctaggaaaacaagaggatttaaaagtttagctctatagacaagtcaacaaggaagaaatacaagagtcaaaacatataaaaaccttctccacctaaggaactataaaataaaaatgagatatgcttatcagattggcaaaagttgttttgaattcttaaaatcaaattctgacaacaaagtgggcaaatgggctcctcttatatgctgatagctagacattaaattgatataacctatttggaaagagctctggcagtattcactaaaatttttaaaatacatagactttgactgccagttgcacctattaaaactcagcctattgtgataaaactaccagtatactaagatggtagtatacatcttagtatactggtataagtaggtaagaggatgtctaccgcagcactgtttaatagggaaaaaaccctcaattatcaatagaagcatagctgaacaccttatgactcatctttgtgaccaaatactaaaaacgctttttaatatcatgtgtacacctgtatacctacatttgcatacacacacattgaaagaatttttgtatatacattaattaaaatactaaatgtggctgggcaaggtggctcatgcctgtaatcccagcactttgggaggccgaggtgggcagatcacctgaggccaggagttcaagaccagcctggccaaaatggtgaaacaccatctgtactaaaaatacaaaaatcagctggatgtggtggttcacgcctgtagtcccagctacttgggaggctgaggcagaagaatccctcaaacccgggaggtggaggttgcagtgagccaagattgcaccactgcactccagcctgggcgagactttgtctcaaaaacaaaaacaaactgttaaaatcatatggaggattgggctcatactcctaatttggggaaagaattttttaaactcttgcatatgtgcttgtacaaatgaagaataaagtagaagaggaaggagaacaaatgactaatggtgtcattaggaagatgagatttaagaattttactttagtggttcccattgtattcaatggttgtagatttataattcaaattattaaaattataagaattcttaaaaacctttaaagatttaaaaatattcatattctttgatttaagtagaatcctcttctaagactctgcctaagaaaattatcatatttgtgcatggcaaaatgtgtacatgaaaaaaagttggaagaaaaaaacgcccaaatgttcatcatggtcctctgtgtgataagatcaaaggtatttttttctattttttccatatttttgtagtgatattttataagcagcatatattgctttgctgcttataaaatataactaccatatatttcaggaaaaatagggtgataaacaagaaaacaaaaaaattgtttctctttttcctctccaacaataaaaagaagaatgtaaaaacattgccaatcttctaatttaaataatttatttttctgatttatagtttttaaagattgtccatgataaattaccttcaaaatgtgattgcttgcaaattgtgcttgcccctgagaactaagagggaaaaagtctttataggttttttttttccatttctttccagttttacaagatctaaatatatacacgcagaaaaccactaaaccaaaaatcactacatggggcaataggtgtgtggggtttcttggcgagaagaaacttgccaagaaacttgggtttcaattctggctatctgtaaagctatgcgatcttgggcaagttattcaacctctttaagctcaagttctcatattgtaaaatgtgagtaatacttatttttaccatgtcttgattttgttgtagttaaaagaattaaaaattgcttatacaatgccttaataacactttgattaaaaataaaaaccaggccgtgtgtggtggctcacgcctgtaatcccagcagttttggaggccagggcaggcagatcacttgaggccaggagtttgagaccagcctggccaacatggcaaaccccatctctactaaaaatacaaaaattagccgggtgtggtgaggtgtgcctgtaatcccagctactcgggagggtgaggcaggagaatcgcttgaacccaggaggtggaggttgcagtgagctgagatcatgccactgtactccagcctgggtgacagggagagactctgtctcaaaacaacaacaacaaaacaaaacaaaaccagctactattattacattatctttgtggctccatttctaagaacatccctggagcgcagatgaacctgaggtctggctaattgcctaccaatgcacccagcacagtgctttgctcatagtaggcatcctacaaaaaaaaaaatgtgtggaatatatgatgactatctcataaaacaaaagatgccctcggattcaaacacaggcagtctttgactaacggagcccatgttttccatgactcaacatatggcatccctggagattcagttgctgcagggcataatggagctggatacctctgtttaggtcaaggccgcaagatactctaatgacacacccaggcaagagctactagactgtggtggagatgcaaagaggtcaaataatttccccatgtgtacaaacatctggttagtatgaaaggtgggactagagtatctcttttgatctcaaatctggtcagttggtggtcactgcaatgcagtgtctaacttacaaattctatggctaaccttgccccaaagtctgactctagcacagttttggacaagcctcccccttttgacgtggaattgtgatagcagtgagatcgtcgagcagaaccaggacacaaaactggatttgaacacctcctaagaattgtcttcttactcatcaatagtgaaagaaaattggttctggcacctcgccaacctggcatgcagagcctggcttgtggccctgagaatgtacctgttggacaggccccacagtagaaagagccttgagtgttgaaacactgcacaagtgtggagcaaggcccgggctggaagctgcactcgtctctgtccagcgtgcaggcagggctgttgggtgaaaacatccacccagcatcacagacgcagctgtacttgggctggcaggatgacaacagcgtgaataaagacaatcatgaaaatcagcaagaaaagcctttgaacatttcatcaagcccctaactgtttatcctctaacgttcatttccataaggccaatccactggcttctctttttcttcccatatgattaagcatttagaccagaccatgcaaaaagggaaacatctttatttcagagtaaaagcaagctataatttctcccaaagatgccagggaaagagtaacaacaatcaagaactgtaagtcaatataattaaagtcaatcaactcagcctgctatgtttttagagggaaaaacacccatgtaggcacagaccttggaaaatcaattccgtttgtttttctttggaaagttcttcctcctacccacctcctcaacccttccatccccatcattggacgggaattattttccatcacatgggtagaaaaaatacaactaaaaataaagaattgaagttctcatgaagagccaagccagccaagactggacaaccttgagggtcaggagtcaaagtcatcaggacgcagggcatggagggtcgttctggggagtgggctcttagagtctgcagcagttccagagacccaggccgggaaaagtcagactccttgaaaccacatgttgccaacaagactggtccttttatattcctgtgttttgtcactgttaaaataaaacttacaaggccaagagaaggtcttatctcagagagagtcatgacgggataataaaaatggtcccatttcggccgggcacggtggctcatgcctgtaatcgcagcgctttgcggggctgaggcgggtggatcacctgaggtcaggagttcgagatcatcctggccaacatggcaaaaccccgtctctactaaaaataccaaaattagccaggcatgttggcatgctcctgtaatcccagctactcaggaggctgagtcacgagaattgcttgaacctgggaggtgaaggttgcagtgagctgagatcgtgccactgcactccagcctgggtgacagagtgaggctccatctcaaaaaaaaaaaaaaaaaaaaatcctattttacataatgacatcttaatctctgggtcctacttcctgcatagttcatctcccctcctcgcctatgtcctacttacagacaggaagtgacttcacctctgtaagctccaggtagtgcttgtatgcagtgggcataggaggaggaggagctactaaccatggctctctgcaaggaggcacatttggggaagggacccacctctccagcttgctctcgcattaaatcctcacagatgccatggacacagcgtgccacagaacccccttcacagtcgtcatatttggatgcacactggggtccgtacgtctcaggtgggcagtgacaactgttggttacacaagagcacaatgtcagggcacgcgctttggggccagtgcctgtctcttaatatcaatgagaaaaataattcaaattacaaatcaacgatgttaacttggaatcgtcagccagcaatgcaaatttactgactggagtctcgggagaaaatcactctgctgtgctccaagtggtggattgagtaaatacaatgttggtgaatcacaacttattatctggtaagcctagcactataaattcttgtgttatcaggtcatcaaacagcattttcaaaggtcagatgtgtataagccaaaggtaatggagttagttcaagaaggtaaagggagagatcagcaaatccattcatcatctgtccaattggacctgccatgaagcacaggcaacgtgggctacactgataactctgaatgctctctaggattatataaccccacacgcaatccagtgtccacacctcacagtctatgatcattattattatcttacaaagggcaatatgtcttctatccataaaaagcgtagttatataatataatacagtggcatttctttcatagccacacttgaatttccaacaaaatgtggtaattattacactatgcgtaagctagcagtgggtgctttgttactagaagatttaagtccaatgataatcaaataagcaatgttgttttaagcccttgtcattgttaaagctgctttagccttatctctgcagcttaatgggaacttctatgatctgagcatgggagctaggggaggaggagggtagaggagtcccagaagcctaagcctatccccacatgccagggcacatctgatggagaggtagggccaggcccagaggttgccgattgccggacttgagcagaattggcaagaaaagctctcatgggggaaatgactgttggtgccaggggtcagagacaaggaacagggcgtgcctgcgtggccaggcctccctcccatgccattctacaaaggaaaagagctattttaacaagacacagtgaggtacaaggagcttagtaatgttcatggatgacaatgtatgaacgacattgtgggaaattagcatttgactgtttgaaaggcatcaagaaccaacctccaggcacaggattcggcttgcctgtggtgggccccagaaccaattgctggggtggcagctttttggcagtttctaaggaagaggagagcaatgagtgtggccagaaatggagaataagaatgcagggagcaccatccatgcattcaagtcgggaggccagacttagcaaataaaaatacagcatgcccaaataaatgtgagtttccaataaatgaatattttttggtataaatatgttccatgcaatttacgacatcagtatatatttacataaaagctgattcattaatatatgacatttctgagcattccaaagttgcctttggaacggctcactaagataaagtcataggaaaataacaataaatgattaaaattaaagagaaattgaattatccatcccccccatagacatttatattccccgcatctctctctactttccttctcatattgttttctttcctctttgtcctcccatctttacatagaatatttgtatagagaatttaattagactcttgaggattatggaactttaaaacagttcatacacatatttgagcatttgatccaggagacttcattactaaaagtttactttgccacctgtcccaacacctcccaacaatgtttaagaatcttttttatttttgtttttgttttttttgagatggagtctcactctgtcacccaggctggactgcagtggcatgatctcagctcactgcaacctccgcctcccaggttcaagcaattctcctgcttcagcctcccgagtagctgggactacaggtgcgtgccaccacacccggctaattttttatttctttttttagtagagatgggttttcaccatgtggtgaaaccaattgattagttactgatttagcagaagtctcttttctagaggtagaggctggtctcgaactcttgacctcaggtgatctgcccacctcggcctcccaaagtcctgggattacaggcgtgagccaccgcaccctgctgaagaatctttaaaccaactgttactagctttctattttctatgtctgggagatctgagtgtttggaaacccctgggataagattgcctaggtttaaattttggtccttcctgttaactgtttacccagacaatgtactaactccctctgcctcaatttcttatgaaataatagtggtaatctctgtgaattatggtcatattgcagtctacaggcattcccctgtagcaagtgctaagaagattgtctttattttatcactaagtgcttaactattgcaaaatgacataagatttgagaggagattctggttcatggacctgcagttaaatcctttctctttatctctctcttccttcatccttgctattatcactgggagatgagtaggcattaatcctatactgttctctaaatagctacagagtatacttctttcacttaagtttagatgatgtgagaagatagagaaagggaggaagaaactcaagtaaaccataggattccttcctatgatcctcaaagacaagtattattaatcccattttacagactaacatttcccaaaaccacaaaatgaataattggcagaagataaatagacacttaggtctacccgactcctgcaccattgttcctgcatgttatattcttacattctgataagtagagttatatgaagatgctgcatttttatgcacctttttgttttgttttgtttcgttttgttttgagacagggtcttgtgcccaggcggagtgcagtggtgcgatctcggctcactgcaacatctgcctcccaggttcaagcgatcttcccacctctgcctctcaagtagctgggactacagatgcgtgccagcacgtaagctaagtattgcattttttggtagagacagggtttcaccatgttagcaaggctggtctcgaactcctgacatcaggtgatccacccacctcggcctcccaaaatgctgggattacaggtgtgagccaccgtgcccagcctcatgtaccttttaaacataacagggttaacaggcaaaatatattttcaaggtgtcttgatatggcctttaaaaatgaacaattacttatatacctccctaagtgaaaataaaagccatatattgtatttttaaaaccaacttactactattcctgctttagttattagttactgatatagcagaagtgtcttttctatgaccttttattgccaacttggttccagcagaacaaatctaggcttttctttgaaaacactgcaagtgcattttggcaattgagaagaggttaaacacacttggatagtcatagtttaacttgtgttagagtccatggttcaatactaattttactgactgagtgaaaaaggtaataagtttaatacctaactaccacctgagctaaaactagattatcctcattgtttaaactctgcatgatgtaaaatctaccagtgatatgaatggaaataagtgaaataaaatttactaatcatcatgtttctggaaaaccagagaaactcaactttttgtttttctggaaagccttctagatctgagccctaaatgtacaacacacaccatccatgcatggcaagctcagatcccaagggctgtcttaaatccaaagtaagcaggggaggctgggcacggtggctcacgcctgtaatcccagcactttgggtggctgaagcgggcagatcacctgaggtcaggagtttgagaccagcctggccaacatggtgaaaccccatctctactaaaaatacaaaaattagccgggtatggtgtcaggtgcctgtaatcccagctactcgggaggctgaggtaggagaattgcttgtacccaggatgcagaggttgcagcaattgcactccagcctgggtgacaagagcaagactctgtctcaaaaacaaacaaacaaaaacaaacaaaacaaaacaaagtgagcagggaaacaacaagaatcacgtcttcagaacaaagagggagtaacagcatggagaagtggcgaaatgtaattgtgttagttgtctgaagctctgggtctagacctcaagccaaaagaatcagtggaaacagaaaatgatgtttcttgtgctataatcattgttctaaaaaagaatttccaccagaagtttacctatgaaacaggtatgaaacaggactttccatgaatgagtatctgcaccttttcagaggtctttacaatggcaaattattaatccagttaaagactcctttttccgtccaagtaaaagagctcaaagagttaaagaaactgaatgaggtccaaactccaaagcgaactttgatgccatgactacatttttgcaggtccagatgattctgaggctcaagttttcttttagctaatgtgtgctgaaatttcccaaagggttttctagcctcagtgaataccctgattaacaaggatttaacctcacataattaacagaactcaagaaagtatctaaatgttcacttgtttcattacacgtggattccacaaagcaataatttaatcttatgctcatgcaccttttttcattttcttttattccctcaaaaagtctctaacatatgcctgaattacgggacttaaagtgtagataatgaaatggaattcatgaggtttcagaaactattcccatatcaagagaaagaaccctgatttaaatgctctgttctctaatgtcctccagcaaatctatgaagggcagagtctaggaatcaagatcatttccaaagccatccacacatcatcagttcttctgtattcttgctctcctttataaaagagtgcaagagagaatttcgtactgttcttacaaagttgaatctgtcatttagaaatgcagctttcaacaaataaatggttcctttcctcctagctctcattctgtcatatgtgtgtgtggataaagaactctaacctctgacatgctgcagagtggtaaatagtaaaagggtttttgttttgtttttcattttgcagggggaagaaataacgtgctgaaaacagcaacagcctttatcttggtctatggatctcatcacagtttgcccatacttgtcgctctattggcccacaagactccaaaagacagtgatgataaaggaagactaggagtgaaatctaatctctgtaacattcctagatatcaggaaggtcagaaagcagaagttctaggagcctggacatttgccaccaatgcctctatgtagcaatcctccttgataaatgcccataaacagaaatcaggagataatgggttcacggaaatgagagactagactgcattttgcttccagcccaagcctaacaaaggcagggaaaaaaggcttcatttaaatgagaaacagagtcctggaatcaaaaagctctttaataacataacactaaatttaagtcagaagtggttaattttacttttgcataatgattgaactcatagacatatctagtagaagtttgaataatttgagtttataacctggaatgagtaaaagttttaaagatcagatcaaaaaaacaaaagtatcaaataaaaagagaaggtttgtgactgcatttttagaagtgtgcattaatagtgatggtttaacatggaatactatgcagccataaaaaaatgatgagttcatgtcctttgtagggacatggatgaagctggaaaccatcattctcagcaaactatcacaaggacaaaaaaccaaacaccgcatgttctcactcataggtgggaactgaacaatgagaacacatggacacaggaaggggaacatcacacaccggggactgttgtggggtggggggagggtggagggatagcattaggagatatacctaatgctaaatgacgagttaatggatgcagcacaccaacatggcacatgtatacataagtaacaaacctgaacattgtgcacatgtaccctaaaacttaaagtataataataataaaatttaaaaaaaatagtgatggtttaaaaaacaaaattactgcactcatttttgctggaaagactagaatggatattgttatgtggaaattgaagaacaagatagcagagacaccagtaagagagcaaataattgctcttcaatccagtgagattctactccagagcattgaaaggatttgttcattctatagcagaatttatttattaatcttttaaaaatcacaaaataaaagagaccagccaaactataaggaaagacactgtctagtttaaaaggtgacttcaaagaactgtacaaaagtaagtttggcattgatctgccttaattttttggacttcgtttttagaaagacaatgtgtgtggcatcagcaaagctttgacgatggatatccctagagcatgatgggaacatagaggccctgagatgcctcactctgcttaaaaagggaagggaaagtttcctgcagaaagtgatgcctgagctgagcaggagaattctgtggacaagtcacttgacagaataagtcagaagagaagatagagctgtactgataatgatgactgtggtcagagagagttacttcattcattgaacctcagtttaatctttgacctcgttatggtcacattttgacatagcattgaataaagctctctttacccaaaactatgagcttgctaatacatggaaagagtacagctggggacactggtgtggtggggtgtccccttttctacttaaggccattcagtggctccccttcaatgctccggctcttcctaagtcttcagctccttttgcaccaggccatgcttactctctgtgccaatcacgggagccttcttccggttccttggggatgttagagcaaggatttcttcacggggtgagagtaaaggactcatgagcttttcttcagttaagtaaaaatagctatgtagacgttaagcaagagctaaatatttcctcatggagtaccaacttttggtggaatacagatagttaatttaggatgctcttaactatgggatgttttaggccttcaaaaatatactgatatttaccaaaaaaaaaaaaaaaagttacctgtaacttcccattgtattaacacatgtgcctccattctggcagctcaagggtgttcctgagtaaatctcacattcgttaacatcagctgagcagagaggaccctgtgatcatataaggaacaaagtcaggtgccaaaggtcacagaggtatctggagcgaacattcacatgatacgtttaaggatttatacgtggacagtatataagtcctcataaagtcaaatacaataatactgatattaacccctggctattcttcctctggaactcagatttcacctaatagaacacaagagctcttcataagatcacagcagtcacaggagaggaatccttatctaaacataatagaatcctcagttcacagtggtgctacatctgggaatacttacttaacttttttttttatgtgcatgctggagacagtttccatcgttatcagaaaaaataaacaaacaaagaaaatgagaaaatttgcataggtatgtcaagatttgtttggtactttccaatgctgaacaatttaaattaatgttaacagaaatattgtgttcttccaggcagttatccaatcaagtgaacctctcctttcaatggctttagtatttggtgggttatacaatcatactcaccactgtttgggttttagcatacctggtatatttcaatttgatttgggaggccacagaatcctagaaactttagatggagaattaaatatgcctgatgattccaaggaaaccacagatgctgacctgccatcattcttaaccaaagagtagatgactcaccttccactgtgggggacagatacaaaaaaaggaatcatgcagattgaggcaggttccaccattctggcaaggattgctgctgcaaacctttttgtcaacagtctgaaacaaaaacaggacagtcaatgagatgacttgcagtcagcagcaacaaaacgcatgttaccgtgcacgtgggattacatttaactcttaatcagtgggggtctccttctacactttaaagccattacttatgttcttcttcaaatcacctctcttgtgaaaaaacagaaagcattttctattatcaatcttgttcctattccttaactctcagcatgcttttgaccacgggtgggatgaagtctgaggggagaagattctcactttgtcttggaaaagtattattctcacctgagaaagagacctcagtggacaggagtaaaggtttcaggtgtggaaataataatggatgttgctattgcacaaagaaaataaaatggagattccggttattttaccggtgattcttatctttggtccctcgaggtgagcctttgaaatataatcatctgctgctgctgcccctcctcccatgggttaaggtgactgaactcctgctccaagtccctttgttagaaatgtggccagctaagacatatctttcaccctggtgctcacctgactgctttcagcccagatcacaaacagacctacctttgtctacatctacatctacataacctggggaatctgaccctatgtcagctaccagtttgaatcttgttaagatttttactgcctttgggtgcagagaaaacttcttttttttcttttttcttttttcttttctttttgatttttttttcttttttttgagacggagtcttgctctgtcgcccaggctggagtgcagtggcgcgatctccgctcactgcaggcgctgcctcctgggtccatgccattctcctgcctcagcctcctaagtagctgggactacaggcgcccgccaccacgcccagctaattttttgtatttttagtagagacggggtttcaccgtgttagccaggatggtctcgatctcctgacctcgtgatccgcccgcctcagcctcctaaagtgctgggattacaggtgtgagccaccgcgcccagccagagaaaacttctttagagggaacacttgattatgcaatgatggccactttatgaatttcactcatagtccaattgtctgggttttggttggtatcgttgttttgtttgtttgtttgtttttgagatggagcctcggtctgtcacccaggctggagtgcagtggtatgatctcagctcactgcaacctccacctcttgggttgaagcgattctcatgcctcagcctcctcagtagctgggactacaggaatgtcccactacgcctggctaattttcctatttttagtagagacagggttccaccatgttgaccaggctgatctcaaactcccgacctcacatgatccacctgcctcggcctcctaaagtgctgggattacaggcgtgagccaccgtacccaacctaattctctgcttttaaaaagttaaaataggggcaaactgttgattacatttcatatatatgtatgcacacacatacatatatattatatatgtgtctatatatatgcacatacatacacacacacatacaaatacaacatactatatacagtgactcataaaaaaaaattacgtctgtttccttcattttatggatgaaatagaaagccagaggatagccaactgactcaataccattttctgcaaagcacattccttctccactttggtcataaattagatgaccacacgtctgggggtctctttatgaaccctgttttattccattattctatttttctctttgtgctagcacaacaattggctctgtccatcatagaatgctctttaaaacattaaccacaaactcattcaaaggttttctgtcagacaaaagcaacactgtctggggactaaaatcttaaaagcctacaggggcctagtagaaaatgaaatcaggagtcaggaggaagacaatagggagtggtggggactgtggtggccagagagcatttgccctatccaaaggcacaaagcattcacatttgaaaatcattcaacattcctcctgagggatgagggtaggaggactggctgagcgaatataatgaagccctccaggagacaaaacttgagtgcagtgtcacggtccacagcactattctttactcattttctttcgcttaactactctcttaaaaatgacagctgaggggtcaatgtattatctaagtggagaaaaggaatacacgaacttgatcatcaaatgacaaaaaggtttgcagcagcaatccttgccagaatggtgggacctgcctcaatctgcatgagtccttttttttgtatctgtccttcacagtgggacagatcaaacttaaaagtagaggaaaatgcttgaagcatgagcaaaacagatgaagaatatttttgcagaaattcttacactggaatccccagatttttatgcaaaattttaaacatgaagagattctgtacatttctctgcatagaaggttacagcttccatgaaagtctttaaaaggtcagcttcctacaaaaggggtaagaagcctaagtttacatagatcagtctacaagcatgtagtacagttatacaatgttttctgtaagaaactgttcaagtttaattaccagcaaatgtcattttaagaaaattcggactattttgtgatacacctagacttccgagcttagcgtcagagaggatgcttgctttccgagccccagtccctgatgggagaatcagcaagttgggagatcactagctgaccaagcacagcacacacagctaaagggtgatggtaaaggatgtgggctgtgggctgcaaactcagggtcagaagccctaacaggctcggagacctcagccttgtcatttcatctgtcttagactcagctctgcatctgcatcctgggaagcacatgctgggatgagaattaaattatgggaaaaagcaagtttttaatattaatcatccattcaccttcaaaataagaatagcagctctattaatgattctagtatgttttctgtgaaagatttgggtatgtagtagcatgagacctacctgctgcaagccttggaattttctctcaagatccaccagctggcaatagggaagaaaaagcttcagttagctggttcaaaggcattgcacatgtgatgttatatccttgacatattgtcctaatgccctctgctagggacacactttgttcattcctccttttattccctttttcctcttcattcctctcccctcaggattttcttccttcctattccctcctatcacatagatttctggggtttttttaagtttttttttaaagtacaacccactgataagttgaccgattgcttctctgtaggcagtgactatggaaatgttcataaatgtcagtgatgcatccacttccccaataagaagattgctctcagaacttcagcaaggcttcttttctttctttcttcctttctttctttctctctctctctttctttcactctgtctttctttctctctctctctctgtctctctctctctttctgtctctctctctctctttctttttttttttttttttttctggcaaggtcccactctgttgcctgggctggagcacagtggcatgatcatagctcactgcagtctcaacctccctggctcaagccatcctcccacttcagcctcccaagtagctgtgagtacaggctcatgccaccatgcccagctatttttttttttttttttttttttggtagagacggagtctcactatgtggcccaggctggtctcaaactcctaggctcaagcgaccctccctctgtggcctcccaaactgctgggattacaggcagttttttatattaatcatccattcacttgcagtgagccactgctcccagcccaaggcctacttctgcaacaagtgcttgcacagcatttcctgccttctgtccatcacttctacagcctccattacagctgtgtcatttaaccaaacagtgagtagttacatgctaaatctctaaagagcacacaaagttggtatatcccctacaaaacggttacttatacaatagaactagggagaactcatcggttcttatgacgtagatgtcagacttaccttggaattaagctgatagatttgactagatatattttgaggcagaccaattgcactcccttttaactctataatatcttctttgtttttctggatctaattttagaaaaagaagaagaaatgaagagcactagtgaaaatatcatatttatctttacagtaacataattaaaaacttgagtagtattctactttaagcactaagatcttgcctattattataaaaaccaaaacaacaccatgcgtaataaacactgggctaaaatagccacagcataattccacttatccttttcagtaacaatagatcaaggtattttccatttgtatgttttcctataataccagtttagggtgcttattaagaaacctggcttggaagcagactgtttaggttttaagtcctggctcagctatttattgctgtcctgggcaagttacctaactgcttcagggtttctttacctcttgtaaaactagggtgacaataaaggccacctcataggacagctgtgaaggtcaaatgagataacatccatacggtgctaagcacagtggatggcccacagtaagctctgaataatgctgacttctaacattatgactgaaatatgcagtgattattgggaaatgaaaacacccagtaaggcaggagaataactggccaattctgttctgtggcaaaagcaaactggtcacatgtccacatatccttggtcccctacttcctcgcatcccctgtggaggagtttcagttccaccctccgtgccttctctggactagggtgcattgtctggcacaatgagcttctatcttttagcatactccctctacccactattaaccccaggccatcgtcctttacaagaacatgtctgatgcccaattatgttctctatgctaaagattcaaggtacactaggaagggggagggaggctgaagacaggttgattaatgaatacaatatatagttagatagaagaaataagacctagtgtttgatagaccagtagggtgactatagttaacattaatctattgtacatttcaaaataactagaagagaacaattcatatgttcttagcatgaagaaaaggtaaatatttaaggtgatggatatcccaattaccctgatttgaactttacacattataggaatgtatcaaattatgtattaataaaaaataataattaaaaaagattcaaggtacagattaatctagacttgttcaattaagtcaccgtatatggatatacaaaatgacttcaatatatttccagtgtattacctgatgtaaacactcactgagatcttcatcatttaatttaatttttcccagggatccggttctaaactcaatgttttgagcagaccccgtaagaaacaccaaatttcctctctctgtagccattcgaggcctatataattcaaacgagagaatgcatcagtaattagcaagtacaatttttaaaccaaaataacaaagtttcttactgaataactacaggccaaatacatcttcactttttgatcatctcaacccaactgcccctgctcatctgccacttttttctctgcacatttctcagagatacctcctggcaattgcaaacagattatttgcaaaatgacagataataatttgtgcataggaaagtaatttcatacctcagtctaaatgtttttccctgtttgcttctcaacataattttcctcaagaaaaattgcacctttgtttatctggctatttgggaaaactggtgaggaattagcctagtccctgagcaggaatgacccatgtgtttacttactgttggagattgatgcttcttttttgtctctgcagctcaagttctccagcttcgccatttacttcagcaaatattaataaggtaagcaaactccaaagaaaaggtaaagacatgttcatcatcaacctcccaggttggcaggtaagagtgaggccactccaaccaactgagcatgggattttggagaacagcaaaccaggcaggtgtactttgaaccatggaatatcctgtaactgttgagttttttcttctttgccctagaaggctatgttattttttcttccagagggatgtaaatgatcttagatcttcagtactcttcaacttgtgagaggtcaaaatctaccttaagtgatgcgcaacttaatcattatctatttgacctttgaaacagtaacaagcagctttgaaaacatccacttaaacaatctttgcttaagaagtaactaggtttcaacaaaagtaaactggtcattatctacacctttctctgttcccctccttcctcacctcccttgcagaggagttccacctttacccagcgctaggaaaactagatatccacatgcaaaagaagttggaggcttacctcataccatatgcaaaaattaactcaaaaaagttcaaagatctaaatctaagagctaaaactataaaattaactcacaatggttcaaaaaatctgaaactataacataaaactcagaagaataggacaaaaattcatgaccttggattttggatttggcaatgatttcttgagtatgataccaaaagcatgggcaaaaaaagaaaaacacacagacaaccaaaagatataaattggaatacatcaaaattaaaaacgtttgtgcatcaaaaaatacatcaacagagtgaaaaagcaactcccagaatggaagaaaatatttgcaaatcatatatatatgaaaatgggttaatatccagaatgtacaaagaatttgtactttttactttttatcatccctgtgggacctatggacggctgtggaatccattcccactttccacactgcgctatacacccttccagctggatatatggtttgaggacatggagcactgatgtccccactcactctgtgctgggactacagaaaccactgagagtgatgaaaatattctacatttcgattgtaaaatcaactattgatgcactcagactttccatgagcacacagacaaaactgaatttgagggagagctgtaaaaatttcacttctaagaaaaatctctaggtaattaccattgcattggttaatacccatgcaggctctttcaggacaagcctgtttgtgttttacttattttgtgtcttacttatgtaggctctttgaggagaggatcattatgtaccatagcttataattctttacttatgccgggcgcggtggctcacgcctgtaatcccagcactttgggaggccgaggcgggcggatcacgaggtcaggagatcgagaacatcctggctaacgtggtgaaaccccgtctctactacaaatacaaaaaattagccgggcttagtggcgggcgcctgtagtcccagctactcgggaggctgaggcaggagaatggcgtgaacccgggaggcggagcttgcagtgagctgagatcatgccactgcactccagcctgggggacagagcgagatgccgtctcaaaaacaaaacaaaacaaaaaaaaactttacttgtgatactcaaatagtcactgcttttaaaaattttttttaaaccttcccaatttcttctatatgtctcttgtatctgcttctttcactcaacataatgcttttgtaattcatctgtgctgtagtgtatatcattaattggttcccttttattattgagtagtatttcatcatatggctatcccacagtttgcttctctactcatcagttgataaacacttgagttatttccagtttgggactattataaataaagctgttatgaacatttgtgaacaggtctttgtgtcaacataggtatctcattacaattttaatttatatttccctaatgaccaaagatgttgggcatctttttatgtatatttgccatttgtttatcttcttcggtgaactgtctgtttagatattttgcctattttttaaaattttgttgtttgtcttttattgattgtaagagctcatatattctagatacaagaattttcaaatacgtattttgcaaatatttttctgccaacctgtggcaagtcattttgcttgcttaaaaatatttttcaaggacaacaataagacacaaaagactacttcctaagtgattctatatcacatgattccatatgaaaatctaaaaaagccaaaactacactgattgatagacaacaaatcagaggccaggggttggggaggagattgatcgcaaggaggcatgagggaatatttaagggtgatgaaaatgttctgtatcatgattgtgattgtggttgcatgactgtataaatttgtcaaaactcataaagctgtatagttaaaatagataatctttggcagatgtaaattacagcacaataaaactgattaaaattatttctcttctatatttgtaaatgtcttcatatatcaggatgatacaaaatattaatttggtattaaactaaatgctaagaaaagatatccaatagcctttacatcaatagagatgaaatttatcataataaatttgtttatttgaaagcttaacaacttggcatggggtggagggaaagtttgacaatatgaaatttttggcaagtttagaataggataaaatagtctgggctagaatcttccaatcaaaaggataattcaaactctctgagctctggacgtaactattttcatgattatactttcttaaagaccactgaactcagctaatctttccagtgcaatagaaaaggcctccagcatgatcttaataaggacttcctctttgacaggattttcctgttttgttaattaatgtgtttattactcaacaaagtaaagataatctctcagctcccaatctaagcattcaattgctcattgtcacccatgttagaaaaaaaaaagaaagtaaccgtcgttcaaggtctgactgacttttagtgatgagttagggaattttacatccagctcattcactcaactctagctcagatcaataggcaagtcagactgtctgcatatgttgactctgtgaaaagcaatataaaaatcaattgctgtttccaagggattggcactcattctgtttacttactctattcagaaatacttcaggaaagatgaattaaagtagttttagaatctatgaccttcagatctatatggtagataacctctcttcttctcctctcccaaggtaaacattctatagacctgaaattctatctttcattgactagtaaaactcctgtctcttccctaatctagaatgcattcccctaatattctgcatgtgccctttacatattagccatctataagatgataggaacacgaaatgtagtaaattgcagattcttccctctgaagcctccagtctagggaagaccacatggttgaaggttaagaacacgggcctgaagctcatttatgtgcgttcaaagtctgactccatcacttactgaccatggaaccttgttttttcatcagcagacagataataacagcactgaagttatgtaaaatgtttagcacattaggttactggcacaaaataagtgttcattaaatataagctgttatcaatatcatgtaaagaaatataataatcctcaccctcctgtatcctctcttgggtttagattccttaaaagaaaaaatgacaaaaagaattcacagctgtctttataatcttgggtacaaggagaagcaagggtgtctgatcatttctcctataaaagaggatttcagagcagagagatgaattggggactttgagtgaggaagacgattgctgacctggagttaaaggtgtgaggcaaaggtaactgatgtctaagaacaaggcaaggtgactccaggaagcacagaacaactccacattggtgggtggagagcaagattccatttaaatccaagagttttgaagagcaggcaatccaaaagaaacggtatcatccttgagtggaactgagtaaccagggtgaggaagcttttatatggggtgctagcaatggagccctcggacagggaggatctgctctgggggctgctcagtgtttggaggagggcacctagttggagagtttacctaaggaacccttatgcacatttgtacgcattcattaaaataaaacccttagggcccggcgcggtggctcaaacctgtaatcccagcactttgggaggccgaggcgggtggatcacgaggtcaggagatggagaccatcctggctaacacggtgaaaccccgtctgtactaaaaatacaaaaaatcagctgggcgtggtggtgggcgcctgtagtaccagctactcaggaggctgaggcaggagaatggcttgaacccgggaagcggagcttgcagtgagctgagatcatgccactgccctccagcctgggtgacagagtgagactctgtctcaaaaaataaaaataaaataaaataataaaaaataaataaaacccttaggtcagaacactgataacattaatggcatgttgtagactttaagtttataatggtgtctgctgtactgttgatttccactcatcagcctttactctctttgacttcttcagcaagacacatgcaaatgtattttgcattgttgctgataccatacatggtacatggaatgagggtggtatccaaatgttcagtgtactgctcatccataattcatgacctgctgacttctgctccggtcctgtcgcatggtctcacctttctctttcttcctcatcctggctccacagcctttctcactgaagtcttagctcccttctctccctccctccctccttccaaaaccacctgaaggtggttgtaagaatcagaatgaactactcctttctcctgttttttatgtttttcaagatatctctgtgcaaccttttctccttctgtgacattcacttctcctccctttatattctgaatgctcagttctttgctcctcctttaaataattcccacagacttcacaaataaaaattcctgtggtcatcaaaaacatacatgaaagttaatcccagtatactagaatttcatatgaggggaatttaaggttaagaaggggtcatggtaatcagaatatggctaaggacaaaaacagaggttgggggagggggagggagagagagagagagagagagagagagagacctttattggagaacaatggaggagagaattaactctgcctggaaggggaatgcaggcttcccaggagtccatctgagtagttcccaggtagaatagtagagtgaggagtttcaggcagagtaatggtgtatacaaagcttttcagtagaaagtagctcagcagggctacagcagtgtctatatgtgggagatgaagttttaaaaatgaacaggaagccaaatcaagaaggactttgaaatatcattttaatgagcttagattttatttacttttaatactgcagaattatgagagtctcttagggaagagattaacatggtcatgtttgcattttacaagcaaccctgtggagccatgtctgagacccagagttggtaaggaggttagagtacatgtttccccccgcagatggagtctcactctgtcacccaggctggagtgcagtggcgtgatctcggcttactgcaacctctgcctcctgggttcaggcaattctcctgcctccacctcctgagtagctgggattgcaggcacacaccaccacacccggctaatttttgtattattattagagacggggtttcaccatgttggccagggtggtttcgaactcctgacctcatgatcggcccgcctagagtacacttaaagagatgtgacctggggagccttaaggcaatggacagtcagatgaggagacagtgagaaagatattcagaaaacaggctacagaaatacttgggtagttaatatttcattagaactattagagggggaagttggccgggtgcagtggctcatgtctgtaatcctgacactttgggaggccgaggcaggcagatcacttgaggtcgggagttcaagatcagcctggccaacatggtgaaaccctgtctctactaaaaatacaaaaattagctaggcgtggtggcgggcacctgtagtcccagctactcaggaggctgaggcaggagaatcacttgaacctgggaggcggaagctgcagtgaaccatgattgcactatgcactactgcactccagcctgggcaacagagggagactctgtctcaaaaaaaaaaaaaaaaaaaaaagaacagaggtttcttgcttggaaaattggaattggaaggaaagagatgtcattaattgagtaagagaataatcaggggaagaagattttggaggaaagatagttcagatttggatacatagagctctaaggaatatcaaccactctgctgcttcacaggcctcactctctgcaagtggtttaaccatctaagatgggagtggggaagatgtagagatggcgtagactagaaccttgctactccaagtgtggtccacagacccagcacaggcgtcactcaggagcgtgtcagaaatgcaaaatctcaggtgctactgccaacctgctgaattagaatcttcattttacaaagatcctcctccctgccaattatctgtacactcattaaagtgacctaggagcacaaagacaccttcactcatgacgagagtcaagtggtccctgccattgcgtctgcatttccatttctacatttttcttagattgattctccaatttttaaataattttctattttccacctctttgtcttgttttgttatactttctgagaaagtatttatcttttaattttctagtaatttgttttaaaatgttgctatcattttaaatttgaaaaccccttttttgatttttgctcttgtttcgtagttgtaacatcatctagtaatttttagatagttgctttttgatgttttcttgtttcctgtatgggctctgttttctctaagttgtttttctcccatttgtttgctggtttaggtctttctaattcatgctagaggctttcctcaaatacctatggatccttatatgttcattgacatttaaaaataacacattacagaatggatggtaggctctgtgtgcatgggtggcgattataactggtaggctttgccacagagcaaccgaatggcaaactgacaatttcactggggaaccccaaatgcccatctttgaaggcatcttgccctggagacgttcagaaaaaaattctccagtcttctacctggactagtagaggtgactggagattttatactaagtgtacagactttacttaccctcttattttctgtatttttctccaaattcttgaagagcatctcattgccacattagtatatttcactgctgttttttataccaatgttcactttttattcctaccagctttatctaaattccattgttttagaggcttaataagcatttagtgaagacatacgaagtccttgaccatgggggaaatttgaaagaagtaaatttattgaccttctctgatttacaataaagtcgtaatgtacaaatctggagagccagagttaggcaacattacaaagacaagtgtgacaagatggcacagatacacagtagcatgctgttaagtaaacagcaggtaccaaactaggaaagatgtccaaggcccagtatgggcacactatagaaagtggttccactggccgggctcagtgcctcgtacctgtaatcccagcactttgggaggccaaggcgggctgatcatttgaggtcaggaatttgagaccagccaaaatggtgaaaccctgtctctactaaaaatacaaaaaaattagccgggcatggtggcacacacctgtagtcccagctactcaggaggcgaggctgaggcaggagaatcgcttgaacccaggaggtggaggttgcagcaagccgagagccactgcactccagcctgggtgacagagcgaaactctgccaaaaaaaaaagaaaaaaaaaaaaaggttgttccacttgtccagcagggtgaccttgaaggaaagtggctgggtaaaggaagagacatcgacagaaggccttaagtggcaggttaaagaatgttgatttaatctttttaatagggggatgttcttttatcttgagtgcaataatccttatgtgatatttctgctaggccagctgaatttatctggaggactggatcaatgtgggagtcataaaaatgaggagagggttgagatgcagaggtgcgttggaggatggacaaattggcaagattctcacacccctaatgctagctcccattacatgttatagcttcaatctggcttttgtgctttttttagtcccttttcattttcatatcagtttaaaacagaacactgtagaattaatctggtttttagtcattaatggaaacatttgtgaatataacgatcttttaaccttcatgacacttaattcattctctttttcagggacgtaacattgcttaaaagatacatttacatatgtcagttttgtgattttctgcaaaatttcagggcaatataacattgttccaattctttcattttccatgaaggattacataaaataatgatggaaatcaaggtacatttaaaactattcttttgctcatttcatgggaagtgcattaccatgtaggaaattaccaagtctactactgtgatgaactgatctttttgaaagcagtgtggtcttggctcaaggcacataaagcagacatttgttctccatgctcattattacaatgactacaattatctttgagtagaatgaaaaagaattatgagttaatcattaacatttaaattgctgaggtttggcagagcttttcctgagaaagcagattgttgagagtttggagaacttttccacttttttcaagtttttttttttaagtaatataatcccttcataaacaatgagaaaaaaataacgaaattcaaatccagagggacaaacgcaataggggaatagggctttggaggaggagcacaggggtgttcgtggcacatgtatacacacgtgtgcacacacagcttcctaattgtaactcaagcaaatgttacagaaaacataaaatatgcactggagggtctcgcatcattataaggatcagccatagcagaggagatactaattgctaggattaaaggctccaaaagctagtaaaaaaatcaacagagctttctctacctccaacagctcccggaatggggacttcagcagctccattggattaatccaagcttggtttccaaggtgtgaagcaatgaagcggagtttaccataggtgaaccctcctgccatcctgttccaaatcaacctaaaaaggacaaaatgagttttctacttggtgacccctaaaattccccaaacaaggcggtgaagttaaatatttagacaccattcatacgataatcaaaggaaaatgtctgattgcactcagacttcagcatgaatgacagaagaaatgtaggtggtaaataactgcaaacaacttatattggatctgatcttaggaaaaggggaaagtacatctttgtgatgatattttgtgttctattaggggaggagagcaagagaggtgaggatgtcaccaccgatggggggaagaaaaaaacagtttggttctcttctgggaaggaaaatgaaaaaaaagaaaaagaaaacaaagtttggggatacctggcactcttcagactctgcctcttgtacctttaattgggaagatagacgcagaagcagtacacacaggcatctttatcttgtgagaggaagctttgcattacggatgtgatttacggttagaggagtgatttaacaaggctgatgccttacaaaggggcatcattcccaggggatttgttaattgaagtgccacatagatctgtgggaagatttaaggtgttgtca

SEQ ID NO: 1062 - DNA, 36543 bp, Homo sapiens
gcaatgctaaagaggaggctttcccctttcctctccttctagacgataaacagatttcctgggcaggaggaggcagggggtgggcagggcagctacgaatgtatagactcaggtgtcacagagagcgaggcccttctctgcctcttgggcaaagccctgcagttgctgcagcacccatgatcatctgtaggatccagcggcaacaggcctgtgctctgctccctgggcagagtcctgggaaggagcagaccccagagagagaagaggtctaggcagatggccataaccagcgttttggagaggcccacgatgtggtgtggcatgggtgcagcagagtgactccggcctgcagcgtggcatgggaaagtgggcacagtagttggacctgagggccaagccagacaggaagaggggccagaccacctatgtggctcgatggctgtggtataggtgggaaggtggatgtctggtgaacacctgcgtggcagcaggggattcagggaagggtagttaccagcttattgcagggagctgcaaggagcagaaaacccaatagaaggtggtatgaacaagtgggaggctttgtgactcttgtgctaggaagtcctgcatgggcagcccaaagtggttgcagcaccatgacactgtctcctggcacccaggcacttgaggcgtgttttctttaccatttgctatggtttgaatgcgtctactccaaaatccaggtgttgtcaatgtgatggtattaagaggcgggggtctttaagaggtaattatgccatgagggctcctcctttgtaaatgggattaagtctcttatgaggcttcatgcagcgtttggctagcttggtggcttgtctttctgtcatctgccatgtgaggacatggtaagaaggccctcatcagaccaaatgctcatgccttgtcttggaattctcagcctccagaactgtgagaaataaatttttgttctttttatttatttttttattttattattattagtattattattattttgagacagagtctcgctctgtcgcccaggctggagtgcagtggcacaatctcggctcactgcaagcttcgcctcccgggttcatgccattctcctgcctcaacctcccaagtagctgggactacaggtgcccaccaccacgcccggctaattttttgtatttttagtagagacggggtttcactgtgttagccaggatggtctcgatctcctgaccttgtgatccgcctgcctcagcctcccaaagtgttgggattataggcatgagccacagcgccctgccaaatttttgttctttttaaatatcccactctatggtattctgttatagcagcacaaatggtctaagaaactattcttttattaggaaaaaaatagcaaattgtggttttagatttaagagataaatttaattcatgcaaatgattcatcctataaagatgagtcataaataccaaagaagtgcatccttttttagacatgtttaaatatagtccacaaataccagtgcactgctaactatagctactcctacaacttcaagttatctcctactcagccaaatgtcaaaattttaccagtgaaaacttaatcactatttttcttgctgcattaatttcaccccaacaagcctttagtactttagtaatattttgtgccatctgaatagcagcagctgaatttacccagcacatgccactaaagccagaagccatgtattttgaagggcccactcaggttcatcacagagcagaatgacacctcttgcctcctcaactctgcatccttcatattctgcttctgtgcaaaactgtgttgacgaaaaagtacatataactttaggtcctgcttcagccccaagataggtttaaatctgcgtatgctgcttaggcattcctggggatacctgtgtgcatgaggcctcaggctacaaatcttcatctcattcttctcctgaagagggaagagaagtgaggagtccatgggaaggtttctagacactagagttaaggccaccatgctgtttcatgcacaaaagatgggagacaaaggctggaggagcatgagctcacctcaaggtgaaagacaggccagggacattgggttgcaggctatagaagggttacacatggggcaaggaaagcttcctgtaaaatcaccaacagcaaagctgacattgtggtgtatcaggaaagaatgcaaatgagctggtccactcgactgtggtagagggagcagtagggcctcggggagggccccttaactttggggaagctagctgtgtcctttggggcaacaaacagaagaaaagggaagtgagcctattcaaatcctctgctgtgggcaatacactgtgctagatgctttcactgcaatctctcattttctcctcaaccctgaatatagacattgccaccccgtttttctgagtaataaggcctgaggcagttaagtaatttccaaagaccaacactctcagagcgtggatgtctaaccttcaagttcaggctcatcagcttcagagacagggtctgaggaggggccaggacagaaccttgtaggcaagaacgtggcaaaatggcctcagggccctgttggtctcactgaagatggtacagttggggagtctggactccacagatggcacctgtaatacttggaggaagagagtagtctggggcaggtgttccctcagcctgggagtggccaaaagtgaccaggctaaaggttgataacctgggctccttacttctctcaaggttgctctgacactgtatttaggatttacacatggttttttcaattcttttttgccagtaaatatacaggagatttcaaagatactctcaactcttaattgctgcaattacaccatccctagactgagcattaaaaaaaaatgcttcctggtataaggttttggtactgtcttagcagttcatgccaccacaggtaaaatacctggatgcccttacgaagtagccaaatggagtgtgatcagtactccaaggagttggcatgggcatcaattgcgtattattttctccagcctatatctatctgcctgtacttggagtactgatgaattaatgcagtgttggctctgctgcctctgatcagtttacattaacgaccatgataaatatgttgtaaataaaagtcattttcttgactttcaggtttaaatggcatctggctaacagcccctgggcagccctttccaatattttattaaaatgctaattaatacataggaaaagatgaaaatgctcaataatgccgcagactaagactgaaaccacgttgtgagaataggggaggaaactgcattctacaggctagagcttttttttttttttgagatggagtctcgctctgtcacccaggttggagtacagtggcgcaatcttggctctgcaacctccgcctcccgggttcacgccattctgctgcctcagcctcccgagtagctgggactacaggtgcctgccaccatgcccggctgattttttgtatttttagtagagacagggtttcaccgtgttagccgggatggtctcaatctcctgacctcgtgatccacctggctcggcctcccaaagtgctgagattacaggcttgagccactgcgcccggcctgtagagctattttaaaaaagaaaccactgtaggttttgccctacatggagtgccagggaaagtggatcatctaggatgactccgaggttttgaccagagcaactggaagaataaagttgtcatttactgagacagcacagactgtaggggagtgggttttgcgatgagtgccaggagatgctgattctatatccaagggaagttgttagggaattgaatacacacatctggacttcagagaagtctgggctggagaaaaggtttagaccttgtcagtgtagagagatggctttgcgactggctgagaaaggacagaagagaagggaggggagaagaagagggaagctggaaggaaagaggagcagataagtctggagactgagcctgaagcccttgatgcacagaggttagggaggcaagaaggaaccagagaaggagactgcagaggagcatccagtgaagttgttggagaaccgagagagtggcatctccaaagctgaatggaaaagctgcttcaagaaactttgcctaattctgctaatgggtcaagtaaggggaggcctgattatggaccatgggatttagcaacacagagaacgctggtgactttgacaagagtgtgtctgggggagggttgagaagaaaattcaagaatgagctcacctcaaggggaaagacaggccagggacattgggttgcgggctatagaagggttacacatggggcaagctcatagggagctgtctggagagaactcttttgagtgcctctgcatggacaggagctgggggagatgtggtatcaaggggaggctcctaaaaatgagaagtattctggcctgcttgcataccaattatccagcagaggggagagacagataatgcaggagaggggataaatgcaggaggggaaggttaaaggggctgggatgcatcgttcaggtggcaggtttggctttagataagcgcagggacgattcttccatgatacgaggagggactgcagagtgcactggcacagctgcaggaagatgggaagatgtggttggggtaggccatggaagttcttttctggttctatttcctcagtgaaataatgcgctttcaaagggaaactcatatagtagtgctggaagtgtaaatgagccttttgatattaggtttcccagtctggcagctgggcatcctcctccccaaagcaagagtaccgggatatgccaaggggttcttaaagctggaactcatggatttccctggctgattggagcatcactgctgccagcaaagcccaaggtataaagtatgcataaagtcactatggtttgaacttttaataaattttacttccatgtaacgtatagataatttgtgaaatgcaaccgagagataatttacaaaatatttaaataaagttgctaatgtttgattttgttctttcttttattttacaggtgtgagctctacattatgctgagatggctatgtacaagtatatccagaatgacggtggatacgttgaaagtccaatcaactgtgctaaatcttgaatcagttctctctgttgccttttgcaggttgtttaagttttgtatagaagtggatattttgaacattgaaactgcacaagggctttatggttgctctgctcacctctatttcttcttctcctgctaggaaaccccattatcctcagaacaagtctctccacctcctgctcttgcctgatgctgtatggctctgatggcttgtcctgtgtccccttagcccaggtgctaagtggtctctgttcccttaaaataactgttttgggatgttatgggtcctgttttaaaaatcccctcatccctcttcttttctctcttctaaagggcagccttaccatctccttttaagaacagaagtcttttctttctgcctcttaaagtcagtagctggtttgtcacccaataacaaaagcccacaatatcctgacctcaaagactaggaaggtaggtggtgctaaggtcagggattgggagtcttagagagccagcaacacagtgtcatctctctgaaaagtaaatttccagtagctagcaagagatttacaaatgctgaaatctcttagtctactaattcctttcatacaatcaaagatatgtgcaaagatttatgttcatcatactgtcactcctcatagagaaaagcatgggagtaacacccatgtctgtcagtagggcttggatggataaagtctattattgagtcctttgcaatcattcaaaatcatgtttgaatataatagatgggaaaatgatcatactataatgctaattgaaaaaagatataaaactgtatatatgttctcatctcaaatttttaaaaaataaaaatgtgcttattttatatatataaacatatatatatagtttatatttaaaaataaaaatgtgcttaactctgaaatttgtctttttgacttaaggatatattatggacatccctttagggtcatatttatagaattgactcattcttttaaattatactgtattttattgtatggctaaattgaaatttattggaccattttcttattgatgaaattcaagtgcttttaggttttgttcagtttttaaaattgtaaatggacaatttataattatatagaactatggggtaaaaagcactgttatgatttatgaatacaatgtgaaataattaaatcaagctaattaacatactcatcatctcaaatacttaacatattttgtggtgagaccatctgaaatttactctcttagcaattttgaaatgtgcaatactctattcttaactagattcaccacactgtgtaataaaactccgaaaaagaaaaaagcaacatattcctcctatctagctgaaattttgtaccctctgaccatcagctctctgctctctccccaccccctaccatctgtaaccaccattctactctgcttctatgagtttcattgctttagattccacacataagtgagaacatgcagtatttgcctttctgtgcctgtcttacttcacttagcatcatgttctccaattccatccatgttgtcgcagataacagagtttccttcttcttaaaggctgaattgtattctattgtgtatatatgccatatttcccttattcactcctctgttgatggacacttaggttgattctataacttggctattgtgaatagtgctgcaatgaacatgggggtgcaggcatctctttaacaaacagatttcacatcttttgggtaaatactcagaagtggtattgctggatcatatagtaattctatttttagttttggagacacctctaaaatgttgtccataatggttgtactaattcatatttctaccaacagttcacaacagttccccttctgccacgttcttgctgacatttattatcttttgtctttttgataaaagccattctgacaaatctgagatatatctcattgtgattttaatttgcattttcctaataattagaaatgttgaacatttttccacttacctgttggccattcgtgtgtcttcttttgaaaaatgtctattcttatgtattttttttaaaatatggtcatagcagaaaataacttcagtgttaaaccacagttatctctgggaggttgaatattgtgtaattaaacatttttaattttaaattgtatatttttcatgttttctatactgagtatctttcttttagaatcagaaaaatgtacaaataatttaaaacaaacgccttgaaaaatgaacaatcttacctagtattcaaagaaatgcaaattaaaatgttatttttgtttctatctcagtaaataaggaaatatggagtaaaagagtaatcttcctgctgagcatgttttgcggttgccagcgctgccccgggtgtgtctggaggaacactccctgttgcctaacaactgctgtaatgtaacggaaatagaagcacgatgccacacatccctcagaaaacgacttggcccttggccctcctgtggatgaagagtatattgaagagaaactggatatttctaaatttgctaagactcgcttttctcacttgctctcagatcacactacttttgagtagcccaaaattttgttgccaactcagcaagttaagcaaacaatattacaaatcatgttgaaactgaagtggtccccatgggccagtgagtacggtgcaggtggagaaaaaattagctgctgagttaggacaaactgctccaattttgaaggcacaaatgggcatcatcttgggcccgggtactacccaaggtggacctctcaatcaggctcttatgctcccaggtgtagttgttgggtgaactctctccctggatgctcagggacagcatctcagagagaggtgaatggaaaaaccatgagaccctgtacacactctaggtgcaatggattacaagggttgatagctcttcttagtaaccgaaagcctatatgctccatctttcttgatggcaaggtccctgggaaggagacattctcttagaatgtcattaaatgaccatagaataagcatgaagtgagtggaattatgtggaagggattcagcattttacccaagcactgggcagcccctgggtgtggctgtccctccacagtggcctgtctgtctaagtcttgacccacccacccagatcctcttggaagccactgatagcatttgcctctgggaattctgcagcctttgctgatgagtctcagttgacaccatctatcattgcagatacagatgtctccaaaaggcaattgccaaaggctgtgccacacagcacacacctgtccatgtgcagattgattctgttaaactcttcagctatcttgtgggctgcttttccctgcctcattatctgcctgcagaccttccttctgtgttctctgctcttagaggtcagattgatctgtatttttatcaagatgaggaaggagatggtagactgtgaatcaaggatctacctctcccagtaattcactgtggcatcttggggcacctgctggccctctctgagcctccattttcttacccacgaaatgtggatttggacccagttatctccaaccacccaagagtctgtgattctgctactaagaaaagcaaaaggcaagtacaagatagcatgtgtttagttgctggggaaagctcagtctaatattaaaaataataagtataaaaataatcaccaccattcactcgagcttgctttgccagttctgcactgtgatctttgcaggggtaatcttactgaatcctctgctccaaccctaccaggtgggaactacttttatctttatttttctgatgaggagattgagcctcagagatgttaagcaacctgccgaagcagagagttaatatgtcgggattcatcacaggcagatccctctgctcttgggaagcccagacctcagaagcaggagtgggtctgattcaggtgtgctctgagggccagctgtcctttccaaaaatgccttcctttatttagacaccaacatccttgctattttggatttttcaatgagcttccttattttctccctattctgtcctattcagcaaaatgaatgaataaatataggttcctaatgttacaaatttaattttcttctagaaatgaaagtgtttatttctcttcttttatttctcaagccaaaataattatttcctccttcttagaagtccaggaataggttaaactttaattaaaagtcttatggttcaacagttggaatgaggatcaggtaataacgaagaaaccccgtaaacaccctgaggagaaccagcaccccctccattggttgttttagctcagcccacagctaacagctcagctcagaaagttcctaccacccactccgcttctaacgccttttaatattcgcacagagttttctcacattgtggctctcacacacttcctttatacatgctgtttcctcagcctggaatgccacctctttctttacctggagaacccctgtcccttaaagacgcaggtcagaagtcacgtagtactcctctgctaccacctaatgcaaagcgtgattattccttcacttctcttctgcatttaaattattgagggaagaggcttggtctcattgcctttggaatagctctggatctgcgttcatgttttgtatataatacgactcagtaaaggttgtgtaatatatgactttcatatgtgtgtatgcaaagataatgtgttcccatgccctttgactcagttttccccatggcaatgaatttaaccacaggaaataattgaataggagaaagaagattacacagatggaagttctataaaatatgtatttgctaaacattggaaacaagttaaatgtttatcaattgagtaatggcaagtaaattggggtacatgatcttgaaggaacatgacttattctctcattcattatacaaacatatagactgccaaagagctatcagatacacagcaatttaacagttaccacatctgacttcaatgaatacacagtctggtagagtcttctaaaatgataattaccaaactacatagaaagcgagcactatttgtggtctaacgttaagaggaaaacaaatcagattataaaaccatctgtacattacgattgcaactctaaacatgtgagagtgtgaacaaggtctggacgggtgaatacaggaatgacaatattgatgtggttagattggatgactttttctttagcattattacaattgttttcgagctttaaacttttagattgttccaaacgtttctaggggggaaaaaaaagctgctcccatagccctggctccccaggttggcagtagcatgaatgatggggtattttcccagatgggcaggggcttgccacaaggtgactgggaggggatattcaaggcagtccaggagagttgggttacggaaggctatcactctgtagacttgggagtgctcactgggtgccatcgtaagaaccagcctcttctgtgtctgggctatgccacgcagcagcacctgcaggctcttccaagctttgtcagcaccacaacttgggcacagcacagcagtgccaggtgtggaaagcagaagtctaagaggcagacaaaagggttgagacctgcaagagttggtggctagttcctcatgctggaaaggatgatctctatgtgaaaggtaccttatccctcttctacagaccaggaaactgaagcttgatttgtcccaagctactggagttggggttggaatccatcccttcttatttgggggcagggtttttctatttcccttactggcctgggagcaggtggagatgcatgaggtcatatggaagagacaggctgataggatgggtggagtcctttgggaaggaggaggcaatggggaatctattggtaggaccccatggtggacgtatgagaagccaagcatttgagttttgactcgatgcagtaggcagtggggagcccttgcaggtttggggacatgatggaagagggcttaatgaagacgaggctggtgtaatcaggggagaggctggatcaggcacatggtaagggtgatgtgtggcatttgttttgtgtaatcagaatagtacccacccatccaacttcttggaaatatgtatttctgcttctccatgagattggactggaagcttccatcttatatatcccttccccatggataacagcaccttccagggatgggcacctgatacaaacttggcctatcagagcacttccctgggaattttgcccttggggccagagaaacatgggtgtcagtccctctctggtgataaagctgtgtcatgtaaagtctgggggatctataatgactaaaagatttgagagtcagagagagggaattctagcttggctcaggccctggtttcccctcactttgagggctcagacacccttttgcttgtgccacaatatgaacaatattcaccaccctcatttaactaaactagtctgagttgaatttttgtcatctgcaaaccaaaaagttctgatgacatttgcagtaagagaaatgtctactctttgtcattcaaagagttcaatttgttcattcttcaaattttgagcacaattctcaacaacactctagggttgttttgtgtgcattgggtccatcattttgtgcctgtaagaaataacaacaaaaatctttcctcactagtcagcatcaggttcaggaactccaggttctctgtagacacaaggctttgggattcccttcagagaaggagcaatgcatctccatcactcgtgtggtaagtaaaattgctgctcagaacacttccatgcctgctcctttgtgattcagatgaggagaaatcaacgtggactgagcgcccacacaggacagccaggcatttcccatacaggtggtaaaggtatcttctgaacttctccccagcaaatgcatagatgagaggattcaggcaacaatggctaaatgcaaccgtctcagtcacactgagggccagcctcagatccttcctcatgtcacaactgggaaagaagtcatagagcttaagcgtctccaggaaaatcataacgttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacgcctaggctgatggtgacgccatgctgcacggtccggttgttcatggagttggcggccaggacgatggccaggtacctatcaatgctgatgacggtgatgaagaatatgcttccaaaaaagccgatgaagaagaaggcggtagtgaatttgcacatggcattgtggaggcccttttcatttatcaaatagtgagtccagaagggcaaagtggctacaaacagcagatcagacaaggccaggttcaggaggtaaatgtcggtgacactcttgggcttcttgctgttggtgagggcaaacactaccaacaaatttcccaccaggccaatggcaaagatgacggagtagaatatggacaggaacacagtcccaaagaccacgatgtccccaatataacaggcctcagccaaatcatcgtactcaaagttttctgtcactgattcagggaactgatccatggtgaaggcctggatcagaaagaaaaacaagtaactgtgttagttatcagagaaacaaagttggaattctgtgtggcctcatatgtaggcaggcaggaagaaacaaatattggttgggtgcacactacatttcccaacttcccacttgccatcttgtttaatccccacaacagtcttgtgatgaagactgcaacagactcttctgacaggagaggcggactcctttgacttgcccaaagccatgcagtaaatggctctgtgagcatttggctctaggcatttttttttttttaaatggagtctcgctgtgtcacccaggctggagtgcagtggtgcgatctcagctcactgcaacctctgtcccctggggttcaagcgattctcctgcctcagcctcccaaatagctgggattataggcgtgcactaccacgcctggctaatttttgtatttttagtagagatggggtttcatcatgttagccaggctggtctcaaactcctgacctcagattatccttccgcctcagcctcccaaaatgctaggattacaggcgtgagccacagcgcccagccagctctaggctttttgaagcttgagacagatctgttttacttttactgcccaaaatctctccaaaagctagctagtttgaccaatgtgtggatgagaaagggagaaccatgagcaggagggggaggggggtgagatggggtgaattgggggtgcagctgtaattcacacttccagtccaaacttccccaaagcaattctccatcctcttcctttgtttccaccttttccaccctctggccccttacttttccatgaagctaggcctggagagagaagcctcagacccagagccttgggcagaacagcacccggaagccctcatctttgttttttgagaaccatttcacctcctcttctccttataatcaacaagtccttctctttcttagcaggtatcagacagagtcatacactctagagtgactaccttgttttgggctgcccaggactttcctggttttagccctgaaagtcccatctattgggaacccctcagtcccaggcaaatcaggactgttggtcatcctacaacgctaagtgaagagaaggtgttgccatcattcaggactctgcagtcatagaggggctgactgattcaagatggaggatggggctccgttagtctgctgggctagtctccgggtgactaattccccctacgattaccagccctatagttcactttggtttggacttccccactattcttatctcctgtttccttctgagcaggaattgaaaaaagaagacacttctgcaggctgcactccccttcttttcgcagccaggacttgctgctcattcactccagagccggctgggaggcagccctttcacacggctcctctgggcgtctcctcgtgataccacagatgggtccctcagaaaccctcaaaacaggcctcctggttgtcactgcctccctccttaccacaacttacagcaaagctcacgctttaaccgagggagtttccacgccccactacaccctttccatgatggttttacccaggtggtgtctcaccaagatgagggcccacccagccagggtgtgtcacttctcgcttcccagcctctgctttggggcctgcatctcacccagactctcctgggataagtgggccggggctttacaacctaagctgtctcaggctgtgatgagttctcaaccccagggaacgtgtatgctttctctgcttcaggctacaatgcccttttctcagagaataatctctggctgtgacgttaattaataacatttaagtcaaatggtataaaatggctgacatacagctatttttgagccacatccatgtcagttttatatgactcaagctaatatgtgggaaacagaaattgctacttagtgcctgcagcttgtcacagagcatgatcttcccagacaagctgctgtatgagtaaaaatagtcaagtccttggtggttctatgttagggaccctggagctagctactttctccctccccttcccccagtgagaagagctggcaaagccgacctcgagaggtggccaaatccagtaaaaattgtctcgcatctctttatgtgcctgtggtcggtccttcagcacaggaacttctgtggactcgggcactcccgagattgaatcctgcatctgtcctctctggctgagtgatgggtgagcttgaaacctctgagcctaacattccttgtctgtaagatcgggattcattctcatgcctgcccacagaactgttttaaggggagcacctggcacagtgtgtcacatacagcaagcacttaatacatgttcaatttgtttcctgcattatgtgaggaagcaaaagccctttggatctttggaaacatccaggctgcctgtggactcccatgttccacctccaccctgggtatcctgggaatttggtctttaaaggtcactttatttttttttccccctgaaataagacatgctttcttttcagattattttgggggaggtaagccaccctttattgagcttttactaaactgtcaggctcattgctctgtttggattaatattgatctaatccgttctgcaattctgaaaaaaaaaagttctatatttaattcactgcactgctgaatgcctctggggatattcatgatgagaggaaggaatgggacaaatgtggagaaggaagggaaagttagaaataagcaactgattgcctggtggagtggcagaggggtcccaaatcaggccctttgccttactgggtgcttgggctcagggctgccacgtgcacaggggcatctctaatttgcaccaagtctccatataagctgggggtggtctggcttggcaaggagctcatgaaaagatcagtcaggtacagtctaagccaggaaggggcttgtcttctcaatggggaaaattcacataaagactttgattaagacagaatggaagaagtgggtgaatgtatcttctgcagatgggatgcaaattcagataatgctctgggcaggatggttttgcctgatacgtggtgatattatgtattgagagccaaatggctggttatgggcatccatctggcttgggactgctccctgccatccagggggtctgctcagtgagggcagacgaacactctgcagccctcatcctagctccctgctgtctcagagtccccagtgaagaccctagaattgctgtggctcccacaggagtctctcagtgctggcacagtgggtgcatgcagtgggtgctcacccagcatatcatggtccctgctatgagccatctggaccatgctacagaggaaagagcagtaccaatatcgctttctatgagttcccacgtgactctgaggaacagcactggtcattgagggacatttttgatcttcatgttcacatttccattttgcacacactgtgcctcacaggaggcacagctgggtgaagcacctggcccatcccacagctagaagcagggggagcaggactgaggccaaggcctgtgctgttcccactctcccttgaagatggaggagactcgggccctgggcttaggggccaaatcctggcaggggagaagagtcaaggactcgatgactatcaaacagttgagtcccaagtccagtggtaaaaaggcatcaaaacaacagccttagcttcctcctctaaaaaaataacctcttaggtttgttgagagcataagaattaaattactttaaattgcttattgggatttatcgtagacacacacatgctcaagcaagtgtgtacactgtcactgcaacaagcttcaaatataaatgaagggaaacaaccccaatgtccatcactagggacagatcaaagcacgataagtccaattaatggaataccaagcagctgcttaaaaaccaaacagtttctagctcttggaaacttgggaaaaacaacaaaaacaggcagatctgtatattctgtcatgcaacaatctctaagatatactggtaagtgaaaaaagctaggtgaggtaccatgtacatagtatgctgtcatttgtggaaaagaatgatgtgtgcgtattttgtataaagtttaaatatctcttaaggaatacactggtggtggtaattatccctggagagggattctgaaggattgaggatatgggaaaggagacagtttttatggtaaacttttggaaatgttttttaccatgtacacatactacgtattttggaaaatagtttaattaattcgtttggaattttaaaataaaaatcaacaaaaatatgagttatatgaaaaactaaaaaatgagtaacttagtacaataacaagcatgctgcacataataagtggtagccaacatataaaaggatcatctctatttttatgggcaaatagatgaattcagagagggtgaataacttgttcgaggtgatgcagtgtgtgtgcaatagggctgcagtgagggcccagatgtgttcggcctcagcacttttttttaacttcacattacagcccttccccattcctttttcccaagactaggagttcctaagagaagacccacgtcctcttcagctctgcaggccaatgttcaacagaaggcctggtacacagcgaatgccatatgaatatttgcagaaggataaatattatatcctagacctttgttccaaagagtttcatctagtagtgatgacagcaccctatcagtcaccctgatcccaggggtgctcatgagcacacaggtgtcctttctgatcataggctaggaagccttgaactctgagaagttagtaggtgcctgatgtgttaaatgaattaataaataagtgaatgaaagacttcaaggagcaagaaaagagattcgtcagctctataatatggagccccaggagatgagaagaggctcaccagctctccacagtcagaagacaacttggcaaacacaacctctcatttcaaccatacctctcacatgtggcttttgaacatatgtggtcatgaaatagatatcagcgtgggtaattgcagctctgtcttctgtgcaaatctcaagaaacagcaggagtcattgggcaacatagggttttgcctggttctgaagagacttgtattctgtgtgctggagctagttcaaaccgcccttggtagccaaatgccccagagcatgtgaaggcaccatttacataaaaaatctgacatcgctgaagctgtgtccttcgcagaagtattccagtgaacttgatagctttagcaaggcgctttttaaggaagactgagcctgagctgagtgtacctcctatttgtggatcctccaagatgttcaaggtttgggagctgagcctaagatagggcctcctggcagcagatgcgagtgtggccgtgccttgggggtggccctcagggtggtcaaaggcctgccagaggtctaattggttttcatcttagactggaccatggctttcctttgtccctgagggacactagaaaccaagtggaagaatcaaatgagaagactttgcagtgtctacccagctgggtttcatatccacaagggttgtaagacgcatgcattctgggatgttgcactaataaaggcatcatcaactaaggctgcactttacaacttagtgcagcagccagtaagaatttaaaccttctctgggccatcctcaggcctccttacccactattcagttaagccaaggttttactaaatggccttgagctgggagagtttcggtgaacctagacagagctttgagtgtacacatgtttcacacccaagtagaaatttgtaaaattccccactcacatccgtggctgatcctggtctacttcctctggcctacttccttttctcatgcctgctcatttattttttaactttttaggggagggacactcatcattacccattgtttccaatcagcttcccttttctatacttcccttcttctttaggtggccagaatccatttcttcttcaatctgacattcttttatgttgctttctccctctcttttggcttcacatccagcttactgttttctaaatccagtgtatcttctggtagtttttaccctcctggtctctgtttatggctttttagtaaaagtgaagactgggtttgaggttcagtctggtgccaagaaaattgtgaggcttaatttttttctttgtaccaaatgagagtagagaattgcttgaggagccccaacccaaactttccttatgaggatgccattgtgctgttgacattgtggaatctgaagtcaccctcagaaagccccagtttagaaagggaggaggctgccattcccggatgcctgctaagtgtcatgctccacacacaagatcccaccacattctcttcacaaccccactggagaaatgatgatccccatggtataaattaaccagcagaggcccagagatttggttaacttgttcaaggaagcaaaagagccaggatctcaaccccagatgcctctttccacaaagcctgtgctccttgcaccgcacaatgcttttctccctggaggggaaatctgcaggatattgcaggccacttctctcgaagtagaactgaaaatagtagacccaggccccttaagagaaactggtccatgatgcatctctgaattcgttggggttctccccctgtgggctcataacccagcaggctgcccctcagggattggtgagtggaaaatggaatgcgggatattatttgctcctctagccaccactaggtggtccacactgccagatccccaggaatctagctcccagcaaccatagtgaggaaactggggtcattttctctggagaggaaaagtctgaaggctgaaggtttagcctattttctgccttcaaatatatgatagtgcttttaagagccacatgtttcacaggagcccatacatttctgagcatgaatggctgagagaccctgggcaggtcactctgctctgcttcagtttcttgatgtatgaaattaaagcattggaccagaccacctctaagagccttgctagctctggcatgctcaatttttcagcaagaatcaaacagaaggaaactgtttgtttgagacaggatctcgctctgttgcccaggctggagtgcagtggcatgatcatagctcactacagccttgaactcctgggatgtagcaatcctcccacctcagtctcctaagtagctgggagtataggtgtgcaccaccatgcccagctatttttggtagatatggggtcttactatgttgaccaggctggtcttgaacatctggcctcaagagatcctcctgcctgggcctctcaaagtgccaggattacaggtgtgagccatcatgcctggccaaggaagcagtcttaaagagcaacatgagtcctaggtcagcaaaagtgtggtctattgtcaacagagaggctgcccagcagcctgcccagggaacatgacacttctacacttctggggcacagcctgtgagcattcagatgaggttctgtttggagatagggagctggatcagttgatcaagtcttggcaaatcttgtttaccttgtactagatagaaaggttctcagtcggctgccatgcccagacccctgactgtttgggaagccaagttttaccaggtcctgatggttttctcatttatgatggcagctatttttataacacatatcccttgggattcagagagagctaaggctgatggggagaggggtgctgaattccatgttaaggagctataaggaaacattttataccccatcccctatgcaagtaaattcagtgactatctattcctatagcaatgagcccatctagaacagcatggcattgtctacccaccagtttttcacacaggccaaatgcacacccaacccttccctccaaccaccaccaaaaaaaaaaaaaaaaaaaaaatagcaacaggagaatcctattgggtttagtgaattgcccctttacaaaacctgccattattttgtgtttgaagccccacccttccctttcctcttcaaaatactttatggtatttatttatttatgtcaaagtaaactgtgaaattttgaagggaaatacttcataatttttttaataattaggaaagagatagacttgttaattgtttaattattaattaagtcaatatttttgagcatctgtaccatattctagtctaagtagaaattaaaaataaaaacatttaattattcttgttaaaaataaggacagagatctcctcaccttctgtttttttctcagagcatttactttagaaaactttttttttttttgacatggagtttcactctcatcgcccaggctggagtgcaatggtgccatcttggctcactgccacctccacctcctgggttcaagtgattctcctgcctcagcctcccaagtagctgggattacaggcgcccaccaccatgcccagctaatttttgtatttttagtagagacaaggtttcaccatgttggccaggctgatctcaaattcctgacttcaggtgatccacccgcctcagcctctcaaagtgctgggaatacaggtgtgagccaccgtgcccacctagaaaacttttacatactttctcctctctttgaacatgtgtaaatccttttgaaactagataggctttttgtcagctttatgagctaagctagtctttcccaaggacctgggcgtcatctctttgaaatgtaaacaaacctaagggagatagtgcttctatctcttagtttctgtgggaaggtatgagcctaactgaagagccttgctcagtgctgcaaaattaccccttgtcttaaagataaatttgattttcctctgggtagagccagttagctaacacaagtggttaccctaattaccaggtaaatttagagtgaaccatgtacggcaaacggtgctggcaagacctcttacttgaggaacagttattgtttgccttgataacatgtatgtaacaggttgtatctacttggctatacaaaagggggagatttctttctgttcttgcaacctcttagtagatggcctataatgctctgcatattttggtttactgcttattccataataaaactgttctttctctactccttttgtggagagaatctctgtgttgaaagaagactttgttaattatatttcaccaatactaggcactgtgctagattctgtagaggcaaaagtgtttaagatacagttcctagaagtgtttattattgctcagtaacagaatataagaaaagtcatgggaagcccaaggattgaacctctatatctgtctccttaaaaactgggggagggtgatcaagaggatatcacaaaaaaaaaaaaaaaaatctgccgtttgagctgatgttttaaggatggggaaagtcttccaggttgaccaagatggaggtggcagtgaatagtgggtgggctttgaagacaaaggcacagagggtctgagcataggaaggtttcctggggccaaggccaggcagagggaaataggaacagaaggcagtgaagatggtggagttgggaggagcccacatgctcccagagtgttcaggaaagtcagtttaggctgagtgcagggcttcggggaaggatgcagagaaagccaaggctgaaaagggagaagagggacatagagaggggtctgaaattccacactaagtaactacaaggaaaaatgatgaaagactttgaaatagacacacactgaagattactgggagtcctttctggcatactctttggggctacctcccccttttattgcctgagctaattttacagcaccgtaggttatagcagatagcagtgcaaatgactcttgctcatggaaatacaaattttgtctagtggagatgcactggattaagtgccctgtagatatggaccaattgtgcctttatctctaaattcatctcagtatttctggaagcatctcacccatgctgttggtttggctgtagactgctaattctccttgctgcgtaggattccactgtgtgactagtccatgatttattgccatttctactgctaatgcacacataggtggctttcagtttgttgctagtttggacaatgttgccgtgaaaatttttgtgcatgtacatctcctacaacgtggatgcattttaaaagtttagtcttgagccaaaccaaaaagtatgaatccaaatatgaagatcaaaaataggcaaagctaagctatattgtttagggatgatatttagattcagtcaaactatagggaaaagcaaggaagtgatcaccatagaagtcagacttgtggttctttgtgggagaggaagaggctgtggtcaggaagggacatgagagaggcttctggggttctctttctcagcctggatggtagtaatgtgggaaattaaatctaatactttgctaacccagacattgttctttcagtgtgttgtattttgcaataaacaaaatacaacacactgaaaagagactttccattttctccttaagcacactttaaggggaaaacaaaggtggtctaggaagatgtttaaagacatatgatacagcttttcttccttactcacaagctaaaaagctgcactttggccaaacaagatgagggggtcgaagcatcagctgtggccagcgtgccgtgagaatcccacctgtgaagcagccagcagattctgagcccctcaagagggcaggtgggatcaaggttcagctagaagccccaactttcccctggctcttctgggcagagtgagtgatgccagagagcccaacttctcggaatgcctgggctgtgctgctaggaatcagaacaagtccttgggaaaggcagccaagatctggattctgccattctggttccactccctcctatgaccgtgacctgctgtggagcagcagaagttcccctccttgttcagctcctccattacaggtgctggttccaaacgtctctggactcaggatactgggtcagaggctggggctggggaggagcagttggatgcctggatcccaagaaggaggttttttgaggctagggtctctggctagggagaaccatacctgacattgccactgtgccatagctgcctagggccgggcaggcttcctcctgggatggggtggggtgaggaaggggatagacgatcgtcctgactgggtcagctctaatacgttctttgctttcctgcccctacagctctggattcttcacaacctcattcaatagtagtcagtgtttttcaggtatccaaactttctgaggctcagtttcctcatgacaacaacatatatcgtttcttgagcatcaaagatgggtcaggcagtgtgtttgggacttcctataccatgcctttaatccttgcagaaagttgacacatacccattacatggcttcaaaggctgatggacaatctccattttaaaagcaggaaacagacttagcaagcccagtgcacagtcaccaagtgcagagccaggacttcattcctgacttcattccttcattccaaagccaagctgcctatgtccccatctgtgaagtggggccagctgaggagcagggttcaggagcagactttgtggagactggcacgtggctgatggatagtaggtgctcccatcccagaggtgtggcaagtgccaggtaagcctgagcactaagaagaaccacactgaagttgggctgagactatttcctgccctgccttcctttgtgaaaataaagccaagcaaagaggaagatgaaagaatccaccctagccttcctgagcccatttctcattcccaggggttttgaaccccaatccactgcccccattcccaacccacagtggtcctcaaggctctccagcacaggtccgtcacccaccctgcctcctctcaggaaacccagctccctccaaagcgccctctgggcctgggatgccctgagcaatgcaagctttcttgcctgctttcacgtggttcaattttcctttttttttggctcaatttttttctgcctcaagttttctacctcaagtatttcaaaaattaatttttttttcttttcttttttttttttttttttgtggagtgggtgttgaaagaatcctaaactttcttagccattctctggactgagctataaactcacaaagcaaggattgcaggctctgtgaggctgtgattgccagaggcaaggcaagagaaataacaagccgtggtcagtcctcagctggggcctctgatggatttcctcctgtcttgcactcataatttctttctgaagaccatgttttccacccacacaaacctgagcctgagtatcctcacaatggttataacaacatatatcaaaattgaacactaaatttgtgccaggaatttattaatggagaaaccccgcctctactaaaaatacaaaattagccgggcggtggtacatgcctataatcccagctacttgggaggctgaggcaggagaatcacttgaacccaggaggcagaggttgcagtgagccgagactgtgccattgcactccagcttaggcaacaagagcaaaactccgtctcaaaaaacaaaacacaaacaagaaagaaaacccaaaaaacaaaaaacaaacaaaaacccatagatggtacaaaaagtggaagaaaaaggaaaaaaaaacccatgaaactatctgcaatgcagtttcctagaatcaaccacagtaatcttttagcttttctctatctaaatgttatacatattttatatttatattaagtgcatttatatttatattaaaatacagatacaaatttaaaaactctttattattaaattttcaaataaaaagcaacttttcaaataaaagcagcgagaacctccttatacccaacacctggcttcaactattagcaacccatggtcaatatttcctctatttcccacttaatgtctctactgaattatttaatttcacccataaacacttgtgtgcatctctaaaagttaaggactcttttttgaaaaagactttaatacaatttctcatctcaaaaaattagcaataattcctcaacagcatccagatgcaatttttcatgcttttttcagttagtttaaaatcatgagcttttctccatgtctctaaaatgtaattactaatgcttctaatactattccaccaggttgagtgtattataaatgatctgatcaccccttgcctcccactcttccatccccttggacatatttaggctacaacatccccaggaaaatggtttccattgtctgcacgtaagcaaacaggcattattaacctattagctgtccactgctccaccccacccacaggtacccaactagtcctgtgcacctacctggcgtggactgccaagggaacctctggatctgccagtcagccaccctgtcctgctcagactttaccagagacgagtatttccctttccttccctctaagagcattttatttgcagagttagccaatagtatcttgtttcctgtaagggagactatctttagatgctgccacaggcaagctcagatactccagggtggaggccagctgccaacaggagggcctgactttataaacctggaagatctaaacctcagggaagactgcggagctggagggagagaggtgccacttaccccaacctggaggtggggggcagggagcaggccctgcagtcagcaaagcacagcacagtcagctctcattaatggggagccttcaggaagctgggagagctcatggggccctcagcttccctgcccacgagagggagcccagagtactcactggaccacactggggcacacacagctcttctcctcaaagtgcagtcccaggcactgggagcttattaaagacagcacctcaagccctgccctatatctgctgaattagaatctgcattttaatgaaattcttagaagagtgatatgcatactaagtttgagaagctttggtactgaaggcatctagtgagtaccttgcaccttgtagatgctcggtaaatatttttttcctcacctctctgccccaaggcatttagtggctccctatacccatcagtcaaggctgaggacacagctttcacccaggacctggcctatgctcctttcacagtctctccccctgccactcttgccctgcagtggggagcctggtgggctccggcatccagccatgcttctgctccctggcctggccagcttggggcgactgcaacgtgaatctcaactgccactgcctcatcaccttccgatcacttcattacctgcctgacccctggcatatgctatataattctgatccatccctaactagggcctggcccatggtggccttcaatacaccttcattaaatggtctgtgaccccttcaaggcccctctggccccttgctgcccacatcccagccacatccggtgctcccttacctctagtcgctgtggtgttccgaggacagcgggtgctctgtgtgctccccaccttgcccctcctcacctcccccaaccccaggacagagctgggggctgcagtgcagtgctgcgggcttggtggcctgctcatggtggaagaagtccaccagcagttttctttctttgttcttggtctcagtgtttggccacctttccctgcctttggccagaaggccacaggacaaaagcagagtcaggccgctccccatccactttctgacactggcccctccccaccccacaccaccccttgatacctctcctggggtccactcagctgggctggctgcctcagccccttccttgcctctgactcccctcctcttctgagggctcctttcttggatctggccaagactctccctctcttcctgtcccacactcttgacgacagtctcatccaccccacatcagtaatcccctccgtgttcatgagcacacatctctacctccatccagggcctggataatttcccaagcccatctaaccttctccgttctctgtctttcctctcaccacttaccccactggccattctccacccagaagccagagagctcttcctgaaatccaagtctgccaacttaaacgcctccaggggttctctcatcctggtttaagtccacggcctggtaagcacggcccgccccttctcacttcctactgtgctctcaccacttccacttcccccaacatgcctgtgcccgtggcaggctctcttcccttcccaactcacctggctgtcctgtccaggacgtgattttaccctcttttaaagctaacggctatgttccacagctgctagcagcacagggcttcatgcttggcaagcatgagaaccagcgtccagtgtcagttgccttgcccccaagccccacagagtgatgccatggcttggatagatacctgtgaatgtgtgagggatggggaggttataggaagggaactctgaccttgggtaacgtgccattttatagcaagcagtaagcaagtcggttatttggccctgagcgagatgtcagctcatccttcaaggttgctcactgcaaactcaaccctgcaagatggaccaagtgaagagcattagtgctttgcattcttgacacactcatggagacagaaagagccttggcagccttccccctccctccacgcctccttgggcctctgtaaaggagtctctggctcagcgctgggaattctctcctccctgaactcttgttcaacccctcccccgtactctcactctggtacagccttattccttagatccccgtcttcatctctctttctgcccagcccctttggcttcactctctgttggagctgacccttgttcacaagttctttgtcattctgcatttctcttccagttgagacagtaaatgcagaggacagtttggtttctgctgggcagagaaatgagagtgtggtgggctggctcaaaggcaggaggccagacagagaggctgtgaggatggtggggacaccctggacagtgatgggtgtccccacccatcactgcaggcacccatcacacaatgcaggcaaggactggagacttggtgtgaataaagctttgtgggaatgtggggtagagatgcagaaaaggagagtgagaatgtgattcaccttaattgccaaaccaagatacttccatgttcttctgtgggccctggagaaatttgggaataattacataagcagttgtgcagcactaggtctgcctgaggcaatgtcctaagtcctcgatgtacatgaactcatgtagtgcccccagtgaccctatgatgcaggtgctaatgtttttgtttttgtttctttcagacagggtctggctctgttatccaggctggagtgcagccacatgatcatagctcactgcatccttgatctcctgggctcgaacgatcctctcacctcagcctcccaagtagctggaactacaggcacacatcaccacacccagctaatttttgtattttttgtagagacagagtttcgccatgtacccaggctgctcttgaactcctgagtttgagtgatccttctgccgcagcctcccaaagtgctgggattacacgtttaagccactgtgtgtggccgcaggtactattattatcctcatcttatatgtgaggagtttgagacaaggaggagaagttatgtaacttgtacaagaccacacagctcatgtgtggtagggccaatatttgaacttagcattgaggttttatggtctatgctgtgcattcttagtagaggtggtattacttccaaggtggcgaaaattggttctggaaggttcttgtgctttatgtataaaacacagatatacatatagtagctaaaccaatagcatatctgtggaataaaattccatggtagggggaggtgagtaagaatgtaatgtgggccaggcatggtggctcacgcctgtaattccagcactttgggaggccaacgtgggtggatcacgagatcaggggttcaagaccagcctggccaaaatggtgaaaccctgtctctactaaaaatataaaaattagccaggcgtggtggcgggtgcctgtaatcccaactacttgggaggctgaggcaggagaatcgcttgaaaccggaaggtggaggttgcagtgagccgagatagcgccactgcactccagcctgggcgaaagagcgagactccatctcaaaaaaaaaaaaaaattatatatatatatatatatatatatatatatatatatatatatataatgtggttaataggcacaaaaaatacttagaataaataagacctagtatttacaagcacaacaggggcactatagtaaaaaaaatttaatttacctttacaaataactaaaagagtatgattggattgtgtgtaacacaaaggataaatgcttgaggtgatgcataccccatttcctctgatgtgattatcacacgttacatgcctgtatcaaagcatttcatgtaacctacaaacatatacacacgctatgtaccccgccacacacaaaagaatataatatctaaaaggacttgttggggagtgattaaaaaaagctgagaaaccattgtctaagttttttttttttgtttgtttgtttttagacaggatttactcccatcacccaggcagaagtgctgaggtccgcctcctgggttcaagctattcttccacctcagcttcccgagtagctgggattacaggagcctgctaccacatctggctaatttttgtatttttagtggagatggggtttcaccacgttggccaggctggtcacgaactcctgacctcaagtgatctgcccaccttggcctcccaaaatgctgggattacaggcgtgagccactgcgcccagacaagaaacccttgtctaaggtcttaatcagaccactctgctacctcccagtttaaagtctggggattagagggtgacatgacaaaagtagtctcttcagaaaaatcaatcaatgggtgggtgtgagggaaacggctgcataaaagggaaggaaaagacgtacatcaaggacttctccatgccaggccctgtgcgaggcacattgtccattatatctcttttttactttcactttctagtcaggtattattttttccattttcagatgatgaaatggggagaaaagagcaatgagtcctaggccacacagctgaaaaagggtcaagtcaggattggaacttcctgcccagatgcaggcagggaacagcaagaggggagccaaagcagtgggtggtggaagacggagaagggatctcgctacaggaaaatgcatagaattgtaaaggaccagacacgttgagggtcaagtgagcatccaaaggctgtgttgccattgacaagtcgaaagcaatatgctgggagatttcagaagcagaaaaaaagtctctctttcctcttctaccctaagaggacaaaagatcttctccctctaagaggagaaaagatcagacttagaaaattagaggccaatagaaaattggaggtggctcatgcctgtaattccagcaccttgggaggccaaagtgggaagatcatttgagtccaggagttcgagaccagcctgggcaacatagggagacctcattggtacagaaaaaaaaaaaaaaaaaaaaatagctgggcatggtggtgccgacctgtagtcccagctatgggaggctgagatgggaggatcacttgagcccaggattcaagggtgtagtgagcagtgatcctgccactgtactccagcctgggtgaaagaatgactccaactcttaaaagaaaagaaaagaaaaatggaaagttggagaggagtaaatgtagacaaagtaagtgctatttactacctccttctgtcccaatgtttacatttaacatcatctgtggcaattttcaggtttgtttcataaattctgctcaacagtgattaaaagcacttcccctttggaaccatagcaaacaggatctggcaaggaactccaggagtacttaggataaactattttttaggcatcattcaacttttgctttgcaatacttaaaaatatctgtctgcagacagtatatgtcattttttaaaaattaaaaattaaaaaatctgctctctcaccaaatatggcatgtgtttccattaaagtggaacttaccaatggaagaataatggaaaatgaataaatgaactacaatcttgaattttaaaacatgcccattttagccctttgaaatacacaggtaattcaaattaattgccaaaatgtctttatattgtttgctgatattatggagagtctgctttaaaaaataaggaaaataatagttgtctctcacaaacagctttaaaacagccttttctgtcctcgctgtacagataatataacgttaaataactagggcaataaagtatcagaactcatgagtctgtatcattggccagatattgaaaaataagctgccagattagccagctggccagggtataagtgcacctacaagataaccttacatgtggcattgtatgactacagaagtgacaggtagatttcctaaactattgctttcaggattttacttatttcaaagggtcattccaaaaacaaaagccaaggggcttatagtacagtgcagaggtgaggaacacgtccagaggcagccttgcacttgctgacacaaatgcagcaggttcactgacacgaagagactaataacaggtgatcttatggatatttgggagctgcagtggatactgtttaatataagactataattgggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagactataattggaccacaaatgaagttggggggtgggattctgggtccagtgtgagccaaattagctcctgataaactctctcagttggacaaacttgaatcaagaattttagacacctcagctacactttttcatcctttagaggattaagtaatcctttacctgaactgaaacttgtttcaaaagtacaagatgcaaacatagcaaaggctgtgaaagaaacatctgaccatctactttcttagcattcagaatatctgaaataagcagatatttggctgccgttgtcaatgaaaacttaaacagtatgaaattgtagttgtggctacaagtgaatacagggaagccgggctggagagtgttgcacagccgtcaacctgtggttatagcaagaagccctttcttaggtacttttgtccatctctattcttttataacaacaacaaaatggctgtgctaagtaaaacaatctgtattttattcagagccagcttctaatctccttgactctaaaacaaaatatcaatatttatttctgcttgatctagctgccaaaagactcttgtctatataaatcacactcacagttttatctatgtttaaggtaatgaagacctaatctatatgtggctgtagaaggtatttattttgctgtttactgtcgtgcagatgtagttggtagagcaggtggtaggtcctcaagtgaccgtttggccaggagggagtgtttggtgtccagcaagcagtgctgagtcatttcactcggtcaatacacttggtgatggaacctgcagtaacatttcaatttagaaagagccaaatggagatgccatgctcactccaaagtttctgacactctgcttggtaaacggacttcagattgttttagtgccttcagcacatttattttcgacaaatttggaatatccttgaaactgaattgggcacaaggaggtatatatttcaataatttgaatgggtcaaatggaaggttcacgtattctcctttcaaaagtgttttagatcaatgatcaagattttgtaaatctacaatgttgagttaattttacccacatgcaaaagaggctgagaggtatatttccttgaagccagtacatattctatagcttaagtgtatgtctgggtcccaggaagaagctgatgtttgttgaaatcacacattcggcaacatggctataattcctggatggtgacatttcaccaaaggaagcaacttaggatgtgaattaagcaacagttgtcatattcaaaagctcacgtatgtgtgtgtgtgagagagatgatttaatgtgtgtgtgtgtgtgtgtgtgtgttttaaataagtgaaatccatctgtgattcatatgtgaaaatgtgtctgtcattctctgggaacctagcttgggttgaattatttttaaacctcagtatgttgaggcagaagtcctaaaaggctcattgcagactaaaacaaaagtgcctctttattcccaaatgaaccatcacttgccccatatactgcttaatagttattggtaattgccgctattatgtgtcacacttttgtacacaagcaatgcatctccaacctgacccttgctcactcacttgccaggtatttagaaagcacatgttgcctgcctaccttctgctcagggctgtttgttaaggatacaaagatgaatagggcagggtctctaccctttcccttaatggtctcgctttggcttccactcttccaggtagctcaggaaacttaaggtaatctacagtcatcagatacaggagtgagctgccttgcctctatcccctgagctctgtctccccctcctggtgtctctggctctcaccagcaacccccaggtccaggagcagcaggcggagcagccaatcagcagagatggccccacctggtgggcagccctttggcttcagagctcccctctggttcattggttttactcaaaacacttggctttgctgacagtcatctgtggtagctgcatttccccagaggaagtggtgtgtgcaggcaaatctggcaagcctttgggttacagttttgtgatgagccagccggcccacaattacctggaatcccactctcctggttcaaatcctgaccctgctactctcaagctgtgtggcttagggcgagatatttctctaagcctgaatttccttattgttaaaatcagggcaggccgggcacagtggctcatgcctgtaatcccagcactttgggaggtcgaggcgggcggatcacctgaggtcaggagttcgagaccagcctgaccaacacatctctactaaaagtacaaaaattagccaggcatggtggcgtgcatctgtaatcccagctactcaggaggctgaggcaggagaatcacttgaacccgggaggtggaggttgcagtgagctgagatcgcaccactgcactccagcctgggcaatgagtgagactccatctaaaaaaaaaaaaaatcagggtaaacttatatggcaaagtcggcatgaggattaatggtgacatgtgtaaagcacttcatatggtgctctgagtagggtaatgagggtaatagaaatctgtgttccggggatacaaagaaggagcaatctcttcctaagagtcttggtggatgcattcacctgggcaggatgtgccaggagagggaccaagttgtacaaagggtcaagagggtagaagagcctcactcattagtggagcctctcagagtagcctccttctgggctctctggagctttgctgaagcgcagctgtcccttcagaactcattgcactgtttctggtcctggttccctcttactccacttgcttggcaaaaatttctgagtgacaactcccttttctacttgaaactggtgggcaatcttgtccctctcctctcctgaatggccttttaactattcttagaaaaaaattaaaatccaagtatatggactgaattatgtttcccccaactcccattcatattttgaagccctaacccacaatatgactatatttggggatgaggcctctaaggaggtcattaaggttaagtgaggttataagagtgggaccctaatccaacaggactggtgtccttatcagaagagagagacaccagggatgtatgtgcacagagaaaggaggcggcatctgcaagccaaggagtgaggcctcaggagaaatcaagcctgctgacaccttgatcttagacttccagcttccagaactgtgagaaataaatttctattgtttaagccacccagtctgtggtattttgttatgaaagcccaaggagactgacccccaaagttaatgtcaattaatcagggtgaaattatttct

SEQ ID NO: 1063 - DNA, 26283 bp, Homo sapiens
tccacctttcccgattctgagtcacaaggtcccaagaagaatccaaaaatccggatttttaattagtacacactttgagaaactgccctttttatttatttaattaacttatttattattatctttttttgagatggagtctcactttgtcacccaggctggagtggaatggcgcaatctcagctcactgcaacctccgcctcccgggttcaagccgttctcctgcctcagcctcccgagtagctgggattacaggcacgtgccaccatgcctggctaatttttgtatttttatagagccaaggtctcgccattgcactccagcctgggcgacaagagcaaaactctctctcaataaataaataaatagtctaattcaatggcatttagtatactcacaatgttgtacaacaatcccctctgtctacttccaaacatttggcttcctgtattttcaataacagataaatttttttaaattgtctttcttaaggccgggcgcagtggctcacacctgtgatttgtaatcccagcactttgggaagccgaggcgggtggatcgcctgaggtcaggagttcgagaacagcctggccaacatagtgacaccccgtctctactaaaaatacaaaaaattagctgagcatggtggcgggcgccagtaatcccagctactcgggaggctgaggcaggagaatcacttgaaccctggaggtggaggttgcagtgagctgagattgtgccactgcactccagcctgggcaacaagaacaaaactccatctcagaaaaaaaaaaaaattctttttgctttttaggttcatacactaggaaaattttttatatttattttcatgtagtcagttataatagccacacaaaaaaaaaaaaaaaaaaaaaaaaaacagcttatggccaggcgcggtggctcatgcctgtaatcccagcactttgggaggccgaggcaggcggatcacaaagtcaggagatcgagaccatcctgctaacacggtgaaaccccgtctctactaaaaatacaaaaaattagccaggcggggtggcgggtgcctgtagtcccagctactcgggaggctgagcaagagaatggtgtgaacccgggaggtggagcttgcagtgagccgagatggtgccactgcactccaggctgggtgacagagcgagactccgtctcaaaaacaaacaaacaaacaaaaaaaccagctgattgggtgttttgtcacaaagcttttggcccttctgttttctcactacttgacacttccttttctttccagcctatacttcaaggtcaccatatcaacccctatctcatcagcacactccaccctccattcacaatcctgttctcaatccacagcctggatccatccaactatctcccttctctgctctgaacacaggggttggtgctcatacaaccacttgcttgttcattcaacacattttgtttttgagacagagttctcgctgtgtcacccacgctacaatgcagtggcccaatctcgactcaccacaacctccgcctcccgggttcaagcgattctcctgcctcagcctcctgagtagctgggattacaggtgcccgccaccccacctggctaatttttgtattttttagtaaagatggggtttcaccacgttggccaggctggtctcgaactcctggcctcatgtgatccacctgcctcagcctcccaaagtgctgggattacaggcatcagccaccgcgcctggccaacaaacttttttgaactcattctaggtaccagacactaggtatgaatctggggctgctaaaaatatatggtctctaacccaaggtgggcccccaacacccgataagcttttgtctctctccatgtccctggttacctccctctcctgctcccatcctatgcactaattcttttttttttttttttaaggtggagtttcactcttgttgtccaggctggagtacaatggcacgaccttggctcactgcaatctctgcctccccggttcaagcgattctcccacctcggcctcccaagtagctgggattacaggcgcccgccaccatgcctggctaatttttgtatttttagtagagacgaggtttcaccacgttggccaggctggtctcaaactcctgacctcaggtgatctgcccgcctcagcctcccaaagtggtaggattacaggcgtgagccaccacgcccagctacctacgcactaattttctaccttcctcatgctcaaagtgacttctgtttttcacagagattaggcaatgaaggatgaataatttcaatttcccacctcctactgacaaacagtgacatctacaccaattctcctacacaaccaaggttaagatgccttctccagttcaaagctaatccctccacctgtgctcagattgctgtcctcccacctccattgagaccttgattcaccaaaccacacccctctcctacctgtgtctatggctcttcctccatggtaaataagcccacataagtctattccatttaaggaaagaggagggaggaagaaaaaaaagaggaagaaggaaaggacaaaccaaacaaaacactctcctctacacttacgtctcttttttatttcctctcttctttggttttgttttgttttgttttttgagacagattttcgctcttgtcacccaggctggagtgcaatggtgagatctcagctcactgtaacctccgcctcctgggttcaagtgattctccagcttcagcctcctgagtagcttggattacaggcacccaccaccatacccagctaatttttgtatttttagtagatacagggtttcaccatgttggccaggctggtctcgaactcttgacctcatgatccgcccgcctcggactcccaaagtgctgggattacaggcatgagctactgcacccagccctctctcactcttcattctttctttactttttgttttcaaagttatatatacatataaagaatcagatagtactacaagacctattacaataaaaagcagacccttcccactctaatttcctcctcctcagaggcaactactttcaccaccttttttttgagacagggtcttgctctgtcacccttggcatgatcacagcttactgcagcctcctcgatgccccaggctgaagagatcctcccacctcagcctcccaagtaactgggactacaggtgcaagccaccatgcccagctagtttttttaacttttttgattattttattaatttgtttttttgagacagagtctcactctgtcgccaaggctggagtgcagtggcactgtgtcggctcactgcaacctccgtctgctaggttcaagcaattctcctgcctcagcctcccgagtagctgggattacaggtgtccaccaccatgcccagctagtttttatatttttagtagagacggggtttcaccatgttggccaggttggtcttgaactcctgacctcaggtgatccacccaccgtggcttcccaaagtgttgggatgacaggcgtgagccaccgcgcccggccagtttttttattttttgtagagatggagtatcctcacgttgctcaggctacacctggcctactttcaccacctttagatgtttattttggcatttacctccctatctctaaacatgcttatttggcaacttcatgatttttgtttttgtttgttttttttgttttgagagagggtcacgctctgtcgcccaggctggagtgcaatggtgcaatctcagctcactgcaacctccgcctcccatgttcaagcgattctcttgtctcagcctcctgagtagctgggactacagatgcgtgccaccacgcccagctaatttttgtatttttagtagagatggggtttcaccatgttggccaggatggtttccaactcccaacctcaggtgatccgccagtcccggcctcccaaagtgctgggattataggcatgagccaccacacctggcttgtgtgacagatttttttcattacttccctcatggtttgatttttcaagggtgttttgtttgtttgtttgttttgtttttgagatggagtcttgctccaaattgcagtgttactgataccttctagtcttctgaaaataatgtttgtggaggaagggatcaagaaatgtagcaccatcatttaaattccctcaggaccaaccctactggacacataaacaatagcaacaacatctactttcaataaaatgttggcattgctctctgccaattaccttgagagcctgactctggaatgaaaagctctataccgaccctggccttgaactcctgacctcaagtgatcctcccgcctcgacctccaaaagtgctgggattgcaggcataagccaccatgcccagccaaggatgctttttcggattcaatcatgttttatactatctcttacctaaaagcttcaacagttgtccccacctccccctttttattttggtttctgtctttcatgttagaaagtttctttacatacctagaaatttttgctttctgctcacatttaagagcgggtgcttagcttgacatggtggctcacatctgcagtcccagctactcaggaggctgagacaggaagatcacttgagcccaggagttcaggactacaatgacctatgattgcgccactgcactctagcctgggtgacacagagaggccctatctcaagaaactaaaaaaaaaaaaaaaagagtgaggtgccaagaagttgactagaatttccatgtacacagttgggacttgccaactgtgagtttcagtatgaggtgatctggccaactgactggttggagaacccctgacgttcacatcgtaaggtcttttctcacttaccaaattccccagagaagagtcttccagtctcttacctggaaagtataagccttgtgctggagttctggaaactaccactcactatataaactttcgtttttgtttttgttttttcttggatacagggtctcactctgtcacccaggctggagagcagaggcgtgatgaggactccctgcagtctcaactcccaggctcaagcaatcctcccacctcaggcccctccaagtggctgggactatttttatactttttgtagagttagggtcccactatgttgcccaggctggtctaaaactcgtgggctcaagtgatcctcctgccttggcctccaaaagcgctagaattacaggcatgagccaactcacctggccctaaactttcacttaatctctgtttttcttttttggagactgagtctcactctgttgcccaggctggagtgcagtggcacaacctcggctcactgcaacctcctcagcctcccaagtagctgggattacaggcacccgccaccacgcccggctcattttttgtatttttagtagagacgggggtttcaccatgttgcccaggctggtctcgaacttctgacctcaggtgatccacccgcctaggcctcccaaagtgctgggaatacaagcgtgagccaccgcggccggcttaatctctgttttcaacgcagtacccttgccctcaactgtactcaggtgctctctaagctaaaaaacctgttttccatttccgacaaactccagtattctgatgggttgggggagatcggttgccaagatatatagagtcaataaagagatctggaggtctaacttcaaataatcctcctaattttagtaccactttcaccccagctgtaagcgatgctactaatttcatggtaaatcaggttgcttgtaagctttctttgctgctggcttagttaccacctcactgcaaaatgagtctgttttccagcatctgtctaaagttttgctattaactcctctccctttgactcctttttaaaacaactttaggccaggcacagtacgctcacacctgaaatcctggcactttgggaggccaaggcaggaggatcctttgagtccaggagttcaagaccagcataggcaacacaatgagaccctgtctctacaaaaaaaattaaaaattagccagatgtggtagcacacatctatggtcctgactcttcagaaggctgaagtgagaggtcacttgagtatgggagtttaaggctgcagtgagccatgactgagccactgcattccagcctgggcagcagagtgagaccttgtctcaaaaaataaaattttttaaaaaaagcaactttctgttattttattagcatttagggaaggattaagtcaaatgccagacccatcaagttttttgttttttgaggcagggtcgcgttctgtcacccaggctggagtgcagtggcacaatccatggctcactgcagcctcgacctctcaggctcaagaaatcctcctatctcagcctcccaagaagctgggaatacaggcatcagccaccaagactggctattttttttaatttttaatttatactttttaaaaaattatttgaatttatttatttattagagatggagtttcactcttgtagcccaggctggagtgcaacagcgcaatctcagctcaccgcaatctccgcctcccaggttcaagtgattctcctgccttagcctcctgggtagctgggattacaggcatgcgccaccatgcccagctaattctgtatttttagtagagacggggtttctccatgttggtcaggctggtctcgaactcctgacctcaggtgatccacccgcctcggcctcccaaagtgctgggattacaggtgtgagccaccaaacccagcctttattttttaaatataggagatggggtctcactatattgcccaggctggtctcgaagtccttagttcaagtgatcctcccacctcagcctcccaaagagctgaaattacaggagtgagccaccatgcccagcccccaaatttttttataaagacagtatctcactatgttccccaggctagaccattcagtttaactgagtctaaccttcatgtgctaaccttgggcaaactagtttcattcttgataatctactataaactgttacaaacgatctttccaaaaaaggtaattctggtcataacacacttcttaaaaaccctttaaaggctcaaatgtcttcagactcaagtccaaagtacatagcttgcaagccttttcctgattccgctcctctctccagcctcaccattgtcatacctaacccccaccacgctccgttcactccaggcaggcagaatcccttgctggactccacatgcgctgttcccgtcacagcaccatgctgttgcctatgccgtctcccttttccactacaagctttcatccacgtagttcacctttaagattcagctcacgcctgtaatcccagcactttgggaggccgaagagggtggatcgcttgaggtcgagttcgagaccaacctggccaacatggtgaaaccccgtctctactaaaaatacaaaaatcagccgggcgtggtggcgggcgcctataatcccaggcacccgggaagctgaagcaggagaatcgcttgaacctgggaggtggaggttgcagggagggagatcttgcgactgcactccaacctggacgacagagtaagactgtctcataaataaataaacttgtgtagaataaactagaggccacagacagtgtcaagaagatggacaggtctgaatggcctcgggctaggggatattccactgtcgcctctgactacgggtggtcctgtggctgaggcgcagcgggccctgggagttgtagttcatcaagcggaccgaggaggcgaggctgcgctgagcatcctgggaatcgtagtgctcgctacacggtgccctctgcgcaggcgcacaccgagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggttcgggatgcgacaacctggacagcggggagcgaaagcgtgaccgggctgcactggcagcctgacctgggacttggagcagggttggggagggaatcctacgtgcgtgcgcagcgaaagggcgggactgagaggggctggcctagggagaggctacactggcagtctccgtgtgtccccgccctctctccgccctggcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtcggtgtgtctggggggttctgcgagcgaaccccagctctgggtcaaagcctcaggcttgggtgatccagggtggagcattaactgggcaggaccagacctccccagccggccatccagagcgggtttcttcctctaaaaggaaagaatgggccgggcgcagtggcttgacagagttcgagaccagcctggccaacacggtgaaacctcgtctctactaaaaatataaaaattaggccaggctcggtggctcactcctgtaatcccagcactttgggaggctgaggcgggtggatcatctgaggtcaggagttcgagaccagcctggccaacatggtgaaactccgtctctactaaaaatacaaaaattagctgggctggtagcgggcacctgtaatcccagctacttggaagggtgaggcaggagaatcgcttgaacccaggaggtggaggttgcagtgagccaagattgcagcactgcactccagcctgggtgacaaagcaagactgtctcaaaaaaaaaaaaagccgggcttggtggtgagtaccggtaaccccagctacttggaaggctgaggcaggagaatcgcttgaacccaggaggcggaggttgttgtacttagccgagatcatgccattgcactccagcctgggtaacagagcaaaaactctgtctcaaaaaataataaataataaaatgaaagaattaaaggtggccctgcatacctcactgggtaacatcacatgtgcctagcagaagatgtgtaaataatgctagaactacagaactttgtcactggaaacttggcctgacctccaggccacgaggtcccaaatccttatatcctgagaagagggacaggattgagaaggttctgaaatcgtcgcagggaccactaccattactaatttttacggtgtgccagatactctgcattactttatctaatcctcaacaactctaggaagtagttattgtcacccccattttacagacaagattaacataagttaaatgatttatttacccagctaccagatggcctaacaaattcaaactcagggaagaaatgagacgagacctgatgcctggttggagttagggtaaaggagatggtgctccattgatagtctgtcttgtaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggacaaaggggcaaatggtgggcatggaaaaactgaagcccgagcctgcccacagctatgctttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaaatacatacttcttcattcggagagacaaaacaagaactagagttttaatgataataaaagcaataataataaaagcaataacaataaaaacaagatcagactctcactggggtaggcaagggactgaggaggtgaaaccaacccgtatggtgtcccagcacggcacctgctaaggagggagggtgggaaagcccaggccttcgctgcgggtacaggaggatgcaggagagggctgaggtgggggaggaacaactggtgtactgggagagagatttgggacgagggggaaccatcagcaaaaaatgaagccaggaatcacagtaagggcgcaagggctgaggccagttgtttccataaagaagactcaatcattacaaaaataatttttagtagttaaaaaacacacatagggccaggcatggtggctcacacctttaatcccagcactttgggaggcctgggtgggcagatcaccaggtcaggagttcgagaccagcctggtcaacatggtgaaaccccgtctctactaaaaatacaaaaaattagccgggtgtggtggtgagcacctgtagtcccagctactcaggaggaggcaggagaatcgcttgaacctgggagatgggggttgcagtgagccgagatcatgccactgcactccagcctggatgacagagcgagactccgtctcaaaacaaagcaaagcaaaacaaaacaaaatacacatagaatttgtccaagttattatcacccagtgtgaaaagcagattttatagtataaccgtttttaaatgaggggcctaagagagggcagtggctggttagtcctatgttagatattaacaaatacgtgtaggctggatgtggtaggtgacgcctataatcctcgcaccttcagaggccaaggtgggaggatcacttgactcaggagttccataacagcctgggcaacatagagtccgtctctaaaaaacaaaaaacaaaaacaagtatgtatacagtgcctaccatgttgtcaggggtcagtctcctttattacactttttgtaagaataagccacagtttaccctcacaagcttccattcttggctcaggtattagagtcaggtgccacaggtatataatgaaccggcagatctggaaaggataaagaaattgagagatgagctctgagatcaaggacagtgtttgggggatgatagcttgaactagggaatcagatgaagacatcaacactatgacctggcccacagtaggtgctcagtgaaaatttgtgaattgaatgactggccctcacctccctccacagcttcatctcccactagcttgctctagccatcttctccatgatgttgctccaagcactagtccttgtgcctgtggtggcttccttccctctccactgtctacagtccccgactgactgtcctcagagggcccagagtcaaccttgtgcagacaaccttgatacttgtgtgccaaggccaggtttccagccacctgagagccactgggtcaggatgcctgtcaggaaggctctgggtccctggggggagggttcaaaggtccagtttacctggagaggactgcggtgactgccccctcctcctcttgcacagcacataggaaagggctgcggtgaggatgaagatgatggccaggaggcacaggactggcactgtggctgatgtcctggctgtgggaccagcatttttttccggctgcttctggttctccccagcctcaggcccagctgccagactgtggcccgcagtgtgaatggtggtttcattgggacgagtgagctctttgtccgaggacagtgatcctactgggagggtggggcgctgagtggactgcaaggtggacaggagcatctgggcaggggtgtggatatctgaagatgccccctctgaggcctgagaaattggggggctggtaggaagtaaatgcttctggtgggccacaatccccgagtaagcatgtccacattctggaaaggaaagaaatgaggaatcaggactatcaggagacaaggtgaaaaagcagatagaggtgtaggggagaaaaagtaatatcttttcctcacccatcgcaagggtcaaggctgatacccctataaataaaaaacattaacaagagaaaagcctaacatttatttaatcacagttttacatgacataggaaccttcagaaacaaagacccgagaaaagtgcatttttatgcttaggcttgctgtgaagaatggacagctgtatagacgtatgattggattggccgggcgcggtggttcacgcctgtaatcccagcactttgggaggctgaggtgggtggatcacctgaggtcgggagttcgagaccagtctgaccaacatggagaaacccagtctctactaaaaatacaaaattagccaggcatggtgtcatgtgcctgtaatcccagctacatgggaggctgaggcagaatcgcctgaacccaggaggtggaggttgcagtgagccaagattgcacaactgcattccagcctgggcaacaagagcgaaactccatctcaaaaaaaaaaaagaagtatgattggacaaaaagggtatgatctaatggcaataaatggggggtgggggaccagcaaggcctgtccagattcttcttggcctccaagtatagggcaggacccatctgaaatgagagcctatgacctacttccacgtgaagttagagaattcctttatggccagctctcacagaaaaacagagcagagtgagctacttacttctgctgttttcgtaattaccaaggtgccatgttttggagtgtcatgttctgagctccaacagagggaagagtgagtcagggaggttatcacgctgaaggccagaagaggaaggcagatgacagacggaaaaggtaggggacaaggaagtgagcgaaccacgagacaagtgggtgtcatgaactgggaaatcagaagaccagggttggattccaagctctgctgtaaagtagctgtgtaacctcaagtagctgtgtaacctcaccccttgtccctaacctctccggaagtgatatcttccagctgtaaaatgaggataattgtagtaccaagggccagggttcctgggaggatgaaaggaaatcatagaggtctaggcagacttaaaggcagtatggatgacacagatcctacaaaactttagctaggacatggaagaaccttttgtattttaatggttgtatatttattttaagagaaaaatataaccaatgcatcaaacttgtgacttcacagatattattgcttaggataatttactatttaagttttctttctttttttttgttgcccaggctggagtgcaatggcctgatctcggctcactgcaacctccgcctccaggttcaagtgattctcctgcctcaacctcctgagtagctggaattacaggcacatgccaccatgcctggctaattttgtatttttagtagagatggggttttaccatgttggtcaggctggtctcaaactcctgacctcaggtgatccaccggcctcaacctcccaaagagctaggattacaggagtgagccaccgtcctggcctctacttaagttttcaaaactagtttgtgcacacttaaaagtaattcatttcattgtatgtaaatttgaactcaaaagaaaaaaaagcattaaaatattgaactctacttaatatacatgctgaaatgtcttgggatgaagtgcaatgatgtccacaatctgccttgaaatgcatcaagaggccgggcactgcggttcacacctgtaatcccagcactttgggaggctgaggcaggtggatcacctgaggtcaggagtttgagaccagcctgaccaacacggtgaaaccccatctctactaaaaaaatacaaaaattagctgggcatggtggcgggcacctgcaatcccagctactcggaaggctgtggcaggagaattgcttgaacctgggaggcggaggctgcagtgagctgagggcaccattgcactccagcctgggcgacagagcaagactccattaaaaaaaaaaaaaaaaaaaaaaaagaaatgcatcaagaaataaggtgatggatgatggatagaagaatgaatagatggatacttaataaagcaaatatcgtgtaattgctgtaaaattgatagtgtaaaatatatgtttatgtaaatatgtaaaatatacatatataaataaaattgtagaatctaggtggaggcactggatattcagtgtgccattctttcaacttttgtatatgtgtaaattttcataataaaatattggaaaagaaaaataggccaggtgtggtggctcacgcctgtaatcctagcacttttggaggccgaggcgggtggatcacaaggccaggagttcgagaccagcctggccaacatggtgaaaccctgtctctactaaaaatacaaaaattagccaggcttggtggtgcgcgcctgtaatcccagctactcaggaggctgaggcaggagaatctcttgaacctgggaggcagaggttgcagtgagccaagatcgtgccactgcactccagcctgggtgacagagtgagactccatctcaaaaaaataaaataaaatagtactttgatttcaagaaaaatattaataagtagacaatagcacacgtggtagaatgaattggcaaaactcatgaaggtgatggtgaatgatcaccccgtttggcaaacagggactcgagtctaagtactttggacaggatcagaagaaggttctaggaatgtgcggccccaggggaaaaggctcaggtaaagaaaactgtcaggtggaagctgctaagccctggaggcagagcctgaagagcagtggaaaagtctcacctttgagatcaagacagctcatcaattcctgaacccatgggtccttgttgcccccacacacgctccaggaaaggagctggaacctgcggaggagagacctgggcttagctgcggcgccttctttccttccccggctccttcctcattccagaggcgtgaagttgccaccaagaaagagccctttctcctgggactgggaaactccccagtaggtgagacggagtcatgaagtttcggggaatgagagcaaacggaacccggagatggggctcggtgagccgggaaggagttcaggctggaccagagagggtcctggaggcacctgcaaggaggggccgcccaggcgctgccctcgcagaggcaggtaaaattacctcgtgtagtatagacaccgatggtaagctctcaggtgtttccggagacgattcatgaactgaaccgatggcggggagtcggaagaaattcttttaccacaataacaacttccagtgacgctgccctcgttgccattgcctgcgcgggacggaggtggtcggcacccattcccaggcccagggtccccactccgctgttccctggcatccaatccacagccccatgacagcctctcggtggacccagggtcagagcgccaggctcaacccacacatcatcacgcccccgacaacatccataatcccgcccggagccaggcgtccccgggcctctgtccccaaccccaggcggctggctggctttcctcttgtccccgctgccttcatccactcaactccgtgggcctcgtgtcccctccccaactcacccccttcccgtgacaggggaatctgggtcccctgccccgcccccggctaacctggctgagtcaggtacaccagcaggagcagaagcaggagcaggagcacgcgggacccgggccgcaagtcccgtcccatctcggggctccgcggactctgcggggatggagccacctcgctctgactcccagacatgctccggcgcgtgacgtccagctggtgtctcaatggctttcgccggggaccggaggagacggcggccggagaggaggcgcgagccagctgcaccccccggccctgctgtgccccgaccgtgcgctcagtactcggcccgcgccatgccagcctctggacgcagggaaagccgaggaggtggagctcccgcgccctgcgcccccgcactgggcccggctccgtcgagggaaggccaggaatcttggaagaaaccgaaagaaaactccggcggcgggcgaggaggggcgggaggacgacggcccgaggagccgattcggttcggttcaggaggccgcccgcctggcccgtccgccgacctgtgaggcggctgcactgccggaccggccctcctcctccgaggcactttcacttccccgatccgggcgccgcgggacccagccgcgctgcatgagcctcccgggcggcccggtggagagagtcgccgccagccccggccgcgcgcacctgcggggcagccacccgcggacgcaccgagcccggggggcgtggccgcccgctgagccggcgagggctcgggcagccctgacgtcacaaccgcacccgcgcaccctccaccgcgaggtatttaccttcgaaaagtggtggcggctgcaggtaccggaggagtggggcggccgggaggggctaggtctaccggggctgcccgccacgcagatccgagcccagggaaccccctcgctcccactcccataccccacagacgcatccaaaatgcttccctccccaccaaaccgttcccgataggattagccctctctcctctctagccttaatttaaactctgcttttgagggtgtgaactctccaattttaagccccaaataccatctcatccctgagtagtcttctccaaccctggtcacccactttcaagtccagcccccattttcctccctaaactcccatcctcagccctgaaaaatcctcttctccgctcctagcatatccacggatccaaccctaagtgactctcaaacctaccctctccctcaatttgtgacccagccccaaactccatcattgctctcctgtccctcaccatatatcccttcttttgctcagtctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtggtaagaacccagggctggccctgccctaccccttgcccagccatcctcccttcggaagccctcccctgccactagttctgagtgctggccttcaggccaatctggcctgaaaaggtgtttttattgacccacagtggggtttttttttttaatttaatgtttaaacattgcaagaaaaaaagtatccagaagtctggatttacacattcccaagaaaaatctcaagctctgacagtgggcctacatttctgcatggcagcgcattctggtcctctgtagcagctgtcccctttagaaggagcgtgccctctctacccagagccctttactcagtgaggttacttgcctagccccgtaggtatttgagtttggtactcctgaccctgaccacatttgtctctcgctgccccctaccacctcaacttttccctctttccccagaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcggtatagaaatctggtatctgaggctggggaggactcgggccctggattcccaagcacctcctccagcctgatgccatctcccccccaactgcatttagagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttggtgagcagccccaaagctgggggagaggaagaccccaataggcaaatagaaggaaggcagggtggtggggggcgcctagcagacagaaggagaggcagggacatgagaagatgcagaggaaacaatacagactgttacaggcggttagagggtgtaagacaaacagaccgagtgacatatgggcagctgctgggcagttgaacagcagacaggacctacagaggttaacactaggtgcccaccacccgctgtgtccccagcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctgccttttacctacaccgcaggtaccataaggaggtcagaatggttgggggaaactgggaccaggtctttgagactgggaattagatgtctgggaacagggtcctgcagttgaaggctgagtgtctggggctagagcctagatccctggaacaagggcaggggctgggtgtttggggctggagacagggtctctgaagccgaggcctgagtgtctgggtccctgagagcgtgcagggattgggggacagggattcaaacacttacttgcttcccagctccaccactaactgcagtgtgaccttaaacaaaccactttacttcttgaagcttccgtgtcctcatgagggatacggagaaggcccatggaattgttacaaggattatcttggcttggtgcctggtacgctggaggcactcagaaatggtagttcccggcctgactggaaccagacttagaaccagggtcctcgcgggaggctagggagagttcaaggctggggttctaggccgggcaatggttcacacccgtaatcccagcactttgggaggccaacttgagcccaggaatttgagatcagcctgggcaacatagactctgtctctacaaaaaatagaaaaaattagtcaggcatggtgcactcgcttgtggtcacaattctcgggagactgaggtgggagaatcgtttgagtccaagaggtcgaggctgtagtgtcccgtgatcacgccactgcactctagcttgggtgatagagcaagactctgtctcaaaaaaaaaaaaatgtctggggttctagcccagcacctcaactcctccccttctccttctccagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggtgcgtggggtctctccaggcatgggccccttggcctagagggaaggactgggaagaagttgtctgggtcccagatgatccctccacatacacactgacccctaccaacagcaccagggccatttcaggcctttcccagccctcaatggaatcacccctaccaactccacccagaaaccccatccctatgcaaacccccattcctcttactgcggctgtctcagggaatacagcccctttggaaggaagaaagagatgggtcaggtgggggtctccctgaccccaggcccctccttctttcatcctctcaggagacccctaccagcttctccagggagacgggactgccctgatgcctcctgtgcccccacatccaccccggggtgtttttggtgagctggaggggccctgtggaagctaggggtagggccagggactggagaaccagagcctgggtggctgtgaagaagaggtttgttagactagagggggtgggggtccagggccaggtcctctagcaaccctctcctgccaggctcatggcaggattactacacatggcggggcctcagcttggactcccccatagccgtgcttctcacctacccgctgaccgtgtactacgtcatcacccacctggtgccccagtcctgtaaggagagcggagtggggggtggagcaggatgggggagtgagagtggaccacatccttaaagcgctggtttttcacccagtccctgagctcaacatccaaaacaaacagtcactgaagatccacgtggtggaggccgggaaggagtttgaccttgtcatggtgttttgggtaagtcaccccaggcctgaaggttgggcattttggtatgggggtgggcacagggtagaccccagatctttctttctttctgtccttcaggagcttttggtcctgctcccccatgtggccctggagctgcagtttgtaggtgatggcctgccccccgaaagcgacgagcagcattttaccctgcagagggtgagggctgagggggccctgcttttcagccctgacccctccagtgacctcctggttgggtcctgcccttctgccccccactccccatcttgcctggtgcatcctccagttccctgacttccagtggcttttccaccccactcctggggcccctcaggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggtaaaagcctgggtctcagggttaggcatgtggggaaggtgggagagaagcccaccgtgggagccagcttctccctcctctctgtctgcaggatttaactccgggtttgctctcaaggatacgtggctgaggtctctgccccggttacaggtgggcaatgggggcaaaagggaacttctctcccctcctgcctggcccctccccatctccttttctgaaagtctctgggctctcctcctcttcaccatcacctgctccacaaacctggggagtgcccacgggtccccctgcctctctctgtgtctgtctccgtcctccccctgctcccctccgcccggtctgtccggggacctcggctttcagcccggtctgtcattctggctgctgggatggatttggggaggggcctctcagagcgactctcgctccaccccagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtaagggtctgcgaccctatttccttcctgacccttaacttctcttactctctggctccacatcctcgaaggcccacctctaccctagtccctgctgtcctggggccctcctgcccccagcccagcaacctgccttctctgtccccactactcgtcgcccccatgggaggtctcgacatcccccagcacacccctctttagatctagctcacggaatctccccaacccacaaaagaccccgcgaccctccaacagacccaaccctgagtctagccccacgccctggaactcagaggggcaagccccgccccctggtccctgaccgcccggtggagccccgccccctggtccctgaccgcgcccctgggagccccgacccctgggagcgccgacccctgggagtcccgccccgtggtccctgactgcgccccgcgcccccgcaggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaaccactgagtcatggatcttttgattacacgctcataattgggccattaaactgggaacgaagagaaagatttttttgtttgtttgttttttgagacggagtttccctcttgtcaccgaggctggagtgcaggggacacgatctcggctcactgcaacctctgcctcccgggttaaagcgattctcctgcctcaccctccggagctgggattacatgcatgcgccaccacacccggctaatttttgtatttttagtagagacagggtttcgccatattggccaggctggtctcgaactcctgacctcaggtgatccgcccgcatcggaaaaggagttagggatgacttactttcccccagacccttttagtcccctcaacggctgtcatttctttaactcacagtcagggattgtgaccctccttggtaatcccatggttctcctaattatgtgttggctagtcactttccagccccggtaaccctcagggaccggccccaaggcaaggaaagtggcttcttcctgggggcgggagaagcaatcaacctcctgggaccacacagatccttggtttggattcagtgaaaggccccagccacccaactccaccttttctcaccacctcgtattcaataatcaactcctgctgagctcttctgaaatcactcaagtccatcaaggtatgtccattcctgctgcaaactccaccgtatctcatcgccacattgcagcccagagtattcctcctcaaaaaaagacatctgagggccgggcacggtggctcacgcctataatcccagcactttgggaggccgaggcaggtggatcacctgaagtcaggagttcgagaccagcctggccaacatggagaaaaccccgtctctactaaaaatacaaaattagccgggcatggtggcacatgcctgtaatcccagctacttgggaggctgaggcaggagaatcgtttgaacctgggaggcggaggttgcagtgagccgagatcgcgtcattgcactccagcctgggggacaagagtgaaactccatctcaaaaaaaaaaaaaaaagaaaagaaaagaaattaaccgggtgtggtggcatgggcctgtaatcccagctactcaggtggttgaggcaggagaatcatttgaacctgagaggtggaggtggcagccaagatcgcgccactgcactccagcctgggtgacagagtgagactctgtctcaaaaaaaaaaaaaaaagacatctgacctcatttctccctcgcttcagtcccttcagtgacttcccttagctcttaacagtgtgggctgcccttaatgacttcagtcactgagtatagatagggaaaaacagaggagaaacctggcagataccaccttaaccaagggattaaggtgaacaattaagtcctgttgatgttactcttttttttttttgagaaggagtcttgctcagtcgcccaggctggagtgcagtggtgcaatctcggctcactgcaacctccgcctcctgggttcacgcaattctcctgcctcagcctcccaagtagctgagactacaggcgcacgccaccacgcccagctaatttttgtatttttagtagagacagggtttcaccatgtcggccaggatggtctcaatctcttgacctcgtgatccgcctgcctcggcctcccaaagtgctgggattataggcgtgagccaccgcacccagccctgttgatgttactcttaagtctctttcattttgtaacatacctccttggcttttattttttatttcatgacactgatttgacaagacacagaatcatttgtcccgtaaaatgttcctcactcaggagctggctgattacttcctcagggtgttttttcatgtgttcatttatcttcttcagttcctgtcaaccagtagttagatcgagatgacaaggttctgctgatgtggtccctgccaacctctgcaggctgatctcatgccatttccttcccctgtcaactctgcagccagatgcttctaaataaagacgcgctctctcactgtggaacttcccatgtgttttttgttttgttttgtttttgagatggagtttcgctcttattgcccaggatggagtacagtggtacaatcttggctcactgcaacctccgcctcccgggttcaagtggttctcctgcctcagcctcccaagtagctaggactacaagcgcctgccaccacgtgcagctaatttttgtatttttggtagagacggggtttcaccatgttggccgggctggtctccaactcttgacctcaggtgatccacccacctcggcctcccaaactgctgggattacaggtgtgagccactgcacctggccagaacttcccatgttcttgctcaactaattcttagcctaggtggcagcctaaatgtcacttccttaggaaaggaagcatttcctgacccccagatgaggttagacacccctctccctattaagccctcatagcaccttgcatatgccctttgatgacctttatcacacaatttcttgtctaccctttcaacggtcaacccagaaggggtgggtgctacctctatcccccagggtctagcctggccgggcatatggcagcatacagtaggagctcgttaactgcttatcagattgctttccccccatactttcaaccctccctcctcatcttttctctcagcttcacctcctacagccagaaaggggaagcctgggtctctcgtggactgaggagaaatagaccttttcaccactccgttggccaaaaaataagcttttcctaactcctgacatctattacataacaataggaaaggatgtggttatctcccagtggtggggttactaaggatttgtttattcattttatttagctggactgctcatttttcttccatgaacacaagtgcttttgtaataaaaatgcttaatatacaaattgctctttaataattcacttaccaactattgattgaatacacaaggctttgtgccgaaccttagcgacgcaatggggaaaaaagacacataatggtctctgcctccataaagcttacagtttagggcagggatcagtaaactacggcttccagccaaatgtagcccaccttttgtttttgcatggctcgtaatctaataatcagatttcacagccgggctcatgcctgtaatcccatcacgcctgtaatcccagcactttgggcgcccgaggcaggcggatcacgagttcaggagatcgagaccatcctggctaacacggtgaaaccccgtctctactaaaaatacaaaaacaaaaaattagccgggcttggtggcgggtacctgtagtcccagctacttgggaggctgaggcgagagaatggcgtgaacccaggaggcagagcttgcggtgagccgagattgcgccactgcactccagcctgggtgacagagcgagactccgtctcaaaaaaaaaaaaaaagaagatttcacgagaaaattattcgaaattcaaattacagggtctataaatttatattgaagcagagccacaaccatttctttctgtattgtccgtggttactttctggatgcaaacggcagggtttgagtgccgcaattgcagcagaatccctatatgacctacaacgtctgaaatatttatgaacagatcctttgcagaaagtctgccagcccctag

SEQ ID NO: 1064 - DNA, 27761 bp, Homo sapiens
agctggagtccaggccaccctgggtgccagcctgcagcctgtcatttgtgagctgcaccatgagggctggaggccaggaaatggcgctctgtgcccccagtgtggggcacctcaagctagcatctgcagtgactgtctctttacggccaggagcggacaggtgagcccaccacagctcaacggccaggagcagacaggtgaacccaccacagctcacctgtggactgggaccaggcgaggtcccctctgcggctgctcagcccccggccacagccctaggcacctcagtctggagctgggtttgaactcgcaccgggtggcagtggaccccaggtgtggctacccatccctctggctcttggacactggtgcagaggggcctgtcctaggagggtgactgcccccatgtggtctagtggagaggatgtttggtcaggcagctgggaaggacggccttgctgtgtgacaggcatcgatgggcgtccacgccctccagggacgtcctgctccaggtggttggcactcacgttctcctcgctccccatgcagtgactagaaagcctgtgtgggattctggcaacggcatccgcccgccagcccctcccagggggtgccccagggcctctgccctctgcccgcagctcctcccccacagccacgcttccacccacccgttcggctgggctttgggtgggcaggcagacgtagaccctgcttggaggcggtggccctagagggatccacagatggggaaaaggccgagacacacgagaccactcctgccggggaaaacccatgagggggtgggggcggccgcgccgcagggaggggccctctgctgtcccagccaacgtcccatgacgattttgcacccccgccagcagtgccctcggctggacacacctgcgttgtgggcagccggcagcgcgtgacccactgtgcacctgcgccttgatgtaggggggagaccctgcagagagcgcttccttccgccctgtccagtgccctccctgcctcacccctcttcccgcaggcccgctcagggcgctgaagggctcctgaccgtgggtccgtccttcgctgcgtctggggggcgtcccccgcgctgcctctgacccgcccggccctgcgtttgtctgaagcccctcgttccgcatctccggaccagggtccgggggcgtggtctgctgggggcgggcccgggttgtggtttgagagccgctcggcctgtctgggcctccgcctccgggtcgccctccagccttcctgccgccgcttttccagtcttgcccaacccggtatttctgcgcttgcctcagccacccgcaggagcgcaggccgcccttcgtcctcccgtcctctgcgcccacaggaccccgggccccgcccagtccgcaggtcccgcaggtccccccgggcgtgtcttcctggccctgcgacccccgggacagcgctgagaacacgcggaaggtggggagacgcgcggcgctggccgggtccctggcgccgttctcgcggtgcagcctgtgcctgggagtccggccgtcccacctcagaaccagagcaaagcgggagatggggcggcggccgctggggagaaggcagccccgggtcggaggaggaaggaggcgggggcggagcggagtccgcggtggggctgccttcttccatcctcccctgggcggggcgcaggatgcgggggcgcccagccgagggagggaggccggggaggacactcctgtgcccgagggctccggcttcttctgctcactccctcctgccgaacttttccactcggccatttacctcctcaggcactggctgccctcatcaggccgaccaggtcctgcccgagggaacggcgtgtgtgacccacgtgtggacagacctgttccccatgccaggagggagggtcactggctccaccgggggatgggggacgagggcactaggccgaggtggggggcttctcgctctccccgtcttttcctggcgttttcctccattccctctggctcctattccctcccccttcctctctttcttgggtatggttgagcaggtcgtgcactgcacaaggactcccagcagaggacgaggactgacatcaatttgtctttccctcccaacactgtgcgttccctaaccctgcacgaaggcaccctcctcccctcctcaagattccccacccggcctggcctgcagccctagccccaagccgcagctgggcaggttgggcagagcactggggaggccaggcccggccatgctgagcccggtgactcgtcagggtttccacaaaacatcttgagcacccagctgcaggcccctcgggacgtttccaatgaggctcccctgggcccctctctgtggcagaagggaccccggggctgcttcgtaggtctcaacccaggggaggcccccagagactccggagccagggaggggcccagccccctacccccaggctgtgcttggcatgcagagattgcggggggtcttgagtttttgtccccagaagaatggctgagtggactctggagaaaagacaaacacccctgccccactgccgccgccctgtctcccaacagtaagagtgcttgtcagcctcctggcggcaggtgctgcggcctgcgaccacctgagccaggcaggtgatgctaatgcgcctcagggcagccctggcactggagctgctatcatcccactgtacccatggggagagccgctctcctccctcctttttccattctgtgttatttacagagcaccctcctgtatgccctgcactactctcaaccctgggtacacagatggggctgccacagacgtggccctcaaggcgctcaggccgccttttggggagggccgtgaggggctggaatttttctgagacagccaagcgcccgtgcagagaggcctgtatcagcccagcctaaggcagggccaacccacacaggagcacctgtcctgctggggatgcagtgggttctgctgtgtcctggaaaaggctctacccacaccctaacccaacctgtgaacgcgcgctcatttggaaaaggggcttttgctttgatgtaattagggaaaggatcttgagatggctcatcctgggttaaggcaggtcccacgtcctgagaaggggggagggattatcttttagactgggccctacatccaacaaccagtgtccttataaaccacagaagaggaaaaggcgggtgcagcagagaggccacgggaggagccgccagcccgggaaactgagggctggaagagcctccaggaggacccagccctgaacacgcccagctccacggcctcgtggaataaacttctcccatttcacaccccccagtttgtggtgcatggttagcacagccctaggaaaccagcacggatagtgagctccccgtcacaggaggtatgcaagcagagggtgggtgggcaggggcactgtcgggaggagcagccctggggactccagcaatctgtctttgattcctcccagactgttaaccctggggcacagcctccttcacccccagaggcccacagcagacaagctgagagccacacagcggccaagaggaggtgctggagggcccaggggtcccagtgctgcctcagccccacccgacttgggagcttttgtgttcagagagactgaggttttcagcttagaggacacctccgtggaacacatctgcaccgcggcaggggaggaaaggctgggggcacacaagcaccctccctcccgccctcaccccgaagctgaggggaccagggcggacagattcccccacctctgatgtggccaggggccctggggactccaggacaaccctcctcaggatgacgtcaaacccccggcattcaaaccttcccaagttctggctgcagctgtccctttccggggaaacaaaggcacctccagcgcccccacccccagccagcctcaccgatcaaggaggccaaaggcagctcccggccccgcttacataaagcttcctgtgtgtgctggtcacacctcacacctcacgcctcacgcctcatgcctcattcacacctcacacctcactcctcacacctccaactcagactttttagcttgaacttttttctcaataaaaccacagaagcccaggccgggtgcagtgactcatgcctgtgatcccagcactttgcgaggccgaggtgggcagatcacgaggtcaggagatcgagaccatcctggctaacatggtgaaaccccgtctctactaaaaatacaaaaaaattagccaggtgtggtggcgggcgcctgtagtcccagctacccggcaggctgaggcaggagaatggcgtgaacccaggaagctgagcttgtagtgagccgagatcgcaccactgtactccccgcctgggcgacagagtcagactccgcctcaaaaaaacaacaaaaaaaaaaacaacacagaaacccaacagagacctgaagacgtgcctgcctcccccatctccgggacctctcccacctgggtgaagggggcacgtgagcctcacctgatcttgaccatctcagctaaaacactgaaccacccttggcacccaccagcagcagacggagaagaactgtatagggtgcaaaagcgccccgccaccatcaggtccagatgaaaacctacaagttgaatcagcaaggtgctgacggatacgcaagcagaaaccctcttataggaggttcaaggctgggcgcagtggctcactcctgtaatcccagcactttgggaggccaaggcgagcagatcacttgaggtcaggagcctcagaccagcctggccgatatggcaaaaccctgtctgtactaaaaatacaaaaattagccaggcatggtggggggtgcctgtaatcccagctactcggaagcctgaggcaggagaatcgcttgaacctgggatgtggaggttgcagtgagctgggacagcaccatttccctccagctcgggtgacagcaagaccctgtctcaaaaaaaaaaaaaaagtttgagaatgtcagacaaggcagcaccctgtgtaggtgctcaggttgggcggagtctctctcgggggaggggggtaacaggacagcgcctcccggggcctccttgcatgtctgtgtcctgatgcacagcaggcgggggctgcggggaccagagaaggaagaagcgccccagctgggcacttcccgaggaggaagtggtgccggaatttcccccaggtgtggcctcaggtataagagcggctgctgccaggtgcatggccaggtgcacctgtgggattgccgccaggtgtgcaggccgctccaagcccagcctgccccgctgccgccaccatgacggtgagcctctccacatgccgctcggatggatgctgcttggatgtgcagcctggcatggaagggctggggttctctgagcctgggaggagggtgttgggatggggtctgggaaacccctcagtctgggggtaggggaggcagctgcagatcctcggagcgctggcatgctgggtgtcttgggctgaagggctagcctctctgggcttcagtttccccatctatagagggagggctgtactccatctttccgctgggaacaaggaaagctgaggtggaagtgaggtgccccctgccctgggcacctcctaaccacccacctgcctgtttcaccagctcctccccggcctcctgtttctgacctggctgcacacatgcctggcccaccatgacccctccctcagggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccggtgaggacctggggattccgctgtggcgtggggctgcccctcccctggcggggccctgactgcccggagagctctctgggccttggtggttctcacctgtcaagtgggcgtggccacctgagctccctccctccggccctcctgacctggacggctgagctgctgcttgcggctggccgtgccctgcctcccactgtcctaggtggccagggtcccctggggaaattctgggcccgtcacctgagctcctgcagaagtggggctgggtgatgaagtggaagggaggctcctagaggcctccggaccctgctctgtgctcttggagggccctggggagacgtggattaccaccacatgtgagcccgactgcaccccaagcccgtgtggctcagccctcgctgcctcaggtcctatcctgagtacacggagaggggccctgaggggagaggggcctccaggaggacagggtagggccagagactcactgtgcaccccgtcccgcagtgtggacacggatgaggaccgctatccacagaagctggccttcgccgagtgcctgtgcagaggctgtatcgatgcacggacgggccgcgagacagctgcgctcaactccgtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcagtgtgaccgccgaggccgtggggcccctagactggacacgtgtgctccccagagggcaccccctatttatgtgtatttattgttatttatatgcctcccccaacactacccttggggtctgggcattccccgtgtctggaggacagccccccactgttctcctcatctccagcctcagtagttgggggtagaaggagctcagcacctcttccagcccttaaagctgcagaaaaggtgtcacacggctgcctgtaccttggctccctgtcctgctcccggcttcccttaccctatcactggcctcaggcccccgcaggctgcctcttcccaacctccttggaagtacccctgtttcttaaacaattatttaagtgtacgtgtattattaaactgatgaacacatccccagaggccaacattcaatgcgacattctcccgttcagccctggtccaggccagccatggacccaattctggggtgtccttccagaaaggtctacgcagccgcgagcagtgcatgcaggtgggactgagctgtagcacgggggggtcacaggtgtccctgctctgcccacacagtgtctcccctgaggacacccctgggaacaggaaccagcctccttcctcaagcagtgccttgagccctatgctttgtaatgatgtgagcgcctaggggcaccctctcggcccccaaggcaagtctctgaggatgaactgcagggctgtcggctcaaggcagggcccccagccttcgtggttcggatcaacatccaaggccaagcgccctccctgatggtgaactagccacgcttcgggacccaggctctgttggagattttagttaaggggccccggggggagcagccccagtcgtggaaagggggcccaggcctgtgacagtctcagggtctcagtctctaggcccccggccccaagggctgacattgccatggggctgctgggcagttgttagcccctcccctgcctggccccctggctcacccacctactgcgtccaggtgcctggagatgggggtgggggtgctgcacagaagaacaaggactccactcagactcccaaagcaagaggcctcagggaagacttcctggaggtggtggcccttgtccaggagatggaattttcattcaacacatttattgagtttcttttctttcttgaaaaagggtctcgctctgttgcccaggctggagtgcagtgtggtatgacttcagctcactgccacccccaccttctgagttcaagcgatcctcccagctcagcttcccagtacaggcgtgcaccaccacacccaactcatatttgtatttttagtggaggcggggtttcgccatgttggccaggttggtctcgaactcctgagctcaagtgatcctcccacctcggcctcccagagtgctgggattacaggcgtgagccaccgcacccagccatatgagtttctactaagcacctggcactgggaacaggccgagaacaaaatggtgaaaacccttcctgcctccacggtgactaatgaaacaagtggtgtgtagtctgtgagtgagtccaggacagaggctctgggggaggggctgcagttcttttttttttttttgaggagtctcgctctggcccaggctggagtgcaatggtgcgatctcggctcactgcaagctccgcctcccgggttcacaccattctcctgcctcagcctcctgagtagctgggactacaggcgcccgccaccacgcccggctaattttttgtatttttagtagagacggggtttcaccgtgttagccaggatggtctcgatctcctgacctcatgatctgcccgcctcggcctcccaaagtgctgggattacaggcgtgagccaccgcgcccggccaaggggctgcagttctaagcagagggtcagggaggcctcgaagacctgaaggggaggaggaaggagccaggcagccatgcagggaacagctccaggcagcaggaagagcccatgcaaaggccctgagaagacacatgctgcgtgtgtccaagggtcagagagtggcctgcgtggctgatgccaggtgagagggggaccgcaggggcagggcagggcgctgggggtgcagatcatgtctgccctggggccatcagaagcttgtggctgtcactggaggtagctgagcctgtgggttctgagcctgcggattctgagccggaggcactggggtgaggctttgggtttcaatggcagcatcaggatggtttcaggggatgagggcagagcgggaggcggcaggtggcctgggtggggatggcccatgtagctggggtctggatttgggccaggattggatgtggggtgtgggggtttcaagggtgacctgaagcttggtgacctggggggacggctgagatgaggctggattgagacgtctgtatggtgccgagtgttggctggtggggggtggattctgaaggcccccaggaacagaggaccctggctctgaagtgtgagttgctgggagagcaggtggacaagcagcaggcaagggcttctccggcctcaggggagtgggtgccttggcgagagcccaaaggtgggggacgtggctgacgccgggcaaagctttgggggcaccgggctggggtggtggtgaggacctgtgggcaggtgtgtgtgcagccagccacagcctccgcacaagtgaggggaaggggtggccagaagcccctgcaacttggcctgagcgtcctgggcagctggggggccccccagcatcagtgtgggggcaaacaaggccacatccgccaccagcttcaccccagcttctacggaaaagaggcgcagggtagaggctcaccacgtggctccgaccctgttcccttttcacttaacgccagcggcctcctctggaatccaagccccttagggaggcgttaggtgtggagggcctgcagggcctgcaggagctgtcaagggaggactctgctgcctcctccaggcccgggaggacctttctagggaggcacacacctggaatccaggtactatatttcgtggaatatacggtacccgggatttcgtgtgctgctgagaaggaaggcgatgctgatgttaatgaaactggaatgcggcccggctggcaggaaacggggtgcctgcccaggcctcgggaaccatcgctaccccagccccgcccaccggccccaggcagaggctcacgcgctcccggcttcgctgcatttattgcaggtgggtgcacctggcgggagggcaggtccggggcgaggtcacacgacctcgtcggtcaccgggatggggttgacctggggacctcccgggggtccccccgccgccaccgcagcctcctcctcgctgggcttcttgcgggcctcggccgggggccgcggcggggggttgctgggcggctgcttgatggtgcctccgatctgcggccgctcccggggcttgggctcgatgggcgtccactgctcgccacgcacagccgcctgcggggcactgaagggttgagccgcgccccagcgcccgccctccctccctccctccctccccggaggcccaccccgctaggggccctgggacaggctcaagtctgaatcccacgcaggatggtgtgactgccactcagagaggttaagtgacgcgcccgaggccacacagccaggacctgggtcggcctgacaccagcccaagctatttcttcatgccaggagtggggcccgaacccctgggcttctggaagatcccgtggtggacactcccagatgcaaattctagtactcaaattctcctctcaaggtgccaagggcagggaaggcagggaggcaggcccgaggtccagcaggaggggtggcccaggagagtagcaggccctgctccgtctggtgggcgccattcacccacgctggccggcagccccccaagggtgcccaggcatttctgcacatgggggtggtggggggagagcttgaagaccacgggattccactggcttttactaaaaatacagactcctgggcccatgcccggaggttccactgcaacaggtcaagtggacctgggagtgtgtgcttttcatcttctatcccataatatctggtggaaaaatatgtcacatcatatacgtcatgaacagaaagagaaactggacatgtgtgatcctacctgactccaaaacggaaacattccattctgaaaagcaaaactagaaggctgatagaagaaaaggcaggaacgtgaaggcaggacccagggccagggaaaggtgttttcacaaagcacagaccatagagcaggtgaacagggaaacctctgctcttccgtgcagtgaaggactccacgcgccaagttaacagaccctcaccagaaagcatgaaggcatccccagtgtttaaaggttacaaaggctaaatagctaaaatatatgtggacttcctgcaacttaagaaaaagacaatcaggccgggcgcggtggctcacgcctgtaatcccagcactttgggaggccgaggcgggcggatcacaaggtcaaggagatccagaccatcctggctaacgcggtgaaaccccgtctctactaaaaataccaaaaattagccaggcatggtggcacgtgcctgtagtcccagctactcgggaggctgaggcaggagaattgcttgaacccaggaggcgaaggttgcagtgagccgagatcacgccactgcactccagcctgggcgatggcgcgagactccatctcaaaaaaaaaagaagaaaaagaaaaatacaaaaaccacaatagaaaaatgggcaaaggatttgaacaggcaactcaagggagaagaaactccaacagctcaaatccacagtcagagaagggcgagtccaagctccacacggccagctcgtgctgtgaaactggcaagcgtgggagaaagcctagtgcatggtgggagagatggggccacatggctggtggtgggttgtctgctgaggagcagctgagcccggcagggtgaacggtgcagaggctgatgcctgacccagcaattcctctctgggtttagcacaaggaattcctcccgaggtctccaggagccactagctgtgcgtggcagcagggagacgggggggatgcgggtggcccccggaaaacaaagcaacagcccagatgagcacttggcaacaggaaggggttctaaaggagagttctgccggtggcaggtcagtgaggcttgaaacagaactccacttccatacgcggaaggcgtacacagaaagtgctgcacctttcccacgcacacacactagaagacgcacagcaaggggagggcagttgcctctgcgggcaggagggacttggctctatggacaaaaggatttaaataagcaaagtctgagggctctgtccacccagagacccccgcagtgagaggtggcctgcagccgtctgttccggagcccagggcaggcagagggcatttcacccaaggcctggccaggctgcgccctgtcctcccacccatccctggcctctcagagagatcactgtatcccatgggatgggcagccttctaacagggtgcagcagtcataaaccaaacgcaggtgtcggcagtttaagaaaatgtctgcgtcctggcaccgcccatgaatcagcgcgaatagggtttaggtgagaaaagcctgataatgggacccaagcgcaggcacggtcttcggccggctgcgtgaccccaggccagtcacagcacctccctgagcctccgcatctttgtctgtaaagtggggaccccagtacccctcccagggctgtggtgcgggttaatgaggaaatgcaaggaaatgacccgacacactagacacgccaaaaatggcagcagcaaccgctgcgtccccgccgtgctgtgagcacacgcccaggctcacacttgctcccagccttggctcagcctacagagccggcttcaagggccatgcgtgtccgagggtgtcagggcaggggctggggatgggggtggccggggccgacctcagagggcgccactcaccagtaggtagatgccgctcgcaatggccaggcaggcggtcccaaggatggtggccagcaggaagccggcgggcaccgagagcctgggggacagcgggtgagaggcagggacacagaagggcactcagaaaggggaacggagccccaggtctgggggccaaggccacaaagtctcaggacaaggcagactgcagacccaggggacgtgcgcggaccggggcttgtttcggtcctgggtgttctcagccttgatgtggacactagcggctctggtgcacttgctcggaggaagcagccacgtgtgggtgtcctggcctcagccggcagtaaccagcagacacacagcacggaaccctccaccctaccaggaagcccaggcaagaccccccagcagtgcatgctgaccccagaccctggcgacggatcggagctcctcggatttggagtggatccttacaaatcctgcacactagacagcagacacaggccctgccagagccagggacccgaatttttgtttggaaaaacactgaggtaagtgggggtggctcctgtccaggcagcccggccggtgggacagtggggagggtcggctccaagccctcctgagccctagagggggtgcgggacggggactcacaggagatgcaggacggcccgaacatagtaattcctggtaaagggcccgaacagcttcaccacggcggtcatgtacttctgtcccctgggggagggaggaaggcgagacggcgcggctgggcctctcccactcgggactcctttgctgccctgctgaccaccccagggcacccaggcctctttcctcccacaaaacacaccgggcaggcaccggccttggtttacccacaagcaccaaagggttggttccggagcctccaagtgagaaaccaagctccacccaaccctgtgagccctgcctgggccccgcagcccccggagagaccccagagcaggaggagactcaccagcgctccatggtggagcccttcttcctcttcccccgggggtactccagcaggcacacaaacacgcccgccacactgaagccatgtggttaaggaacagcccagctcagcctgaggggccacagggaactccctttactgaagacaacacagagaggggcccgagcacggtggctcatgcctggaatcccagcattttgggaggctgaggcgggaggatcactggagcccaggagtttgagaccagcctgggcaacatagtgagaccctcatctctacaaaaaatttaaaagccaggtgcagtggtgtgtgcctgtggtcccagctactccagaggctgaggtaagagggtggcctgagcccaggtggaggctgccatgagtcacagctgcaccactgcactgcagcctgggggacagagcgagaccctgtctcaaaaaaggtcgggggcagccactgcctgaggtcacagagccaggaggcagccacgggaggttccaacaggtctggcactcggggctgcccacgccctccctcccaccaccctgcccagtgctccttgtcgcaaggtccggctgggcggcagggctgagatggggcagaggaggtagaggggccggtcaagggggatgactgacaggagcgggcagaggggatcccagcagtccaacagggaggcctcagtgctggccctggccctctggtgacaccccctgcccaccactcaccaggacttagactggcgggtctgccgctgatcgccacatggtcctggcgaggggcctggctgctggggcctgggctgcccaacccgtgcacagcccaccctgtgtcccagcctggctgcggtggtggggagcggaggcaaacagctcactgtgaagtggctccccagctctgccctgggcgttccccgcccaccccagcctcaggtggaaggatacatggagtaggcaccaaagtaccactgggtgaagcgcccagctgtggccacgatgcccccggtgatgaggactgcggggagaagtgggtcaggcactgtggggctcccgtcccgggggcctgggccaccccccttctctacctactgtgggccaccaggccacccagagctgccccctacccatccccacagcacagtgacagggtcggggacacccccaggaggcacccctctgcactggtgaagagcagagcctgtggcgcacgggctggcggagggggtgctggacatgcccgggctctgggtcccaggagtggccaaggacagcccgacctgcaggccccagtgggctctgggacccccaaatggacccccttgtcaccatgagtctttgtttgatgcactgaaagctaacaggccgagtgtggtttctgcatcttcttgggggagtgtctttttccccccgatacggagttcctcttaacccgtcagcggttttgccttaatttcggtttcgtctgatatggctatttctgcacatttttgggggggtattgtccaatattcccccttactgttttttttttttttcgagacggagtcttgctctgtcacccaggctggagtgcagtggcgcgatctcgactcactgctacctccgcctccagggttcaagcaattctcctgcctcagcctcctgagtagctgggactacaggcgcccgccaccatgcccagctaatttttacatttttattagagacagggttttcaccacattggccaggctggtctcgaactcctgacctcagggaatccgcccgccttggcctcccagagtgttgggattacaggcatgagccacggcgcctggtccttcctactattttatttctttttttttttttttttggagacagagtcttgccctgtcacccaggctggagttccgtggcgtgatctcagctcactacaacctccacctcccaggttgaagcgattctcctgcctcagcctcccgagtagctgggactatgcgcgcctgccaccatacccggctaattttttgtatttttagtagagacggggtttcactgtgttagccaggatggtctcgatctcctgacctcgtgatccgcccgccttggcctcccaaagtgctaggattacaggtgtagccaccttgccctgccagccattctgtttttgtctccacatggtcttgttggaagatttcctatccttggtttgagcccagctacacattaactctctgggtttgtctgtctgcgtcggaggaggggagggcagtgtccttgagtctactcagccaattgtccatgcatctttggggaccgtcctggtcccgagcctgccatccgaaagagggtgcaaagctgccgctggtgccaccagggaggtctgaggacgtattctggcacccagccacatttacagagcacctgctgtgtacaggggggactctttgtcaaggccctgctgtctccgggccagctgcctcctggggctgcacggtctggaaggacctccccaggcaggtggcatttgaattgagaaataaatgagacagccatgaggctctgcagaagcagcagcttgtgccgaggccctggggcacgctcaggagatctaggaacagaaaggaagcacggcagctggaggagggggccggagagccgggaggccagggcgggcagtgcagggcgtccagtctggctctaactcttcgggccaggagcccctggagggtttcagcaggaggccagactagagcccaggtctcctggctcccagctgggtgccctcagtccgtctacttcctgtagggagtgcggggcaggcagggtgagtctcacggggcagctctggggagagctgtctgaactgacccaccgacttcttggccgctgactcgaagcaggcggtcactttcctgggcacaggacaggctgcagggccccgtcctccagccctcccaccctgaggtctctgctcccactccagctgccacgcaccctccagacaacagggagggcgctcagagccccaggggagtggtggcagcgggcccctcctcctcaccctcagcccccaggcccttcccaggcactcctcccccggtgcaggtccttcctggagctgctgcagtggtgcctctgccctcagacctcgcctgagcccagcctcacccgtgctgggccagacactccctggccctggtcccgagagggtccatttccaaatggagtccgctgccctcaccagaacctctgagcaaatgcacaggagggtgactgggggctgtgccatcccaccccaagagcaaagtgcctgtgcagctgggctgggcagggccgtcactgggtggtttcggcgccttgtgaaatctcagaccgcctccagcgcagactccagatgagaagggctgagccccagggcatgagcccattccccaccccaagcccagggagagcgacctccaggccagctggctaccgaggggcaggggagcttctcccgatgcccaggccggagcccccactcgggggcttcggggcggtgaccccggaaaccaccggggctgaaccgcctcttcccctgcgctgcaacttcctccttcgcggagtcgggggaccgagagaagggaatgggggaggggcgccgcgctccgcagggtctgcaagggaattactgggggtctcagaactcctccttccagcccgcggcctgagggtcccgcccccgttccccgcaccctcctggcctgaccccggcccggcctggcccgcctggcgccccacttccccaccctgtaagtagcccgaggtcccggctggggtcttgggacacccctccaggctgcagcctccaccgtccctgacgtgcactcactcaggccggacgccagcgcctgttcgttggcccacatggcccactcgatctgccccatggcgacacgaacccggctgggacactgctaggcgcgcactgccgcccctgcgctcccggccgaaccccgccccgcccaggccccgcccccagccccccaggtgaccgcggctgggcggagacccgcatctgtagggtgcagggctgtcccggagccttctgcccccgccctctctagccacgccgaggcataggaggggccctgcccggcagccccagcccaggcggggagttcctgcgcttccccagggcttcccaaacttcagctctcaaacactgacaagtgcccctgcccaatgctccggacccaaccgagggtcccgtgtcaaccaggcgtctattaatagcaggacaaggtgtgaaggtcggcttcctgagcaaatcggcctctccagagccttggggggtgggggagtcacccctacagcccgggaacacctctgcaccctgatgctaccaaggacaagggtggcctccccatggggaccagaggcccagcccccatttcctccccctggctctgggctggcacaggcgtggcctgggtcagacactgcagggggcctcccgtcaccaggtcactgaactgtgactgagactcgagggaggggacaggatgtgtacaactgggaaagcacagaatgcagggacggccccgtcacgtccggcctgggtacgggaggcaggggctggcgtgggggtggtgagcccagcgcccatgggaagactttagacctggggttgctcctgagggtcccacctgagccaatgtggggtttgaggggagcccctctgtggctctgcccagcctgcccctcccccaggccctcatggggcacacctggactccctgacaggtgccagggtcactcagagcaggaaccccgggatgctggtttacgaaacagaaaaacggcggaggccggaggcagcaatgctggtttattccccatggccaccggggccgcactggtgcccactcctgccaccattccagccacacccaggccgtgggcagccaccctccgagacacctgggccgggggcagggtctcagcagaagcgccgtgggcagccaccatccgaggcacttggtggtttcctgaggcccaaggaggctgctcccagcacggtgaccccttccctggtccgctggagggaccacctccccactgagctcctttctcagagaactgggcatagccagagctggggtgagaaagcccttcagccctgctgcaccgaggctctgccagttctcataccccctccccatcccatcttggcaaagcgctggtgcagcttagggcagctgaagcactcggcggggacctctcctgacacctgggcggccgcaggactccctgcactgccccacagcaagctgcccatgggcccggggtcaagccaccacccacatgtcccaggagtccggccagcccaccacatccgctccctagctccggcgaggccaccccttctccaagcggcatgcggtccctgctgaggcagtcaggcagctggcttcggcaggccgtcaggacccaggaggtgggcgcaggggtcatccaggatttgaggccctggccccacctggggatagaaatccatgtcaggtcaccaggaatggcagcgcctcatcctgtgcccagcatctgtagggccggacacaggagggtagcggtgtgcccccgcccttcctgtgggtcctggtcagaaggtaaagcgcctgagtggtgacacccacacgcagctcctgcaggcacagccgcccctgccagctgcgagccccctgccctgggcactgcttctgtcacaggggggacagagaaccacagagcctgggaacaggcagcccctgagaggaaggtggcggcaatggcttgggcggccgtgatcactggatgcaagcttggccctcggagcaggtcagagggcaggaactccggtctgctggggtggttggggtgggggggtcccagggaccccagcagcccccaccccaggcgctccctattcaagggtctgatactccccacctgtctccctgggagcctgtgtcagactcaccctcccaccctcagcgcagccctgctgctctgagcatcaccagtggcctgtaatgtccactttgagagcaaatgaatggacaaaggcgttctggcttcctgcctgagacacggtagggacagggagccgcgcttagcctttaagggccctgggggctgggcgggcccccctggcaggaaaggaaaccccggggtactgggtgagccccaggcctcacctgagtgacaatgatgtatttgaccccaccgggggtcggctccatggccagcgcagcctgaagctcagctgagagaggggccggcctcacctgcagccccttcagaaacctggaaaagcagggcaggggcacggtgaatgcatccgtttctctaagcgtctacaacagtctacaacaggcaagtccagagatgggaagtgcattcctggccgtcagggctcagggagggggagacggcaggtggctgctgtggggacaggtttcttttaggggtgatgaaaaagttaaggaggtggcttgaggtggtgctcacatgaccctgtgaatgtcctcaacaccgcaggattatatgctctcgaatggctgagacaggaaattttaggttatgtggtaaacagctatgcccaggctggacccacatctggccaagggtgctgccaagccccatggggtaacagctcagggaagcgcccaattcaagctggtgcgttcgtcaccgtgttctgcagaacagcggaagcctgcaagccccacccggagcagcagccacgagcctggtgcttcccaggcgggcagtcctggggtgtgggtctgagtccaccccacagggcaggcccctgaccattagaaggtgttattgctcccacccgggacagacgcacatccccacacgcttccagacacccttaaatgggaggcgcctctcacattgagaataagacaccatgaaaacacgggagggaagaaatcaacagccccggggcgtaaggaggctgggccaagctgtgcaccgaggagggcgtacatgggggctctgtggcacccccacagagcagcgcaggggaagaggcggttcagggccaagctgtgcaccgaggagggcgtacatgggggctctgtggcgccaagatgcagctgccggaccccacccaagaaaagacacccaactgccggggcggggtcaacacccggccgccttgactggctctaactcgcttcagtaagaaggaaatcaggggctttgactcctttccttcaaaatgtcggacacttacgcacacatctgggagtgcaggcgtgtttcctaagccactgttctatagaataagagcctgcggggtcccgagctgcaggggacgctgtcactcaggaggtgggagaccctgggcgttgctcacacacgcgtgagcggcctctctttcttccctgtggacgtgggctgtgggatggctctatggggacaccctgcccgtggctcccacactcgggggactgctgcctgccctgggactccctgtctcagcgccacagccttcaggtgcctccgtctcttccgaccagagttcctggcaccatctcccaaaaaggaggaggggcggggtccacactcacgtgtctccattcgagcctgggggaaagccgtgccacacagcagccacaaactcagccacagtgtcgtccagggtgaagatcacggcattggggcccgcgtcaaaggtgtacgccacctggaacccacagcagtcaccctggctattcacgtggtgcctgacccttgtctccccaaccctctggtctgccaggcggccttgggctctccaagagctcagtctaggccctcagggccacactggagtggagctgtgaccccaagtgcctggtacttgacacgtctgcctgtgaacccaggaagaaggtggtggggccgtgacccgggcaagtcaagaaacaaaatgaaacagaagaacccagatggtcagtgagcttcgcacacagcagggtggagctttcagacacagattgccctgcacgcgagccccggggccgtctccacggcagcacaagcctagacacgcgctacagcgcgagcgcagcctctgccctcccggcccgcgtcaccttggtgtccccgtggtgggcgttgaagcggtgcaccaggtggatgatgcgccaggagatggcattgaggtaagagatgggcgggaaggtgtcgaggcaggtggcgtggaactggttgctgtccttcatggtcagctgggcgaagctggggaagtctcgctcccggatgcagcgggccatctccgccatgcgcgcgggcaccacggactcggcccggaactgcaaggcacagggtgtttcccatggagccgctgggggtctcgacagcagagggttcgaggagagactccggggttggaggcccggctcgagccccatctctgcatttggctcctgcacgtggtcttggcggggctgccgcaggtgtgagaacactcgggcccagacagaggctgagggcagagccgggcacaagcgtgactcccagggccccgggaccacccgctcctggccttacccgaagcagggggctggtctccacactggcccgcatgcccacggtactgcctgtcagcttcttctcagcgctcacctgcacgagggagagacagcctgggccacaccctgcagggggccagccccaaggacctcagcctcaaacactcggccctccctcagccaatgcaggcagcgggggtgggagtcagtgccacctgcctgaccacagaggcctcccggccacagcaggggtgacgcaggggcaacttccagatcccagcgggtggtggcgcccgccgcatgggagcggttcctgagcactcaaccacgcttctgttccttcagcccccgctgaccccaggagccaagcaaagcctggatggacgccttcgctcctgctcccggcagcagccctgactagggacagaggccaccgggctgctgctccacccgccccaccccactcaccacaaggatgagcacgcggagttcaggccagtgtgactcgggggccacttgccgagcgatgctgtccttcccgtcggcctgctctcccatctgccactccacaaagcccccatacaggctccggcaggcgctgcctgagccccggcgagccacttctgagaggtcactctccacgccgtagacacgggccagggtgtaggctgcaggcatgcggattcagggagggtcctcagagctgcctgcgctgtgctccctgacagctcaccgccccaggaacgtcccacaccccacggcaaatggggatttccagatgacagggcttctgggccatcagcctttgaggccagcattcaccggcccagccgtctgtcccccacctccgctagttccactctcggacactctctgttcacggcctgcagagcttgcggcccgcgacaagggcaacaaaaggtacctgcggcagagcaggaagccccatggaaggcgggagaaaggcccccgaggacacccaagctgggctttgagggtgggaaggaattttaaggctgtgtggggcagggaccgatgccaggacagagctggactccacaagacgcgccccctgcccacccagcacgggagccaccttctcccctcctcccacagggctccagcagggcaaccccacctccaggtctggtcacccaccctggtcaccgagggtggttcagggaaggcgcaggagcccaggtgggccaggaagcgtcacccctggagttgaggggtgaagatggtgtgagaccaccaccggggggacaggctctgacagtgggtgggaagctgccagcaagtggcctggggccagcagagagctgggtccagcggggcctgcaaccagctgtgcccattggaatcctcagttacgtgagccacaaaatcatcgctattttagggctgagccagtttgaagtggtttctatcactgacaatctagaggggctccacatacagcaacgggaagatttttttattttttgtagagatgggggggggtctcactatgttgcccaggctggtcttgaactcctggcctacagtgcttctcccccatcagcctcttaagtactgggattacaggcgagagccccacgccagctgcaactggaagatgaaaatgttcagatgtgctctgggaagagactgaacaactccagagaggccagggaggcctggggtgaggggatgctcttttagccacgcccagcagtgggctccctgacccgggaagagcatgaagtggctcctgcgcccacagcccagaacccctgcgggtctctgtgggcacccacctaggcaggcatagcccgccgctgaggaggccaggcccgcagccgtggggaagttgttcaccgatgccacgtgcaccttgcagctgaggctggagggcagcgggtccccatcccgtgagttcctccgcttccgggccaggcagcggactgcagagacaatgagacagcgtgtggcccagccgtcagcaccctgcccgccctgctcctgcccacctgcccggggtcacagctgaacaccaggcctctgcctgccagactcctcgtggagagtttcttacccgggaaaaccccagactgacccaagcccagctggtcattgaggtgggccactgccctggagctggcggcccagcgggcatgtctggttcccagccaccccgcctgctgcctcaggaggggcacagaggcagaagcactttctggatgctcggaccctgctgacaacagggagggatgggcttatggggaccccagctcactctcccgcaggcaggcctgcagccgcggctgccccacatcctcctcccggccattcagccaaatccggtcctcggtgaagtccttgctgatgacggctgttgtggtggtttttaactgaaaaggaaacccagggccacctcagaggccagcattgaggaccgatgccagccaggtacccctttctactgagagagcctcatggctgcccactcgagcaaggtcagccctgctgagggcagggggggaaaggccagtctcagctgggcagtggggaagcccgtgggggatgaaagcgtgggccacaccttgtggagcaaccaggccttatcctgaataaagagacggggactcccaggggagcccctggggcacggtgtgcgcatgtgtgacgagacctgggggcacatgtgtgctgtgctcagctctcctaatactgggagatggaacagacactgcgtgctggctgggagtcgtcgctaggccatctcatcctagcctttaggtaaaaaagtaccaattttttttttgtttcagagacagggtctcactctgtcacccaggctggagtgcagtggtgcgatcatggttcactgtggtctccaatgcctgggctcaagagactctccccaagtgctgggattgcagatgtgagccaccatacccaacgggtaccaactgttctacaaatgttctggaaatggcactgtggtgtttagtcgtcagtccacacatacctggtcctggtgcagagtgacgctcagggaggagttgatgggcagaaccagctcttcatcgcgcttgccccctgtaatgaacagccagggccaggccggtgggcttcccggcccaccctcccccagtgttccccacaggtgcccccaccccccacccacggcccccatccgcctcagtcccgtctctcaccgcacaacctgtgtgcccctcctcctgccagaccccggcctgcaagaactgctcccaccccactgagctcaggctcccagagcagagctggaggccagccaacctccgtccccgctccccattccttcatcgcttctactccagcatccgtgagtgcccaggtgcggatcgctcccaccgcggcctgcctcccctccaccttcccaaacaaaaggagcccagctctgagaactcctcacatctcactgctcatatgccccaggaacatccaggataaacccctttctgcccagcacggccatgggacagcacgtgaaatcaaacttccagaaagcccgaaaggaaacgtttgccctgggagcgctgcgtggtgcttcagctgaagtcttattccacggcggcttcgctaagcacaccatctgctcggttttgtgcgaggggaggtctctgaggatggcggacagttccaggggtgataaacgcggacacctggcagagaaccacgccctgcagctcgcgaggctctttcacgcacagcactgagcggccccccttgcaggcggacgccgctgccctgacaggccgggcgaacctctgctttcaggaaggtgggccaggggacttctcccgcttcctcccactggggacaactgagaccctggacatcacaggtgagactctcacgggtgacagagggcggctgtgggacagtgcagggggagcccggggctttcttttctgcttgccctagacctagccctgcagaagctggaactgccaaccaaagccagccctccctagcaggaccaggaagggcagcctagcaacacagaaacagactcctggccgggcgcggtggctcacgcctgtaatcccagcactttgggaggtcgaggtgggcagatcacctgaggtcgggagtttgagaccaacctgaccaatatggtgaaaccccatctctactaaaaatacaaaaattagccaggctgtagtgacgcacgcctgttatcccagctactcaggaggctgaggcgggaaaatcgcttgaacctgggaggcggaggttgcactgagccgagatggcaccactgcactccagccttactccagcctggcaacagagggagaccctttctcaaaaaaaaaaaaaaagaaaagaaaaaaagaaacagatccctcccacactccaggctggaacagtgccccgccccctttccctccctgaaggagtggggactttcacctccccaggagtcattggagagcacacgggagactggactcccctgacctgccggctcttgtcagaggccaagcagacactcaggaattcctgagggcctggtggggatgggacagcgttggtggggaggggaacctggacttctgcctccttatcttgagccagcaccccctcctccaccagcgcgctatcaaaaaccagctcaaacgtaaggtttaaagaagaccagagtctctgaacgttacaagaaaatggacacgtttccataaatatcactgttggtgagcctcagtggctcacacctacgatcccagcactttgggaggccgaagcaggcagatcacttgaggtcaggagtttaagaccagcctggccaatatggcaaaaccccgtctccactaaaagtacaaaaattagccaggtgtggtggcgcacacctgtagtcccagctactcgagaggctgaggcaggagaatcggttgaacccgggaagcggaggttgcagtgagccgagatcacgccattgcactccagcctgggtgtcgcagtgacagtctgtctcaaaaaaataaatataaaagtaatacaaataaatataaaaatataaatataaaataaataaatataaaaaataaaaataaaaggccagacgcggtggctcacacctgtaatcccagcactttgggaggctgaggtgggcagatcacgaggtcaggagcttcagaccagcctggctaacacggtgaaaccccatctctactaaaaatacaaaaattagccaagtgtggtggcacgtgcatgtagtcccaaatactcagaagactaaggcaggagaattgcttgaacccaggaggcggaggttacagtgagccaagattgtgccactgcactccagcctgggtgacagagcaagactctgtctcaaaaaaaaaaaaaaaaaaaaaaaaaatagcagaagagaaaatcc

SEQ ID NO: 1065 - DNA, 40051 bp, Homo sapiens
gatggctcatacctataatcccagcagtttgggaggctgagacgggcagatcacttgagaccaagagtttgagactagcctggccaacatggcgaaaccccgtctctactaaaaatacaaaaactagctaggcgtggtggcacacacctgtaatcctaggtactcaggaggcttaggcacgagaatctcttgagcccgggagacagaggttgcagagagccaagactgcaccactgtactccagcctgggcgacagagtgagatgaaaagaaaggaagagagagagagagagagaaagagagagacagagagagagagaaagaagaaagaaggaaagaaagagagagaagaaagaaaaagaaaggaaggaaggaagaaagaaagaaaaaagaaagaaaaagagagaaagaaagaagaaagaaagggaggagggaggaaggaagaagggagagatggatggagggagggaggaaggaaggaaggagagctagagatagaagaagaaagaaagaggaaaaaagagaaagaaagaaagggaaaggaaaggaaaggaaggaaaaaagaaagagcaaaaacaaaaggaggggagtggagggggatcacgccactgcactccaacctgttgacagagtgagactccatctaaaaaaaaaaaatgctattttatattttattttttgagatagtctcactctgttgcccaggctggagtgcagtggcgcaatcttggctcactgcaacctccaccaaccaggttcaagtgattatcttgcctcagcctcccatggagctgagactacaggcgtgtgccaccatgcctggctacatattttgtatttttagtagagatggggtttcgccatgttggccaggctggcctcaaactcatggcctcaagtgatccacccacctcggcttcccaaagtgctgggattacaggtgtgagccaccgcgtccaggctaaaaatgctgttttaaacactgggaagcacaggaaaagatgctcaacattattggtcattagagaggggaaggaaggggcgggggaggggagagaaggagaaatatttactgaattatgtctaggctctcttcaagcaggtgtcttagatgggtctccagaagcagattgagataaagagcctggtgttgggcctattgttaagtgtgagccttaatcggagagggggtgcggttcactgggaacctctagaggacagtgtagggaatgcactgagttattccaggaaaagggctggagggtggggggttgaaggattcatctgccagcaaccatcagtccttggttaagaaccaatcaatgagaggttaatttcccaacacttctgggcttgtctgagaggcagagtgagatccagctacaggaagctctgcagcaaagagacgttggcagttggaagacaggatagtaaatattgcaacagcaatatgcaaagagttacaggcagagctctaacagaatctactataattgaataaacagaacaagaacagacaggacaaaagagatctctctgccttatggaacttgcagctcgatgaagaagacaaacgataaaggattgcgtaccctatctgctttcaataaactaggaaacaaacactctctcagagcaataaaatgctatgacaaaaactgatcatgggataaaaattatctgggatggggggctgtttagatagaggaggaagagcttggatgaaaaggtgccatttcagccaatcctggaatcagatgagactcagtcacaaaagagctgggagaaaagcattccaagcacagggaaccgcaaatccaaaggctgtgagagaagaacagagagtctattagggaatcagaattgagcccagggcggccaagtgcagagagggagggagagcagctgggaaggaggtttgaggggtctgcagggatcagtggtgccgagtcccttatgctaagagataaatgtttgtagcaggatcttattgggagacattcactgaggtttccttcagctcccacccccttgcacttccatgtgcccccatcgctttcagaaaaaaaagaagcgcctcctatatgcacagcagagagggcaggcagagctcattcaatgagcacacgttagaattcttggccaggcgcagtggctcacgcctgtaatccccaactctttgggaggccgaggcaggcagatcaggaggtcagaagttcgagaccagcctgaccaacatggcaaaaccccgtctctgctaataatacaaaaatcagccgggcgtagtggcacgcgcttgtaatcccagctactccagaggctgaggcaggagaatggcttgaacccaggaggcggaggttgcagtgagccgagattgtgccactgtactccagcctgggtgacagagcaagactctgtctcaaaacaaaaaacaaaacaaaacaaagaaacaaaaagaattcttgccggacaggcatggtggctcacacctgtaatcccagaactttgggaggctaaggcaggcagatcacttgaagccaggagttcgagaccagcctggacaacatggtgaaaccccatctctactgaaaatacaaaaatcagccatgcgtggtggtgtgcacctgtaatctcagctactcaggaggctgaggcaggagaatcatttgaatccgggaggcagaggtcacagtgaaccgagatcacaccactgcactctagcctgggtgacagagtgagactctgtctcaaaaaaaaaaaaaaaattgttgccattgatttccaagatacacaaataacagtctcaaaagaccttttgagatctgcaagagccaggctttctgaggcaggaagtaataatggccacgtttatagtgcattttctataaagtggcacagctctgagccccttatatttagtccctgggatgagtctgacgtaggtgctgttgtctccattatatggttgggaaaccaaagcacagagaagggaattaacttgcccaagtcacacagcagagctgaggcttgagcccaagcagtccggctccagatcccatgcctttgggtggtgtttgcatccagtggtctggctttgaatctctagagccaaaagggatgaccctgaccctgacccccccaaaaatgggccagggaggcctgtgctgggaatggaggaggaacttagaggtgaaaggatggggatgcaccttccccccgacactcttatgagagcacctggcacacagttgggagggaggggtgctcaggtagcatctgctggacaggctgcctgtgcagcatcagggacccagaagagaaagggactcagagcctcaatattgccccttaaatccatcctaaaacctggtccctctcctgctcaagcacctcccatagctccttattgcccacatgataaagtccattgttgggctctgaacctgcgatccatgtggtcagccagagaggcagtcagggtcttggcttcagagaccctgccccacttccacccacacacaccctggatccttgcagtccccaagcagcccctgctggctttagatgagactcaggcagaggtgacaaacattttattcctgggaatctgcaaaggtgggtgggtggggttagggtggatccctgcaggcctcagctcagtggctccaccagcagctaaagtccgccctccgcatgcatgatcagctctggcttcctgccgggctccatgtggtgccgcaggaagcggaagcccagcagcgtgagtgccaggaccaccttcatctcggccacggcgaacacctgccccatgcagatcctgcgggcagatgagaggactctgactgtgcccaagacccgcatcctggccccatcctggcaccatcccccaaaccaggcacagctctgagaggattactgtctgcaaaatagaaaagcaatgctgcaaaatgaaataaatatacattagatatatagcctaagttatgtcacattcatttctctttgcctttagagttcatagttaaatttttcattccaaaatgatgaatattcccataaaaaagacaagtaagcaaaagtaagaaatagaagttatccacaatcccatgtcaaaataagcactgtaaatattctctcacacgtccaggttttttatttatatgtaatctttttatctgggaaaatgcttattaatatctaaatttattacatttacgtgcaatatttttgtttaaaaatgctattttaggctgggtgtggtggctcatgcctgtaatcccagcactttgggaggctgaggcaggtggatcacgaggtcaagagatggagaccatcctggccaacatggtgaaaccccgtctctacaaaaaatacaaaaattagctgggtgtggtggcacactcctgtagtcccagctactcggaaggctgaggcaggagaatcgcttgaacccaggaggcagaggttgcagtgagctgagatcacaccactgtactccaacctggccacagagtgagactctatctaaaacaaaaaatgctattttatattttattttattttattttattttattttattttattttattttattttattttattttattttattttttgagacagtctcactctgttgcccaggctggaatgtggtggcgcaatcttggctcactgcaaccgccactacccaggttcaagtgattctcctgccttagcctcccaaccagctgagactacaggcatgcaccaccacgcctggctacatattttgtatttttagtagagacagggtttcgccatgttggccaggctggtctcaaactcgtggcctcaagtgatccacccacctcggcttcccaaaatgaattacaggtgtgagccactgcgttcagcctgaaaatgctgttttaaacactgggaagcacaggaaaaggtgctcaacattatttgtcattagagacaagcaaatcagaaccacagtgtgatgcttcttcacagcccctaggatggctggaatctaaacatgggaaaataacaaacatcagctagtatgaaagtgaggctaagagaagaactgttttaagattgaggaaatatagcattatatgtattccaacaggaatgatcaaatagagtgtaggatacacggtcaataaacaaaactcaattatatttctacatcccacatatttcactgttacaggtaagaactctttggccgggcatggtggctcgcacctgtaatcccagcactttgggaagccgagtctggcggatcacttgagcccaagagttcaagaccagcctggccaacatggtgaaacctcatctctactaaaaatgcaaaaattagccgggcatggtggcatgcccctgtaatcccggctactcaggaggctgaggcatgggaattgcttgaacctgggaggtggaggttgcagtgagccaagattgcaccactgcattctagcctgggtgacagagcgagaatctgtcttaaaaaaaaaaaaaacaccaaaacaacaacaacaaaaacaaacaaacaaaaaaacaaacaaacaaaaacctgtttgcctaacctgtatatcccagggatacagaaatatttcaacccccgggacatagggattaggcaaagagttcttaaatataatggcgtaaaagtaatccacaaaaaacaaaattgataaagggtacttcataaacattaaaacctttcgctctataaaagaaacttcagggctgggctcggtggctcacacctgtaatcccagcactgtgggagactgaggcaggtgtgttagatatgagttctaaatttcttttcaaagaatcaatatgtcaggatgttcaattctttgccttctacttttaaatttaacttcctcataaagcagccttttcggattacctgttccaccctgactcattcctattacctactccaccgtgactcattctgattacctgctctgtcataaccatttttcccgccaaaccactcatcccaccactctctttaaattagccaatcggaattagtttagcctgtgtggtctaaccctagccaataggggaacgacacagcagcaggggccacatgcatcaaggataagaaccccttcccctcccttgtccaagtgtgagctcaccattgctccatctgtaagggcgcacccttctatagaagtacctttccttgctgagaattaaaaagaaaattttatattcgagtgatatttcttttgcggcaccaaaactttacttataacaggtggatcacctgaggtcaggagttcgagaccagcctggtcaacaacgtgaaacctcgtctatactaaaaatacaaaaactagcggggcatggtggcaggcacctatagtcccaaggctgagacaggagaattgcttgaactcaggagatggagattgcagtgagccaagatggcgccactgcactccagctggggcgacagagtgagactctgtcttaaaaaggaaaaaaaaaaagaaaagaaaaaaaacagataatgaaaaggctagccgcagactaggggaaaatacttgcaaatcacacatctgacaaaagacttgtctgcaaaatataatctataaagaactctcaaaatccaaaaataagaaagcaaacaacccaaggaaaattaatggacaaaagattagaacagacactttaccaaagaaaatacaaagaaggcacatgaaaagatggagaaatgcagactaaaatctctgtgacataccgcagcatacccacaaggaagactggaaaaaaaaactgacactatcaagtacaggtgagtatttggaggaactagaattctcataccaatacaggagctagaaagaaattattttggcagatagtgaggataagacagttatcagtaaggtttccttttcataaaaagcagcccccaagtcatttcttttctaacaaaaagcagcctgaaatatcaagctgcaagcacagataagcaagctggaagtttacatgggtaaatgccggcagctgtgccaatagaaaagggatatctggaagccaggtgtattcaacttggaggtttcctcttcccttttctttgtcaccatgtgtgtagtgaaaagcaggcaacaggtagaaaaagcaccggccaggtagagacccctatctgcataataaaagatcagggtgggatagccagcttcctcccatgctatgcaaacagcacacctggtctgaccaatctttcatgccctatgtaaatcaggcactgcctcctcaagcttgtctataaaaccccatgcgtttcaccacaaaaccacaagacccattcaggagcccctctttctctgcagaagagagagcttttctcttttctctcgcctattaaacctccactcttttttttatttttattttttgagatggagttttgctcttgttgcccaggctagagtgcaatggtgcgatctcagcttgctgcaacctctgcctcctgggttcaagtgattctcctgcctcagcctcccgagtagcacactacaggtgtgcgccaccacacctggctaattttttgtatttttagtagagacagggttttgccatgttggtcaggctggtctcgaacccctgacctcaggtaatccacctgccccagcctcccaaagtgctggattacaggcatgagccactgcgctcagcctaaacctcaactcttaagcttacttcttgtgtgtcggtgtccttgatttccttgatgtgagatgatgaacattgggtatttaccccagacaacaacgccacttcaatacattcctgataggaattaaaaatgacatggaccttttggaaacagtttgatagtttctcatcatggtaaacatacactgataatatgccccagccatcccattctaacagcaatgggaatttagtttccctgaagaacctgtgtacaaatatccataacagttttattcataatatccaaaaaccagaaacaatccacttgcccttcagccactgaacaaagagtgtcctatccatgcccagaaattctacccagcaataagaggaaacaaggttttgatacagacaacatgggagactctcagatgctttatactaagtgaaagcagcaagactcctaggctcccaatggcataaccccattcacacaactataggaagaaagcaaatctatgggaagacagaaaacagcagtggttttcaggggtcaggagtggaaggaggtttttgaccaccaagggtggctgtggcagtagtggttacatgactctagccatgtgtcaaaactctgaactatctcacgcctgtaatcccagcactttgggaggctgagggggcagatcacctgaggtcaggagtttgagaccagcctggccaacatggcaaaaccccatctctattaaaaatacaaaaattagccgggtgtggtggtgtgcacctgtaattccagttacttgggaggctgaggcgggagaaccgcttgaacccaggaggtggaggttgcagtgagctgagattgcaccactgtactccagcctgggtgacagaatgagactctgtctcaaaaaacaaactgaactaagcaccaaagaaaacaaattctgaaaatttaatgtgattttaagatgagccatgaaaatacaggagtggcaagtaagcacactcattgtaatgtaggcatgctaatatgtaattagggtgactaattacatatattgtttggctaaatatactatgaaaggatgcactaggtgtgaaagtatttacctttatacacatgaagaaactgggcagatgaagggcatatgtagcaccattacttctcactgggtattttattttttacacgagtgaatgtacttctggtcaacaatattatatttaaaaacttggggctgggtgcagtggctcacgcctgtaaccccagcactttgggaggccagggcaggtggatcatctgaggtcaggagttcaagaccagcctggccaacatggtgtaaccccgtctctactaaaaatacaaaaaattagctgggtgcggtagagcgtacctgcaatttcagctactcgggaggctgaggcaggagaatcgctggaacccggaaggcagaggtttcagtgagccaagattgtgccactgcactccagcctgggcgacatagtgagactccatctcaaaaaaaaaaaatcgggactgggaggaggggctcacacctttaatgccatcactttggccaggagtttgaggttgcagtgagctatgattgtgccactgcactctagcctgagagactgagggagactctgtctcaaaaagacaaaatgaattaaaaaagaaaaagaaaaagaaaaagaaacaaaaaacaaaacaaagcaaatgtaggcaccacctgtcaaagagtctcatctactcagtctagagtctgtaggggttcccaggtaatctgatgtgcctagggctgagactcgctttgaaaatcatgtccttgatacgataaggcatgacctctgatgccaactgctcagattcacccctgactccacccttcactgagtgaccttgaacaagtgagttcatctacaatctgtaagatcgatgtgaggatgaaatcagcatttacctgggggagctgaaaagtcaccttctcccttctcagtgatctacttctgttaatacgaccaaaatattcagtgtctgtggaatttccagatcataactgttctatgaaaggtgtctaaccacacctgtatcttacatgaatatttgtgcatctattgctgtgaaaatgagatctctaccccaaaagttacttgatgaagaataactcaatttgttactaatagtcaatgtatatgaagctaattcttacaaagtgagacaaaacacttttattttctaatatgatgtctttttttaaattaagactgatttgaacacttaacacacacattttgaggaccacaaaataatgtttcctaagatgatttaatgtcatggaaagatgctcacagcatattattatatgaacaacctggacagaaaaaaaatgtatgtgagataaaatagcaaatttttttgattgaggtagaattcacataccacgaaattcaccatttcaaagtgtccaattcaatagcatttagtgcactcacagtgtcgtgctaccttcgtcagtatctaggtccggaacattttcaccatcccgggaggaaaccccatactgattagcagtcgctcctcagtcccacctccccacagctgctgaaagccaccaatccgctatgcatctcttcagattggcctgttctggaaatttcgtataaaaggacagtacactatgtgaccttttgcatctgacgtctttcattcagtatcatgcattcaaggttcatccacagtgtagtagggatcactgcttcattcctttttatggctgtgtaatactccattgtatggatggaccacattttgtttatcctttcatctggtaatatatagcttggggttgttttcatcgtttggctactgtgaatagggccgccatgaacattcacgcacaagcgtctttctgtttgaacacttgtctcaattattttgagtagatatctaggatggaatacaggactgtggaacagggtcttagggtaattctaggcttcacttttgatgaatcaggggtcattttagtggggtcagagtgggtctctgcagaactcagctcaggggctccacccgcagccaaagtccgccctctgcgcgcaggaccagctccggcttcctgcggggctcggtgtggtcaggcaggacgcggaagcgcagcagcgtgagcgccaggaccaccttcatctccgccatcgcgaacgtctgcccgatgcagttcctaggggagggaggtgggaactctgactgcacccaggagccccatcctggccccatcaagccggtaacctggcctgggacacccaaccccacctagagcagtttgaggaatagagaagggggtatccgtgcctggatccccatgcgggcttgcatatcctgcaagcctagccgagctccaacccccagcctagaccaaggtggggtaggagggggctctgagcacaccacagacccttctaggaccaacccaaccgtactctatggaccttttcctataaactccagaggaggtgagggaaagagagctggaacttggaccatctacaatgtcccccttttccccactgtcatgcccagacccctgcacccatcaacccgttcccacctcagacacaggccgcccttacctgggccctgccgagaagggaataaaagccagaggtgacctctccttgatgttctctgggtcaaagcgaaaggggtcgtagacctggaggtgagaccaagaagggttgttgggtggggtctcccagtccgccagccttggagagacagacagttgtgtgtgtctttgagggaggtgatgttggatactcctgatcaaaaccctgccccctcctctaggagccttggaatggacaaaaacagagagaggggccccgcacctcagggtccggccacacagctgggttgtgatgggttccgaaaacactgatgaggcagataatgcctgtgggagagaagggagcagtcaggagaaggcctccttcactgaggggcccctcttcctacccaggagactcctccccgtgaggctgtgagcacctttggggatgacccggccgtctgggagcacaatgtcctgggtgacatggcgggagatgaccgggactgggggatgcagccgcaggctctccttcatgcacatggtcaggaagggcaaatgggccaggtcgtccctaaggaaacaccccagccccaatccttatcaagggagcaaagacacaattctccagcttctctctgtttgcaagtgagaccttttctccccgcaataaaataaacttttaacaagaattgttacaaagtcgcaagaataaaaatagtgtggcactgtggcaaaaatgagaaaacagacccatggaacatgagggagagctcagaaaaagacatgagaataagtgaaaacttcacatttgataaagacagcccctgctcaaaccaaaatcctgggaaactgatggattttacagttgtaaaagaaaaaagtggatcaatttaacttcacagaagttgaatatgctcaagatggtagtttttgcagataaaggatagtaatgaaaagtaccctccaaaagttgaaaggcaatattttgcaacccaagacagaaaaaaaaaaatcaattttggctgggcgtggtggctcatgcctgtaatcccagcactttgggaggctaaggcaggtggatcacaacatgaggagatcgagaccatcctagctaacacagtgaaaccccgtctctactaaaaatacaaaaacttagcggggtatggtggagggcacctgtagtcccagctactcgggaggctgaggcaagagaatggcttgaacctgggaggtggaggttgcagtgagctgagatcacaccactgcactccaacctgggcgatagagactgcatctcaaaaaaaaaaaatcaattttaatacacattcttaaaagtaaatatttttaaagaatccaaagaaaaagagcaaaaaaataaaggaaccacttccataaaaagaaacaaacatcaacacgtgaaagagatgttcaacctcactcttatttaaaacaatgtccatcaaaagaagaaatatgaagattggcatagattttaaaatttaataatacattagtagtattggtaaagttatgggaaaacttgtgccatcaaactcagctaataggaaaggatttgcaatgataattaaaattgtacagtgcaaatgttctttgattcagcaattgcacttcagggaatttgtcctgcagagatgcttatacatgcaaggaatggtcactgtgcacacatgctgactgcctcatgtccacttttagcaaaaggttggaaacaagccacatacacattgatgggaagatgtttagataaacagccacacgatggaatactatacagctacacaaaaggaggaaatagggatcactagtctcatcacattctgcaggctggaaggtaaatcagtacagacactgtggaaggcaaattggaaatatctactataactgaaaatgtttatgtgcattcaacataggaatgagctgaataaataaggaataaaatatttagcattcagaaaaaaatagcattaagacacactgtcgagtgaaaacaagttacaaatatatacatttgtgcacataaaaagggcaaaaagtatatgaatatatatttatgaaattaatgattcagagatagatgatagattgatagatgacagataataaataagagatatagagagatagagaatagacagatacatacatagatgatagaaacagagatacatagatgatatatagatagtagataggtatatagatacatagatagatgatggatagatagatagatagatagatagatagatagatagataacaaatctatggctctggagacacctttggagaatgagaaaggattaggtggggtggcaggattgtcaaggaaaaagctagtcttatctgtaatatctcatttggtgcaagaagaatctgttcttatcactggttttataatttaatgctcattttccatgtggtgtgtatatacaatggaataccattcagccttaaaaaaaaaaaaagaaagaaaacttattttgtttgccacaacatgaaagaacctggaggaacttatgctaagtgaagtaagctaggctcagaaacacaaacacacatgatcttacttatcttgggacctaaaatagtcaagctcatagaaacaggagtggaggtcgggcgcggtggctcacgcctgtaatcccagcactttgggaggccaagggcggcagatcacaaggtcaggagttcaagaccagcctgtccaatatggtgaaaccccgtctctaataaaaatacaaaaaaattagccaagcgtggttgcgggagcctgtaatcccagctactcaggaggctgaggcaggagaatcacttgaacctgggaggcagaggtcgcagtaagctgagatcgtgccactgcactccagcctgggtgacagagcgagactccatctcaaaaatgaaaaaaaaaagaaagaaagaaaagaaaagaaatagaagcagaatgatggttaccagaggccagggctgagggagggatagagaagggtgagatgttggtcaaaggatagaagcttcagttagacaagaggaatagtttttgagatctactgcacagcatggtgatttagtgaacaatgtattaattgaaattgctaagagagtaaatttcaaatgttctcaacataaaaatgataaatatatgaagtgatggatttgttcattaccttgatttaataatttcaggttgtatacatacatcataacatcacattgtacctctaatatatatatgttctcaacataaaaatgataaatatatgaagtgatggatttgttcattaccttgatttaataatttcaggttgtatacatacatcataacatcacattgtacctctaatatatataattaaaatttatcaatgaaagaacaatttaaaaacaaactcatttttgaaaactcgtattttaagaaaaatagatctcagagataatgtccagaactgcgtctattttgtatagttttctttacaaagaaaaacacagtatgtgttcatataaataaaaatcacagtgtgaattcatataaatgtgggcattgggatagccattttctggaagaatacacagaaaactgttgaccatagtcactgctaaggtggagcttaataaggaagctcatttttatcataaaattttttggaccctttcttttaaccacatccataattttgcttgaaatctggattttatactccaggacatgggtccaggcaaagattttctgtgttaagacctcaaaagcacaggcaatagacaaatgagattacatcaaggtaaaaagcttctgcacagcaaaggaaacagtcaacaaagtgaagaatcaacttacagaatggcagaaaatattctcaaattactcatctgacaagcgattaataaccagaatatattatataaggagctcaaataactcaataggggaaaaagaactcaaatcatcttatttaaaaatggtcaaaagatctgaatagacatttcttaaaataagacatacaaatggccaacagatagatggaaaaatgctcaatgtcactaatcatcagagaaatgcaaatcaaaaccacaatgagatatcatctcatcccagttaaaatggcttttatcaaaaagacaggcaacgatagacactggtgaggatatggagaaaggggaactctcacacactgttggcaggaatataaattagcgcagccactgcagagaacagcacagaggttcctcaagaaactaaaagtagaactaacatataacccagaaattccactactgaaaagaaagagaagaaatttctatcccaaagaaagaaaataaaactgttgaagagatatctatacttccgtatttattgcagcactattcaaaacagccaaaatatggaatcaacctaagtgcccatcaactgaatggataaagaaaatgtggcggccgggtgcggtggctcatgcctgtaatcccagcactttgggaggccgaggcaggcagatcatgaggtcaggagttcgagaccagcctggccaatatggtgaaaccccagccctattaaaaatacaaaaattagccaggcatggtggtgtgcacccatagtcccagctgcttgggaggctgaggcagaagaatagcttgaacccgggaggcagaggttgcagtgagccaagatcgtgccaccgcacttcagcctgggcgacagaacaagactctgtctcaaagaaagaaagaaaggaaagaagaaagagagaaagagagagagggagggagggaggaaggaaggaaggaagaaaggaaatgtggcatgtatacacaatggaatactatgcaccattaaaaacactggaattttgtcatttgtggcaacatggatggaactggaggtcactgtggtaagtaaataagccaaaaagagaaagacaaatatcgcatgttctcactcacatgtgggagctgaaaaagtggatctcatgaaagtagaaggtagattggtagaagggagggaggggtgaggagaagttgattaacgggcataaataagaggtttgataggagaaataaaacctagcacttgatagatcagtgggttcactatagtttacgatatgtactgtatattcctaaatagttagcttatgttagttatgtttctagcataaagaaaagactaaatatttcaggcgacagatatcccaagtacactgatttgatctttaccagttatatgaatgtattagattatcacatgtatttcaaatctatgtgcatctatttatgcagcaataaaaaattgtttgttaaaaatgcagaaaaattattggttttaaaagcagaaaaatgtttctcctcctcactggactgctgtgctgggcaaaggtgtggacgagaggacactgaatccaagacatccgtccattccaatgcttcctctccttcctccagcccctggcctggctctggtctcagaatgtccccactgtgccttcattctacagctggtcctctccagtacgccctccacactagccctagaaagatcttcctggtacccagatgtgacctgtccctacactgctcaaacacttcccatggctccctattgccattgggctaaaactgaagccattaacattttccccaaggcttccacagccagcccctgctaccatctccggttttatcatctcattacaactcagtctctccctctctctccccttctcctcctttctgtcctgaccctgctctctctctctctccttctctctctctccctcgctctcctctctctcttcctccctctctcttcctcccccaaagaccccaggcagtcttcttgacctagagcactgccccccaactgtacccaattatctactgatcattatttaggctctcaactgagacactttctataccccctagtcctgcttctcttactgtaaatcccatctctgcccatgtgggctgggagtgtcctgcccagggacagctccaccaccaggctgggagcacctggaaaacagatccctgggttggttccttcccaggtctccagagcacagaaagatgctgtgcacagatgtgggggtgaaaatgcagtgtgggagtgtttgctgaataaggatgggacggatgaacagtgcaagtgttccggacaagaatggatgaattttacccctaggtctcccttataaaaccctggactcgactggagagtaggaattagggaacagaagagcaaacattcaagaagtgaagatgttcaaaaaaaatgatatttctgggaggaaaggaagagagtggaggggaagttcatttgctgaacacgtctaagtggcgttatctgtcctcacatatcatcaccaactctctcagaagcccaggtctttctgtcctaagggcctataacctttccccagacagtcaggatgggtactaagtcctgcctgtggtcctctgctcctattcccactaggcaatagtggcagaatcaacaaaaacagcttttcctcccctccccacctggggagcagagccaatgagaaggtctcaggaagaggccacaagcacctgcactcaccattcaatctctttaggctcacggtccttcagaagttcttgcacctcctgccggcagcgctcctggtattctgggtgctttgcaaggtggtacaggacccaggagagaccactggccgtggtgtcatggcctggggggcagcaaggcaggcttgggtctctgggctgcttcagcacccgaaggtagacagcacccatgcattgagggcctcagggaggatgggggaagggggatgggaaggttgtgggggtctacccaccctgttcctggaagggagagatcccggtcccctctctagccccacactggggccctcaccctcaaacataaaggtgtcagcttctgctcttatgtcctcatcagataacttcttcccgtcttcatcctggagagaaggcagtaaccccccccaacccccacccccataaaaagtcacactagctctaagggctcttgagtctaatctgagacagtctctgaagattcatcctttttccagaaatccaagtccatcttgcactcctagacccctcttggtcaccatggccagagccctcacctcatggccttcctctctggcttccttgcctcctcttgggttcctactgggaagactcaatgacccatgaatattttaatgaaaagtttctgagaaaaagttactggcaacctgagttacaggagaattaaatggcaatttcccttggaaattagagattaagtattgcttcaaagatttgcccacattctagagtgataaatctagagaatcttatccccctggagacgtttgggttgtaaggctaaggactatggcatctcactgaagaggatttgtttatgctccagaacaaagcacaccatctctcacaaagctaccattctcactcaatctctctctctctctttctctgtctctctcattctctttcttgggaagaaatagaaaatgtgccaagactcataatgtagggcccctctcttaggatgcaaactctgctgcacatacaagtgaaaacattacccttggagaaatttgacttgaggatgaagagccagtgccacaatcccactctggctaacagtattgctgtgagcaagacatgggctgctctgatctagaggtttaatgcatctgtcacaatagacctacacatagacaaagacatagacacagacacaaacacacatagacaaagtcatagacttagaaactgacacagacacacaaatacacataaacatagacataacacagatatagacacagacacacacacataaagtcacagacttagaaacacaaacacacaaatacaaataaacatagacatagacacagatatagacacaggcacacacatatagactaagtcacagacttagaaacacagacacacaaatacacgtaaacatagacatagacacagatatagacacagacatacgcacacatacacaaaaacacagacttagaaacacagacacacataaacatagacatagacacacacacacatagacaaagtcacagacttagaaacacagacacataaatacacataaacatagacatagacacagatatagacacagacacacacacatagataaagtcacagacttagaaacacagacacacaaatacacgtaaacctagacatagacacagatatagacacagacacacacacacatagactaagtcacagacttagaaacatggacacacaaatacacataaacatagacatagacacagatatagacacaggcacacacatatagactaagtcacagacttagaaacacagacacacaaatacacgtaaacatagacatagacacagatatagacacagacatacacacacatacacaaaatcacagacttagaaacacaaacacacataaacatagacatagacacagacacacgcacacatagactaagtcacagacttagaaacacaggcacacaaatacacataaacctagacatagacacagatatagacacagacacacacacacatagacaaagtcacagacttagaaacacagacacacaaatacacgtaaacatagacatagacacagatatagatatagacacagacacacacacacatagactgtcacagacttagaaacatggacacacaaatacacataaacacagacatagacacagacacaaacacacatagatgaagtcacagatttagaaacacagacacacaaatacacataaacaaacatagacatagacacacacacatagacaaagtcacagacttagaaacacaggcacacaaatacaaatacacataaacatagacacagatagacacagacgcacacacatagatgaagtcacagacttagaaacacagacacacaaatacacataaacatagacatagacacagacacacacgcacatagacaaagtcacaaacttagaaacacagacacacaagtacacataaacatagacatagacacagatatagatacagacgcacacacatagatgaagtcacagacttagaaacacagacacacaaatacaaatacacatagacatagacacagacacacacgcacatagacaaagtcacagacttagaaacacagacacacaagtacacataaacatagacatagacacagatatagacacagacgcacacatacatagactaagtcacagacttagaaacacagacacaaaaatacacataaacatagacatgacacacactcagacacaactactgatagacataaacatagacatagacagaaacagacacaagcacaggcacagacaaagatatagacatagcattgacatagacatagccatagacgaagacatagtcatagacacagacaaaaaacatggacatagacatacactgagacaaagacacaaacacagaaaaaagacaaaggcatagacgcagacacagatatacacatacacatagacatggatgaaaatatagacagagacaaagacataaacagagacatagaaaagacaggacaaaggcgtagacatagacaaagatgaagacatagataaaaagacatacagatatggccaattacaaagacaaagacatacacatagtcacagtcatagagacacaaactcaaacagagacaaagatatagaaagacataggcaaaaacataaacatagaccagacatagatatagatgtagatgtatggagttaaatgtggacaattaactcattagtttgtaaatagagcaaactctcagacttgtcagtttcaagcctagcagctccctgctaggtgcactccacagtcatctctaaaacctatctctgacctgtccctcccttcctcaatcaccttccatggctccctagtgccctcttaatcaagttcaaatcctttcatctgacatttcacatgaagctcccttctacttcttgaattcagatcccagagaggcccaccttgctcagcaggagtacatcaatgaagtccaaagtcttggatttggccttggcttggaggaagtcatcaacaccctggctagggagagtgcggcgccgctcctggatgacggcatctgtgaagtcgtgcaccaggcggcaggccctgcggaaacgctgcccatcaggggtgagataatacaggaagtcaatatgcaggaggatctcatggtgtctttttgatacaagggcactgagctccaagatggcggcaatatattcactgggtttcctgcaggataagggcagaaagggaggcaacaatttaatatacctgaagccccaggatcacctcccaccagcagccaggatctacctcctatcagtaaacagagtatccaggaacagatgaccccacagatacagggtggggatcagcatgagattgattctccaagctctcttctctccctgcatcccatctctgtgagatgcctccatgccgctaggcacccagagcatagcttgcacattattctcctattctctctttccctcccagtatacagtcctgacccgtctccttgaaactgtccacaaagctcagactttatcctcctgcaactggtccatggtctagctttcaccctagcctctttgcatcagtgttaactccatttagtgctacattagtcagtcccctacagagctctgaccacacccaccagttcaaaccccttcaatggctccctggaaacctcaagataaagttcataccagtccttcaatgatcaggtataacaaaactcctccaggaaggtttgtctggtttccctgcttagtcctccctctcccacctacccactttgggtccacagcccaagatcccagatcctgggcaagaacttactcctgacaatggctgtcaaagctgaagacacatttctgtagactgtccaaggtcatgaggctgatgtgctcaaacatatccaaacaggcactaccctctgaggccaggagctgccacttggcctagccagagaaggggacagagctggggcaggctccttgctcccttgagcacctctccaaccccaactgccaagatgggctccccagaataagcctcttcatcttctccccagggacccctccccagggagcaccaggttatggtgcaaacaaaagctgttactattaagagatgaagacccaagattgggagttaggagaactaggttcaagttccagctctgtcccctgtgctctgtgtgccattagtcaactcattaccctcccctatatcctgcctgtcaaatcttcagaaacagttaagatgatgtgctttggagccatataattcacattagaaactctgctccacctcgccatgctcacttattagctgggtgaacttgggttagttccctaatctctcagacctgcagtttcatcatctaccatggggcaaaaatacataatctctccttcgcagagctgttaaaatcaaattagacaatacatactcgtatcatggaatgggcacatggcattgtttctggcatatggtatgtgatcaataaatgttggatttccccgtctgcattgttataaattgatttcaaaaatatccctgttttgggggaggtagtccttcgttgagtcctgagcattctttctgggcatgtcatgaatgcaagacactgatgtccttaacatggaaaatttctcagagttgtgtttgcgaagaaaaactttgagggataaggtaaagactccctctagacatgttgcttttgctttctataaaagcagattccctaagcttaaagctcctcttctgtaatgcaatatatgatgtcagcaggcacttatagaagcccacctgtgtcagcccatgggatttgggaagcttggagggaaaaaaggcaatctaacaagaaacacatgctgctgtctgtgtcatgagtagtaaactatcctttgtctctgacccaggagtctctcgtccttctggaagaatttatgaaacagtaacaagctaacttatcaatttgcaagttaaaaaaaaaatcctagatacttcgcaaaacctttgccacaattcttcccttcctgccatatccacaccctttgcaatgtgatttttcagcaactcccattaatagacagagcctattttatccccctgcctttgattctgtgttggacttttggctttcgatgtcaaaatacaatgtggtgaaaatgatgagttaataactaacgaagctaagccttgtcttactccttggaaccctgcctgcattgtgaaccatggcgcgccttctggaaggagacaatcatagggaggaacatccaggggtcccagatgaggccaaacctagacacgtgagagaacccaaacatgtcccagccaaaacccaaacatgtggcagaattcagtcaacacctgcaaggctgcctacctgacccccagctgctcatgtaccatgagtggtcccttccatatacagaagaacctgccaactgtcccaaagacttattagcaaacataaacacttattggtttaaaccaatgagttttcaggtggtttcttatcagcaacagctactatgaaattgttgtcatgaccctcttgtgtttacagggctttggtgatggaaacatagaaacagacaccttctgggcacctgctatgcaccagagacgtgactccattacattactctgaccatcttttaagtagggattattatccccattttacagatgaggaaaccaaggctcagtgagaaagagcaatggcccaatggcacccagcagagccaaaactccagactagatctctctgttgtcctttcaccccaaggctgcaagtgggaccttggcttcaaataactcacgtgcatgatgttcacactctcattgaaaatcttcatatagggcttcaggatgttgaaatggaaggcaggcgtcagcatccgacggtggcggctccacttgtcaccagcactcagcaggagcccatcccctagcagggcagccaagggccatgggcaaggacctctccctcccctggccccccaacgtttttcccaaccctgttcacctgcagatactcacccagccagggctccaggaagctgtagaagaacttgtcctttggtgcaatggcagctgacataaatgaggacaatcaggggccatggaggcaggtgaaagagggactttgggggtgggtggaggctcccagcaagaggtttgcacttctcccactctgagccccacatagcaggaagagggccaagggcagaggaagaagggaggatggggaggggagggaagaccagaccaggctacagcagcacagtacagcaatgacactgcctaacatggcgtgtaggagctatgtcagggttccagcatgccttgacatgcctcctacacgatccaacatgttccgcaacccctgagcacagctcagcattctacagaatgcttcacaaggacctaggacaccctgtctgtcccagcactctctgacatcttctgatatggcatcttctgacatggacctggacatgagacatgaccctgacatgtgttcacatgtcctgacatggccacaaaatacatgacaattcctaacatgagatggtgtgctctaacatgcacatgagatggtctaacatgatcttaaaagcgtgttccacatacaggctctgggttgaatataaatatggtacctttaatgtcacagacatagccaacatgtgaaccagactgttcctcaggcatgacccaaatatactataacacatgcctcagacaagactcaaataatgtctcagacagttcacatagggaccctgggtcccagacctcacacaacccccagacctcacacaacgcccagatgtttggaccaccaggagaaaacggcagtgtcaaacagcacctgagacaagaaccaaacaggccctcacatgccccaaatgtccttggccacagataagccccaaacttgaccagctctacatgaccccagttggaattatataccagatgtaaccaggtataacatatttcaggtgtaaccaggacccaggtgtaaatatacaaggcagacctggccatataacagccattgtagagacacgccccagacatgagcaaacagcaacagaggttagacaggtggaagtccaggggcgatggaggcaatggcatctccaccacagcccctcctgtctgcacatcggtcacgtgttcagctggaggcagcacagcaaccccagctgtgggcaaagcttggccagtgcgatgtctacctggagcaaagagcacaggcttgatgcacgtggggagaaagatgtggatgactgcctgccagggccccacccaccagcagcccatatccccaaaggtgcacgccaggctttgtgtgtataggagaccttcttctgagctgtgaatctggagaaaaacacacaggacccaattcatgctctcctaggctgtgagagagaaggatctgcagggaagaggtcgaagccctctccctgagaatttcaagcagcatctcatcctcctgtcagtgctgagcaccccctgcctcctcacatcctccatgcaggactctccagtccttcagttacacagacagaaaaggtctttccccatgtggatccacacaccatgttccctgggctctcattcatcccattttccagatgaagagcctgaggctctgaacaataaagtcacttgcccacagtcccagaccacggcaagcctgaggcctaagactaggtctgtctgcacccatggcctgaatccttaaccaacaaacttctttgtgcccccaaaacagtagctctggaagacccaggcctaccaagactgggcaatcagagacacagggattgggtgaaaaattggtcctgtgatccaggccaggagaagtaaaccatgggccatttctgggaactctaggggaaaggtggcctttcccataagaactgagcttctgggactcatcgttgacatcatgaggaaaaggccaccttgataggaaaagcgacatggagaaagctaaagccaagagagaaagacagatttccagtgaccttgtgtgagacctggatccagccatgcctgaaggccaccctccctggactttaaagtcaatagattatctttctttgcttagaccacaccaggttgggtttccaccactcacaactgaaagagacttcaataaccagagacagctgggtaccagcccagagtcactcagcattttgaggtcagagccatggtctctgtaggatgctgcccattccccctgctcagcctcgcccgtccaacgatgggaagcacaggggtcaaggaaagggacccaagctggggtggagtctcctcttggagatccccgggacctgcagcaggagagcaacgaacttagggcagacaagctataggatggggtaaagggaattgacccaccagaggtggacatcatggaagtagcagcccagatcccccaccagccacaagtcctcctcattgttctaggctttgggacaggcaaggtgatgctaggcctggcaaggggccttgaatactaacgatgtccaattgcctcaccctgcactctcctttcaaacattcctactcattgttccagacacagctccagtaactcctcctctaggaagccttccagcctgccccagcagagaccttgttcttccctgggctgtgatccatctccctctggccctttcctgatcccatgaagttggggatatctctatccaggtccatctccttaaagttgggggttcctccaggactgggccttgggttgaggtctcttagggttccagggcagcccagaacaccagaacagggggtagatggcaatagagagaggagacgctgagatggaaattgatgaatacatgaaagaaagatgaagatagctgagagggaaggaaaggagaggccagagtactgcagggcccacacaggagcttggggatagcggaagtgcaggcctcaaatgcactgccccaccagctgttccagatggtacctgaggcgttgatgacagaccggatgatgtcggggtggcacaaactgaggaggggggagatgggtcccatccagaccttaaagccctgggggtaggtggccaccagctgagtcagaactctcatgccctcctctgtggggttgacctgcaagcaaggcaggggtcattaccttctgtgatagttaattctaggtgtctacttgactgggctaagggatgcccaggtagttggtcaaacattatttctgggtgtgtctaatctattcatcctatctatctaatttttctatctatatatctatctgcctacccatctatccatcaatccattttatctgtgctttcatccatccatatattcatctgtctgtctgcttatcatctattaatagccatctatccgtctaatctatccatcatatatatctactccatctgtctacataatctatccatcctatctactctatctacccatccatccatcatccatccatccatccatcctatctgtgcatccgtgtgtccatgcatccatatgtcctattatttgtctatctatctatccatccatccatccatccatccatccatccatccatgctatctgtgcatccatgtgtccatgcatccatctattctattatctatctacctacgtgcctgtccatccatccatccatccatctatccatcctatctgtgcatctatctatctatcctattagctatctatctatctatctatctatctatctatctatctatctacattcctcctgctctatctatctatctatccacattcctcctgctctatctctcttgggtccatctccaagtcccaagggtgcatcccagggcagagggagaagacgcactgtccactcacagaggcccagttatcttgagaggaaggattttctttttctgggagtcatttcagcccagaggcagctatatggggaggtcctcacaggggagatttgtggggagcagtatcgcctcaggacatgtccctaaggctggtccccacatgccttcatgtcctggctgatccacagaggctccagttcctcccatggagaaggttctgcacatgggagaccttcccttttcagcagccactagtggagcagaggtgactctaactgtccatcaggacaatggctcccacctgggagcagcttctgcagcaggctctgtgctagtgtgtcctgtgcacccttccactttatctgtggacacatccatcaatcctgccatttgcaaatgagcagactaagaccacattccccaaagaggagagcggtctaagtcagagggcaaggtcacggggaggagaaaggccaaggaaagcttctgaaaggtgaagtgagtggccaacttttatctgggtttggcaacaggtctcattgataagagggagataagaagaagaatataagagaaaggtgccttcgggtgtagtggaagtgggagacggcccatgcctctcctctggcccagctgtaccctcataacaggaaatagtccaggcaaggagaggaccctggacagtgggcataagaagcctcgagtccagcaatggagaatgtgggaatgccagggactcgcctctctgtgcagccaaccctctgcccaggagccccgcagaggtgcattaatgtgggaagacaggcaggaaaaggattcaatgcaggcctggagtgggaggacaaggaagtgagaagggcttgcgtaggcacctcacagaaatgaataagcagaggaatgagtaagatgcctcctctgcttctctgccaccccagatcccagcccaccccttcacccccactccctaagcctcgtacccctcaggaagtccatccatcctgagacctagacccatcctgctgccacactcaccatgccctggtgtccccaaaaccagttccgtcttgggggttgtgggaaacaccgaaggcggcggcagttgtcatagaaggcgtaggtccaggccaggacatgggccaggagccaggaggccccgaccagcaggaggagcagccaaggggatgctgccactggccagaggcccagccaggacaggctcagctgggacatcctgcagggcagacgggatggacggtgagatcctgaggcccagagaacggcccagggacctccagggacagtggagaggcagggacgggcagtgccggaggtagagcagggagggctcagggatgggtaaaaaggggctgagaggtaaagtccagaaaggcccaaccaaaaccagcagccaagtggcctccagttccctagtaagcacttagaatgggaaagagagagagagactgattaaagtccagaaaggcccagcctgaatcactgtgaggttgccaggggcttggtttcagttactcggaaaccacccatcctccaggccagcacccaggagctgcgtgggccttgggcagtgcccctctccatcccaggccaggaccccccccaggcctgccacccccagcctggcaccttctgtcaggagcagtctgtcccagacaacctcctctctctgtctgctgggaggcctttgaccctggcccttgatatagcaaaggctgtgggagggctggctgggttgggctgggccaaccaatccctgcagcctggatgtgtctcctgagcctgggcagccaatcaacacctggcgtcaggccagctgggtgcagaggaatcagctcagggtccagatggatgggtagatgcacagatagatagagtagataggatggatacattaggtagatagataaagtagatatagataatggatatattagacagatggatagatagctattaatagatgatagatagatacatagataataggataaatagatggaatggataaacgtacagctaagatggattgatggatggatgggtaggcaaatatatatatagatgagaaattagatagataggatgaatagattagatagacacacccagaaataatgttccatctctgtcccagatatgtgggatcctcatttgtgacatgggaactagggatcttggatcactccaatcactccagatgctacaaggccagtgacttactcagtatgatgctgaggaacatgaccatcagaaacaggatcagagtcactctcaagcaaaaaaaaaaaaaaaaaaaaaaaaaaaaaaaaaaaaaactccaaggattaaatgatttttcccattgtcctggggagaaattaatccaagggaggtcacaggagggcaaataattccccatcaccaccaccaccaccatgagcataccatcacccatggagttttctgatttactctttggcccattaagcgtgaaatttcttatgctaggtttctttctgataagggagaagagattagtatctctacatttcctctcctcctgctacctagtctctgtattctaggttaaattataatttatgttgaggatttacaatggctgatacacctagctgagccttctgcacagagatacattgggagtggaggttaattgggtcaaaggagaaatgccataagcccacactccagcctatcagggtggattaaaggtctgatttgcccaactcttgtcacacctgctcccactgagaggtgacagcatgctggcagtcctcacagccctcactcgctctcggcgcctcctctgcctgggctcccactttggcggcacttgaggagcccttcagcccaccgctgcactgtgggagcccctttcttttctcttcttttctttttttttggatttttttattattattattatactttaagttttagggtacatgcgcacaatgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatatgttctcattgtgtagggacatggatgaaattggaaatcatcattctcagtaaactatcgcaagaacaaaaaaccaaacaccgcatattctcacttataggtgtaggagcccctttctaggctggccaaggccagagccggctccctcagcttgcagggaggtatggagggagaggcgcgagtacgaaccggggctgcgcgcggcacttgcgggccagctagagttccaggtgggcgtaggcttggcaggccccgcactcggagcagccggccggccctgccagccccgggcaatgaggggcttagcacccgggccagcggctgctcgggaaggtgtactcggtcccccagcagtgccagcccaccggcgctgcgctcgatttctcgccgggccttagctgccttcccgcggggcagggcccaggacctgcagcccgccatgcctgagcccccggcctccgtaggttcctgtgcagcccgagcctccccgatgagcgccgccccctgctccagggcgcccagtcccatcgaccacccaagggctgaggagtgcgagcgcacggcgcgggactggcaggcagctccacctgcagccccggtgcgggatccactgggtgaagccagctgggcttctgagtctggtggggacgtggagaacctttgtgtctagctcaaggattgtgaacgcaccaatcagcgccctgtcaaaacagaccacttggctctaccaatcagcaggacataggtagggccagataagagaataaaagcaggctgcccgagccagcagtggcaacccgctcaggcccccttccacattgtggaagctttgttctttcactctttgcaataaatcttgctgctgctcactctttaggttcacactgcttttatgagctgtaacactcaccgcgaaagtctgcagcttcactcctgagccagcgagaccacgaacccaccagaaggaagaaactccgaacacatctgaacatcagaaagaacaaactccagacgcgccaccttaagagctgtaacactcaccgcgagggtccgcggcttcattcttgaagtcagtgagaccaagaacccaccaattccggacacaccattgtctgagtaagtttgggtgccaggactatgaggtcgtgtgaagacttccagccccatacctgcagaacagtctgcagctcactctgctctgaactgccccaactttgcacagatattctccattcctcgaaatgaaactgtatccttcaaagctcacacatttcgcttattggctcagcgtagggagcaagttctctagatagcttactaccaaataaaatggtggagaagggaacccaggcagctgggcacaaaaaaggaatgagcaacaagcttcctctctgaacatgattttctgtgtaaggtcttggacactccctcgactgcttccagccatctgcctcatgctaggtttctagttaatgtggaatgaaaactctcacatcttccttctagatgtagctgtggtaattgcaacttaggcagttgtgcttgagaatcttcttcttaataccacatggcaaggtcattccccaatgcttttatttaccttcacttgaatttttatattaaacattggattgaacaagaacggagaagagaatcacaattattgtgtagatgctacattgtagttacattttctcttgtaattattacagtgctgggactattcgagctttaaaatcctttctgaagatcctaaagctactcagtggttctgctggcattaggggttgatatggtttgggtctgtctgtgtcccttcccaaatctcatgttgaattgtaatccccaatgctggatgtggcgcctggtgggaggtgtttggatcatgggggcggatccctcatggcttgatgtggtcttcgtgttagtgagttcttgcaagatatggttatttaaaactgtgtagcacctgaccctctctctcttgctcctgcttttgccaagtgatgtgcccgctcccactttgccttctaacacgagtaaaagctccctgaggcctccccagaaccagatgccactatgcttcctgtacagcctgcagaaccgtgatccagttaaacctcttttgtttacaaattacccagtctcaggtatttcctttttttttttttttttttttggtcttaaactccaagcctcaagcaattctcccaccttggcatcctaaaatgctgggattacaggcatgagccaccatacccagccaggtatttctttatagcaacacaagagtggcctaatacagagggatattgccaatgatttaatagtagtcttcttttctgtatgtcactctgcttgactaaccttaaacagtctctttaaataatttgtaagattcacctaactacacttttcatattgtccttcaatccttgcacttatggcataaacatgttttatgattattatataggtatttaaataatgcatatgggtcctatatttctctatcaatgttataatttttaccagctacataattttgaatcacatgtatataccatcatttaccttccatccatccaaaagatacgagaaggggaaagaaaagaataaaaggtaagtgctaatagataatccgaataggcctatatctattaaatcgattgaaacaataattaataaccttccaaaacagaaagccaagaccccaattggttcactgattaattctactagacttttttttttttgagggggtggcaaaagagctttatttacacactggcacaaggcccgccgggtgtcagctgaagaagtaggtggaacgcttcaccagctccaggtcgaaggcccctggcttgggcaccacctgcagtgtctccttcatctggctggcctccaagatcttctggggctcagagcagaaccgcctgaccaggaacctggacaggtcctgcaggatggactcgctgtgcaagcaaactgctcccggcacacctggttcatgatggagacatcagctgcatgggtccggtaacagtcgtgcacagagacgaaggtcaggcccttcctgtagcagtgcagggtggtgagcatcatgtgtgaggagtccagcgagtggatgaagttgggccggaagccgttcttctgcttaggtgtgttgggcttccggctgatgtctctgttgtgggtgtaagtgatgctctgaattccacctcctgattgcttgaccttggactccaggcgatacggctggatgatggggacgcccaggggggtgacccactccaccacagagcccgtgtgggagacgaggtgggcgctctcgatcagccagtgctggatggcccgggtccccgagaacatctcctgtagactcctgaagacctggcgtacgaggtagtgggaggcctcccacacgaactcctggggaaagtcgttcagctcccggaggcgcttctcaatctgcaggcgcccaccgtagcgggtgaccccgtacaccacggtcatcactgtctgcttcaccaccttgcgggtgatgaaggcttccagcacctgtgccacccgcatgccccgctgggcgtcctgcctacggaacacctccacctgcgcggccacgccgctgtacacgtcctgcggcacatccgagggctccaggttgactgaggcggcgcccacgctgtcgcggcccagggcagcataatgctgtaggccgttgcatctactaaacatttaaggaaggaattataccaattttcttccatgtcttttgaaagacagaagcagaggaaatattgcctaattcattttatgaggccagcattatacctaatggcaaatacagacaaagacatgacaagaaatgaaaagagaaagaagaaaagaagaaagaaacaaaaaaactatacagattaatattgctcacaaacctagatgcaaaatcctcaagaaaatatcaaatcaaatccaacaatgtataaaaataattacatatgttaacaggggtgagatgacatcttatcatggttttgacttgcatttcctagatgattagtgatgttgaccattttttaatgtatgtgtttgccatttgtatctcctcttttgagaaatgtctattcagatagtttgcctattttttaaaaggattattttgaggtggtttttttttttgctattcagttgtttaagttccttatgtattctaattactaatcccttgtcagatggatgatttgcaaatattttttctcattctgtaggttgtctcttcactttgttgatttgtttctttgctgtgcagaagctttttggtttcgtatgaccccgtttgtctatttgcttttgttgcctgtgcttttgaggtcttaccaaaaaaaaaatccttgcccagaccaatgtcctgaggtgtctcccagatgttttcttctactggttcaaagtgtcgtgtcttgcatttaagtctgtaatctattgtgattgttaatattgagtgtcaacttgattggattgaaggatgcaaagtatttttcctgggtgtgtctgtgagggtgttgtcaaaggagattaacatttgagtcagtggactgggaaaggcagacccaccctcaatctgggtgggcacaatctaatcagctgccagtgcagccagaaaaaaagcaggcagaaaaacgtgaagagactagactggcttatcgtcccagcctacatctttctccctcgctggttgctttctgcccttgaacatcaaactccaaattcctcatctttgagacttggactagtttccttgctcctcaccttgcagacagcctactgtgggacctcaccttgagattgtgtgagtcaatattccttaataaacccccctttatatgtacatctatcctactagtctgttgctctaaagaccactgactaatacagattttggcaccaggagtggggttcatacatctatcctattagttctgtccctctagagaaccctgactaatacagattttggtaccagaagtgggattcatacatctatcctactaattctgtccctctagagaaccctaactaatacatctatcttgatttgatttttgaataggatgaaagagaggggtctagtttcttcttctaaatatgaagatccagttttttcagcaccatttattgaagagactgtttttttctaactgaatggtctttgcacttttgtcaaaaattagttggctctaaattcatggatttatttctgggttctctgttctgttccattggtctatgcatctctttttataccagtactatatggttttggctatagcattgtagtataatttgaagttggcagtgtaatatctccatctaagttcttttttctcaggacagctttggctatttggggtcttctgtgataccacacgaattttagaatttttttgtatttttatgaagaatctcattggtattctcataggaattgcattctatctctatattgcttttagtagtagagtcatttttgcaatattatttcttccaatccatgaacatgggaagatgttccatttttgagggaccttttccatttctttcatcagtgttttatagcatttcttgcagagaactttcaactacttggttaaatttattcctaaatattatatatgcacctattgtaaatggcattgctttctttttctttttctgctagctcatcatttgtgtatgggaacactagtgatttttgtatgctgattttgaatcctgctgctttattgaatttgtttaccagttctaagacagttttggtggagcttttagggttttctatgcacatattatgtcatcttcaaacagggaaaatttgacatccttgccctttatttctttctcttgcctgatttctctggccaagacttccagcactatgctgaataaaagtggtgaaggtgggcatacttgttttgttccagttcttagaggaaaagctttcagtgtttccccattttgtatgatggtggctgtggatttttcatgcctatcctttattttgttaggtatacttgttctatatatttattttgttatgtatgcttgttctatacctactttgtttagtgttttttatcatgaagaaatgttgaattttatcaaatgcttttcctgcatttattgagatgattatatggtttttgctattcactctgttgctcttcaataaatatgatgtgatgtcattttttttatttgaatatgtcaaaacatccttgcatccctgggataaatctcaattgatcatagtaaattatctttgtagtgtgctggtggatttgatttcctagtatgtcattgagaattattgcacttctattcatcagcgatattggtctgctgttttcatttcttcttgtgtcccattctggttttggtataagggtaatgctgccttcatagaatgaattaagaagaactctcttttctttgattttttggaacagtttgaaaagaatgggtattaagtattttttttaatgtttggtagaattcagcattgaagccatcaggtcctgggcttttctttgatgagagagtttttattactggttatatttcattacttgtaattagtctgtttagactctctatttctttttggttcaatcttgataggttgtatgtgcctgagaaattatacatttttactaggctttccaatttgttgactcatggttgattgtaatagactccaatgattctttgtatttctgtggtatcaattgtcatgtctcctttttcatgtctgatttcatttatttgagtctttcttttttcttactttgtttagctaaacatttgttaattttgtttatttttttacaaacaaaactctttgttttattgatcttttgtattttatttttactttcaatttcatttatttttgctctgatcttcattagttcatttttcctactaattttgagtttggtttgcttttgtttttcttgttccttgaggtgcatcattagattgtttatttgaaatatttctacttttttcgatgtaggtgtttattgctataaaattccttcttaatactgcttttgctgtatcccatagcttttgatacattgtgtttatactttcatgtgattcaagaaattttaaatgtacttcctaattttttattaatccattggttgttcaagagcatgttgttaattttgatgtatttgtacagttttgaaagttatttctgttattgatttctagctttatttccttgccgtcagaaagtatacttgatgtgatttcagtacttttaaacttgttgagacttgctttgtagcccaatgtgtggtctctccaggagatttttccatgtgctaatgaaaaaaaatgtgtattctgcagctgttgcatgaactattctgtcaatgtctgttaagtctatttggtctaaagtgaaatttaaatacaatgtatctttgttgacttcctgtctagatgatctgtccagtattgagattgggttattgaagtctgcaactattattgtatgggagtctatctctccctttagatctaataataattgttttctgtagctaggtgctccagttttgggtgcatatatatttactattgttatatgctcttgctgaatttatcccttgtctgttttatttttatctgatataaacatagctactcctatttgattttggttcccacttgggtagaatgtctttttccatcccttcactttcagtctatatgttttttgataggtaaagtgagtttcttatgggaagcacatagttgggtcatttaaaaaatccattcagccagtctatatattttaagtgggggatttaatctgtttacattcaaagttattataggtaagaaccttcttctgtcattttattcattgtttgctagttgttttgtatatcttttattcctctcttcctctcttattgtttacgattgtggttttggtagttttctgtagtaataaggtttgattcttttctcttatgtgtatctgctttgccagtggattttatacttttgcatgttgtcatgatggtaatgatcctcttttcacttccagatgcaggactcccttgaacatttcttgtaagacaaaaagctcaatattgtcaggatgtcagttcttcccaactaaatctatagattcagtgaaatcacaatgaaaatatcagaaaggttttgggttttttttttacaatttaaatttttactagagaaagatattattcacatccacaatttcttaaagtcctttataaatgagtgtattccataagaaatacactaaaatcattacttatgtttcatagagggaaaaaactatgagaatactattaacccaaactatatccatattatacttatttcttaagcatttacatgttcaaatacgcttgttggatagtgatcattcatccccacagtggtaaatttcagcataatattaagtgactgagagagactaaagtagtcacatgtagattagataaacagat

SEQ ID NO: 1066 - DNA, 42982 bp, Homo sapiens
gtgacctttactctagttcccaataagttcctcatctccatctgagacctcatcagcccggccatctctgtccacatcactatcagtattttggtcaaaaccattcaacaattctctaggaagttccaaaccttccctcattttcctgccttcttctgagccctccaagctgttccaacctcttgcccattacccagttccaaagtaacttccacatttttagatatctttatggcaatgccccacttctttggtaccaattttttgtattagttcattctaacaccgctataaagaactacctgatactgggtaatgtataaagaaaagaggtttaattgactcacagttccataggctgtaaagaaagcatggttgagaaggcctcaggaagattacaatcttggtggaaggtaaaggggaggcaagcatatcttcacagggtggcaggagagagagaggagggaagtgctacatgcttttaaacaaccagatgttatgagaactcactcactatcacgaggacagtgtgttagtctgttctcacgctgctaataaagacatacctgagactgggtagtttatttaaaaaaaaagaggtttgatggattcacagttccacgtggctgggaggcctcacaatcatggcggaaggcaaaggagaagcaaagtcacatcttacatggcggcaggcaagagagcatgtgcaggggaactcccttttataaaaccgtcagatctcgtgagacctattcatcatcatgagaacagcgtaggaaagacctgcccccgtgattcaattaccttccaccagtccctcctccaacagtgagaattacaattcaacatgagatttgggcaggaacacagatccaaaccatttcagtggccttggccaacccaccatgctgagacacttcaaacccagacctgttctcctgggaccaaacaggcctttggcaatcccagcacttccaagacatcctgttgctccaggtattgaccagtgccacccagaaagatatcctcatcagcactgtagctcatgctacctcctcacctcctacgtgacacagaccatctctgtcctggtcattttaattcgccctttccccagggccttatggggccaagtctctccataacttgatcagcagaggggaaattggatcagggtgtgcagatcgttgcctgcttcttactttgtgaatgtcagaagcccccaggcacagagacctgcttgtttccaaagtctcatctttgaaaagcagatggcaaggcttaggcttgattgaatttgtgtttatgtatgtgatgcatttgattgtagctggagggaggctgcctggtccaatagctaatttggcccatcaacagggtttaaacctacttacctgttagaaactatttgttccatggaggcagttgtgcctttggctggtggcataacagccagcgtctgagcatcccccttgaccaaagccttttgaacctgtgggttgatttcaattagggagcccaaagtccttggctccacagcccgggctctgaggactgatgctatagagccgtgggtacaagtgtatgagggccggcagacaaaggcaagagttgcaccgctgtcactcatagtttaagaaacaaacgacccacatatttatcaacagggagttggctaaatcaatcagagaccatgcctgcagtgggatacttgagagctgtcaaaggcggaggcagcactgagcgtgtatactcaacatatatccaacatgcacgtggaaaacaccagtggcaggacagtgtgtacagcaggccatttaacaaacagtgatggctcctcaaaaattaaaagtagaattatcacaggatgcatcaatgccatttctgggtacacactcaaaggaattcacaacaaggattcaaagaggtatttgcacacccagcagcatgattcacaacagctaaaagatgaagcaacccaactgtccatctactgatgatggatacatctagtgtgatcattcatacaatagactcttctccagccttaaaaggcaaggaagctctgacacatgttacaacctggattcaccttgaggatagtatgctcagtgaaatagaccagacacaaaggataaatcctgtatggctctatgtctatgtggtcttagagtcatcaaaatcatggagacagaaagtagaatggtaggtgcccagggctgggggagggggaatagggagctgttgtttcatgggcacagaacttcagttttgcaagatgaagcgttctgaagacagatggtggtgatggttgcacggtaataggaatatgcactgaaagccattgaactgcacgcttacagtggttaaggcgggacattttacatgatgtgacaaatcaataataaacaattttaaaaatttcagagaatgaaaagctgttctgacagacgacatattgagctgttaatggtagtcgtatttgagggagtgattctgcgccgtgtttttcaggcttgtctggatgtttataatgatagagctcgccaccgtggagggagccctcactaagcacagatggtccagcctctgcctgcactgactcggggagcccccagcctgaggaaatgcgagtgtaattctgtcactgtccccataagctgaggaaacaaggtacagaggttgaggaacatgcacctgcctctttctgcctttgtcttgattacttctctgggataaggaccatgtccctcccagtgaaactcacctaaatgtcaagggacagcactcctgagcctcagcctccacattgcttgcccccgggtaggaccacagatgccccctcggccctgggcgctgaggccagtggaagccctgctgagcctgcgaggctctgcccttcagcatctctgggatcaggtttccaagaacacctggccctgaaatgggcatggggggtgggatgagggctgactgaccactcagaccttggggcccaagtcccctgttctcagccaaggcccagggagtcagggcaggtccgggggtcctgggctgggtggcgccggtctcagccacataggtctgtgtccagtggggtgtggcagccgcgagctccaggggttggtggtgaagtggcccataagccctgagcgggggtctgagggctggtcgctggcattgtagcctttgccaggcagctcactcgaaccctgcccgcccactctgaggctgccatagcccccatcttgagagtcagcagagcctgcatggaaccgcccgggaggcccaggccagccttcctctccagactccatggacgccagacgccacgctcttccaggcctaccactctgcagccaccacccatgaccacggagccctggccagtgccacttgtctctaggcctcggcatcctaagttgtgaaatggtgacagtcagggcctccatgtgacttggaagggttgggtgccctcactcacgagaacgcccagtgcctgcatgctcgcctagggaagaggcaggtgggctgcagacacggctcctacgagcctgtggactcagagggcatctcaggactcgggagcccagaccacaacctggtgacagctgtcccacacagggctcccactgcacatggcatggtgcaaagggcattgaccctcaattctcaccacaacccccatctcctgggcctgcccaaggcaactggtaccccacaacttcctgcatctctgcccccccctcccaccctggggtgggcttggctgtgtgagtggacttggcccaccagccggcagcccccatgctgggctctgataccccaggagcgtccttctgccagtgagggatgggtgtgggaaggtgagggccccggcttcttcacccttgatgtgacagttttggggtgcattccacagtctctccagggtccccttggaactgagtccctactgcccatggaggaaactgattatgaaagtacggttcgtgagtgttcccactcccctgcccacccgtctccgcacactctgagctctccttccacacagcctgctcacatccagacccttgcctcagcgtctgcttttgggagaaccaaaaccataacaggacaaaaagaagggaacacagtctccgactgcacttgggggtcccaccagagtgtgacggtgccagcagacactaggagaggagggcgcttgtatttcctgtggccactgtaacaaatgaccaaaaactctgaggcttaaaacaacacgattttttttttttacagttctggaggtcagaagctctaaaatcaaggtgtctgcagagctggctccttttgggggctctgggaggggaatctgttcccaccttttccagctaccagaggcctccacatcccttggctcatggcccctgctccgtcttggaagcagcctcctctccttggaccccatcaatgcatctccttctctctctcgtaggacctttgtgatgacatggggtccacccagccaatccaagaccacctcccacctccgggtccttaatctaatcacactgaatgtcccttccccaggtagcctacccgacttgcagggatctggacgtggccattgggggacatccctctgtctgtcacaccacacgccagaagctcagagagattccagggagggaggcggattctcatgttctccgagaccctcctgggccagagccctgcctgttggaccctgtgatgtcagtgggtgcagcagcccccgagatggatgcgggtgagggcagcccggggctgtctcgctagccctcactgcatcggccccattctgggtcaatggtaggtcaacctggtggatctctgaggtgaccaagcttactgacagatgaactacagcctcaggaagagggtcatggctggcaggagccagcggggggcaagaccagcagccctgagtgctggtgcaggccacgcagggcccagcctctgtagccagaagtcagcgccagtgccggtcctgagcaagatggccatttcacagatgaggaaagaaggctcagggctgtggggactgtccgggtgggtcacatggccggcaggtttcagggcctctctttccatctggtgcccacagttacgctgtggcttgggtgtggtctggagctactgcctcaggacccaccaccatcctggcagtgtggtcccttcagaaaagctgaaaatgcaaaaatcaggcacatgcacctccccccatgagctgctcaagagagaggagcagtcacgcatccttatggagaaaaggagaagcaggacccagaaagggtttccctgtaagattcctcagggcccagcaggcctcagccccaagattgaggccaaattattggaggggtgtgtgtgtgtgtgtgtgtgtgtaaaactgagtatgtgagcatgagcccagagctgggggtgcaggccacgcaggtgtgagagtccacctccccatctcgctgacccctgtgtatggaggagagatggaggcgggggaggctgtgtcctgcccaggccagccgcctgccagtgacagtggaggacttgctcacagtggggctgcttggggtcacacaggagtggcctggcaggcctggcagccccagccctggagccagccacagactcctgggttctgcttccctgggagcttccaggggagtgtcactggggctcacgataccgaccccttctgggatcagtggccccttgcttttggcacagagcttcagggccagagggtgcctctaatccagtagctgaggaaagctttcagtggtgctctgggcacctctgtgacctgccctgggcccagtcctcatgctgatcccactgtagccaccctactcagtgccccaggccctggacacctcaggccatgggatatcccaagcattcaaactctcacggccacctacgcttatgagcagaggcagaggcatggtgccaccgctgcctcctcaggcaggatatgctttttgtttgtttgttttgagacagggttgttcgctgtcattcaggctggagtgcagtggtgtagtcagggctcattgcagcctcaaactcctgggctcaagcgatcctcccgcctcagcctcccgagtagctgggactacagtcttgtgccactatgcctggctaatttgtttttatttttattttggtagagactgggtcatgctatgttccccaggctggtctcgaactcctgggttcaagcaatcctcccgtctttgcctcctaaagtcctgggattatagaggtatgagtcactgtgcccagcccagaatgtgcctcttaactttcataccgcagcccctatgctcaggacgaggagggacataggccagctgccccaagttccccaaggggactgtgccaccctggagtgggctctgtgatggacagagtcaccgtctcccagcagctcccaatccatcccatcacaagtcaggtctaggcactgccatcagactgatagttgaatttttcctgccaagaggaggtccctaagagcctgagccacaggcgagggacagtgctgtcctgtggccaggccccgttgtcactggggagtggcctggcctgttcactcacccagctccagtctgcaccaccgtcgctccacttggggttgtcactgcctgaggttaggacgtcagcagaagccagcctcatgtggcagaggcgatggggaattacagcctgcaaaggctgatggcatcagagagattcaggaaagcaaagggcttattaaaaagctgaaattggttctaaacaaggtcagccgtcgatgcgccttggagggaagccaggcgctgagcagcaggaatggggcttatttcctgacaccgtggccgtgacaccctgcacctccccggcctaccccacccccaaccccactcccacccccattcccatccccacccccaccgccacctctggagggcaacgtgcacccagacactggagcagaggcagcaggggtgggagcagggaggaaagccccccgcggggcaccacagggaggcatgtggccaagagagcacctggcaagcaggtgtcacctctgaggagggtgagggcaggaggagagctgactgttgcttccttaccctggggtcggattgctcccttttaaaatccattaatgcaaggaagggcgcagccacggggccatccgattggattcgctccctcccgcccggccccagtctccgcagattttctctgcggttgcatttttcatttgagcgtcccttcctcttgactccagtggaatttttctgaccttggctgacaaggtgtgcagccccctccagctcagggcaccctctttggggtgcttgccccaggcactggcccaccctgtgagctcaggcgcattgtctcgcctctccgaggctgactctcctgtgtctgagacagggatgatcgcacacccagccacccaaggctggccaggatggaggcagggcaggggaagccctggtgcggcctgacttgtgtctcctgtccctccctaggacttagttatcagtattttggaatcagctgaatcatttctgtcaaatgctagaggaaagccagttttgagttggataaagaaaatgtctttgattcctgttaaaaataaacatgtgtgcataacactgctgagcacgagaccgcacctgccgtccctccttagagctcccagcagctgttggtctttggcgtatccgggagaggagcgaggcctggaggtgtgttgagccgtccaagggctggtagcatcaggggctcttcactgcctctcgctccacagaaccgctgggttgaaggaagctggagggatcaattgtccttgtcatccaacttcctgtgtctgtagatggggaggaggcgctgggttggaaagcgcttctctgaggacgccagctgcgcattcaggagggcggagcaggatatgaccccagagctctgaccccggaggagcaggaggggtgcctggggcctcaataccccagaggggagagaggtgccccccttcccacaacgcgggccccagctggtgctcgtttagcctgttgtctagctggagccacctgggtggccaccaggctgctgggagggctcacccctgagctgggtgtgctgtggagcccgtgaccctcacctctgcctctgctggcttttgttatcccgtgctgggaacaccagtgcctgcccaccccggaggctcttcgtatcaccggctcgctgtggccgctccccagtcccgagagtgaatgtccgggatgcagcagacacctgcttacaaggcacaggtgaggaggttttggaactaatctgaggcatgaaggtgaggtgctctcaggcgacggaggtggcatgtcctgatgggaaagccaggccttcggaggctgagacccttcccaaggctcaccagagaactcccaagagtgtctttcccctggcctgggagacaatttcacaccaatgccacactctattgcacaggtgattatgcacttggacctcacctgcctgggctgtgggtgggggcgaacggtgcccctctgggtgcaatcagtggggaggggctcatggcctgagcttggctttgcaggatggcctggccactgtggggcagagagcactgcctgcgagggccaggggaaggctggcactttctccaaatttcacgttcgtgcaaagacacagtcattcctttctacagcgtagagctcagagctgaagcagcctccagacctgctgtcatgggtatttaaggacctaaatgttgctgtcagcctatgacatgaatgtgcccctaaggctagattctgggtttctccagagagacgagaaacaggagggaaaaggaaggaagggagggaggaggctggggaggagggacagcttctagtccagctggagagatctgtcaacccagcctggggggtggagctggagggatcaagcagaatgtcctgaaggcagctgccctcagtctacttgtgggagaggacaggagggagaggtgccgtggtgagactgaccctcgggcccacgggtggatgatggcaaaggtcctgtggcaggtgtgggagaagcagggctgcggccagctgccctgagaggcttcaaattcaggccagatctgctctgggcaagaggaagctgtgggtttgggagcttcagagacaggggagcaggcctgtcactcaccctcttttccttaaaggctgtcacccccagcagtgcaccctgcagcctgcctatcccctgtgcagctccagctccgtctgtccccagcaatgcaccccacgcccatgtcccccactccctatgatgctctcgcgccttctggagcagcagtggtaccagctggaggctgtggaaaaattgagaggagacaaaagtgggaagagcaggccgtggagagagtgtctaaacacagggactatttggagattgtcttatttttggtttgaaatgggcccacctgctagtattgtacaaacggctctgctcgctaggccaggcctgcagtggctacgggcctatccttcactggtcagcctggagcagctcctcggacctcagtctgctcatccgtgggtagaggcgacgcagaccccatcccactggggactgggccagacagcctgtgaggcagtcagctggtgcctggccagagggtgtctgaaaggcctcttggctgcagggtgcatctgcttttgggacagctcttcagagccatctcagaagggacagcatccgcctgtctacttcaactcccactgatgacgtccatgtgtcattagtgccaattagaggagggcagcaggctgagtgcttggcctggggcgcaagcttgtgggagggaaaattggattccccgctagacaaatgtgattacccgtgctgcctggacccaccccattcaggaccagggcataaatggccaggtgggaccagagagctcaccccagccatgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggtgagtctctcctccctgccagctctccaaacccttcctgacccggcaccccatctggccgtctttctgcactcaccctccttaacccagaaagttcttctgtcacctgtcagtgtttgagttgactctgctctgagccaagtctgcaccccgagcttgggcatcatggggatctcagtttgaggacaaaataggaaagacatgctttccatggtccttgactgcccgccccaaatcatgggacccagtaatcccaaggaatggaactatacacagaggacgcacacaccacacacactcgtgccgctccacaccccacacgcgcatgagcacagaccccacgaccctcggccctgtaaacaatgcctagtaccacgtccccagagcacacatgcccactgatgtgggccaggtggtggcgcgtggctgggcacagcatgaggcctgcacacccatgggatccagcctgacctactgtgcttgtacccgtggaccaactgagcaggtgcagacaccctgcccctacccataggtgttgaacaagccccacagggctcagccaaaactgttaggatgggctcttgactcctttccgtccaaatttacctccactcttgtttcacagggtggagaaaggggaaaagtttcccttcaaactggaggggactttaggcccttccacaagctgcagggggtccccgaagtgggcgagcccaccgcctacaatgggtcctgctccagccttcctttccacatgggactggccaccagggcttctttgtggatgaaacccaactctctccacagaaacacacaaaggagtgacaaaaaagttttatttctgaagtcaggaggtgcctgctttatctgggagtgccgagctggagcgggggagctgtgtctgtgcggagcggccggctccagctctgcatcttggtctcaccatgggctggtggggcggagagtccctctctgcctttttgggtgttgtgaattcatgagggcagatggtggctgctgtttctggagctgagcttgccccctccaattcccaagactcggccaggaggcacttgcctgtgtcgctagtgaggcttagggccacccaggtagggtgagtggagctgcctgggaagggccctgctctgacccatagggctgcacagattcctgtgcacaaagacactctgtggctcaggttccagccaagaaagacctgggacagccctgattctgagccgtcagccgtctggaggagcagctgaaccccatcgctgacagtttggggttcttcgcaagcctctgccatgaggcaccctgagtgcaggagcatttgctcctctctggggcagcgtcccccctgcctgcatttcccggctgctagggaagccagaggaagccaggtgactttgcctttccgtgcactggcaaggttaatttgcacaacaaattcctacgaaagcaaatgtcagccttattattcctccctaagcaatatgttcaactaatatcttcttgatttccagctgaaatatcacaggcgaactttctgcctctgtttaaaatgagtctctcggcaaaccagcggtgtccccagcggggttgcattgtgtggcttttttctctagggaaagttttgcagtatcttttgcagatttcttttttctcaaggaaatgaagaaaagatgttttaccctgaatgtaagattaaaaagaaacacaacccaaagtccttaaggccaagggcccgaggctttcttggggtttccatgggaaaggccaggcagggcagggaagcagcttcgtttggacaattctggtgggctctgggtggctggggtggtctctagttgcctggttcctggccctagggtgttttagggttggggcaatattggcctggggtgtgagagtcaggtggaggaggtagctagggatatgggcttggtgtgggtcggaatgttaggaatatgattctcacacacgtgtgaatgttggagggcaggacaggtgtaaacaactctgaccatctgtttgagccttcaatcaattaatagatgccaaatagacaaatatggaatctaagaagggcccttcttgagtacgaagggcagcctgcttgttggggaaggctcctcgctgtctctcagtgggtctccctggtggtcttccatgtgacctggcctcgggccaccgtgtccctgccccttagggcccagtgcaaggggagcggccggagacggggagggcagaggtcactgatccagatcccaggaagcatcctcggagaatgcagcaggtccaatgcctccctgggcctcagtttaccttctccaagcagggctgggactaaggtgaggggaacaatgcctaggctgcagggtttaaagtggtgcttcaggctgggtgtggtggctcatgcctgtaattccagcactttgggagggcaaggcaggaggaccgcttgaggccaggagttcaggaccagcctaggcaacatagcgagaccctatctcaaaaaaaaaaaaaaaaaaatccaaaattacatgtatttataaagtaataaagcagtgcttgttctcagggttgtgccagtgcagggtgggcacctgctatcaatcaccatcttagatgtggcaccctggtttctctctcctttcctgttcatgtcccaccctgttcccaactctcccctttctgaggctccgcaactctcctgcctgcatgaatgtgggcagcattggtctgaggcattgttcccagtcttgaggaggccttgggagcctcaggcatcttcttaagaagctcagtgtcccgcccgccaggcccgggaatgcccatggctaacagaacctgtgacctgctggcaagtgacagccctggttcctggctgcagaggaggaaccaactccactgtcggggctcatctccactgtctccaggcagaaatggagatagaaggtgtgagtgaagccacagccccaggcagaaccctcagatccacagggactgaggcccagcatccccagatcagctggcaatgaatgcggagctctgccggggaatgccctcttcccctgtggattggcccggcttggctccttcatgcctggagcccagtgcttgtctctgcaggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaagtaaggggtggccgcgagtacccaggagggcgtgggctgcgtgtatcatgctgccatcctgtgccaatgtcatagtacctttcctgtccctgataagtctggggcctgggcctggccagctatgacagagagaaagccaaggaggatggccagaggcagtggtggggccaaagcacttaggatggtccagctctgctattgcccctgagccctcaaagacgcagctctttgccaacacgtagctgacatggtttctagatgcggggcttgtgctgaagcctctcccattggactagaccttgcttctggatgtctctctcctcctggtcctgttaaccatcaggtgggattctggagcccaggcgacctggctttccatcccggccctgttgccagctcgctgtgaggctcgggacaactgcccccctcctctggacctcactttgcccatctgtaaaatggagatgggaactagatgatctgtatggcctgaccaactctgggagttcatgggagccataaaacattgtaaaagccataggcttcttatgctgctctaagagccccccaacctcttagggaaagcaacccaccttgcccttgaagacaaaactcttttaactctagcacacctgacagcttttgtcttgtgtaagtaatcctttggtgtggcagtggcctgggctggccgttagtgccaggtcttaatcatgggtgtagctgagtgaccacacgggaggccagtgccatcgaaagattgattgcatttccggagagaaggggcacctgtgccgtgcagggccacctgcagagccctgggtttggtcaggaggcagatgcaggagctaggggagagcccaggcctgaggctttcttggggtttccatgggaaaggccaggcagggcagggaagttgcttcatttggacaattctggtgggctctgggtggccggggtggtctctagttgcctggttcctggccctagggtgatttagggctgaggcaatattggcctggtgtgtgacagtcaggtggaggaggtggctaaggatatgggcttgggacgggttggagggttgggaatatgattctcacacaagcgtgaatgttggagggaagggcaggtgtaaacaactctggccatctgtttgagcctgcaatccattaatagatgccaaatagacaaatacggaatctaagaaaacagaacagctggctgtttgccagatgaggaaactaaggcccggagacggggagtggatgtacccaggggttcggggtgtgctggggcagacctggtgccagaagaggtgttcttccaggaggttgttgagcccttaccctgcttcccagtggacgaggcaagggtgagcagagaaccctctggaagcacctcacagggggaggccaatgcctgtgtgtgctcagcccagtggccccaggccaggtataggggcctttgcctggagttctgggcgtcccctgcacagggcggcccatcggctttccgcaaactcaaagagcaaattagccacccacacgggtctgcactgtggagtgcccagaaagctatgaaaggcactttccacacccgatccccgtttccattcatgacagcatgtgaggaagccagccccacagcttgcctcctgagtctgcctgtggcctccagcaccgcgtagatccatggagctttctgtggctgcttggtcccctcctgccaagctggtggtgactacataatatagcgtggctccgcagctcagcgtgaccatcagcaagccccagggtgtttccttcccttcatagagggcactgaatcctcaggctgggctgctgaactgaccaatgatcccccacacccagtccccagtgaccttggggttggtggagggaacaaatgttccggccacactggctcacggcgggcccagtagtcactggttgaatggatgttaagtgaatgtaggtggaatgtgtttagaagagaaaagtatttgatggccggtgcaaataggggatcctgggggtcgtcagcccgggatttggccccagccagggccatgcaagcctcaagggtcccttattcacagagatgagagtgaggtgtgtcacctggtaggtgtgggtgggcagggatgtggcatcctctcaggagcccaactctgggggctctgagagggcgaccagctgaaccctgtctcggctgcaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaaggtacgtgcgggtccagggccgaggtcctcgcccagccctgccttcctcccgggcctgggttgtccctgaccctggagagctgtccacagtcctggttggaccaggtgtcctcttatcactggaacctcaggcacctgcctgagcaggggagcagcaagtggtcttggcttccccatcactctgctcactcccctaccctcaaagggccttggagctcccacttccctgcctggaccaaagtgaccaacatcttgacttctgcatctttccttgggactggaactgctgtctgtctgccaggccacctcccccttcatgaaaaagcagctcgagtcagaactcacttgctctcgaacacccgtccggggaagacagaatagcaaaggcgatagctgtcgagtgtccactatgccactagtcccgggggaggggcgaggtgatccctccttcatcataagagcccctagtttccagcagaggaagtgtggcccagggaggttgagtgtccagggtcacatagcaagaaggggcatgtccttgaaggtgcactcagagaggttatgtgagtgtccagagtcacacagcaggaagaggcatggccttgaaggtgcgctttgggcccgggctctaacctcagggctgccctgcctcccactggggctgcaggagctggcccggccacagccccatatgcatgaggacggctgcgtcctgtccctgccttggcctgtacgaacctcatttccttcactctggagctgcctacgggatttctttctgggctgatggctccaccctcaaggctgtgaaccccagaagtgcccctgaaattgtctggatcatccctcccattttacagatgggcattcggaagcccatggaggagggctgctggggaggggagggtgggcggccggttcccgggctcagagggctgcctcctcacagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggtgcgtgccctgcgaccccagcatggtgtctcctgcctgggcccctggcatccccacacctctgtttccccagcttcaccgtctcagaggcttcaagaaggggctcccaagggggctcacgaggccaccagaagggccaggcctgaggtggccccctcgcctctgtgatgtctgaaatgcttcaagccttttttttattttccacagaaacgcaagtgccgcaggaccttatgccctcagtgggtcctgattctgtttcccaactggagtcagggttttgtgtacaggtggtcccagggctggctggcggtggggccagtgttgaggcctccacaggctgagacgatgggggtctccccagctcttacacccgtctagagaaggggttttgggggaaggctcagccctaggcaccagctcctctccccaactccctgacccgagtctcacaggatgttcctggggcgtgtaatgagctgcctgtcaggaggaagcatcgctctaatcctgctgcgccccctccaccacccctgaggctcaggccccaacagttgactgggtttgcccctgcccagacctggggccctctcaggacacacccgtctgtctgacaccttgccccacacaggcattttactacccagaggaagccggccttgccttcgggggtccagggtcctccagatatctccgcctggaagttcactaccacaacccactggtgatagaaggtaggcggctctgctgccatcctcctcagaagccctaggactcagctgtgttgagccagtgagcaaatcccgcccttcgtctgcccagcatggtgcccccgctgtacagctcctcttggcacgaggcccttgcgtctgcctcatccgctgtccatcttccatggctgtggtgggctcccagggacaggacctcgaggggctcactcctcacagcttcgccagggcccagcagtggccccacacctccctcctcgtccctataatacgggctgccatcggcgcagcactgtgcatcccaggggaaaggacaaggagaattttcataagggaagctgccagatgccaagttccaaatacagggagaggtgtgtgcataaacagggaggtggtagtaaagcagggcatattccaggacacaggcgctccggcctggccagagtgcagggacgggaaggggagctggggcagctgctgttggatcacccatacctgagggtggagtgagcagggtcagcttttagcatggcaaggccaggtgatgctgtctcagaaactgaaaaaaatacttccctctctctgttgcaccagcatctttcaccatatatagacacacacgcacacaatgcacacacacacgcacacacacatgcacacatgtacacatatgcacgcagaagcacacacatgcacacactttttctctctctctgaatggtgcttcttcttttcatttgtgcaaggtgcagaagtggcctaagagataggtgctaggctgtgcctcaccaccttggggacgctgggtggatgacctcacccgctgcctgttctcccacctcccacagctattgtgaagctgggaaaggctcacgcacagaacttgctgtgggcacggggctgtgctcagctaacagtcgcctgtggttttttttttttttcctggctgcataagtaataccttccgccactgttggagttatctccacatgcacagagaagggtataagtcagcttgggccttagcatgacacgggatttattgctcatttaaaccctgaaagcaaatggatttttgaaaactcctgaagcatcagggaagtctgtctcttcatgattatctggttgtatttatggatcctttgccaaatataaggacgctcctgtcacttcacccatcttgagatgggctgcttttctataaatatcaaaatcccacaattatttcatgatttaatccccatctgaattttaaccaattgcaacaccctttttattattatcctctgatgtaatcagcctggagatacaggagccgtttgagtttggatggtgtaggggtgtcgagggaagaaggcagaggcaagaggagttgttttggcctcatcttaaaggaaacaagtagggagatggttgggccccctggaagtgccctgcaccccagtccacagccctgggtttgaacctcagcttggccacttcccagccctgtggtcttgtgtggagtcttcagttcaggctccatcctcagtttcttaatctgtgaaatagggctgatgattctcactgtgcaaaacttccatgaaaggggtaggttatgcttagagcatttttggcacccagggaagatgttagtatctgtaccaccctcttggtttgatcagaaagggcaatgcatgtacactggtgagaagatggacagcagaaaagcatgaagaagatgaaaccaccccccagctcccggctccaagttttgaagtgagcactggtcacccagctatgtgtctgtcctgactgcttttctggcccattaatttttttcttgtgactagaattttatatctttttttttcattgttgtttgtttttttacttaaacttcatcagaagcctcttccctgtgaattaaaaccccttgtcaatttcacactccttgccgcctgacatccctttcctgtacataacccagggggcagagcctcctgctgcacagcccctccagaccaccccgccatgtccgccatgtccaccatgtccaccatgcatccgggggcatggggccaggcctttagatcctccgccaaccatgagcccagccggtactcagagcctggctgctgattcactaggcatggagtttcaggaacggtggggctacctggatgacacctggttgtgaggatgttcgagtgggtgccagcatccctgaacctctgtttttttgttttgagacgaaatctcactctgtcacccaggctggagtgcaatgcacgatctcagcttaatgcaacctccgcctcccaggttcaagcgattctcctgcctcagcctcctgagtagctgggattataggtgcgtgccaccacacctggctaatttttgtatttttagtagagacagggtttcgccatgttggtcaggctggtctcgaactcccaacctcaggtgatccacacacctcggcctcccaaagtgctgggattacaaggcgtgagccaccgtgcccggccccctggacctctgaccatcagtttcatgtgaccactgggaggctggcccagggagcttcagggactctccaattagcaaacggcaaggagaactaacaggtgtggccacaccataatcaggagacacagtctccgtgactcgaagaagcaccatgttattcctttggaagaggcccttgagtgtgggctgaggctcataaagggacagcaagtcatctgagagcacacagcacgctgttgaccaagcaggacctggcctgtgcatgaacgggggctagacctgcaacgctggccctcctcctggggggccacattctcactcaaattgttcctgagatgtcagcttggtaggtgggttccttgggtctgcaggacataaatcaaagtagtaaaagtgggggctgctgggaggatgtgctccttgaatgcttcttgttaacctcaacacagagatacactcacacttgcccagctttgacgcagggccagggctcttctgtgccatcggcagatgggagttccatgccctcttctttgcccagaccacaccctgcaggttgtcaccgtcttgcaggctgatttccagcttaggttcctttgaacgtggaagaagaacatcaaagcacttatgaaacaatctgagcacagaactcaagttgtttacgagtttccgtctatcagcagcatctcacccgcacctgattccatggaggctttaagtggctcacgttgatcacatctttccatagcattcaactagttttcatagaaacagcagctctttcttcccagtgagtgtagcctgtttgcgttaattgatcttgcgagctgcctggcatccacaggtgtggaaacaaagacagccagctcttggtctgcctagcaggtgggagcagatggggggtgaccggccctgcctcctggctgagggtggctggggtcatagggataatctgtccgcagggggaagtgagagggcctccacttaccgctcacctccatccatcccaccttctcccaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggtgagtggggctgggcccggcactgcaccctccctcctcccgcgtccctcagtggaggcctggcaggtcgtggcccacgaagggtggcaggcacagctttggtttcccctgaccctgaatccccctgcggtcctccctcttttctgtatgcaagggaaccctgctgctgagaggccatttgtgtgtgtatgcacctccctctccagcaataaccatggctcccactagtccacacccacgtgccaggcttccacgagctgcattttaaaatatgccttcattatgtaagcaacacacacatgcacttgccactcacaagcgcaggcactgcagctaaagagaacgctcccctcatccgctgccgcctccccctgagatagccacttcttggctctttgtgtccttccagacctttttcctgtatatttcaggaagctcttgcaggtgttagaaaccttttgtgtttttaaaaagttgtattgaatagttaacaaatttttcaacaaatgggaggcatttttctggtgatttgcctttttattgctgcatagtattccacaggatggggttttcaccacgcacctgagcagggcaggactaggtgaggcagtgaagtgccgggtacaggatctcagggagcacccgtcctcagggctatgcacgctgggtggaggcacaggttggcgcttagactggcgccaacagcaggtcctgtccttggcttctggtgagttcagagagtgactactaaaatctcctcctttgcttgccctatcttggtccaagcctgtgctgaactgtctccctatcaatcagtgtctaggctgttctcaacttttcaccaatagaaagaagcttctgggaaatccttgtccatgtaggaaaccattttctcatgtagatttctaggcatgaaattgctgctcagagatgtgagtgttcccttgagtaaatcttgcaaaatgcccctcagaaagcccatcttctgctccctcccacacataggacgagagggtgcccggttttactgacccactggattattaatattgtaaatattttctgtcatttgggaggaagacatgtcagtgttgtttaacttgaattttctatttgtggacttgaggatcttttcctctgcctcttggccatttgttcctgttttctgttcattcctatgctcggtttttccagtaggtggtttgtttttcttactgttggtttctaggagttcttcttatatgatggatgttatttcatagtttgtgtatatgttacaaacatttcctcctgtgcggtagctttacttctcacagtgacctgcaaagtaagtgttgacgtacccatttcacagatggggagactgaggcttgctgggatcacactgccagcagtcacgcagagtgaagattcaaataccagtctgtctgactttgaaagctgtggccgtgacagcagatttcgttgtaatgaggtttagagtggattttccttcctagtaaatgggtcgattgggatttgttcttcatgtgggtgagcccccagagcatcccagtcttccaagcaaaggttcctcaaggctgaagggagacggagctctcagccggcatggcacccattgtctccggcaggaaatcagctccttttgtcccagacgggggtggacactctctcccacttccctaaagcgcccactggtgaagcgtgggcccatgtaaaaggcaccttggccagggctcatggggaagagcggcttccggccaggcagcactcactgccccttgcagggccttggggccttcgaccccgctgaccgctgactgtgagaacgcctctctccagcctcaggaatacagacccgcctccccttgccagagtcctccactaccttaagtaacagaatgagaatgttcagtcttgtctctcctttggcagataaaagaggggcacaaattctgcagccaaaatctggcctagtctagctatcccagtgaaataggccaagacaagagtgctgctttggaccagagtgcccagaagagcatagtcctccctccacctggccgacacctggcatctctgggccagggtcggcctctgggggccaaaggggcattgggaccctttgggctcccaggcctggcacacagtggcctctcaagccattgcaagggacacaaagctataggcgacggcaaggtcagggcggccgctgcttgggagcgagagggaaggagcaaaagtgagtcctaaaaagctcggccatctgggaccttcagggatggggctgtcgggaccttgagctctgggacctgctgactgcatgaacaaactgggcagagcctggcagcgggtgggcaaaaggacaactgactcacaaagaaaatgctcgatttcaggaaagacgtgttcttttctttccttctttccttcttttctttcctttcttttctttttctttctttttctttttctttcttttctttcctttctttctttccttccttccttccttctcttttctttcttccttcctttctttttttttttttttgatggagtttcgctcctgttgcccaggctgcagtgcaatggcacaatcttggctcactgcaacctctgcctcccgggttcaagtgattctcctgtctcagcctcctgagtagctgggattacaggcacgtgccaccatgcccggccaatttttgtatttttagtagaggcggggttttaccatgttggccagactattctcaaactccttacctcaaatgatccatgtgcctcagcctcccaaagtgctgggattacaagcatgagccaccatgcccagccatggaaatgcattttctatctaaaaaaagttagcattaggttagagaaaactttcgttctctggaagattctctcatgccccagtgatggcataagacctcttgagatgagggctgccatcttttctgtgaggccggcctgcagcctcagagtgtccagctgcagcaccccatggtcacatccatcttggtcctggatgaccaccttccagttgtagctacagctcccagctgtagcacggggtgatgctgagcacagggagaatgcagccttggctgctttgaagctgaaaggaagccacaacgcagggcagctgaaggtcctgctcggcccaccacgtaggggacctgccaagtaccaccttctgccacttgcttttccctggacagcaagctcttcagcacagaggccacgcgctgctcagcttggtggctttgccacaccctgtccacgggaggctcgccttaaaggcctgttgactgagtgaagatgaacctgtcaggcttcaggggctcaggagaggatgaaggactcggaaagaaagtcgctcctgagtgggactaggggctgcttctttgggagctgggggctgttgcggccccctcgctcttccccgtgaggtttctgatggtggctctaacctggccggggagaaagacctagaaaatgcaagtgttccagggaagcaaactgcccagggtggctgctccctaccgggtcctggccatggacgggagggtcccctcgggggtcaggccctgacactgcagccccccgaccccacaggcactgcctccctccgggatccacatcttcgcctctcagctccacacacacctgactgggagaaaggtggtcacagtgctggtccgggacggccgggagtgggagatcgtgaaccaggacaatcactacagccctcacttccaggtaggaacctgcaccccacccctgccccgcccccacaccctgccaccacacgacctcctgggtctactgtttcctgacaccatagggatggctccaggctggcttctttttcctgggccagccccacccgccccccacccatgtggcctgtgctccccacttgggtgtctggtgtctgatcgtagggaggcctctggcacatggcagatggtggtgggattcgggagacccaggcggccctctgggaacatcaatcttggtcttggataaccaccttctggtttgaatctaatgccctccctggccagaagccacacttagcgggctctggcttccactgtagaggctggggcaaaatggacacccccagaggtcagggaggcctgagggaggacacagtggccgggggtctggtctgcagctctctgaggtctcctctcccccacccctcggctctgcctgccccaggagatccgcatgttgaagaaggtcgtgtcggtccatccggtgagtgcccagcgggaaggctgtcccactcactgccaccagctggggtggctgagagggctgggggtgccaccagaaggagagggacacagaaagtgatagggggagggagagccatccagggcagggggagggtgcctgtgggtggctctgggctgggctacctcatggggagactcactcaggagttcatggagagacgttggaaagagtggagcagacaggacactcccaggggacgcgtgtcctcagtctgatgggccgaccacaaacccgagagtgtttgggggagatgagggcactaaggcaggcagtggagccctgatcccacagagggccaagcccaggcctcggtggggacttgcccaagtcctttgagatgtgtcatggcccaccagctgcacccccactggcctgggccctggccctgttgtgacccactgggtcacaggagctgatggtttataacttgctcgggaacactcagcctgtgaccttcgcacatgaatctgctgggctccttgtagtggacgacagggactgtaccccagaggtgccgtggcatgcacagtggcgtggtcctatgggggcgaggcctccagcacctgccaacgccaggtggcaggtgctgatggtcacattggcttttcctcagggagatgtgctcatcacctcctgcacgtacaacacagaagaccgggagctggccacagtggtaagtcacccccgcttccccctgcacctgcccagggcgagtgttcagcctgagccatctgaggaaggatgacaggtcttgactcctcacttagggcatgggctcgtcccctcaataagccagtcgttctcagctccctgaaccacagtggcagcatcaccagggagcttgggatgaatgcaacctcctgggtgccaccccaggcccactgagtcagagacacaggcggtggcatcgggcaatccatgttttaacaagctcccagcggatgttgacccctgctcaaggttgagaagcactcacaccaagaagcttctcagcacccggggctggtgtggggagaagctgtaggacaagaggttgacctttgccccgtggagctcaaggtgcaccagggagacaggcctggagcacctgctgctaacaacaagcaaaattacaaaacaaaactttaaaaaccaggttgaggaggcagaggtgcggggacctgggagggccttgtcagaaatgtggctgtcacatggagcccaggggagaggggaggaggtgaaggaaggctctgtgcaggggctgcgtgcgggaaggcccagaggaccaagaacattctcaggatggaaaggagaggaggagagggtggagacatgggtgggggtcaggcaggatgagcgtcagctgaggatgcattttggctggactgcagacagttcaaggagaatctgcactggagagatctattttcaaggctgggtatgcaggcagcaccaggacacgggcagccacgtgatgcatcacgcagcggggctgcttccgggagccaaaggggatgctgttcacaattacctgggtcccaggcacaagccagggctgtcctggcaaatgggccaccttgccagtggatccgtgccagctgcttcggtaaccatggtggtctccaataattatcctgtgaattgtgtggctcaagtggagcagacctgggttacagctaccctgacatccctcagcgccaggaactcaggtccatgtcacagccctattctttgtgttttaatccaatgtggattcacctgatgtttactgagcccagactgccagtggtttattttattttattttatattttatttttttttgagacggagtctcgctctgtcacccaggctgtgtgttctcagcttgctgcaacctccacctcccgagttcaaccgattctcctgcctcagcctcctgaatagctgggactacaggcacccaccaccacgcctggctaatttttgtatttttagtagagatggattttcaccatgttggccaggctggtctcaaactcctcatgtaatccctcatgctgggattacaggcatgagccatagcacccagccagtgtttgtattttcacaggtgagacataaaggctcagagagggcaggcacttgaccaaagtcacacagctgatagatggctgagctgggatttgacccagggtcttgtgcctcacagctgttaccccacccttcctgtctcccttggatttcaggtgacaagtgtcctaggttcctgatcacaaactcagggtggagacaggacagctttgtcagtcctttattctctctagaggaggtgctcagtatatcacagcagtggctgatgtcgggtgcttgccacagctcagcactgctctaataactcatcctaaccacaccaagccttgctgagacctctgagcaatcccaccaggagatacagtgaggtccagccactcaggccacacagcgaacaggaggcagggctggtatgggtgcaggtgccaaccccgactgtgccgcctctcggctaagcacctgtgcagtgactgagtgggctcgcaaacagagggctctgcaggtggagcaccccaggcaagtccccaccatcagccccattctgcaggcgcggccccggggccagggatgggagggtcttgccgggcatccagcgaggagactgcatattccctgcccaatctggcttcacggcggcggaactgacgccacgtcccagggcgttcggggctgccaggcctggtgagcaccgcggacatctcagatggccgttctgcaggttgaggccctcggtgccagcgtccccgtgggcagttctgtggcttccctggcccatgtcgtcctcttggcagtggccacatcacagcaccaggtgggatcaaaggggagggcagctccccaggtggacctgagcttctcacactctgacaagccctcgcctgctgatccaagacacagtggcctttgaaattcgatttccttccccaggtgaaagaggagaacagattctacacagggtcggactcagttcccttttgatgtctgtggtggcagagggtggggagggacaggaactcacacaggagggcaatcgtcccgatctgacgggggcgggatggatgagaaaagctgggaaaggaggaatccggcccagagaacaatgctggcaaaaacgcgtcctggccaacaggtgccaggtttcgtctctgggcagaactgtcccatgctctttgtctgcacgggaggagggggcggcagctggtgtaagtgccacgccaagctttgcccagtccctttgttctgccatagagtaaagattgcctttcttccccaccagccagatgaaatccccaggcccacagcagcttcacaaacagcggggagcctggaggggcaagggtggccagggcgtcatgtcccggcccctgacctgctgggatctgagctgctgccgggggagctttgctctctccagccccagctcctccaagctgctgctgttcttcctcctatggctgaggctccacggtcaccagctccaagagcagcaacccagcgaggggcttaaagctggcagtggggactcagagggtgcctgccctgcccctcccatgcgatggcaggccgtagggttgccgtgagaggctggaggttgtcgcggcctctagtcacggtcctgtcttatagagtccctgctcccctcagagccacgttggagaaatgactggtggacggtgcggggctgcagtggaaagggcctcccttgcagtccttggctccaggctctcgctggaggtcatggggacagcttccagacaatggccgggacgctgggtgcactcaggctgtgccaccgatgctgtggccaccacggggcatccccttgcctgctctgagactcagtttctgtacccataaaatgggcacaataacaccccatccgcttgtcccgtttcatttttcctcacagcatcatcagtacctgatacgaatttcctggttgactcactcactcactgcctgtctctcctgccaatggtggcaattccttgagggcagggactcggttccccagagcatgcctggcacggtgcagtgaacagacgagtggacgcagtgtacacgtgggtgcggcgaaagctgctggatggcagcgtctgcgtggcatggcccggggctgacgggtctcctccaacttgcaggggggcttcgggatcctggaggagatgtgtgtcaactacgtgcactactacccccagacgcagctggagctctgcaagagcgctgtggacgccggcttcctgcagaagtacttccacctcatcaacaggtgagggctccctgcacaagctccctgcccccagggaaccccgacacagaacctcgggcctgttaggcggctgggcagattggaggagtccaggctaagttctaggagcagagacctgtggcggcatcactcacccctcccctcactcgtttcctgctgagtctggatttggcttcagagcctcctcaacccagcctgcagcagccattacccacccgccaaggtgacaggagaggtgaggccgttgccggtgaaggcagcatctggggtggcctggcggaggcagcggggctggggaggaggtggcaggacggttgccccagggacaggactcgagttgcagggaggtgttgctggtgcccactgggctccctgcccgtcagctgctccccagcctggctgttccttgtccccaccaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccaggtgcgctgccatgggcccgggtggggcatgcagtcaggcaggcctcatggggggccccagtgaggggtgatgggtctgcactccaaactgctggcaaaagcactcgcacaagacaatgagagcaagtgccaggtggtgacacataggcctagacagccagccagccagcagagagagaggagagaggagagagaggagagagaggagagagaggagagagaggagagagggagagggagagagggagagggagagaggagagagagaggagagagagagagagagagagggagagagagagaaccaataacgaggcaaggaagggagggcaggcaccctctctggtgacacctccacactgtaccgaatgccaaatgcaggtggtgtgagcagggcgcactaacctgcctaaaaataaagcaccaggggaggggaaggtaagaaacgaaccagtctgaagctgcgagctggttttttcctccttatctgagacccactggtattcgaaggcatctaatttatcctgggcccactgggctgtggtcaggaggccagggcctatgcagagttagtcgcgtaaggtgccgcagcctggagatccaggaagatccttcccagaagcatttgggagccagattaactgctaagtcaaacatcctcagcaccaagggaaggaagggctaatactggcttgctgagaatagtgtggggtggacgtctgatggggttgaaaacttggcatttggtgtagccttgaggggaagagatagctaaaaaatatcagagcctgcagccaggggctctggttgctacactagggtgaatgattaaattgggtggggacagaggcggggagaggcctggatgactcccaggttcctgactaggtgaatgggaagccaggggagggggcatttactgaggtgaggacccccaaaaagcaacttgggggagcagagtgagttcagtttgagacaagctgagtttgagggcaagaatccaagaggtggctgggaagtggctggggaagcagccacccatcttgcccctccagcctcagtttacctcctgcccccttccttgcagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggtatgtttgcactccgggccgtcgctccaggagagagaagcttgctcctgagcctcctccctgtgccaggcgtggtaccaagtgcttccccctgagcgtcctgaagctgcctcagctggcctgggtgggtctccccttcctgccctctgagctgcctctcagggacaagttcagctctttgatggtttctggagacagtaacagatgcacttgtgttcagccacttcagcaaaacgctgcccagcctcatggggagagagggagatggatgggcctcggagtcccctcgcatcagctaagcggctgctgcttctgcaaggcacttcacttcatcacagaagggaagtcacgagcccaggagctctgcctcacgttgtataaatcacagcttcttgtggtccataagtcacggcgctagcgctgtgaaatgccaggccccagcctggagagccactccggccctctgtcatctttacagcctaggtgacagtagacacggagcaggcccaagaagcctcttcccgcgatcacacccaattgccagcccagagaagggtcccagggtcctgcccaaacacctggggggcacttgtagcctgccgatctcgggcagggaaactgagactcccagataagtacctcacctggggcccaagagcggcagtgattgggaatcctagccagctctggaacctgccacagcgacaaccccacccccacctcaccccccactcacactcttgctctcaggctggttatcctcttcctcttgcagagacagcagccgtgtcccccctaccccgctccagcagtacccgcacctcctacacccagataagcgtaaccccgtggttgctgagagttgccacttgccccacactgaggctatgcacagccgtggcaatctcgtgaagccatgtagtttctgtttccattgatggaggaggaaactgaggctcagagacctaaagttaggtgccaaggtcacccagagtaagccggggagctcgaagtgtccccaggtctgactccagtgtctgaatgctcaacctctgcttacttaggaaacaggaatttccccaggacccttgtgggggattttatctaaaataagttccttatttagaggcttaggggaagtgctttgttacctgaaaatgacctacatgccccaagccaaagggactctgggctcgcccaccttccgaatgattggggtgtgagtccagcagcccaggttgctattcctgcccctgctgtgtgaccctgagttagttactttccttccctaggcttgggtctccctatctgcccaccgaggagagggttccccagcctcccagggggcagggactgctagggtggcacaaccccccatctgtgaggtgctcagagccctggggtgaggaatgctcatgcccatcagtgttgagagaagtggggcgaccccaggctccagccagcataggggtgcctgcccgactgggtcccagagcacaccagggctgtgctttctggtggctgctagcctcatgtggctacttacgattaattttaaattaattaaaatgatacaaggtcgggtgctgtggctcatgcctgtaatcccagcactttgggaggctgagatgcgaggatcacttgagcccaggagttcaagaccagcctgggcaacatagtgaaatcctgtctctacaaaaaatacaataattagggctgggcgcggtggctcacgcctgtaatcccagcattttgggagactgaggcgggcggatcacctgaggtcggtagttcgagaccagcctggccaatatggtgaaaccccgtctctactaaaaatacaaaaattagccaggctgtggtggtgcgcgtttgtaatcctagctatttgggaggctgaggtgggagaattgcttgacctgggaggtggaggttgtagtgagctgagatcacaccactgtactccagcttgggcaacagagtaaaaccctgtctcaaaaaaaaaacaacaacaacaaaaaaaaacaaaatggaacctttctgcgtcccattcatacccccaacttttcacatggcccaaggctgtctcactgcacactgtggtatagcgctctgccggtgacgatgtaggcactttcttttttttgttgtttttgagacagagtttccctcttgttgcccaggctggagtgcaatggcataatctcggctcaccacaacctccgcttcctgggttcaagcaattctcccacctcagcctcccaagtatctgggattacaggcgtgtgccaccacgcccagctaattttgtgtttttagtagagatgagacttcaccatattggtcaggctggtctcaaactcccaacctcaggtgatccgcccccctcggcctcccaaagtgctgggattacaggcgtcagtcactgcgcccggccagtgtaggcactttcaaaacagtttgctcagaattcctgagaggcagtactcagccacagtgagcgtcatggtatcaatatttccagaaaaaaaatttaaaaatagctacgaaacggtgtttttaaagttgaggtctggaagacctggctcggggtctgggaaggtgggtcttttgtgatgtggtccccgggcggtgcacttgggagccatggcggggccaggacctctggcagcgcagggatggagcccgcaggtgatgagcttgggaggtgagttgtggaggctgcgctcacatcaatgcccagtgccctccccgaggggccaggttctctctccacaggggcgggggaagcacacaggggacagggaggggtgctgggttctctctcctcgggacagggagcgcagccaggttctctctcctcgggacagggtggtgccgttgcgtgcattccccagctgcagccacgagaaacaatttggagcggaacccgggctctgacctcccctcatcctcagccttcccccagggatgggccgtgagatgaatgtggtcaccggcccaatccaggggtctatggccaaaccgcagacccggaggaagcaggccaggccatctggggagccggctcccctcctctcctcccctggctcccacaaagctgtctcatccagaagccaggcccgcctgtgagcaaggggaggctgcaggtgttccttcagcctgaagcgtgtgaaagccaacagcccccaccctggtctccagccgcagccccctccccagactcagggggccaaacccacttttcacagccatctgtaacccaaacgtctgcccacagctttgttcgagctcagtccacagtgggccgcgtggcctgggagcgtccagtggcagctggggcctgccaggactgctgcccccagatcgctgtttgctgtgtgtgtggctctgtggggccccggctccacgataccctcaagcatctgcctcccgctcttcccagattgcagggcatgcctggcaagactgcgcagtgccgctctgacgggcctgatctgaacctgggctcggggggacaagggaggggactgagcacgtgggatggacagagatgcacacccctcccaggcaggagaggcagagctgcttctgacacacaggcagttatcagggggaagagaaggtgggcagaggagccaccccatctcaaggcagcgtgcagggcagagcctaagagagggtcctcctgcaagggccagacaaggaggagggcatgggcaggaaccgcgtccaaatcaacagcaaagacaaaggtcacctagaaagggggactccaccagactcttacccagcagcacgtccctcctgcctgggcctggtgagcgaggggctcaaggggaaactgaggcaggagctggcacttctgtgtgggtgaggagggcaccaatctgaggccccgcccgctccctgcttcggctcctctgtgttcccgggctgccgactctcaggaggctttgccacctgaagaacagggaggtcgagcaaggtaagaagagctttccagctcctgttccgacctgagagccgagaggcaccatcctgaagaatggccttggtcccaggcctccatgtgcgctgtggcagacaatgccagtcgatcacctctctttcctgacccagacacagcctcatgctcttcagccaagtgccccagggaagcccgccaccgatcagtcaagcctggagtaaaagatgaagcctatttgcttcgctgttttcacgtggggcttatcaagtatttactaagcaccttctagaagcttggaaagggctacaagccatggtccctgagcccaagacacttacaggtttgctttctgggaggattggggtggattagagactgccttccagtcagtgaccacaggatgggccatcttggtctctgtccgtatctggtttgggggttttcgcaggactaggcctaggctaaggacagggagggcacaagttctggctgggtccagggtcctgggacccagggccatttgggacctgtgagaatggatggacagcatgggatggggcatgtggtctgagccctcagtagattcccttcaccctcttgttgttggggtcgaagggcgacttcaggtgagcctgggcaccataggtcacccccattctctccagggcatagtccccgctcttcacaaagtccagcgagacctaggagcagaggtggggatgaggatcactctctgttggtaggtacagggctcacgtctgcctgcttctctggaggagggggtcttggtcttgctacctgccctgtgggcaaactcatccctgtgccagggactcctttctgaacccaggcattgccccagagcaggtgcagttcgtgtccatgtgatcttgagttggacatgggcatctggggtccggcaaagccaaggtctggcagccaatatgacttccaccggacaacacacctcccaccccagcaattccagatgcctgggaaacagcagcaacacggtggcttccccggacccgggcaagcacagcggccagagcagcgccgaggctgggggccaatccggctcgaatccctcggggcaggggcggctggaacagccttctagacagcttggcctctgcatgctccccatcccacaccctggctcgggctccccagcaagcgctcgggagccagtcagccccaggtgcaggtgctcttaggcaggaggagggtgtcacctccagcctggcacagctggtgacgcctggcacttttgctgcagctgctatgaggagggcaggctaggccactcagggaagctgttcttcctttacagcaattaaacccaaggtcagggccacaggagggagtctcgggctccgctctgggagtcagagggctccttcttgttcctagcagctcaggactggatgaaaaaaataaaaaacaaaccaagctttttctgcgacaggagctttaggagtggtgcttctgagccatgtgtgcacctgcagggctgagagctctgagctgccccccgcaggcaggcagcatggagagctggtggccttcagatgtccacgggcatgcacaactcaaagcgggcatctggccttgctaacagatacctacgaggcagaaacgccttccccatctcggagcctttcccatcaatgagcaggtttccctatcttaggcagaaacctccgttaccccacttgggtgctagaaaatgtttaacaaccagctctggggtgaggtgggtgtgactgtagcatttgcccatttccatggtgcaaatgctctggacagccctgatggagggggcaggagacgtgcaccggccgctctgggtgcatcgactggttccccggctgcctgtctggatgccgtttaacctcggaacctcggcttccctggtcacgttggttatggacccatccctgactccggagaaaggcgagcattactgttctttgaagaaatggcaaaggagcctccactccccagcccaccctggcatggagcccataaactccggtttggctgggccccagggctgtggcccccaggaccatggccccagggctgtgtcaggaggccctgcccaccgtgggagccatgccatcacaatccccacatattaagactcactctgtgcagtggcctgtatgacagccctgcatggtaggtgagtgtccacattttataaatgaggaaactgaggctccaagagaggatccttatccaaggtcacaaagcaagtaaaaggcagatccaaaggctagtggcatcaagtgtgtccccagcctcccagctccaccgccggactcagccccatgggctgccacttccccacagctccacaggaccatggtcttgcccgaggcctggcggtgtcccctccccattgggcctgcgagctgggcctgcgcatgttctgcagctcttgctaaggctgctccgtctccagcctacccctcctcatggcttctcccaagtgctcgctccctccccaattccctctacgtgtccatcaggggctcaggctggaaggctctggagccaggccagcacctcccggcctcacttagggcttaggccaaacgtcagatcggctcccatggagagacacgaccctcctcaccggcacctctacttgcagtgccagaaagatgggaaaaggaggtggaggtagagaccaccccttccccttctggggaggctgcccaccccctgccccaccacccctggccacccagagctgtcctgggacttgctcctgggggcagtgcctgctctttccagcctgttcctgcctcctgcagccaggggtcagggtcacctggagggggtggggttgcctggggtcaggggtgtcgggggtgaggaaagagaggataggaacatgggtctctgagtctctagtcggtcaccctgggggccacccctgcaccccaggcaaagggtgggctgtgggtggcctgaggtttgggtctctggtgtgaggagctggaaggtatcagcctggctggctggcacctccttctaaccaaaaaaagcctggaatcaccaaagtcggattcttccagaaagaaaacagagagcagctttggctctgcccaggcacagctggggagtcctccacctgctgaggcctcttcctcccccttctccttctccctccctcctccctctccctcctcctcctccttcctctctcccctttttccttccccctccttctcctccttccttcctccccctcttccctcctccctcctttctcttccctcctcctcttctggaccacacccgtgcctcctccctatgcccggcacactcagggtgcagtgcagggagctggtttggagctggtgagggatcggcatctgccttagcagggccagagaaggggactcaccggcccaccgctggggtcatggatgtaaccgtaggcgatggtcttgtcgatggcgaacccaaagtcagccctccggacatggcccaccacttggccgttcctccagatggcctccaggccaaacatgggtactttgctggaagaagcagtagagaaagctggggccccagaaaccgcagggtggggacgcgtccacagcggcctggaggagaatggggggctgcatgatgcacacccaaccgtggctccaggcagatagggctggcctactaggactacgctggtccccagagccagcccagcacctggcctggacagcagggctcgggcttcgagtgagtaaaagggatgaatagaaaacatcaaaaccaggagtggactttgctgtttccagaagcgagccccgtatatttgggagggcccctgcttccgatttccttccattgttgttcaactctggttttttttttttttttttttttggtgcagtggcacaatctagactcactacaacctccgcctcccaggttcaaacgattctcctgcctcagcctccggagtagctgggattacaggcacccaccaccatgcccggctaattttgtatttttaatagagatggggtttcatcatgttggccaggctggtctcgaactcctgacctcaagtgatctgcccacctcagcctcccaaagtgctgggattacagacttgagccactgcgcccggccaggttcattttttttatagtacaatacatactttattcaaaggactttactacatgtaatacatgaatgctcactgtaaaagttttaaagattaaaagcaggaagacaaaaaaaaaaaagtaagctaaaatcaaagaaaggccagcacccagggctaactggtaacattttgttgccagtctgcagacttctccctgtgcaatgggttatcacggcggcagctatgcaaaggggtccctgaatggaagggctggggtgatgttgagggcacctcctgcatcctcagcctggagtcactgtttgggtcccacctgtccatcagattaggacgaggctggaaggaggtttcgtaaacatctttggtgtcaccctagtttctgttctccacgtgaggacgctgaggccccaactgcccggagtcccagagcagtgtggcagggctgttctctgtgactccactgccagcatcttctctgcgcctgtcctggaactgcaacagtccagagccgcggcgcagggcagctattatgcagcctgacaggaaacccctgagcagagcgcactgggtcacaggggccgtccgaggccctcctaaacccagacatcaggctgcaggtacttcatggagggccagaaggtcggggtcaggcaagcagaaaggacccatggatgctgacctgtctgcaaggggccccctctccaggagctgagctgattcagggagctggacaggctgtcacacaagagacagagcctgacaggcacccagggagaagccacaggatgacgacgacacggctccactcaccgtccctctccctccctctccctccctctccctccctctcccccaccctccctctccctctccctcattctccctcaccctccctctccctcaccctcattctccctcagcctccctctccctctcccttcaccctccctctccctctcccttcaccctccctctcccttaccctccctctccctcgccctccctctcccctcgccctccctctcccctcaccctcaccctccctctccctcaccctccctctccctcaccctccctctccctcaccctccctctcccctcaccctccctctccctcaccctccctctccctcaccctccctctccccttaccctccccctccctctccctcaccttccctctcccctaccctccctctccctcaccctccctctcccctcaccctccctctccctcaccctccctctccctcaccctccctctccccttaccctccccctccctctccctcaccttccctctcccctaccctccctctccctcaccctccctctccctcaccctccatctcccctcaccctccctctcccctcaccctccctctccctcaccctccatctcccctcaccctccctctccctcaccctccctctccctcaccctccctctctctctccttccctctcccttaccctccctctccctcaccttccctctccctcaccttccctctccctcaccctccatctccctcaccctccctctccccttaccctccctctccctcaccttccctctcccttaccctccctctccctcaccctccatctcccctcaccctccctctccctcaccctccctctccctcaccctccctctctctctccttccctctcccttaccctccctctccctcaccttccctctccctcaccttccctctccctcaccctccatctccctcaccctccctctcccttaccctccctctccctcaccctccctctcccctcaccctccctctcccctcaccctccctctccctcaccctccctctcccctcatcctccctcaccctccctctccctcgtcctccctct

SEQ ID NO: 1067 - DNA, 46607 bp, Homo sapiens
ttcctgatggtgaggatgtttgattagttcatctacaggatttgatcttagcttgaagactattgatgctgatggttcccagggcagttgtttgaaggctgcaggacagaggtccagcaatgccaaagaggggcggtcatcatgacaaactacactactgaactaattgaaactggactcaggagacctcatctaatgtgtagaattctcattgattacaacttttatcagatatctttcatgactagaatacaatttaagctaattattttcctgtttaaacctaggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacatataatttaaatttggtattttttcccccatgatattaggatgataatcatttcaaagcacatgtctagcttcagagtaggatttgttcactggccaaagcctgccatgaaactatggctttcagcatctgtctgctctactggctcttgacaaaactcttgaggtcttcaagaaaagtaatgtactcctggtgctccagggctgtgctgagctccaccagctcatctgcaaaagtgttgtccacccctcggtcggcaaggaaatccattaggtggtcatataaggcctgcaaagaacaatatttactagttaaaaaaaaatctgtaatgaacattaaaatgcttttttctccccttgaactaggacccttccttccaaggcccaaaaggttcccccaccttatcaagcactcacccagtccaaggaatctgtgttgagtgtataattagtatccttccattcagactcgccagtggactgaaagctaacttccctgatagagaagatgtcactctcagcctcgtcttcttgtccaacctgagaagaaacaatattgggaaactgaagggttctccaggacaagctagactcaggggaagaaagggggccactgacagcatgaaactcatcaggttttaaccctcttccctcactccccacctctctccccctgctgggctggtctaagctagaaaagtgtttaaatttctgctaaaatagggacaggaagttcccaagggacacactgttccccaggggtgccaagaggctagcactccatcctgcatacctcatcctctggataatgacagtccaacacaagggccttcttgccatcatcattctttataacttcaaccacgaaattgggagttgatgtcagttcaggctggggaaacaagaagtcaatacatgctgctgctggaaggagatggatggctggatcaaggatctctgttcagagtgtctgatggccaccactattaggatattatgtagccatttgaatagtcttatgccatactattcccaaatgaagagcttgatctcacttctgttggcaccctgcttggttaaataacacactgggttttcagttaagaaatgtggataccagcctcagctatgtgccaattaactgagtttatatcagtcccttaacattccaagccttttcctccacccgtacactgcaaagctttcctaaagtttcaagatctctttccagcttgactgttccaggagtcttcataagggaccagggtcaaaggctggggaacctggccatccttatggctgaataacagcagcagcttttcctctgatgcggagctctgggagcagactgggtccaacgtcagggagatgctagttggggtggctgggaaagcagcacaccagagagctgcgccgtccacaccaggtcatgacccaacactgtactgatggctcttgggcagaatgtctagggactctgtggccctcatactggctggttactaggctgggcacagcacttcctgaaatgtttgaagagtaggcatgatccagttaaagtctcttatgcccctgccattctctctctcttttttttttttttttttttttgagacagagtcttgctctgtcgccaggctggagtgcagtggtgtgatcttggctcaccgcaacctctgcctcccgggttcaagcgattctcctgcctcagcctcccgagtagctgggattacagggacctgccaccatgcccagctaatttttgtatttttagtagagacggggtttcaccatgttggccaggatggtctcgatctcttgacctcgtgatctgcccgtctcggcctcccaaagtgctgggattataggcgtgagccatgcgactggacttagaggaattttttttttttgaaagaccaaagaaaaacgctcctcctctaagccccaggcacagcctgtcagaactgaggtaaaagctgattatagtattagcttacctcctgttcttcaaccttctgcccttgcgagggttcctcctcaccatcaaatgttggtgggatgctgttgttaatgttgaaagtgaccgtgattctaaaacggcaagggaaaacagacaaggcaaaacagacaaggcatggttttaaccgagcaggttaacacataaacatggaaatctgctacagttaaaaaggcgtattgaaacaatgtctctgtcctagctggctgaattatatgcagaacttcaaactaggctgggtgcctacatccaatcctgagtgactcagcaggtctgaagtgtgcctaccatgtaccagctgctggaagccaaagctggcctcagtttatctcagccaaacaagtcatgcatgggttactcccaacagggccagtaccccagggctcactgccatgtgctgactgggcatctcatggccacagccagctgacactgcccaccctggtctttccagggaacccttggtcaaagtaaggacctgagaggctggtgagatggaacagaagcccctttaagagactttccccgtcagaaaatttgccctgcaaggaaaggaagaagcgatggagggtgcctctgctaaacaccgagagcagccctggaacggggaagggaatgcctcacaaagaacaagggctgtagtagagactcatcccttagagtacttgtgggaagtttcataatcacaaagcaggccagacacaccaactagtgacaattttaaggtgcaagaatccacacctgacaaatcatgttccaaagtttgagtcaaaattcttgggacataaggtttagaaccaaaactgctgggctatgcaactctggcaggcaccattccacacaagagtacatgaaggctgggcgcagtggctcacgcctgtaatcccagcactttgggaggccgaggtgggcagatcacgaggtcaagagatcgagaccatcctggccaacacgatgaaactccatctctactaaaaaatacaaaaaaaaaaaaaaaaaaaaaattagctgggcgtggtggtacgcgcctgtaatcccagctactcaggaggctgaggcaggagaattgcttgaacctgggaggtggaggttgcagtgagccgagatcacgccactgctctccagcctggagacacagcaagactctgtcagaaaaaaaaaaaaaaaaaaaagagtacatgaagtgccgccctccacttgtgctaactagctgctctgccaggaagccacctttccatggcaacagaggcagtctgaggttgacaaaatctgtctaattccaactgtgctgactaagctgagctcctgggcacagaaattgaatgacgttcatcagagcattatttttaatggcccccaaatagctatgaaaaccttgcgcaaatggtgtttaggtgagattacagaagacacaattgacctgtgtagggcaaaaacacactatgcaacaggcaagagaatcaggaccctacttcacaccatattcaaaatgaatcacagacctaaactaagagctaaaactagaaaactttgaaaaaattaaggcatacatcttcacaaccttgggttaggcagtggtttcttagacgtgacactaaaaaagcacaagttgcacttggtgaattagaagcaaagtaaaaaataaataaaaaagcacaagcgaccaaaaaaataggtaaactgaacttcctcaaaattaaaaacttttgtgtcagaggacattaccaagaaagtgaaaaggaaacccacaagatgggaaacagtacttacaaatcattaatttgataagatagttgtacccagaaaaacttaacttttacaacccaacaattaaaaaggtaaatagggtgggcagggtggctcacacctgaaatcccagcactttgggaggccaaggcgggcggatcacgaggtcaggactttgagaccagcctggccaacacggtgaaaccctgtctctactaaaaatacaaaaattaaccggacgcacgcctgtaatcccagctaaggaggctgaggcaggagaattgtcagaacctgggaggcagaggttgcagtgagccaagatcgcaccactgcactccatcctgggtgacagagcaagactccgtggggttggggggggaagctacaaattgtatgactccatttatatgaaatgtccaaaagaggcaatcccatagagaaagtagcttagtgattacctggggtggctacagggaggaataatgagtgactgctaataggtattgtttggggatgacaacagtgttctagaattaggtagtgataactgatgcataattctgcgaggactaagaaccacttaatttaataaacttcaataaatgggtaaatcgtatgccatctcaattaaatctcataaaagctgtgatttaaaaaaattacatacacatcataaggtcaattatgaaggaaattcaatttatttatttattattgagatggcgtcttgctctgttgcccaggctggagcgcggtggcgcgatctcgactcactgcaacctccacctcccaggttcaagcgattcccctgcctcagcctcccgagtagctgggactacaggcacgtgccaccatacccggttaatttttactagagccagggttttagtgttagccaggattttctcctgacctcatgatctgcccgtcccaaagtgctgggattatgggtgtgagccaccgcgcccaggctcaatttaaaaacctggaagatgccaaatgtttatctgtgtaatgagattatggatgactataatgcagaaaagtgtaaacactttaacagtttaggagatgatgggggagctgacttaggtcacaaactccccacctctgatggcagcccttactacagtgtaaccccatcctgttacatagaagttacatatttttcattttcacccatactaaacattagagagcagtgtcctattttatcagggctgtaaatcagagatcaaactgattctgccagtacttttttgcactacatttttgtctccttagtaaccagcccacagcaaatttgtgttcggtgaatggactgcctggggcttacgaagttgtccaaatgaatccttcactctcttgaaacccatttatcaaagtatccacacctgaactcaaggctcttctggggatgacccaggatgggtcctgcaaggttaagggagttgctgccctgggatccccagaccagtacttacttttccccggcaactttccgcactaatttcgcttctgtcccattcagttccagctcccaacctccagacatcttagggagggttttatgcttctgaatttttctttcctccttaatttcatcactcaggaaatcaacaaaagctttgtctcctagaaaagaaatccagatacataaaaaggaaagccagttagtctaaaacataaaactattacccaggttattgcagccagaaacctggactgtttctaatctctctgctattacggttactctagaagcctgtttccttatcggtaaaaataccataatagtagtaggaagctgagcctgattctggaaaagtgatttccaacaatgaacgcattaccactttccgctataaaccaggagaatttccaatcctcttccacttgccaaacgatataactatgctattttcaaccacgaccatgggccttcccaaaggtccactttcgatagaataagactaaggaaaaaggtaccctagtatttaattttattcaccccctaccaaaagaaaacgaaactgctggataggggaggtgggggaaatatgatcatacgtgggtttagcccgctggttgccaatcaatggaaaaatgtcccagacctcagaggtcggttgcaggccctattcctggtctacgttttccctctgttgaacgcaaaccacacccccggcccgctaaacctcaccgtcggtgtgcagcgagccgcagccacagccacaggcgcagggtccgcgaggccgcaggaggcccggccgccgctcggaacctgcgcgcacgctgagcagcccgaagggccgggtgcacagccggggtgccggctgcaggagctgccggaaaggcgaggcgggcgcggcagcgcggaggccggcgacggaggagcccagcacacggggcacgcagcgcagcagaggcagcatcgcggaaacgactgcgaacacgtgcagatgcaaaggacaacccaggcctaggcgccccgcgacctgaggcgccgccggaagccccgcccctgcccggaagcgcttcccgcgccggcgctctgacgacctaaggccagcgggcggaatcgcgccctctgctggagactccggtgcagcccgggaagcctcgaatccggattccggagctttcttgctgcgctgccgagtccgctgtccgaagctgtttaattccctctagtggccgcttacccactttccacctgctgttctcaaagcacgcaaggcttttgggctgcgtggaatgcactcttgtctcccgccagctctcaccagacccttccacggtcactttcctctaggaggctgtggtgttatgatatatatatgtattggttttcatccacagttcctgggtcgtaactcctatagcccttgttacaatgttctgtgataatgttgggtgtgttaggcctcaggaaacagactctccccttctcctgccctccttttacctgccccaaagcaggactctaatctccttccacatttctgattatgggtcttaagtcccttcccagagaaggtcccaccatataccctgggggaagggatgctgatgtccagaagcttccataaaaacccaagaggagagggtttgcagagcctctgacagctgaatacgtagaggttcctggagggtggtggcccagggtaggcaaggaacctcggagcttcttccccattccccaccctgctcatctcatctgtatccttggtcatatcctttatatgaaaccggtgaatgtgtttccctgagttctgtgaactgctccagtgagttaacataatccaaagaggggggtcgtgggaaccccaacttgaagcgggttggtcggaagtttcagaggcccagacttgccattgctgtctgaaggtgggggcggtcttggggactgagccctcaacctatgggatctgacactatctccaggtagatactgttgggattgaattggaggacacccagctggtgtctgctgcttagtgtggaggggaaaaacccaaacctttggccacataagtcttctgtgttgattgttgtgttgtgagagcaaaggaaagtctgagggttttcctgaaagaggccttctagaacctttttttccaccggctcggaactcatgcttgtgcgcacccagcccatatgcttcattctcttttcaacaggaacctcctagcgttgctgctttaaccaggttaaacccaaccagactgtgacatcctcaagggcaggatccatgattaatttttgtgaccttccctctctgcacctccaaccttgcatccaagttctaatggaacatcatttttctggggacaagaagccagcttatatcatttagataagtccagaggcttccataaaaacccgaggacagggtttggagagcctctgatagctaaatacatggaggttcctggagggtggtggtccagggacggcatggaggctgggagcttcttccccattccccaccctgctcatctccttatctgtatccttggtcatatcttttgtatgaaaccggtaaatgtgtttccctgagttctgtgagtttctccagtaaattaatataacccaaagacagggttcagatttattaaaaatcaacaatcctaccttcccaggatatacaggacatataagctactaagaaggtatgtcttactaactcatggtaagactaacacttaatattttctaaataattttctatgaataatggaaaagagatgcaagaaacaagccacacacatcatatacaagattcatttttaatggatttgatcgtcgggtgcaaatttgagcattatttacaagagctttctgtagagttatttctgttcaaataaaaccagactctcaaaatacaacataagcctgaacctacttgatttttttttctccctctagttaccaaggaatatcgtatctcagatgcatggcctactatcacactggtctttaaagaaaaaaaaaaatgcatggccacagttccaggcagttcctggtagctggatttagtggatttatatatgacagtacagtacatcatcagtttcacccacagggcagaacttgcctccattcaggcatctctttacaactggcagcaatgcagcattaagggtttttagccaggacctgctgtttgcagtcctgccccttgtagtgttactctgggtgttgcacactccatgattactagaagacaaacacctgaggcatgcaatctgcttggagtgcatctatttacatgaagctgctcacgggagctggtgattcttccagatatgggtttcgtaggttggcaaagagttatcacaccatcagagattttaccaatggaaagagagtagctgaagattatattgcaatgttattgtgaaacatttaactttcttaagtttaaagtgtactatctcctgcagctcaatataaacaacgatgtatttctttgtagcagtatgtggagtcagaatgggttttccaatctgatttaatccctgagcagctatgttaaaagttaactttttaaaaaagcccaataaaaaactaaatactgtattaaaactctaccacaatgttacagggataaacttatttctgtacagaaacattaaagctacttagaagctgtttacatcctttgcctctcagaaaaaaaatatacatttccggaaactgttcaggtacttaagctggacataaattaccccaagttttttctttttctttctttctttctttttttttctgagaccgtctcacactgtcggccaggctggaatgcagtggcgtgatcttggctcactacaaactctgcctcccaagttcaagcaattcttgtgcctcagcctccccggtagctgggattacaggcgtgtgccaccatgcccagctaagttttctatttttagtagagacggggttttgccatgttggccaggctggtcttgaacttctcaagcaatccacccacctcagcctcccatcccaatgctgggattacaggcatgaggtgatccgcccgccttggcctcccaaagtgctgggattacaggtgtgagccactgcgcccggccaccccccaatttttttttttttttttttttttttaccagcactatgaatgattaaaaatacaatatttttcttactaagtaggactaaacattctaatcccctactggaaaacaaaaaacaaaaaacaaaaactggaaaacttttcagaaagtcagcagtggtaacaagtcagtaagtggaagaactggttcaaagtttaagaattcagtaagataaggtatataggagctgtcagatcttcttttgcccacgtataaccatttctgacagacagccctaaacactagctgagagcttgactgcacaggaccacggctagtgttggaaataaagactgagccggacttgacatacacaactccggacagatgggaccctggaatggggctgctccatcaggccacagcttccagaaagagagcatccatgatctctgaagagcctcttgggcagcttggcccctggttataactatgattcattcattaagaaatgacaaaacaccccacagatgtatttggaccaagtaagcacaataaaagagctaaatcacggcttcttctagggcaaaatattatctggggaaagattacttgcttctgataattaaatagctaagaggaaccgttagtgccttttctctgctcagaatatcagaacaggaacagactgtggatatcctccaattccctctgacaatgagggttagagagaggtgcctagcagttagaaagcagcaaagccagattgtcccaagtccctacgaagaaggaaaaaatatcatagaaaattaataagatgcaagaataagtgttacagctctagctcttttagaatttgtccagcaggtcttctagacttcactgaactgccccccaccccccccgcccacacaccaaaaaagatacaagaatgtaagcccagatgtggtgtggtatctggcataagccaatgttctctgggttctaggtacccctctcccctcccccacccccaccccctctgaccaggggactgcccgaaaagaaacagctgaaatggtacacagtcactcctcatgcccgcatgttcactggtgcccagttagagagaaaaatggcaactgtgtatgtgggagtcacctacacacacaaaacactgataggtcagtttcccatgtctacacgtgacaggattcagaaggtacaaatcaaccttcacccaggaagcttacatgtctcctgaaagcactgacagggtcacgcactgaggaccaggaggctcctttactggtctctgcttggagacagacacagagtggtccaccctgagacacaagcgttcagtagggatcgccatcccaggaggtacgagataacagcacctccctctggaaacttctacagaagtcagttttgttttctattttaaaactgcattcagagagacattaaacaagaactaagggcaacatccaagctccgcaacctcctgtggcccttccagaaaatctccctcagtcacaagaacttgggatattgctgtacttcacatcatatggcaagcagtaacattcagcctaacggctcccaactcactgtacgtgtgtcgtgcgtgctccaggcatagttctgggtactttccattccttttctctaaactttatgaacccaattttataaggattattattattactcccatttggcagatgagaaaactgaggctcaggtgttaaattaagtcaaagtcacccagtaagaaccaaaagcataattttgaggtttccaggtacaaatgatatgtccatgtctatatggttcagtcccaggagttgagcaaagatgctttcacgctcctggaagtcaggcaccttcagctgattccaaggcttctctaagcgccaacctggaagcctgctgtaaggacaactgtagtccaagctcccagggaccagtgattctggcggcatcctggggcggctcagtttctggcggttctcagcttcctcctaaagtactcaggggcagcctcgtacagccactgtgcatctatgacgcagaggtcccgcatgtagcacttgttggtgtagagcagctcagtgtacacgacgcaggccggcttgcagtggaagaggacagacgacgggtggatggccactggctggtgggtgtccgtggtggcataggtgccatctggctgaagctcggcggtgctcatgaagaggctgtgagccaggcagcggcggacactctccacgtctcctcgggatgatgcgattggcattgacatctgtttcgggagaaagcgaggaatggagccgaccccacacgtaaacactggtcagcactacacagcgtgttggggcaactggacccactggggcaaaagcagcccacattgtgagcctaacgatgtggattctgacattcggaggtggtcaccaaggatcagcaaggtcaggggaagaaggcccagctggaggagcacggaccagaaacagggaaactaccgcctgtgaaggtagggctgggagggaggtgctcacattagccaccagaccacaggcaggttgggtgacccacccctcacctaaattccatcaggacggcccggaaaggaaaggcccttccctctcgctttgaccatctcaccatctcctcactccgattcacccacctgctgctgccaagctaatctacctaaagcacaactcgaatcactcttcatccactcaaataccttcaacaatgtctctactgctccttgcaaaacaatgcaaacttcccgtggtgaagccacgaaggagccaccctgagctgctcgcctgtctttcctctcaccgctctttttctttctttctttttttttttttgaggctgagtctccctctgtcacccaggctggagtgcaatggcgcaatctcagctcattgcaacctccacctcccaggttcaagctattctcctgccctagcctcccaagtagctgggattacaggcgcctgccaccacgcctggctaatttttgtatttttagtagaaacggggtttcaccattttggtcaggctggtcttgaactcctgacctcaagtgatctgcccgccttggcctcccaaagtgctgggattacaggcgtgagccaccgcgcccggcctcaccactcttctttagacactccatggtcccccatagctggctgccttctctttcctcgccccgtttcatgattcctatctgtgccttcacatttgctactcttagtagaaatgctgcctgtctcatcagaggaaatgtcagtcaccagtcaatgtccttgttctactgctcttgatgagtggggcatgtaacctacgcccctgggcacagatgaacaaaccagtggtacacacacgctggacctaagctggccagcttttctcttccaggcatcttttaggtttgaaactggaaaacttgtcaatctctgctgggctcttgagtggaggggccatgcagagaaatcacttccatgcggaggtaaaggtgagaaaagggaaggaggcacgcagagggcactcaaagcaagagaagcagcaggtccagagaaagtggcgggcctggctcctgcaggctttttctggttcctgtgactctatttcctgcctatcggttctcagagatacctttccatccttggaagaatctttattttgtcctttatgatggctctagggtttctgttgttgacaatcagctgatctatgcctgaagaagatacttttttttaagagacagggtctcactctgttgcccaggctggagtgcagtggcacaatcccagctcgctggcaacctctgcctcctgggttcaagcgatttttgtgcctcagcctcctgagtagctggggttataggcatgcaccaccacgctcagcttagttttgtatttttagcagagatggggtttcaccatgttggtcaggctgatttcgaactcttggcctcaagcaatccacctgcttgggcctcccaaagtgctgggactagaggcataagccagccaccacacctggcctggaagatactcttttatctccttatctgtcaagatctagctcagttgtcaccacctccaagaagccccagaggctaactggtggtctctccttccagactatcagctttaccactcactggctgagtgatttggggcaaattatttaacctgattaggcttagtttcatcatttgtaaaatgggaataacaaaagaatcaatcttataggttgaaatgaggattttatcctttgggttaaggtctgagttgaaaaagaaaaaaaaagaaatgaggagtttaaataaggcagccacataaaaagtactcagaacagtgctgaacaaacacttcatgaatgatagtgattattttaatttgatggcctcctggcatgagtgtatgtacgtcaggtcaccatctagattattacttagttactgagtaggcatgtctgtaaagtctcaggaccttaccagtgcctgacatataatgagaggtatccctggccactacagggtcctaaattcacaactaatagagaagcaccgtttctactgtcaatgataaattgagaaaacttatgaagccaagagacagactggcaggaaactgttcaaatacaaaagcagtttaaaaaaatgtgtgaaagacagaatacaataggctactatgagaagaaacagctctagtgccaaccgtaggccgttggcatcagacacaggcctgggtacaggctgtgactgtctcccagcagcgtccgcactgagggggcacaagacattcaccacagagtactcaggacagcagcaaacacacggacactgtctcagtgatcaacagcaaaagaacacttccgctaccctctatctctgacataaaatgtggagtgtcatgcgagcattaaatataccatgacagctctttaaaacaccatgtactctaagagggaataaaaagctaatataaaactttgtgggccgggcacagtggctcacacctggaaccccagcactttgggaggccaaggccagtggatcgcctgaggtcaggagttcgagaccagcctggccaacatagtgaaaccccgtctctactaaaaatacaaaaaattaggccgggcgtggtggctcacgcctgtaatcccagcactttgggaggccaaaaccatcctggctaacatggtgaaacctcgtctctactaaaaatacaaaatattagccgggtgtggtgggtcatgcctgtagtcccagctactcgggaggctgaggcaggagaattgcttgaacacgggaggcagaggttgtggtgagccaagatcgcgccactgcactccagcctgggcaacaagagcaaaactccgtctcaaaaaaaaagaaaggaaaaaaaacactttgcggtggacactttggcaatatctaacaaaatccaaattcccccatctagaaattcattctgtgtgcaccacagcacatacggaggatggtcactacaacagaatctaaatgaccattattagaggcttaaataaactgcactgaatacaatgaaatgctatgaaatcactaaaatgaatgagctagacacatgcagcactgaaagcccagccacaggaaggatttgagaaatacgcatgtgaggccaggcacagtggctcacacctggaatcccagcacttcgggaggccgaggcgggcaaatcacctgaggtcaggagttcgagaccagtctggccaacgtggtgaaaccccgtctctactaaaaatacaaaaattagccaggcgtggtgacgcacgcctgtaatcccagctactcgggaggctgaggcaggagaatcacctgaactcgggaggcagaggttgcagtgagcggaggctgtggtgagccaagatggtaccactgcactccagcctgggtgacagagcaagactctgtctcaaataataaacaagaaagaaagaaagaaagaaatatgccatgtggaagaaaggaagttgtggaacatgtacctcatatgcacgtatccgttatgtgtgtgctcacacacaggcacagagacatgcacaaaaacatacatacacagaaacaaattctagaaggagctaccccaaactgttaacagtagttatctctggaggggcaggattatgggagacttttaaactttctacattataaatcactattttctgcattgtgtcaaatactatacacaactttggtaatctaaaaggaaataatgcagatattcatacttaaaaaaaatcttatgaagaattctaacactggaaaatgcttataaagattataaaaccaaatataaattatacatataatttactatgtaaaaaaatacaataaaaactaggctattaggaaataggctaaactactgaattgtggaattgtgggtaacttccttttttcttatttgtgaaatttgctacaatgagaaatccttttataatcactagcaataagcaacttcaaaatttctaccttgaacaaagtgacagctttgtcacccacagaacactaggaccagacgatacctttaagcagatgtccctcagctgtgctctgacttctgctaccagcgtcatattcttgctgttgacaaaattctctttgcaccaatcctgaataggagaaagagtgatatcacaatccactcattcaccatttatatgttcacagagacggggtcttgctctgttccctaggctggagtgcagtgatacaatcatagctcactgcaaaccaatcctcccacctcagcctcccagatagcttgaactatctgcacatgccaccatgcccagctaacaatcctctcatctctatagagaaaatataacaacatttttagaacacagttgaattcagagaaaaaacttcaggtgccaaaaagaaacgtaggaaaatatctttatatcaaaaaacatgaactataagaaaagtgttaataatttaaactaaagaaaaacttgaagtttcccagattgggatatttgtctcatcatacccaataaatgattagaatctctagaattgattttaaaagttctacaagtcattaagaaaaagaccaacgacccagtagaaaaatggacaaaggatatgaacagacacagaaaacaaaacagaaatgcccagtcaatttatgtaagacttctttcttttttctttttttggagatagatagagtctcgctctgtcacctaggctggagtgcagtggcacgatctcggctcactgcaacctctgcctcccaggttcaaatgattctcatgcctcagcctcccgagtagctgggattacaggtatgcacaaccacgcccggctaattcttgtatttttagtagagacggggttttgccatgttggccaggctggtctggaagtcctgggctcaagtgatccacctgccctggcttcccaaagtgctgggattacaagcttgagacactgtgcctggccctgggcaagtttttcaactgcacgaagcttcgtttccatgactacatgtttcatgaatataaaaaataataattatagtgctcatttcttaggattactttactgaataaatgagatcttacattaagaagtgcttagcatggggcttggcacagagtaagtactcattcattggtacgcactatcattattagacatattacttaatcaagttccaattaagttttgatgggttgggagtcacttaagtcttgttgacttaaacacattcggaacagagaccagaatgacactgcttcggtactgaagcatttctgaaatgctgtctggctttctttttgtgattctttagataatttagccaaaaagggaaagcgtactttttgcacggcttcagtagaaaaagggaagcacatagcagagacaagcagctatcgctggagaacaggtgcaagacaaggctcaccttatttccgcctaggtttttgaaggtccgatagatattgagcagggtcatgtgatccccctcgctggatatgaacttcttgcggaccccttgcacttcctctcgccgggaaggagggttgtggaggacgctgtccacagacagcagggagacaatggtcaggatctcctctgtacagtggaatttgggggacatgaggatggtctgcaaagcaaaatttaaaattgtgtaaacccagctttctcctagctttagaatgcactatttctgtacattgcttttgcagtttcccttctaaggagttaaagggcaggtatttctaaaaccatggcgatgtacattagtgttatttcactctttaatattcaataaaacaggtgactgccttccctacagagttccaaatttcttgtgggtaggggctcttaacttcatctctttgaatcccacactgaacatgaatcagggctatttgcaaactaggggttggtaattatgtaagagaaaaagtgagattaatctagaagcactgggtagatggtactactttgggacggttaactgtaatgtacagaaagaggactgaggagagggtatcatttactttggcaaatttgggttctaaaggaaatgctgccatctttcttcccattggagtcagggtaagctggtcatccttatgttcaagagcacctaacaggtccagttgggcaatggccgcctgaatgtgatctaaagaaacagagacataaaaaggagccaaaagtccaaaaaaatgaagttgcagctagttcagtatttctgggagcttctgataattctacatcaaacaacagcaaaaatcataaccgccactgcccccttgacacacttgtcaaagaacgacatcactgtctttagttcaattcccttttcttttttgagacagagtcttgctctgttgcccacactgaagtgcaatggcgtgatctcggctcattgcagcctctgcctcctgggttccagcgattctcctgcctcagcctcccctatagctgggaccacaggcgcccaccaccgcgcccagctaatttttgtatttttagtgagacggggtttcaccatgttagccaggctggtctcaaactcttgacctcaggtgatctgcccaccttgacctcccaaagtgctaggattacaggtgtgagccaccatgcccagcctcaattttctttttaaatgacctgtaatttggcaatatgtatgtagattttgaatatacacattaaaagtgtaacatctgacccagcaatgttacacttacgaatttcacctgcagatacacatcgcacagagaccatatcgccagaaccaaacacataacagtggaaatagcagttgtctcaggggccagctggggaggctgggagacaaggggatgagaaggacattattactatttactattttatatattttaaactttgaaccatgtaaatatagtacctattaaagaataaaaaagcatttctaaggatgtagtaaatatatacatcccaataaggagtgatctgtaaaatgtattaaatgaaaaaaagcagtgtgtttctcattgcttttttaaagcaatatttatcaactgaaggatggataaatgcattttggtttattcacagaatggaatagcacttagtgtgaaaaagcatcagcacaaatatactatacggaacaagctgaatgaaaaccgcttactcaagaataactaacataaacttacaaacaacaggtggtttagggatacatacgcatatagtaaaacagtgaagaaaagcaaggcaattacaaacaaaatatggaagagtgggtaccccaaaagagtggaaggaggcgagggcaagtgggtgggggggactcctgggggcttcaattgggtacacaggtgttagattttaaccattccttacaccttatgtatcttcttcatttgtatgtaagaatttagcaatgaaagaaaaaaaatcaagcacagaacaatactcaatgtgtgttgctatttgtgttttaaaacatactacaggctgggcgtggtggctcacgcctgtaatcccagcactttgggagaccgaggtgggcggaccacctaggtcaggagttcaagaccagcctggtcaacatagtgaaactccatctatactaaaaaatacaaaaattagccgggcatggtggtgcacacctgtagtcctagctactcgggaggctgaggcaggagaatcacctgaacccggcaggtggaggttgcagtgagctgggatcgcaccactgcactccagcctgggcaacagagtgagaccctgtctcaaaacaaaaacaaaaacaaaaacatactacagcaggggcttggtggctcacacctgtagtcccagctacttgggaagctgatgtgggagaatcacctgagcccgggaggttgaggctgcagtgtgctgagaatgtgccactgcactccagcctggacaaccagagtgagaccctgtctcaaaaataaataaataaatacataaataaaatcaaacacactacatatactcatatatgcatacatttgctctagaagtctactagaaaatggttccagtggttgttctaggggaaggaaactgtgaacctgaggatcagggcaggacccttgtatacccatcaactggtgactttgtgttttctttccttcttttttaaaccaattgcatttcttaagaaaagggggggcaataaaaagaaaaggaaaatggtgcgttgatgagaggccaggtgccaaagccaatatcataaatatttccaattattttcttcttctgtagagaaattactaatgaacaggagagatggatcaaattccagttaaaggcaaagaaatgtgatctttgcagtccctgtgctgataaaagtacaatttcattacatttctgtagtatcccaaggactcgcatgatgaccttcactggttccagaggtcaaggaactttattgatggtgctgatagtacagaatctatcgtttcatagctaggaacactggcgcatgcctgtggtcccagctacttgggaggctgaggcggggggatcgctggagcccaggagttggaggctgtgatggagcctgtgaatagtcactgcacctccacctgggccacacagtgagaccctgtctctttaaaagtcaatcaatgtatctatctatcatttcatgattttcagatgcttctctaataactaatgttgtcatccacaaaattaaataaacaaaaggagatgaccaatatactttatttttttggaagtgtccatttgttgttgtttgtctcctcacccaccttctgcaaaactgtggatttcacttacctggagatggcttcgacatgaagtcaaaggtgagcacatttgggactttcattgctagaagctgaagcatcacactggccaggttacacctgtgaagagcatgagaccagggtcatgacctgatccctctgccattgagtcagaacccctcatggtggagtgtgagtaaaaactgcagctctgggcaagcaggagagacatggtgacaaacagcagcagtgcaggagcaactggtgcctacctctggatctctggcacggtcatcttatcaaacttctcaaactcgtcctccgtgtagagccggtagcagatgccactgtcctctctgccagccctccctgtgcgctgccaagcctgcgtcttcgatacccgctgcactgctaacacctcaagaccactgtctggatggagagtgagccccattagtgcttcatcacatgaacaaactctttctacagtgtcgataaaaagaagcacaccagtggttctttcagcaacacgggggtccagaaagcctcaaggctagcacaatggacagcacaaaaccagactgctccgcagcggtttggccctagtgaaacaaggctttgccataagcccactgtgaaatctgttacaaaaacatcagaaaaacctcacgcatgcagcaaggggcgagaagagtagtttccgaggtcttgccttagatggtaggatggccaacccctccagtttgcttgggacagagggtttcctgggatgtcggattttgggtgctaaaactgggagtttcagcaaactaggatgggggtcatactatcaatcaatgactacgaaattaaatgcctcaaatcacttgtgtgctttatcctccctcccagttctgctgtaagacagaaataatgtgatgtctgttttctagcagtaaatgaggttcattttcttgataaaggtgtatcattagcctggcactggagacccaagctctttcacctacgtcatcacaaaaagatacacctgtggaagccaggaccctcaaatgtttactagagcatttcagttcaataattgggagcaataatttcagtggtctcaaatcctctgtggaataaagcaaagtataaaacagacatgagtcaagatgaccttaagttagcttctcactgcaccttcttaggagaagccagtgctccttccatgcctcacctcagccaggagatctggttccttcctgagaaacctgggagctcaaaccagccatatatatatagtttctgatgacaccctttgattgacacccagctgtccctggccttagagccgacttctgatggggtaccagaccctctgcccaggtccctgaccctgtgtgcccaagtttgctcaacctgggctcttctttcctgcctctacttcctgtctcacatacccgcctcaggactccttcgcggacctggagtgtaggtgatctcactcatggcgcctgccacctgaatttgttagttacaaacatgaaacactcaggggaaaactgtgggactacagtttcagtggctgctcactagacacaggagagacattcatgaactacaaattctcaccagggttatacttctttgctttaaccatgcccgtgtcaactacatattttattcctgtaatggttatggaggtttcagcgatgttggttgaaatgatcactttgcgatagccctaaaaggaggaagaaaaccaaaaagccgcattgacacacggatgattcagaagtcttcaaacatattctcaccattaacttccacaattcactcttgaccaacagaagatgactccattattaatggcagtcattaatattaatggttggtcattaaaccgggcaggggaaggggacgctgcagtcttaaaggtcaatttgaggcaatgagatgcagtggaacaagcacaggaatcagaagcaagtagatgtgggttggaatcgtggccctgccagtgacttactatgcgcccccttgagcaattgttacttcccttcttggggcctcaggatccccatgggatcataacctgccttgccggttcccacgaggatgacagacagtggatataaatgctagcacagtgcctggcacggcaaaggcacacaagaaatggcactatggacaaatgcaatttatgctggtccttagaagtcactcgtttaccttgcagctttggtttatactctccctcatcccaacaactgtctccctgctcctgtcacaggagcgctgcgtgtgtcaccgcgcattttattcctgcacctcctcagtgcgctgatctggcacctgggtatcccatcccatacaccttatctggagcctggtaacaggtacagacctcgctggtggatccgtctgggtgcccagaatagggctggacagaagaggtggtgcactcacctttggggccccttggaagactcggagctgctgtgcatagggcagggaggcgtacagaggaaggaccagcatcgcagggcagccgtctgggaggtgctttgcaatgtctcggcacgtcttgctcatggcttcgatctcctcctgcccagtgaggaacaccaggatgtcctgtgaagaaggggcttcctgtaaaaaaagtagagtgggtttactaggcattgatagaattgcagcttgcacagaaaaagacaatggtgattgatgatgtttcccagagttatttctcttaactatagaaatgtaaatgagcctaaaagttgatgtctagcttggagagaacccttaccagcagtgtgtaaatggtaacaggctgggtgtgatggctcacgcctgtaaacccagcactttgggaggctgaggcgggaggatcgtttgcagccaggagtttgtgaccagcctgggcaacgcagcaagatcccatctctacaaaacacttttttttaaattggtcaggggtggtgacacatgcctatagttccagctgcttgccactccactccagcctgggcgacagaacgagaacctgactcaaaaacacaaaaaacaaaactgtaatatataggagttagccagctatgtttataggccaagtgatgaaattttgaagggaaatcatcagattgatttttctaacaagaacaataccatgaaaagcataatcaggcaagcaaataaaatctgcatgaagcttcctttcttttataagcatcttgaaaaatgaagttgacaaaacagaaggaaacttggggaaatcctaatctatggaaatgaacaggcgcagccatgctggagaaggagcctttaatgaatgacgccgtcgaaagcgctttcacacgccccaaaacacacactatactcggacaactgcttgagatactgaggttaatggggttcctcactttcaaatggaacaacacccaagtgtgaatgacatacctaatgccctgatttttctttgatttctgatcagatacattaatttgtttgatgtaaagtgcttaacactttgggaggccgaggcggccagatcacctgaggtcaggagttcgagaccagcttgaccaacatggtgaaaccctgtctctactaaaaatacaaaaaattagccaggcgtggtggcgcacgcctgtaatcccagctactcaggaggctgaggcaggagaatcacttgaacatgggaggcggaggttgcagtgagccgagattgcatcactgcactccaacctgggcgacagagcaagactccatctcaaaaaataaataaataaaatgaagtgcttgatggactgggcgcagtggctcatgcctgtaaccccagcactttgggaggctgaggcaggcaaatgggttgaggtcagcagtttgagaccagcctgtccaacacagtgaaatcccatctctattaaaaatacaaaagttagctaggtgtgatcccagatactcaggaggctgaggcacaagaatcacttggacctgggaggtagaggttgcagtgagccgagctcgtgtcactgcactccagcctgggcgacacagtgagactccatctcaaaaaaaaaaaaaaaaagtgcctaatggcaaaataaatagaaaaaaattttaataattatatgtatatttatgtatatatgtaaaaatacgtattttttaatatgtattttttttcagcccagtattaacagaacaaatgtgcagagggatacacagacaggataaaatctaaaacagtcaaaacctcatgagtgggagaattcatcaaagccagtggtaacctaatgcaccagcagccatcattcatgaaaaattctcgtttgctttctgcagctgaacaaggcagacttcttccccaaacactatgaaaacgacagtaaaggccactgtcttagaaagaaaaggcaatgagagatgaggagtctcaactcattttggaagagaggggaaaggggctggatgacttggctagagggaggaaactacaaattatgttgtgggagagtgaaaactcagggattggttcaaagtctgagtatagagtagttaaagccttcagttccctctcctacccaggacggccaggagactgggaagccatgggtctcaccacgggaaaatggtgacaaagtgaagagtcaagatgacagctgcacaaaggcccaggagagccacctgccccaactggaacagcagcataaaggactctgaaaagacagactgtgcttgaacacagaactatacacgactggcatatgagatgttggaatatttgggagaaaatgagccagagctacccagaaagcttgcacaactgtgttgttcaagaaacaaggtacagggatgatggtgtgctactagcaatgtgtggtcataatattcttagtattgatactggactcagaaaacatcataataggccagacacaggtgtgcaagcatgtagtcctagctactcccaatgctgaggtgggaggactgattgagcccgggagttcacgaccagcctgggcaacacagcaagatcctgcctcaaaaacaaaaacctaaacaaaaacatgatagaactgtcaagaggttggagataaagggggttggggaggggcattctaaacttttgtcaccatggtaagaaattagcatatgatgcctgatacccataactcaaaaaatagtggtcaaagcaaggtagtttagaaacatgaaagcaatatgtagagattgaaagtaggtgccctaaacagcagaaatctgggatgttgaagtaaaaacaactgctattcttttattataaaccttttactataaactacttgactttttaaaactttaaatcccatatgcatcacttattttaaaataaaaattgactgggcacggtttctcacatctgcaatcccagtgctttgggaggctgagtcgggaaaatcacttgaggtcaggagtttgagaccagtccgggcaacgtagcaagaccctgtctctacaaaacataaaaaaaaattagccaggtgtactggtgtgtgcctgtagttccagctactcaggaggcaaaggtaggaggacggcttgagcccaggagatcgaggctgtagtagctgtgattatgccactgcactccagcctgggtgacagaatgagaccccgtctctaaataagtaaattaattaaataaaaagttattttaaaagtttgcctctggattttctcagaaagctaataggaaggtaaaaacattaaattttatacaaattaaacaaaagtgacttaatgattcaaatttttgaagtaaatgtttaataaaatgagaaaatatttttaaatattctcctaatatagtttaaaaaaaaaagaaactctaagttgcaacccattattgggctaatgtcaactttttctttttttgagataggatcttgctctgtttcccgggctggagtgcggtgatcatagttcactgcagccttaatcttccaggcttaagtgatcctcctacctcagcatcccaagtagctgggactataggcatgcaccaccacacctggctgattgtttgatttttagtagagacaagtcttgctatgttgcccgggctggtctcaaactcctgagctcaagcaatcctacccacctctgcttcccaaagtgctaggattacaggtgtgagctactgtgcccagccaacattttctttaaatgaggcacaaaatatcagagtaccctacatgtagtaaaagacacagtacttcttctttaaaaaataatttttataattttttttatagagacagggttttgctatgttgtcagactggtcttgaactcctggactcaagtgatcctcctgccttagcctcccaaagcgttgggattacaggtgtgagccaccatgcctggccagaagcagtgtttcatagacctatttcagttatatgtatagcgtacggggttgcaaaagaaaaagtacctttttttttttttttttgagacagaccctcgccctgtcacccaggctggagtgcagtggcgcgatctcggctcactgcaagctctgccacctgggttcgcgccattctcttgcctcagtctcccgagtagctgggactacaggcgcccgctaccacacccggctaattttttgtatttttagtacagacgaggtttcaccatgttagtcaggagggtctcgatctcctgacttcatgatccacccgcctcggcctcccaaagtgctgggattacaggcgtgagccactgtgcccagccaaaagtacttcttaatggcggttataatcaaggaaagttggtaagctactgctttaacatgaaaattttctggctcagtgtaagaaagctgctggtcagaactgaattatttttcttttcaatgaaaattagagatatcataaataaaggataaaaatccagacacagcaaatgaactccttattcattgttttttttttgttttttttttcagacggagtctccctctgtcacctaggctggagtgcagtggtgcaatctcgcctcattgcaacttccacctcccggattcaggcgattctcccacctcagcatcccgagtagctgggattacaggcacccgccatcatgcctggctaatttttgtatttttagtagagatggggtttcaccatgttggccaggctggtcttgaactcctgacctcaggtgatccacctgcctcggcctcccaaagtgcagggattacaggcgtgagccaccgcacctggcctccttattcatcttgatgacacaactcacaaagttgttttattcagtagcttttcttttcaaggctcaatgttctcactaccaactgcaagataaaagagaacttttcaggaatttgcccccagcaccatacctggtggatctggaagacggagacaagcgcggcgtgcaggtaatcattctgaggctgtttggtgtaaaacacctggatcggatgctgccgaccctctaggtagaggacgggggcgccattgaaatactgagagaacaggtccacatccatcgtagctgacatcacaatcacctgcataagagaacgaagaggaggaccagaaacaaatagtgggaaggcctttccgtgtccctctcgagccccaaaagcagatgattgaggcctgtgccacccccatcacagtttactttcttccaaggctctgagcagaacaggcagaggaaaacaccctgctagagcacacaggtctgtttcctttcctttccttctttttttttttttgagatggagtttcaccgggcacggtggctcacgtctgtaatcccagccccagcactttgggaggccgaggcaggcggatcacgaggtcaggagatcgaggccatcctggctaacacggtgaaaccccgtctctactaaaaatacaaaaaattagccaggtgcggtggtgggcgcctgtagtcccagctacttgggaggctgaggtaagcaatggcgtgaacctgggaggcggagcttgcagtgagctgagatcgcgtcaccacgctgcagcctgggtaacagagtgcaaaaaaaaaaaaaaatcaagacggaatttcagtcttgttcaagtgactctcctgcctcagcctccctagtagctggaacgacaggcatgtgccaccatgcctggatcattttttgtatttttagtagagacggggtttcaccacgttggccaggctggtctcgatctcctgacctcaggtgatccaccggcctcggcctcccaaagtgctgggattacaggcgtgagccaccgtgccgggccaattatctggatactttcagatcatatttctgccaactccctgaaatacaagttgtctataaagttatgctatttaatgaactttcactttttttttttttttttttttgagacagagtctcgctctgtcacccaggctggagtgcagtggtgtgatctcagctcaccgcaacctccgcctcctgggttcaggcgattctcatgcctcagccacccaagtagctgggattacagatgtgtgccaccacacccagctaatttttatatttttagtagagacggggtttcaccacgttggccaggctggtctcgaactcctgacctcaggtgatccaccggccttggcctcccaaagtgctgggattacaggcgtgagccaccgcgcccagccaggcctgtttccttctgtgtgttacgcatactttcaggggaagtttccctcatactttcaggggaagtttccctcatactttcagaggaagtttcccgagttcctttctcctcttctgtgcagctttcaccactccaaagagcacatctgtgtggatagtccgttcgtgagcttcatccaaaatgacacagctgtatttccgaagcaaagagtctgaaattgcttcacgcagaagcatgccatctgtcagaaacttgatcctggtgtcttctgaggtgacatcatcaaagcgcactgtatagccaacctgtgcagggaaacaatttattcagtcaccaaacatttcttgagcgcccactgtgtccggcactaagttgggcacttgcactaccacagtgaacaagaccaacaccaacgcttcccactcccttgggaagcatgcagtctagctgctgagagagacaatggtcaagtttactttaaccgcaattaatgtaactattacaaggaatatttaaaattaaccttctacctcaagctatttaatagtttcatgtgggccgggtgtggtggctcacacctgtaatcccagcactttgggaggttggggcaggcagatcacgaggtcaggagtttgagaccagcctgaccaacatgctgaaatcccgtctctactaaaaaatacaaaaattagccactgggtgtggtggcacgtgtctgtaatcccagctactcgggaggctgaggcaggagaattgcttggttggaggcggaagttgcagtgagccaagattgcgccactgcacctcagcctgggcgaccgagcgagactatctccaaaaaaaaaaaagtttcatgtgaagctatgtacagatatgaaaagacgtctaaggtatttttaagtgaaatgagtacacacacacacaaataaatctgtcttatatacagttctgagactcattctcaatactcacatatacactggcataatgcttacaatttttctagaatgatatatagataagagagttaagagaggttactgaaggcttaagatgttcaaggaaagcaactaatttatccaacctgacgacagattttgaaagcaaagcacatgggaccaatagagcccctgatctctcaggagctggtaaagaactctcggaagaataggcaagaaagcagctcactatgtaaaaggagtcttgtttagaaaaataaaaggcagtgggcatggggagagagctgttgagtcaagaagtactaatagtcaagaaggaaccaggtaccagcttcccaagttcagttctcttctcatctgagactctagtagcaagagagatggcagctactcgacgaggctgggtcacagcaatgatgccctggcggctgatccctccttcatacaggtactgagggatctgagttgtcttcccagagccagtttcccctaggagagagggggaaaaaaaaaaaaggctcactgaaatgcaaactggggctcggcaccagggctggcacctataatctcagcactttgggaggccgaggtaggaggctctcttgagcccaggagttcaaaatcagcctgggcaacatagcaagaccccgtctcaacaacaacaacaattagcctggtgtggttgcatgtgcctgtagtcccagctactagggaggctgagacagaaggatcatgaggcccaggagttcaaggttacagtaagccatgattgtgccactgcatgccagcctgggagatagtgtgagacactgtctcaaaaaaaataataaaaataaaaaaagaaatgcaaatcggctgggcacagtggctcatgcctgtaatcctagcacgtggggaggccaagggaggaggatcacttgagcccaggagttgctcctgggcaacatagggagatgccgtctctacaaaaaatacaaacattagttggacgtggtggtgcacgcctgtggtcccagctactctgaaggctgaggtgggcatattgcttgagcctgagaggttgaggctgcagtgagccatgatcacaccactacactccagcatgggcaacggaatgacaccctgtcttagaaaaacaacaacaacaaaaagcaaattgacataaatttcaccaaacaaacagctcaaagtcagaagtaaaagataaaataccctgtgttggtaaagcctcaggagaatgggcattcaggtatgtatactgctggtgaaattagctggttaattggtattgtttctcaggtggtcaaattatgttttttaaatctttaaaatgtttatatcccttgacccacaattctacttgcagaaattgattctaacaaaataagtaaacatgtgtataaagatacagcttcaaagagattttattcaattttgctcctgacagaaaaaaattggaaacaatataaatgttcaaaaggtaatttacatagttaaaatataaaataaaatacaaccgttacatagatttctgcatactgactgacatgaagagacatccattcatgcactgctgccttcaactcctggccactccccagcctgctgcctcccttcaaaccctctgcctctgcccacactatgggcagaacacctgccctcacactgcctgcctcgcaaactctaagatgagttaggcctcaaacacgctcccctggctgcacagtggccctcctctgggctccgtagtgccttgttcatctctcttccagcactgaccatcctgtgttgtacagaagcgtttaaatgtgtccgtcctcctccaacaccagaagggaagctcccagagggcagtgctctgaatgtccctctcgtgtacttgagtattttgcatacaataagcacgcagtaaatgttacttcctaccctgtgtgaattcctttaacagtgcctgattagagcaaagaactcagtaaacctgcgcttccttcccctccctctagctaccaccaggcctctctgacttcaaaaagtcctccagtcccatgatttgtgggtttttttccctgtcagtctgtcagccccctctgactgctcatccttcctgacccagataagaatcagacaaaggatttgattattctgcaatcttcctgctgaatccactaggcaaaaccccaaactttgatccatgtctctatctttcatgctcctataccagggcaacagagcgttgctaaagtaaaatacaaaatgcttggaaccagaagtgttttgaactttggattctttcaagttttgtaatatttgcattatacttactggctgagcattttaaatgtgaaaatctgaagtcctaaatgctcccaaatccaaaactttttgagcatctgatatgacactcaaaggaaatgctccttggagcccattcttgacttcggattttcaaatttgggatgttccacctataatctggctgtgcagaagcaaacctgagtttatagtgtagccgaaatgcacctaggcaccactactgccatcgatcttttttcttgtttttgcagcctgtctcgtctccatcctccccaagggcccacttgaagcccagtgactcccattctgagcagggctcctgaacctgtctcacagaagtggggttctaaaatgtggtctctccctaactgcccctagaagcccttctgcagtgcaccatccttacatccgttctctagccctgcagcctcttagccttcctcctcttccagaccagccctgcatctagcccttgtggccaagttcccccgtcccccatgcctcctgatctttgctctgttagctcgattctatcttctgcctccctccctactgagttcttcccctcaacctctgaatacagatggtccctgtcttagaactgtttgacttcaggatggagcaaaagtcaaaatcgtacagtagaaactgtacttttgagtacccacacaactgtcactttcagtatggtattcaataaattgcatgaaatattcaagactttattataaaataggtttcatgttagataatatcacccaaccataggctaatgtacatgttccgagcacactgaaagtaggctgggcatattaaatgcatttccaacttaggatattttcaacttatgaggatgggtggattcatccacacataaccccatcctaaatcgagcagcatccataaagtttctctcagcttccctcctttttcctcaaaacagaagcctcttccccctgctttcagccctcagctcaatgacaaatcagctgttacccacacagctttgttgaaatagctctcgatgggatggatccacgatcaatagtgtcagagatagtctgtgaaagtcatgaaaaattttatgagaggaaatgtatgcaagaaatgttttacaatttaaaagtgattaggcctcctgaatgctttataaaatgtcaccataactcttagctgtagaacttgcctgctttgcagctaggtaaaacctaggacacatggagctaaatgctgaaataagccagaccttaactgcacttctgtctaagtcctaggctgtacacctagcacataattaaaatcccgaacttaccaaggttttcaacaaaggtaaaggttgctaaaagttaacagtgtaacatgtatttaaaactattgaagagacactttatgtgcaaggtgtgtaaggaaagtaaagtacactttcggtaaaaagattatcaggagggataagaatgcacatttttacctacgttaaaaggttaaataattgttttgagggggccaggtgcggtggctcacgcctctttctatatcaaccaatcgggcctagtaaaaagcgctgctaaaaaacgtaaagaaaaggctaaaaagctaagggagtaccaaaaccaccaaatggactcttggtttgaaaacaaaatcatagcatgggtcatcccattcctgggccctctcctaataatatgcctggaactaatgttcttaccctgcctaattaatctttttcaaagatttttaactgacaggatcatggcaatttcacaaacaactacccaaaaacatctacagacggcattgctcctagtcaacccgagaccaggaaactctccatcccctcgttgcaggaagtagccagaaagaacatgccgtccctcctcctttttataactatagggtctggattgacaaagcaggaacatcaccatcttggacaagcccctcattcaaaagttcaccttaataaaaaaccgcctaaatccaaaaggtatcagcctaatggctaaggtcagcacgaccataaaccacaaataacatctccagccagaaacattccaaactcctccccgaccagagacatgttaagggataaccccactctggccgggaatatgccagccgggaatatgccagccgggagataaaccccctcgggccggaaaaatgtctgccccaagataacatcccctgctcccaaagagtccaaccctgccaaaaacttctccacacatataaacattccaagcttgtgataagccccctcaccctaacaccaatatatactcttagtctgtaagagaaagggctcctgaccgaaatcggccaggagcgcctctcaggttttaactaaagaaaagctgtctttaactgccagccgcgtttcgtgtttctttcctttttctttaactcttacaaatagctcacatccaaatccagtgggcatcacatccaagtccagtataaccggacttgactgctgcatctgctcactctctattcctttgactagcagcactcatgggtctccttcctctctttggctgctcatcctttccgtccttcagtatctcctctaacacgttggggatcataagccccatgaaatcagtccctgccccacaactctgcctcttttcatgcaccagaaactacaccttccctttcgaccggaatgtgttcaggttcccatctctcaaacgggctttcccccctgcctagaatgccctccctcccacacgacctccccagccgcctcctcacaaaccgggtcagatccactcttctaagatccgcaagcccccggtacgtttctctacccttttacgcggaaggtgagtctttgcctacacacgttggtcactctcaccgggctgtccagcgcctccagggcagggctgccggactcttcttcgaggcccctctccaggtctggcccagaaaaggtattcaggtttgttgaagccacgaacgaaagggattgagaggcatgtaagaaaaactgctctagctaagccacggacgaagtgcaaggaagagcccgccggcgcggccactcaccgatgaggaccgcgttgtccaggtttcggagctgggccaacagttgcccccgcgcttggaagatgggcagactccggcgctgcagctccacagcttcagggtagggactggccgagggctgggccaggggcggctgctgcctccggcctcctcctcctcctctgccgccgctgcccgcagtcagcagcatcaccacttgcctcccgggagggaaggacccagcgcggctcggaggtccagagcctggccggaatctcttggccggcgggaagcccgcctcctccggcatgtcgggagggcaccgcggcgggaggcgcaagcgccgagagctcctgccccctctcaggtgcagacaacaggagcacaccgccccttcctcgccgccacgtgctggcggctcccggcgaccaccgatgacctcacggccgccccagtctttagaaaaagggactgcatctcccagcatgccttgggggcttgggaaggctttcacttcctgggggtgggaaaagcagggcctgaggtacaaccaggaaaaggcccggagctacaaccgggaaacacaggatgtaaggttccgtgggactgtagtcttggttaacgaggtttttctcattgttttattttttttttttgagatggagtttcgctcttgttgcccaggctggagtgcaatggcgcgatctcggctcacactgcaacctccgcctcctgggttcaagcgattctcctgcctcagcctcccaagtagctggggttacaggcgtgcgccaccggggcccgtctaattttgtatttttagtagagacagggtttctccatgttggtcaggctggtcttgaactcccgacctcaggtgatccgcctgcctcggcctcccaaagtgctgggattataggcgtgagccaccgcgccccgcccattgttttgttctagtagcattacttcttttcagtaaacccgcgttttccccttctctgtccaaataacagtcactcttcaaggaaagtacttaattctgtaaaatcaatgagaagcgcaaacgtgcattgtctaatcctctaaacaacttataagttatgtggtatatactggttattagattatctctaatttacagattaagaaattgagtcatcttagtcattcagatgtccccaaatcataattttgtgatcatcttgtgttacagaaaggaaaaccaattctgatatacatgaatttaactcagaaaatgactcctccaacggatgtggtcgcctccagtaatacaagcagagaaaggagggagttcaatgaaattaaaattgtcttttatctttcctttcccccaaccattccagccagactctcaagttctctacatggctgtgcaaccccatcacagacacttcagtgaagattcagaactgcagcagaaaaaagtaggattataactagttcttccttaccctcctaaaagttcttagatgatttgctaatttaccacggagaatgccaagtagctgtttgctcttacaggaaatgtgatttccagagaatacaccgtaagcttcagctcatgtgaagggtatcttctgaagctcgtttccatgaaactcgccctgttaaatatctcccttcccgtgattcgtgagagagctagtctaaaaacaaaaaacctcccctttgctccaggtcggagataattttcctctagttgctgacagtttggtgaccaggcattactgaaaatgtgcacgttgaaccagcagcagatttgtgtttaagaataaactgacaaattttcacttcctaccctgaaatatttagaaaggcaacccaaaactacaagggataataaatgttaactctcaaattatggactttgagtaaagacatcccagtcctttttcccagtgtgctttccagagtaacttaaggtaggagtccgatgttccaaatgattacaataatttaggtaatgtaaatgggtggacttatttcttgatggagcacattccacctctacatgcagcccctaatcatttctaggcaatggctgtcatgtagacctattattgccagatcttccaattttctcaagaaaagccaaaagtgaagatttttatctgtcaatgttaaatacaggtttaaacttaaaaaaaaaaaaagtactgtcaaaacaaagcacataggtaggtaacaaatctgtaggtaactcatccataatctctggcctaatgatccagctattctatagcctcaaagctaagaggaccaaagagtggaaaaattaagtcctatatatgcatcaagccatgctgctcacatttctcccattggtagactgaaatctgctgtttctcctgaagaagtctcttggggttcaccagctttcatatgtagatactgacaagctaataactattcagagaatatcctggttcttccttcaaacgacgaagtgtcagacacatttcatttttaacttgtctgggatggtctgtggacttaactggtctgatcacgaccataacagctggtggtcacctttgcttttccgaccaccaaattactgcccttgatcatgttcagtttccctctatcccactttcagagacaaccacaagcttcagcaactaggctcaagcttgcatgcatacactttaatccctctataattaaaaataccagataatactttgctgatcaataaacaaaggtatttattcagcacccatgtgccaagcactgtgctaggcactgtggtggatacaaaaattaagacatggtccctgcccttaaggagcttacattctcatgagggagacaagactaatatacatgtaccagctaggaacagtacaagacaatatataatttggcgttaagaatgtcatacagacttgaagctttatagggattcagagacagacaataaaataggccttagagtcaagattttttgaggaatcaggaacaaggccaggccttgaagaactgaagagacttaagttgaggtccctgttaggtagaagtgggagtaaagttaagaaaaaaacaagtatgcatataatgtaggggcttactaagaagtcactgtggatttctgagcagaggagtgacttgatcatacaagattcaacaattttattgcaaactcataaaatatgtttaagtagcctggagacatcctacagaacacagaaaataatggcaggatcatgactaacaacatagctggaactcacctgtcaaagaaaaacagctacaacataaaacactggcaggatagatgacaatagttctaggaagcccattactcaacatggcaatagctccaatgcttccttattttcagaggccccagagactgagggtttcattatccagacccaggacttaggtgttctgcttctagagactacacaagaggtatgaaagatatgaggacatacaagagtgacacagaaaaaacaagaggaagagagaaacaaatagaaatccatactggaaaaaaacgcaccgaaatgtatataaaatgtatctcctaaggagatgcaatttgtatgtccatttatttttaaatgaacgtataccgtatttccataacaaacaaaaaacactatgctttagtcaagtgtgcttttcagtatcactagaagaatccaggaatccctcaaattatgtgtaaggttagttggttggtctcaaaattccatgtatcaaatctcactttcagtttatttgcattgtgaaagggaagtgtgttctggaagaactaagattgagaggtaaattggggagaaagtaaggacttttccttatgtccattcaagcacaggtatcctgtcaagcaacacagggctaggaatggtggttgtagggctggccaaactgatgagaggtgattgaaattaccactgctcaggacacagtgtagtcagtcacacagcagggcatcctgccactgggaacttgcaccctataaaatcggagaaatcaaaaaccctgtaactgcctgcctttaggctgtatattcaaaatgtatttcctgttttacctagtcattaatgtatacagatattccctacttaaatgaacagtgagttaacagattttaggattagtattttaccacaaaaatgccattcattgcataactccaactcagggagaacaaataaaactagagaaactcatttctagcccaaaaacaatttaaaaaaaaaaaacaaaaaacaaaattctaacaaacgtcactgataaagcgttcttgagcaaaaacaagataggataaaacttaagaatcccataaggattatacatgctaagattggcttttaaactttgaaaaccttttttaaactgcttaaaaagcagtcccatagacccaggttccataaaattgcaacaatcatattcaaagttattagcaacatgtaaaatacttaaataccattagttatgcaattccatttaaagacattaaaacacttttcacttcaaaaacaatctgaaaattcctatttaggatgtccattatgtttaagcctatgtctatctttctgaggacaatgtcacattctggaaagctaccccttaacaaaggttgaatgaactactactaacaatccacttttgggaaagggacctgtgcctacatgccgttaatgaaagctgtttggaatcatctctttcctaggggtgctctttcgactcttccaggttctggaagttacttaagcagtgtgaatgcaaacctgctgagactcagggaagacttaatatttaggggaagtatttattgaaccacagcattaagtgtctacttctgtggaccctgtctaatttctacctgattgggaaggtaatccaggtacttggctctgaaaaggttcttgaattttcacgaagcaaatgactaatgttaactagccaaagaccctggaagaacatatgcctagctaactggtatctgttcgtctggctccaaagtcaacattctaacttggtttccaaatctaatgaaaatctgagaccctgtctctattttttttttttaattaaaaaaacaaaaaacaaaacaaaacaaaaaaggcaaaaaaaaaaaaaatggctgggcatggtggctcatgcctgtcatcctagcactttgggaggctgaggtgggaggattgcttgagtccaggagttcaagaccagcctgggcaacacagtgagaccccatctgtatttaaaaaaaaatttttaattaaaacttttttaaaaataaaagaaaaaaaaagtctaatgaaaatcttcctagttttacaaaaatgtggcccttaccaatctttccctggatacttcttaatggagaaatgtaagtaaagcaaataagatgccacattagcttacagctgactttcctatagctgaattcctactgctacaagaaccatcctccctccttttttttcatgttgtctgacaaagtttggcaaaacccagatgcaaaacaacctatccagatgacagaaataaatcatcttcctgctgaatcttgcattctgagttagtaagatgtacacaaccacagcatgacagccacgtatttccaatcctgaaatgaaatccagttaaaagttgtgaagacacaggaagaacagctgtgtaaactgttctgagctcagatctacgcaggagggctacaatacattatcagaatttaaaagatcacacacaaaagctttaatacagtgagagaaaaatggaattccgttttattttgtcctctctgaaacttccatttacaccatggcctcatctatcaagaagaggaagaaaaggctctgccttataccataaaaatcaagtactcatgtacttgttagaggtggcaggatatttgtttctccagttttttggctctaagaaattacactttcagtaccagtgtagtgaggaaccactggcaaactgttggaaatgtcttctggattagtcagtgtaccatttcataaagtgcttctggagttaaaatctgccaagctgtcaaaagtgtccacacttttgcaacaaaggataaaagatcccagtgggtatcaccgagtccttcccagctgggtctcattattggcactgctgctttaacctccaagccgctggccctcaccccaggcgaagcctcctggccgttcctcaggtagtggattgtaatttggatcctcatctggtgtatcaaaaatagctttcctaaaagacaagcaacagatataatttggtcccagagtcatctcaggtccaaagtactacaaggtcagttcaggccccatagggtttccaccaataggtaagcattacacctgcctgccaattaaacagttaacatattgtaagagcatctataattattaacatttacattagcttttatcttttactgatttttactacaaaagcaatccaaatcataataattacagagaaggaggaaatagagatgagcaaaatatcctcaatttccagaggtaactattgtcaatgttttagttattctttgggaatttttacattatgtcattttacaaaagttagatcacactacatgttttgtaacctgactttcacatatttatcattaatgtttccccataaccaaggtatcacccaagtgtgcatcaacaggtgaataaacaaaatacggtacacacatataatagaattttttttttttttttttgagacgggagtctcactctgtcgcccaggctggagtgccatggtgcgatctcggctcactgcaacctccgcctcccggattcaagcaattctcctgcctcagcctcccgagtagctgggattacaggcgcccgccaccacgcccggctgatttttgtatttttaggagggaaggttttcatcatgttggccagactggtctcgaactcctgaactcaggtgatctgcctgcctcggcttcccaaaatgctgggattacaggcatgagccactgcacctagtcaacatggtgaaaccctgtctccaccaaaaatacaaaaattagcctggcgtggtggcgcatgcctgtaatcccagctactactcaggcggctgaggcagaagaatcacttgaacctgggaggcacaggttacagtgagctgagactgctccattgcactccagcctgggcgacagagcaagactgtctcaaaaaaaaggaaggaaattcaggcacatggtacaacatggatgaaccttgaggactttacgctaaatgaaataagaaataagccagacaaaaaaggacaaatattgtatgattccacttaggtacagagtagtcaaattcagagaaagaaaatagaatggtgatggctggggtggggagttgtttaatgagtacagagttgtagttctgtaggatgaagagagttctatggatggtggtgatggcagcaaaacagtatgaatatacttaatgccactgaacatttaaaatgagttaagatggtgaattttatgttaggtattattttaccacaaaatttttaaaaaattaacaaggtatcccaagaaaaattactgcagaacataggaggggatagtaaatgtccaaaagactccctaagtactatgatgtagtaattcaaaacctcactaaagaaggaaccattaaagcagcatcctcaatttgcacttatatttctacttgtaatcctccacagttgataaaattagaaatgtatctgaaaacttctgatttatactggagtcagaaaatagtataattcaaaatgagtttttaaaattcttacaaattaacaataaaaacaaacataccaacagaaaaaatgggcaaagggctgaatatgcaattcaaaaaggaaatccatgtggtcaataaacgtgagaatgtttgctctcacaataatcaaaggaaagtatattagaaactgagatcccggcaggtgtggtggctcatgcctgtaatcccagcactttgggaggccgaggagggtggatcacctgaggtcaggagttcaagaccagcctgaccaacatggcaaaaccctatctctactaaaaatacaaaattagccgggtgtggtggcgcatgcctatgatcccagctactagggaggctgacgcaggagaatcgcttgaacccaggaggcggaggttgcagtgagccgagattgagccactgcactcaagcctgggtgacagagcaagaatccgtttcaaaaaacagcaacgacaacaaaaacaaaactgagatcccttctactgcccaaacattagcaggatgggggtgggggcacagcctggtatagggagtcaagagccccatcagaccatgcacacatggaggtggcctgacgagatgttagcccgagtaggatggggaggcatccctgtaagagggcagcctggtctggggaatctgagggtgagtgagataagcaaggcatccatatgggagaggtggagactatcccgaaagactggttacatatgaggggtaattaggtaggtaaaacattaatcataataagaatcaggttaggacagatggaaagggcagatggaaaggagtggtacattcatacaaccaaataatattcagcaataaaaaggaacaaattaccaataaatacaagaacacagatgagtctcaaaaacattatgttgaatgaaagaagccttataccaaagagtacatgcatactgtacaattctactcatgaagttgtagaacatgaaaaactaatctacagaggaacaaaaccagaatagcaattgcttcttgggggacaggtacaatgattgacagggaaggacatcagggaactttctggttgatggtaattttctgtcttgatagatacacagatgtgtgcatttataaaaactcagttgacacactcaagatttgtgtattttgttgcacataaatactaaactctagttactgatatgcacactcaagtatacaaggaattaagtatacatataatggcacatacattttggattggaaagctagatgtagggataggtgtgcaataagaatagggaactattaattacagaatctatgtggtggctacatgaagctcactccaatttttttctgatttcctataagtttgttaattttcataataaaatattggaggaaaccaataggaaaaaagctagaatgaaccatgaggtagtactagaaatgggagtatagtataaacccatgttttaaaaaatacatagatctaaaaatatacacatgtatacattatcatacatacatacatataattccattgctctgttcactgagaggatctgggaatagcaacactccaatagcaatgagcacatctagcacccagatcttggcttctaaataccattctccactttaaaggaaccagggctccttgaagaaacagctgattctaggactggatcaaggagagcacaggatgagcctggtatatcttgttgtgccagaaaacaattgcaaaaaaataaaaaaataaaaagtggggtgtagtggctcacacctgtaatctcagtgctttgggaggccaagagacaagaggatcacctgaggactggagttcgagactagcctgggcaacatagagagaccttgtctccacaaaaaaaaacatttaagaaagaaaataagcagagcttggtggtgtgcacctgtagtcccagctactcaggaggctgaggtgggaggatcacttgagcccaggggcttgagttaacagtgtgctatgatcataccactgcactccagcctgggcaatggagtgagacctgtactgcatatgtaatttcttgtaggactgaaattgtttcaaaacattttttaaaaatcataaacaatgagacatcatcctacaactattcaactaggaaagggtaaataaaatgccttccttgtttgattaggatgtggggaaatgaacagttataaatgctagttgaaatgtaaacctgaacatccattctggaaggcgtttggcaacaaaataggaattctacttctaggaattatcttttgaaaataatcatggatgtgtgcagagatttagctacaaggacattcaccactccaattacagaagagaaaaccaagcactaacgtcaatgtccatcaacaagggattagtataattacaccatatccataccatggaatatcacctgttataattttataacacttcagggtggaaaaaacaattatggcatactaagtttacaaggttacaaaaattgttttttgagacagggtgccactctgtcccc

SEQ ID NO: 1068 - DNA, 194061 bp, Homo sapiens
ccagtctgtgttttttgattggagagtttagtccatttacattcagtgttgttattgataagtaataacgtactcttgccattttattgtttgttttctggttcttttgtaatcttctcttcattttttttcttcctatcttctagtaaaggtgattttctctggtgacataatttagtttcttgctttttctttttgtatatccattgtatgttttttgatttgaggttaccatgatgatttcaaatactatcttataacccattattttaacctgatagcaacttagcactatttgcataaacaagcaaaaagaacactaataaaagtctatgccttaactttatccccctgctttttaaatttttgttgtttctatttatatcttataaatcttaactgtcttgaaaagttgttgtagttattatttttggttggttcatcatttagtctttctacttaggataacagaagtttacacagtacacttacagtgttattctgtatttctcagtatacttattattaccagtgagttttataccttcaggtgattatttattgttcattgatattttattttctttctggtttgcagtactccctttagcatttcttgtaggacaggtctggcattgattaaatccatcaggtttatctgggaaagtccttatttctccttcttgtttggaggatatttttgctggatatactactctagggtaaaagttttttttttttcagcactttaaatatatcatgccactccctcctgtaaggcctgtaaggtttccactgaaaagtcagctggcagagttattggagcttcattgtatgttatttatttactttctcttggtgcttttaggatctttatccttgacctttgggactttgattattaagtgccttgatgcagtcttctttgggttaaatctgtttcatgtttaataactttcttgcacttggatattgatatatttctctaggtttgggaagttttctgttatccatttgaataaactttctacccctatttctttctctacctcttctttaaggccaatgagtcttagatctgccctttcgaggctgttttctagatcctgtaggtgtggtttattgttttttattctttttccttttgtctcctctgactgtgtattttcaaatagccggtcttcaagctcattaattctttcttctgcttgatcaattctgctattaaaggacttggaattcctcagtatgccaattatatgtttcagctccagaatttctgcttaattctttttaattatttcaatcttagttacatttatctgatagaattctgaattctttctgtgttatattgaatttctttgaatttcctcaacacagctattttgaattctctgtctgaaaggtcacatctctgtatctttaggattattctctggtggtttactgagtttatttggtgaggtcatgttttcctggatagtactgatgcagtaaatgttctttagtgtctgggcattgaagggttagggacttattgtagtcttcactgtctggggttatttgtagctgtccttcttgggaagactttctagatacttgaaaggactttggtattgtgatctaagctgtatctgccttagggggtaaccaaagcccagtaacactgtcattcttgaagacttgtagaggaaccgccttgatggtcttggataagatccagaattatctagttttctgggcagagactcttgttctcttcccttaactttctcccaaacatacagagtctccgtctctgttctgagccagctaaagccgagggtggtgtgacacaagcacctctgtggccaccaccactatgactgcactgcgtcagacctgaagccagcacagcactgggtatcctccaaggccggttgcaaccactccctgactactgcctatgttcactcaaggcccttgggctctataatcaccaggtgccaaagtcagtcagatcttcgtccttcccttctgggcagggacactgcccaagccctaggtgggtccagaagtaccatctgggagtcagagactagagttaaaaaaccttagaagtctacttggtgttctattatattgcagctgagctgacactcaaactacatgatgcagtccttctcacttttccctcccctttccaaagggagaggagcctcaccccacagccactgccaccccaagccatgaggagtactaccagactactgctgatgttcctttaaagcacaggttttcttaaatcagcttgttgtgaacgctgtctggcctaagactcgcccttcaggacaatgggctcccctctggcccatggcaggtcctgaaatgccatctaagagtcatattttggaattgagggaccccaagagccctcttggtgctctacccccctgtggcactgttggtacctaagatgcaagacacttttccctctgcttttctgaagctgaaggagtttttccctgttgccaccacaactgggaatgtgctaagtctcatctgaagccagcaggtctcagaggcttacccaaggccctcgatgtaatagttgggtatcactcctagtaattcagggcccaagggctctccagttagcagctgatgaatcctgccaggactgtattctgtcaagacaatgggttccattttggcctagtgtgtgtctagaaatgtcatctgagagctagggcctgggataggggcctcacgactctgaatggtatcctattgtgctcttgctgggctggtattttagatgtagtaagatacggtcctccccactcttccctctctcccgaagtggaaggaagaggtctctcctgggaccacgagctgtgtagcttggggttagggaagaggtgacgccagcactcacttgactgctccagctgatgtctcatgtgtcctctccaagtccactgtctgtcttggtgtaattcagcactaggacttgcctaagagttgcagtccttatggcctagactgcctttcaagtttacctggagacacagagcactgttgccctcagtggcaaggtttataggtactcaggttcagactgctgggatcagcgattcccctctgggtagggttggtttaaatgttccttccatgggtgagcatcagctgagtttggtctggttttcctttctgctctaacaggacagccctgagttcattgcctcacaattgccatgttctccttcccccagtgcccagagatccctggcttatctcacttagcataatgttctccaaacccatccatgttatcatgaatgatagtatctccttccttataaagattgaataatatttcatttgtatatatacctcattttctttattcatttgtcgatggacccttaggttgatttcttaagatgactatagtaaacagtgctacaataaagataactgcaaacatctcttcaacaaactgacttttgagtaaatatccaagagtgtagttgctgaatagtaagtcttcatttctttagggtcagttgctggtgctttattttgttcttttggtggtgtcatgtgtccctgattgttcttgattcacgtggccatgcattcatgtcagaaagggactgattcgagtctttgcaggcttgctttggttgggcaaggacttcatcagtcaacctgtctagagattctggccactatctgctatggcccatgggcaggcttgcttcttgtgttcttgggcaggcgggcctggtgcctaggtctatgaacccagattcactggagtggacctgttgattaggtccatgggagctgatctagtgctggggtacatacagcctttgactttgaatctgcagggtctagccaggcaatgggatgatcctggcatacaagtccactgggagagaccttgaatctgagtctgtagggctaggtctgggtcctgagtctgcaggggctagcctggtactgcgtctactaggacaggtctgaaccttgggtctgctggagcgtgggtttgtaaaaactggactggcaccggataggcctagagcctgtgtccacacatgccagcttgggactggggtttgtgggtgctgacctagtgctagggcctagacctagggcctaggcatagagcctgggaccatgggggccagctttgtgcttggaaaacctggaggctgggtctatggatgccagcctggagtctgggactgcaaaggccaacctggagctaacacagactgattcctgaggcagcaggtgccaatctggtgcctgaggataggggtatctacctggtgctggggtgggcctgaaacctggggttatatgggccagcatgcactgagctgctctggagctcaggactgccagggccgtcctggtactggggtcaatggctgccaatctagtgctggagcaggcctacaagatgggtctgcatgtgctagcctgaaatctggggttgtgaaggcccagcctggcactggggcagactgggtccctagtctgcaaggactggctggaggctgggtccatgaatgctggcctgaggctgaggaggacctggaaactaggtctacaaaggccggtctggagtctggggttacagggccagcctggagcctgaggctgctggtgccagccagccaggtgttgaggcagtctggagcctcaggtcactggggccatcctggcagtgggacaggcctggagcctgagaatggtctgaagcctgaggctgcaagtgctaaactggtgctagggcaggcctggagcttgggtccatgggtgtccccttgatgactagggctgcagggaccggaccaacactggagggagcatgaagcccagggctatagaggccagcccagccctgggaacaatctggagcatggagccactggggacagcccagccctggggtaggcctgagagaataagtccactggcaccaaggcgggcctgcaggcagctccatgggatcttgtctggagcctatatccattagggtctgcctgttgctggatgagtctgaggactgagtccttggggccatcctggagcctgactatggtgtctggcctggcattggaaccagtccagagcctggggctgctgcaggtgagcttagaaattgtatgggcccagagacgaagtccagtgaggggcctggggctgcaggatcctgcctggtgcttagatgggcttagaggctcagtctgcgggaactggcctgaaatctgggcaataggggtctagcactgggttttactggggcaggcctggtgttggggtccgaggcaccattctggtgctcacctccctctctatcccccatgcagaaggtatctctccccacgtcatactacccaggggtggagggagggtggcacggatgggtcatgtaaaactctttcctatcctcttcacagcatcttttctgatttctgtgcaacattcaggtgctgtaatctctcatttggtttcctcagctcttgtgagtgtattctcatgcatggatagtcctttaaattggtgtttctgtgagggggtgagcattggaaagtcccatcctgctatattgctgatgtcactccccaaactaattatactgtagatttttatctaactttaagtgatatatcacttcacatatagtgtaaaaagtttacaacagtatacttctagttctctcctggcctttgtgctgctgttgtcatacatttaagcaattcttcacctcaggctcctgagtaggtgggattacagatgcccaccaccatgcctggctaatttttgtatttttagtagagacagggttttaccatgttggccaggctggtcttgaactcctgacctcagatgatccgccccacctcggccttccaaattgctgggattacaggcatgaaccaccatgactggccttacttatgctttaaacaattgtctaggagagatttaaacaatgaggaaaagtctttatgtaatttacttatgtagttataattgctggtactctttattcctttgaatagatccgtatttccatctggtatcattttgccttctgattcagaaactttctttatattcctttgatatttcttatagtgcagatttgctggcgatgaattcttttacccttttcatgtctttatgtaaacttcatttttgaaaggtattttcactggtcaaagaattctagattgacagcttttttgcttccaaaacttctaaagatgtcactccactcttctggtttgcattgttcctgaaataaatctgctgtcatccttatctttgttcttgtgtatgcaatgtgtctattttctctttgtgatcctaacatttttctcttatcattgattttaagcaatttgattatgatgagtatggctctactttccttgtttcctgtgcttgagtttcattaaagctcttggatctgtggttgaatcaaaactggaaaatatttggccattattttaattatatttttcctttaccctcctccctcacggactccaattacacatatattaggatgctcaaagttgtcccagagctcactggtgttatttggttccaatgttttttaaaagtgtttccttttggatagtttctattgtgccttcatattcactaatttttcactctgcaatgtctaatctgctgtgaatcccatctagtgtatttttttatctcaaacattatacttttcatttctgtaagtttgatttgaatctgtgtgtcttccacatctcttcctaacattgaattttttctctagcttcttggacatatgaaatagttatgctattaattttatcacctgtgttatttctgtatctgttttgatgtatgttttccctctcattatggtttgtatttacctacttttcatgcattttttttaatgtcaaacattgtgaattttaccttgttgagtgttggatatttttgtattcctacaaatactctggagctatgttttcagataaaatttagctatttggcttttggtcatttcctttttagctttcttaggcaggaccatgatagtgtttatcctaggactaattttgtcctgctactgcagcaaaatccttgagagtactacctaatgccccatgaattatgaggttttccagctggttggtgagaatatgaattacagtagtccccccaccttatctacaagggagatgttccaagactccagtggatggatgcttgaaactgcagatggtactaagccctatatatgtgttttcctctctatatatacacatatgataaagtttaggccaggcatggtggctcatacctgtaatcccagcactttgagaggctgaggcaggcagatcacttgaggtcaggagttcaagaccagcctggccaacatggtgaaaccccatctctactaaaaacacaaaaattagccgggcatggtggcacatgcctgtggttccagctacttgggaggctgaggtatgagaatcatttgaacccgggaggcaaaggttgcagtgagctgagatcgcaccactgcactccagcctgggcgactcagtgagactctgtctcaaaaagtgtaacttataaattaggcacagtaaaagatcaacaataatagaacaattaatatacagtaataaaaacctatgtgaatatagtctctccctctctcaatttcttattgtactgtcctcacctattttcagaccatgactaaccacaggtaactgaaaccacagaaagcaaagccacagataaggggggcctcctgctgaattcctagctttgtgtgattagattgttacctctaatccctttcgatggctattgttctgggtgccagcaatttgctcatacacatacactgattcctttctcagcaaaatattgaggaagatcttgatgtggtttgactgtgtccccacccaatttcatcttgaattgtagctcccatagtccccaagtgttgtgtgagggacccagtgggaggtaactgaatcatgagggcaggtttttcccattctgttcttgtgatagtgaataagtctcaggagatctgatgattttatgaagggcagtttccctgcacacgctttcttgcctgctgccatgttaagatgtgcctttggtcctccttttcctcctgccatgattgtgaggcctccccagccacgtggaactatgagtccattaaatctctttcctttataaattacctagtctcaggtatgtccttatagcagtgtgagaatggactaatacagaccttctgtgtacctctccctgtgcccctctgtggcctttggcctgcgaactctatcctcattatattccccagactcgcagttctatcatcttggcaacttggagaaaccattaggctctgcctgggttctctccctgcctgtggcctggaaactttcttgaggtggtaagttgggacaattaaaatgctcacctctcaggaatcactgtccctccctacctgatgcttaatgtcttgagaaccattgtttatatattttgtcgtcttctttcttttagttgtttcaagctagaaggtgaatctagagtctcttactgcttttacctgacagagaaagttctcttcccttttttctgaaagctcctttgaatcagttttgctttaggcattgagatgtcactcacaagcttattttcctggctcttcttatcagtgggcatattctgacttcccttacttacttaggagcaagcaaatagccaagactcagatttgagttttgggtacgaggttagtacttcattcaataaacttcaaatctgtctggagaaggtatagtgaggttagctcttgccccgctaaatctcaacattgtgtgctttctctgtctggctctccactgtatcccatttcctagaatggcttttggtatagaaggtattcagtaaatacttacttatgaatgaatagactgccaaatagcttgcaaattctctaacagttaaacattttatcaaattaaaaatctcaatggtcaaaaacagtatcaaactaaaaactctaacaaataacatttatttttcttttacatatatatttcacagcctgaacatcacatcttcagagaaagttacttttatgccattgtatttactatttaccacacaggcattgaacattctcattaacatgataagacaatttgctggtaaacatttaaacacacagacattagtttcagtatctcaacatatttttggtcataaccaaggaaatacatcaaaataatgacaacattggctaatattttacaagcaaatatttaactctgcatagtttatacaataggctgtggcaataaataatgtcaccaatctcatcaactattaactggccacaagaagcctaacattcattttaattatgatatgaaatgctctattggtgtagtttcaacatatccttaaatgtttgggtgtttaaccttgaatacacgaaaagaaaaagtactaaactggactaagaaggtgtgtttggttaactacaaatatgtcatgttcacatagtacattcctaacatgaaggcaaatatttaaatagaaaaactagcagtccaaaaaatgtgaatgtgcaaattgtgagtaaaacattgcatttaaatttgcactcatttgcaagttacagtactagctcagtataaacactaacaggaaaaatattcagcaggaaagaatggaaacggcctctcacagcagagaactggtcactgcgcactgctccacagctaagaaagttttccaggtggtctagcgctcctaacaaacaccttatgattatccttcattcaacagaggaggagactgcaggcatgcttcagtcagtggtaagaacaggaagaaaaacccaaatcagcaacattttcttccttaatttggtataaacgtccttttcattatttcaagttactaatttgctaatctcaaatgttttctgaatcaggtttgctaaatgctgtaaagaatagctatccttcatacaatactaggttttattttttttagtatgtcagcataataaggtacatgcgcattcattccaccaacctgtttagataatactcagcttgggtcatattcaaattctacacagagattctctgttttcaatacaactgcttagaaagcagaattgcctagtgatgactgtagtgtgccttttaactgaaatgtatataaaaataaaaccccaatctttatagaatgtcaagaattctgttagggatgttaaaagcattgggcaaaaccctggttttcagcgtgccatctgcaccacaggagaagagccgattgccctggatgatgtcaatctgcatgactccagccccaatgtttcgaaatatggactgcttagcatgttcacttttaaatgaatgaattaggccatggcctgtcaatctccaaacctagtgcaaaacaaaaggagttaaaaatatattacgaaaagaccaaaagcaaaaacatggcccttctgctcccttggcccaagtgatctcactaaagcccaaccttcccacccactgcctctttcctaagagcttatctaagtgggaaatgataacaccactcccacgattcatttactgtcctccttccatattttccttcacatcctcttgtggcttcatattaaccatatgtagcccatctctaattcaattaactatttgagttaattcagttaaatgtgttcctcatgctgagctaggtcctaaggctatgtaaaagtagtgtggtacagacagtcccctacttacgatggtttgacaagactttttgactttatgacagtgtgaaagcaatacgcattcagcacgctccttggcttatcctgaggttagtctcaataaactcatagtaagttgaaaatattaagttgaaagtatgtttttcaactttaacaatatttttaacttataatgggtttgttgggacataatcccaccataaagtcaaggagcatctgcactagctcacttactggaaacgtcacctccaccacacacaagagtactgagggagaggggagaagcttctaaggagccaaactaatgtcatcaaaaaatttcatgcattaaactcatacactttactcaaaatagaatgctttaaagctttctaatggcctgagtccaatgagtttgataatctcattgaccataacagtttagaaagaaccatacaggagcatggggaggcggcagagtgttgagatatgcagtatctccatgcagtagcccaagtgaaataaagtgaagctttatttcaaagaatgtggagtttttgttttttctctttccaatcagtctttagcacattccaacctcttgtactgactcacctttatgttaccttctgctgaacctgtggtaaaatattcctcatagggatccaaggccagagccttaatagctgagtcatgggcctggaacgtgtgaatgagctgcctttgcctgatgtcaaaaatgcagacgtgtcctttcctaccccccgagattaggagttgctgtttgggtgcatactgcagtaccgtggcaccatgatcgtggcacgtgaaacctgaagaagaaaaacatcagagaatttctcaaaacaatttcttgtcttggtaattatgatgtctacatccacatttaaatacagaccttactgatgcatttttcattctaaggtacatttattgttttgtaagtcattgaatttctgtaatcacatgattaaagaaaaatgttaagcaatgtcagaacaaactttttatccataatctcaatatgaaatgaacacagagagaaaaagaaagtttaaaccttaagccctaagtgatactgcctcataaaaagtatacagaagagcagagaccaaccttctcaaagttggtgagtattaacccagccaagtgctgtaccgtacaaaaagttcttttcaggtaagtaattgaaacaacgacactatgagaaaatgtgtgaatgttttcagttacaagttaagaagttcattatccttcccaggagtatttgcattttaatatgattaaagattcaaattaacatgcagaaaatctgtaagcaatgttaaccactgtttgcagaattctgcaataaaattgagaattaactacatatttcaaaatgcatatcagtgtattaaaagactgagaatctttctgtctttctgacaatctacttcatttaaccaaacttacttgagcatggagcactttttgggtggtactatgtggaagacagagttaggacactaatttggcaagtattgtcttaaaaggaataatatttaaatggcactgtttacatttctagtcattataataaggttaacctttgttttattttatggttagggccaggtgtggtggctcatgcttgtaatcccagtacttagggaggtagaggtgggaggatagcttgaccctaggagcttgagacctgcctgagcaatacagcatgaccttgatctccacaaaaaggaaaaaaagacaaaaagtattttatgatgaggtttaattctttaaaatatgttattttctattaagctcaatgaatactttgcaactaatttcttaaatagccttgttagtagtaccactatccataccatattttctgaatagaatataaagactattttggatttctgagaccatatatctttaactcagcaaggaagccagatatgctaattaactttccaaatttttagtcattcattctaaatatttctccattttcaacctgtcaataaacactcactggattcactaattaaaaccaagaaagcattccttcatggtgtattattccttcatggtatatttttaaaaatcatagaccttaactcaccatgaatgaggctgtttccgggtgatattaatgtgtcccagaggcaaacatttcttttaaagaaacacaataacaaaaatacatcataaatgattgttataagtcgtcatcagggacaacctgtctttcagtcaaatattttgcttattcattcttatcttttttgttcactcacacctatagagagtagtgattcccaactaggatgggggtagggtcaaactacacagttccatctcacatggtcctgcccgtctctgcatcctctaccccatctcctttccattgccactccaggaaactgatatgacttcctgagtataaggaatgcttttatatccccaggtggtagccactgcagggaaacaagatgttattcatgggcatgtgttgctaatgaaaaccatgtgaggtcaaaataaatgttgagaatgatggggacagtgtcaaatacctgttagtccctgaatcctcatctctcaccttatacaaaaattaactcaagatgggtcaaacttaaatctaacacttgaaaccataaaaattctagaagataacatcaaaaaaaactactctagacattgacttaaagaattcatgaccaagaacccaaaggcaaatgcaacaaaaataaataaatgggacctaattaaactaaaacacttctgcacagcaagagtaaaaaggcaacctgcagagtgggagaaaatacaatgtatatatctgacaagggacttatatctagaatctacaaggaacttaacaagaaaaaacaatcccatcaaaagcgagcaaaggacatgaacagataattctcaaaatacaaatggccaacaaacaggaaaaaatgctcaaaaccactaattaccaggaaaatgcaaattaaaactccaatacgataccaccttattcctgcaagaatggccataattaaaaaaccaaaaaacaatagacgctggcatggaggtggtgaaaaggggacacctcactgctggtgggaatgtaaactagtaaaaccaccatgaaaaacagtatacggagattccttaaagaactataagcagaactaccattcaatccagcaatcccactactgggtatctacccagaggaaaagaagtcattatatgaaaaagacacttgcacatgcctgtttagagcagcacaattcacaattgcaaaactatggaaccaacctaaatgtccatcaaccaacaaatggataaagaaaatgtggtacatatacaccatggaatacttcataaaaaggaatgagataatcacattttgcagcaacccagatggagttagaggccattattctaagtgaagtaactcaggagtagaaaatcatatgtcgtatgttctcacttgtaagtgggagctaagctatgaggatgcaaaggatcagaatgatatataatggactctgggggcttgggaggggtgggaggagggtgaagaataaaagactacacactgggtacagtgtacactgctcaggtgatgggtgcaccaaaatctcagcaatcaccactaaagaacttatccatgtaaccaaacactacctattcccccaaacctactgcaataaaataaaaatgttgagaatgatggagacaatatcagatgcctgttagtcctagagaaactaacagtgttaacagtagtagtttaaaaaagactgaatagctttaaaataaaaattacatatattaggaataactttcatttttgcttttctctttttggtaagaaaaaacactctgaaataagaattatgtaacaaagtttttttttttaatgcctagagtggaaaaaccctactaatagaaaagtattcttgctaaaggtatggatttctaacgtttttatatttcttactttgcttttctgtcaacctacctattgtcattggagtgtccagatgtggcaactagacttgaagaggtaataaatgcaaagtcacttgtggctttactgtggcactgccaactctacgaaaaacaaagtgcaactgatgttattttaccattggataaaatttgatacagtaccaacatacatgtctgctaataacatactatatgcatgagctaaaaatagtttttaaaaactcggtctaggataaaagaataagtgatagtatgaggcttaactgtcatgtgtatattatttggctactgtccaataatttttaataactggagttggtaaaaacagaattaaaggtcatgtttttcagattatgtaagaataggacatcaaagtacatgaacctacctaagacccgtcaattttagtgctaatgatctcaaatacatgtaataaactttaacagtcacaaaggaaatgcttacagacccaactagtcttaggatgtcaaggtattttaaaatataatgcatgtttttctgtctggaattatagtggtacagatctgactgaagacaaaagtataaattcaagattacttccatttctgcatagacaaggtacagtctatagtgtcctaatttaagagaattatcttatacacataattaagaacatatgtatagtttagaaaaattttaaaaagtatttgggtaatctatctggtcccaggaggttcaaggcgttctgaacctccctccatatatgtgaagcctgaagtttcacacaggacagcatcaccttccaccctcccccatgttcctttcccccaccatatctccatcaggtaaagatctacttatcttcatcaccaactattttgtaatccaatttggattaaggtggctcattgggattggttattttataatctggtaagcacaattctggaacaaattggaacagatgtttggaacctgattctttttttttctgagacgaagtctcactctgttgcccaagctagagcgcagtggcacaatctcagctcactgcaacctccgcctcctgggttcaagcgattctcctgcctcagcctcccgagtagctgggacttcatgcacgtgtcaccatgcctggctaatttttgtatttttagtagagagggggtttcaccaggttggtcaggctggtctcgaactcctgaccttgtgatctgcccgcctcggcctcccaaagtgctgggattacaggcgtgagccaccgtgcccggcagaacctgattcttaatgacagaattttatcatgtgtatattaagaagatagagttttcaaaatggatgaaagtataataataatgaaaaaaaacccaagttgtaccacacacagggaaagcccccaaaatttttaaaatataaactgtacttcaaggtgaaaagcaaggctttttgtttttcaggtcatttcagtctaaaactagggtaaggatgggtgctgctgtcaggctgggattgctgaaaaaaatcatccttttcccaataggaccaccaatgagattcactgtctgaaacagacacttcatgaacaaagtgttgtgtatatgcgccctgggaacatttagtgatacttaccatataaggtttaggatttgatgcagtttggttaacttgccagatactcagaaaaccctctccatccgcaacaccacactgtaagaacagtataactactaaacacatgttcttagcatccacagcaaaggtaaaaacatggaaggaagattcactaaggccctactaaataaacattctgcctctaactatgtttctgttgctgtcattcccaaaaagtccaagtgctaaaaaattccctgtcactttttttttaaatttttttagagacagggtctcattctgttacccaggctggagtgcagtagtgcaattataacttactataacctcaaactcctgggttcaagggatcctccagcctcaaccttctgagtagctaggactagaggcacatgcctgggctttttaaaaaaatttttgtagggatgtggtctccctttgttgttcaggttgtctcaaatgctggagttcaagcaatcctcctgccttgggctcctaaagtgttgtaattacaggtgtgaaccactgtgactggcccttccattacttcttaactgcttacctgtttcactgttttcctctaacctcttactgatgaaatttagtaagaaactaggtttctctcaagaactttactgtgcttacaggaatcaccaacacactcaacacaggcagtttttttactctcacagtatatttagtatctttaaatagatgattaatccatactaaattttgtagatttttgcttctattggaagaaaagagagtgtatgaatagactccaacaaactgtctactcagtttaaatccagggtcactgaattcatttttcgatgcacttttatcacttactcctaaatatccacaactattttcagatgaattcagcagtagcccccagaaactaaccttgttgccttgtgaattaaaatataatctagtaactcttgcattgccagcttgacgaaagcagacaagttgctgaggccgcgtccattcaaacattcgtacactgccgtcctgagcacctgtaagatctgaaacacaagagaaaaagcaggaaataagaaattaaagagttccaatattttctattctataaatcaacctccaaatgaggacacttacaattattaggtcataaatacttacagtattgatggactgggtgtgaagtcattctcttaacattatgtagattccttttcataagctttaaaagaaaattttaaaaattttattttgtgtatgcagaaaagatgaggaaggatatgcttcaggataaattctgacatttattctcttacaccttgcttattactgagataaagcctgttatggatgttctgaaccactacatagaacacttgtctgaagagggtgaggaagcacagtcacttgctggtatagccctggcctgtgaggttaccaaggagcttcatctcataataaaggaactcttcttcaagtgcccctccctgaggatattcaggagcacctccagatgcttcagagcagaacataagaatgggacccctccagctacagtgacaagaatgttactgacatgctttcaagcacttagaagtagacatgaattcccctttaactttgctttaccattttgtatctgtttattcatctgtaaaatgataatggagggtaataatagcacctaccacctaggattgttgtgagaaaaagcatgtatctgacactaagaaagtcatatgaggccagtgtggtggctcatgcctgtaatcctagcaccttgggaggctgaagcgggtagatcacttgagcccaggagttcgagaacagcctgggcagcgtggtgaaaccccatccctacaaaaaatacaaaaattagccaggcacgctggcatgcacctgtagtcccagctacttgggaggttgagatggaaggatcaattgagcccaggaggtcaaggctgcagtgagccgaaattgcaccactgcactccagcctgcgcgacagagccagaccctgtcaccaaataaaaaagccacaataaatgtcagctgtcattatcatggcctatctactggtgtttgtccctgaaatttaggatcattcctatgtcaaagagattccaactgatttttcagagtccaaatccagaaatgatacctataagtaaataacataccacactagctccagtgctagtctgtccagtgcccagccatggcagagatgaaggtggatgcacctgacttgctgaataggatgttgcactgggttgataaagagttgtagtggaaccacgataatcaacatcatctgaactgtgaaaaacattcatgtgttactgtgaacattcccttttctcttaacacaaattccaactaaaaatcttcttatgtacccataggacaatctttattttaaaaactaagtagccatgagaaaaacttaggtacaagtcctaatcgccaatgttaatactggttaacttttttcccttttggcaaaatgtaaatttagtctaatgttgtttggggacaactttattgctgcacaagttgaaacaaaagtttgttgttatctatggaaaaatattatgttctcttcaagtacagatagctcagtatcaaattaacacgtttaaagaaatttgagtttaaagatttcttggagtaagacatataaaatgtgaaagtaattgttgggatggattgtatcatagtacatggttatatctactctgaaatgtgatattaaatcctagttatatcacatactaacaaaaaaaagaattcaacaaaatgaggagagaaactatcatggcaccatcctcaagcatgaacaatttctaagagtctggagaaaagcaggagggaaggcaaaccacaaagaagaaacctcaaaataggtaagaatggcaaaacactcttggtgcagtgtccatagcttcaatgaaaagtaaagccgtctacatttttatgtttaagaaaaggtatgcttatcaggtgataagaagaaacactgcaaaattactcggtaaatgtgactcagtgtaattaacatatttgtgtctactgttttaattatccagatcagattaatttactgaatatcatgaagccaagtgttagggattatccttattgaaatattatcaatagtgtagggtttaatggaagtgtaattcattcagttaatgtagacaaagactttcactggcagctaaaccaattatatttgtcacctacccaaatgaaggagatacacgtataccttttgaaataattcaaatcatgtgcataaccatttggtgggtacttcttacagaaaactatatgtaaaagtgactatgagacaaaccttttggattctctgtcatattcttctccgatccatatgtatgactgacaggccagtagagaagtaacatcaagttcttgaacatcatgtgttgaagccaaaacaatttcattacaatttgcctataaagcaaaggcagaatcgatgatttaagcaatttcactaaggagaaatacactgtgtataatgatgagagcttttaccttattaacagaaaatgccatgatcatatcagattccttatggatgactttcgcctttccacctggatagcccagatcagcttcaacctagaaaacattcatcagcagttttagttgctgcagcacagctctatttagagttatgcacatcccataagatttaaatgtaggataagaagaaaatgtagcagcagcagcagcagcagcagcaagaaaaaagggtaagagtaactttaatgtgttgaaaactagctttggaaaatttgcttaaattctctgatgtcctgtaatcaccccaatttccactgtgatggtaagatactgattaattataaaacatggctaatatatttttattagtaatttatacagtagtatgtctctcttagctcttccaaaagtgcataaatattctgcaataagaatgtgtatacattaagaggcacagagtggagtaaaaagccatagaaaaccgcaaagaaaccaccctttgaagtaagggtggtgagacagaaataaggaaaagttgtaaagagggatacttcgaaaggaataaaagagactgatgagaggaagatgcaatggcttagggttggtgatgggaaggaaagaaaaggcagaatcaagaagatgaaacagccatgcttaaaacagaaaaagtgacaagtgaagatgggacagggagcaagaaagagaagaaccaagggcaagacagagcaagccagatacagtgaagcatctcctcccctgtgccactgaagtggtatgggagtactatgagttctctgagtagttagccagttgggcaggtcatggttagtatcagagatgaggcgttagctccttgaactttaaagaatgagctaaatacaagatcttggaatactaccttgatgtggcaatcttctgctatgcagttttggttgacctgctccacatgttcttctatagactaaataccaccacaccgtcacaaacacaaaacacatgcatggaatgaaattataaagacagtgaaatatttcaagctgaaatggccactccaccacttaaagatgataaaaatgaatttgcaaaatcaagaaaaaattaaaccgaataaaacagtcatcaaataaacacaacacaaagccaaaagagcaaaattaatgtgactattacataaacacaagaacataaaagctatttcaaaataaaaattagttatctgtatacagttttaagaaatctaagttacataactggtaatctataaaattaaagcccatttgtataagcagatgcagaagatgctacataaattcctgccctataggggttgatttaaaatacaaattaaaatatttatttctaaacatagattcaaaatattgataattatttcactcttataaggaatatgatgatttttctctaagtaaataaatgtttaataaaatcaggcacggaaaaagaaataactcagtaatttgctcccgggttgatgcagggtcctaaggatggctgcaatcagaagttatatttctgctctgctgtggaaactctgaaggtttgatcagagaaacaaactcttcctcataccttttcaggtgactgccttcctttcatcacgaagggccattcaaattttctgcccatgcctccagggactcccctatggctgctgcagctgataaagatgcatccaagaaaacttccaaggaatggtcaatgtgtggcacagctaactcagtgaaggccaaactgctgaagaatctatttgtcttaactagctgaattcaccaatctgtttcccaaaaacttgttttgtgaaatattttcctgtaatatcttcagtgaataaaagatcttattcttataaatatataacttcagcatttctcagggattttttttaaatgcacccagcatttttaggattagcctgccaattttattggtcaattttctgaatttgccaaatttagtgattaccaaaatcctatttgacaattttaaagatgtaagcactcttactggattgggtagagttttagtaagttttgcatatttctgagcctaacgacgagtttttattttgtcctaacagccttaatgttttattcataatttttttcttaataaaacaccttttttttcagatctgagctattcaaaacagcaatcactaaccatatgtaactatttaaatttagatcaattaaaattaaaattcagtttctcaatcatgctagccacatttcaagtactcagtaaccacatgtggctggtgactactatgttggactatgcagatacagatttccatcatcacagaaagttctatgggacagtactggacaagacagtaattccattcaatgttttaaaattaaaagggtacatgataaaaattcttccatcctaactcccagccatgtacttcccttccttggagccaactgatgcttatatagcactttaagaaacattccgtttatctctgtcctacttccctgttcatggggacccactgctggaagaaaaatagaacacacagagactgaggggcataatggaagggagactaaggggcggagagggggagaattagttaaggaagaagcaaactcgtggggaagggcaagacgagaatgggagggtccaagaaacccagacacctggcttcccacagcactctacactctgacaagtcaaccagtcaagctgctatcaaccttaccaatacttaaaacatacttgtgataaatcattaattttaataatttgaagaacaaaacactcagaaaattgatcactcaatgaactggttttctgtgaataacagagcccctaattgaccagaaatcttattgattaagacagggtctcactttgttacccaggatggagtgcagtggtgtgtgatctcagctcactacaacctccacctcctgggctcaagcaatcctcctgcctcagccctgcaagtagctgggattacaagcatacaccatcacacctggataattgttttgtatcttttgtagagacggggtttcaccatgttgccaagctggtctcaaacccctgagctcaggagatcccccacctagtgctaggattacaggtgtgagccactatgcctggctaaaatcttttattttaaatcactatcttagattcctatattttagtttatggaatttggactcagcatcactataggaaatgctatacacagtggtttaaatgacagaggcaaataatttgcctctgatttccctaacaaagtcacatcaataatttcaatgccataagggtcttttgttatgaaaaagcttataactaggactcaaaaggtctctacagttcattcttctacttcctcatttaagtatataatttttaaatccatagagaaaacaaatgactgttcataagggctgaccacaattaccattcaggtaagtgggtgagtgggaaaaagaacaagtatggtaggttccactgccctgggcatgaggaaaaactgagaagcaattttatactttatctcgggaaattgagccgtatggactctctctgttttcacttttctaagcgaaatataattcatttcttctcttctcattgattgtgtttgccaaatctttattttttttgagacagagtttcgctcttgttgcccaggctggagtgcaatggcacaatcttggcttactgcaacctctgcctctcgggttcaagcaattctcttacctcaacctcccgagcagctgggattacagacatgcgccaccacgcccggctaatcttttgtatttttagtagagatggggtttctccatgttggtcaggctggtcatgaactcctgacttcaggtgatctgcccgcctcggcctcccaaagtgctgggattacaggtgtgagccaccgtgcccggccatgtttgccaaatctttaattacatcagacgctcaactctgaatactcttcaaactgctcattccctcactaattacctcactaaatagccaaacagactgaaatgctcatataaaaggtcccacttttataaggaagaggtcacttgccaatctcccaaactgctaattcttcttgaaccatgtctgctattacattactaattgtattagcttaaaaataaccatgcaatgcagaacctctgtcttgctttgtaagagcaatcttccttcatcttgtatttgctatttctgtagtttattctctcacaaaagtatcctgaatttgttgcttcaaatcatcattctgttcatttctaagtgctaagtaaagaaaatgcttttaaagggctattttatattttaagtacatatttggagaatattatagagtaagcttatatattaaattcctcaagccatccatcacaatgtttattatgtgtaaaaacctaatgacaaatactgtaaagtaccaactttcacttgaatatatgtaatttatcaaagtacctatgttgtttcattgctatgaaatgaaaattataaggttttatcttaaaagtagttcacggtagtttagtgaactttgactattacccaaccagaaagaaaatttcagaataaatcaagcactgatttccttagaaatgttaaagaaaactaaagaaaaattacaatagaaaatatttttctcaaaatacctcactctgctttcttttcttagtgaaaatatatctaataaatgtctcttgaaggacctcttgtttaacaaggaaatgccaaagtcgtttgactggaaatgcagaagaatcccgggacctattaaaaaaaattaacatatcacactactttagtctatagaaaatatgtttatatttgcagatatttatttttaaaaccttcacaatctattgcaaagatatttatttttaaaaccttcataatctattgcaaagaagacacagcattaagctcaacaaaactgtacagtttacttttaatttttagttctcctaaaaatcatttcatctagcaactaattctctaattacactgaatgaaccagttaagctgagagtcaaatgaatctcttattattctctttttaaattatactttatattggttctcttggttaaagcatatcaacaatgaatacaagtcatagataccgattctaacagcctaacaagctaaaaagctttgttctttcaagcttattttaatagtaaaaactattaatcagggtccactacctcaaaaaaaaaagcatgctgcttatcaaaagggacctagattggcaggtaaaagatcaaaacatcagttaaaaacctgtaatgtgtttactgttaaattactgacaaaagtcagaagcaccttatttgcatatatagattgttagaaaaaaattctgtaagagttctgacaataagaacataaatatgccatacgcagtggcacatgcctgtaatcccagcactttgggaggccaagaccagggactgcttgagcctaggagtttgagaccagtgtgggcaacatggtgaaaccctgtctctacaaaaaatacaaaaaaaattagccgatggcgctcgcctgttgttccagctactcaggaggcagaggtgaaaaagatgggttgagcccaggaggttgaggctgcagtgagctgagattgcaccactgctctccatcctgggtgacagagtgagaccttgtctcttgtctcaaacaaacaaacaaacaaaaaacaccacaccggaaattaatacaataaagactttttcctttatgtaaatggaatgtctatgaattacagataatactgggaaaaattctattcaaatttctgatatttttcttaagcgtattctgctaaaaataggactgcaggttcaaaattatgaatgttttaaagtatattggcatatttagccaaactgtcttccagaaaagttaagctacgctctttatcagcattataagagctttcttacttgaatggggtattttcaggttctagcattgctttatttcgaagaatagctggtccagctcccactgaaaggtcagttggatatgtgttgatatagttagggggtggaccttcaaactgatccattttctcttgcaagatctgttcccagttctccaagtttttaatcacagcaatacctaatggtgatgttacaggcagctctacaaggtgacagaatatgttatttattttaataaaaaatatcgatcatcacccaaatatttatagaatctgaattctcagagataatacttctgaaaatacaaataaatctgcaaatgttaatgtaatacagtttagattcttaatgctttcaacaaaacagaagtgggtttctgctctttctcaatcttctgtgtagagagtgattcttgatataaactaaagtattagactgaagccaggtgtggtggctcacacttgtaatctcagcactttaggaggccaaggcaggtggatcgtttgagcccaggagttcaagaccagcctgggtaacatgatgtaactttgtctcttacaaaaaatacaaaaattagcccagcatggtagcacatctatagtcccagctactcaggagactgaggtgggaggatggcttgagcctacgaggcggagtttgcagtgagctctgatcacaccactgcactacagtctgggcaacagagcgagactctatctaaaaaaataaaaataaagtcacagattggagcctaaaataaacaagactttataaaatatctaatgcactattttttaagtaccaaatgaccttatatatagattttgtaaagagaaacttgacggcaatttattatacttaataacattaatttttaaattccaaactcaccagagaattccagtccagcaataggaaagaaattcttgacattgtgaagtgctagtttaaccattgtcaaatgtagaagagcccagctgttcaaggaggggcaaaaagagtctttaagtgaaaaataaaatcatgggagaaacagagtggtgttccctgccaactgtttagcccactctccaacccagaaaaaaagctgtcattgaaatttactatgcaaaaatggcacctctgtggtcactgaatacaaaaaacttgcaatactatattacacttgctgaaaattacctcgtggaaaaagattaaccacatagtcacatgaaacctaatagtataccaataatttatatattaaactctaatagtatatccatgagttacatattttttcctcactaaagatgcttgtgtttgcactctccataaaagctagtctttggaggtggagaaaacactatgtagacattgacctcaaaggtgtagaatttgtaacctggaaacataagtcatttcttatataaattcaggataataatgttatttaaaattaataacattgatattttctacaaaaagaaaagccaaaaaaaaaatgagagaaagaaaagtcttatttacctataggaatttggatcttggtgctcctgtatttgtgtatctgaaaaaaaggcatcatcttcttcatcactatgaatgctttcatcagaatcatatataacaccactatcagacaaaggaagaaatggctgcaataaaaggtaaaattatttttttaaagattataatttcataaacatataaaatatattttatataacatgtattatatatttaatatagaaaatatttttagtatataattatttttgttctaacataaaagtaaacattttaaatggtgtcagcataagtaaaaattttcttttgcagataatgctacatctacaaaagtcaagatgacaaggtaaaactctcatattcaataactgaatagctagatgtgaaattttttttaatcaatagttttcttcttatagatcagcaataaatagttagaaaagtctaaagaaatacaaaaggacaaactatgaaagctgtgagagagctattgtgaaggaaattataaatctttataaaattatatgaagggaaggactgaaatgtgtaaaaactgtaattctttataagttaatttacacaggctttaagtaatttcaataaaaatctccctgtgaatttctcttcctgttttggaactttaaaatgattctgaagttcgtagagaagaaaaaatagatgagattagctggggaattttttttaaataaaaaaaatcccattttttttagtggatattaaactaagtaagaaaaatgtagtctagattgatgcaaaaatataatacaaaaatcatacacgtataagaagttaatctgacaaaggtaacatcttaagtcagtgggagaaaaagaaagattatttaataaataataatggaacaactagttagctaagtgtgggaatgggagatgaagtctgatccagtctgttcctcactttattctagataaataagagaattaaaagttaaggaggaggagaaagaaaaagaacaggaggaaacagagaaggaaggtaaaataaatgtacacatttattagtggaaaagacttctgctgaaaaacaatgtaatcaataaggaaatgtatggatagatctaatttttaaactttttaaaatttctgtgcatgataaactttttaaaacttcaaatgcataataaacaaaattttaaagcaaataaactagaaaaagcttaacaagataaattaataatatctctagataaagtatccagaaaaaggaaaaataccataatctcaacagataatttaggtaagaatatgaacagtcaatacctcaaactggaaaatcaaatggcaataagatcattaaaattttaatgtcactaacagaaaataaaaatcatttaatctatcaaattaacaaaaatgaaaaaggaatacttaatgctaataagggggtaaagttagatgcatcctctcactattctcaagagagtacaaattagtaatgtggaaaataatctggcaatatgtattaaaagccttatttaagtttatagccttggacctagtacttctttttttttttttttgagacggagtctcactctgttgcccaggctagagcgcagtggcacgatcttggctcactgcaagctccgcctcccgggttcacgccattctcctgcctcagcctcccgagtagctgggactacaggcacctgccaccacgcccggctaattttttgtatttttagtagagacggggtttcaccgtgttagccaggatggtcccaatctcctgacctcatgatctgcccaccttggcctcccaaagtgctgggattacaggcgtgagccaccatgccgggcctgacctagtacttcttaaggaaataatctgctcatgaacaagacatattttaaaagatactattcttggcattttaaacatcaaatcactaacaaagtgaaaagttacatggtcactataattgatgcttatctagaaacaatgatcaaccaagtaagagcgagcaccccagcatctgtctgtagtttctaaatataatttctcacaaaaaggaaccaggttatttcaaaaaagtgattgttctcagtcacgggcaggaaatatacatgattagcctagaataaaactagaaagcaggcaaactcaaacactagtggaataatctcaaaaagattcggagccaattgtggaagaggctctcactggcaaagatggataatctgagtccccatgagaaaaaaataactgcaatagattaaaacatataaaatatgtttaaatctataagttcataacaaagctgaaagcaaaacaaaactcactggcctcctctgaaggatgcttgggaaccaactcatcattttgaaaactggtacacaaaagcaaaagaataaagcatttatcctgtctttccgactcaaaatgtacttcagggtaattgaataggttgatgaagagacattccagcaaatacatgaaaaatgaatgacaggattatattatcataatttaaaactttcactgaaataataaatgtaggcaaagatcaactaaaatcataaaaagcttcctgacagaaatatacaaaaccacctatgaagttaatcctgtactccctcttcctatccaatcagaatgaaattggatttaattttcacttgacaagattcagaggaacaaaatatggtgatgccatcagcaaaatccattgaaaaattctaaaggtcaaaattctttcagggcaaacgaaaaaggtgggagttaagttaaaaaaagagagagagagagagagagaggtggagcctatagattaaaagagactgaagatatagcaaccacttgcaaggtatgaatcatattttagatcctgatttgaacaaatcaactatataaaaacatttaagatgcaactggtgaaatgtgaatactgtctgaatatgtgataatattaaagaattgtgggtgtgcttctgtgggtgtaacactaatgtagatctatttaaaatcctttttttttttcaaaaataaataatgaaatatttttgaatgaaatttcatgatgtttggatttgcttccaaacaaagtagtggggagaggtataaatgaaacaagactgtccatgagtagataatttttgaagctacatgatggtagataaaagattcatatgctattatctctccttttgtgtatgttggaagttttctacactgaagtttttaaaatgacagctatataagtttttaatggcataaaaactgtttaccttgttaatgttaacagaaaaaaaactacatatactgatccaattatacatttttttaatctgaggaaaaaagattaatagtaaattggccacaatggtaacagttatctttgttgcacagatgagtgctatttcccttctttataatattttgcattttccaaattttcagaacatatatcaggaggaaacatttttgaaaaacaaaaatttagcacattaccatttacaaatcttaatgttgttatcactcacattaatgatgcaatgagctttcattcgtggcaaataaaaattttaaaaaggtaggagtgggaactgcctatacatttttaagagtactttattatttccctggtttattagctaaatacaactaagtgcaactcaattggcagccttaagggataggccagaatgactctggaagtataactcggaccctgatagagtgtaaacctggaaatctgcactcacaatgtgcctaagctcatagttctcaaacttcagcacacattagaaccatctggagagcttgttaagacatagattgttggttctcactcccagagtttctgattgaggggtctgagggaagacccaagaatctgcatttcaaacaagttcccaaggaatgccgatgctgccggttctgagaccacactttgagaaccactgacgtaaccaaagtctttttttttgagacactgtctcagtccgacacccaggctggtgtgcagtggcacaatcatggctcactgccacgctgacctcctggactcaagcaatcctctcacctcagcctttcaagcagctagaactacaggcaaacagcactgcacctacgttttaaaatttttttggcagagacatggtctatgttgtccaggctggtctcaaactcctggatgtaagcaatccttccacctcaacctcccaaagtgctgaggttacaggtatgagccactgcacctggcctcagagtctttagataacaaaacaaagcttccaaactcatgttgaaagactttttaaggatcagcttagcatacaaaaaaacggagcgggatcagcgcctcaataactctgagatctaataaaaatctaaaaatgggaagaggcatgactctggagatgtattccctcatgtgtatgcacagcaaggtaacaacagagttaacacatgtaaagagggaaacataccaacagaaggagaatcatgagctcaaaagagcaaagtgcagaaaagcaaacattagcatgcacccagcatggtatgaaatggggctataccagatctagtcaccatgagtattctgatcccctgagaagtttcctttgcgctgggaaaacagagatgtatcatggggcctcatcatggcctgataaaaccgccaaatgtccatccatctccttctattctaattccatgcttaccaagggagccactgataattagaagaggggtgtctaggtggtagatacaagtattccagtcactcgaaaaagatggtgctgattatgtaataagctgacttctaatttatacataactcccatgtgattttaatttgtctcctacatcatcaggtaactgatcatcctcgaatttactatgactattcagtttctggacttaataaattaaacgtctaaactatggtgattcaatccaaaagctaccccatcattcctatgtgagacacatgcaagagttaataaaatagatgatagacttctcttaaagcttgcattcctcacactccttacctttgcaacaaaataatcccacatactaagttcgggaggaataaatttttctttgtaagatggtctttctgcaggcaccggtggtggggtagcatcttttacaggccttccagggacgagcattctcatgttaaatctcctacggtgtttatctatgtcttcagaaaggacaggaggtgctaaatgaagatagaaggaaaaaaaaatctagcattcattttccattgttaattgatagagttaagctttctttttatcctactcttgccatgttttggtctaaactaaattacttattcctgtgcttctaaacttttctagttactgaatcagctttccagcagtcatggcagagatacagatggagataaagcattaaagcctatcttgccatgtgctccctaaaataaggattaaagtaattctatataaaatacactaaataagtggtatattcaataaatattaaagtgagtgattgactgattatccctggctatgaggttcaagaaagattcactgaatatgtagaatttaatagtgtgccttaaaagaagggcagaagttcaatgggaaaatggaaaaggacaatataaacaaataatcaaagaaggtttgggtaaatgaggagtaaattacttttggtagacaggagtcatggagggaagtaatatcaacaacagtctagagttaggttaggacaagtctgtggctatgaacctgggaacttatgttttgggcaattctcactaacacctcttaagttttagtcacacaatgaggtatggcttgtctgatcaattagagaggaagatggaagatgacataagaacagcctgcactaatatggtgggtggtaaaaagtagaggaagggttgtatatgagtgatacacaaaagaaatagcaaaaggattcaggaattgggtatgggagggccagaaagtagaagtcaacctgctcctctcctaaacctccccatcacagaaaataattttatctcaactcttctatcttccctaccccagacacaattcatcaacaaatccattggctctaacctcaaactatacccagaatatgatcacttttcactctgaccataactaacaccctaggatgaaccactattatttctttttaattgaggcaaattttacataaaataaaattaacaattttaaagtgtacaattcagtgatatttagtacatttaacatgtcatgcaaccaccacctctatctagtttcaaagcattctcctcaccccaaaaggaaacactataccaaataagcagtcactccttatttctccctccccctagcccatggcaaccacagtctactttctgtctctatggatttacctattcaggatatttcatataaatggagccagacaatatgagactttttgtgtctggcttctttggcttagcctatttttgaagttcatacagattatagtatgcattagtacttcattccttttatagctgagtaacactccattgcacgaatataccacactttgttgatcctttcatccttgatggtaacccacaattatcttttaagtgaactagcctccctaccaccagcctccctactcttatttatgttacccagtctattctccacaaagcagctagagcggttctgttgaaaagctgaatcagattctgtcacctcctctctttagaacaactaacgcttttaccatgatcctaaaggaacttgccccagctactcttctattctcatctcctacaacactccctcttcatgacagccatgatggtccctgggtagttcttggaaaaggccaaactcaattctacctcaggacctttgcattcatctgcctggaatgctctggtctcagatatccacatggtgtgattcccaacttccttacagctctcctcaaatgctatctcatcagaaatatgtcttccaaccaccttaactaaactggtccattcccattccctcatcaccgtctttccacttactccatttttatcacagttcttatcattacctgaaatatctttgttaattgcctgataggtgttaagtgaataaattaatgcaaatattaatatgtactggcaggttttaagcatggatgatttgatggataaattaccatgaacaaaaaatcagaaaactcaggcagagaaataaacaattttggagaaaaacttttaagtttaaagtggactataaccaagcagcaagaaagagattcagatatccacatttgatgggaatggaagcagtgggagttgataagatcatctcccttacaatgacttacacaggaacctatttatttaactcaatcacagacaatgaagacagaggttagtgtcattaaacttgtgtgccactgatttctcatctgtaatatgtccatttctaaggatgaattaagatgatttctatatatcagcatcaagatagaaatctttcctgcggcatcagtctatacctcaccatatcataccattttcaaaagtgggatgaaaaatatattctggccatgagggaagaagaaacacacaaggaaaatggaataatactatcacattgaagactaaaggaacctattttggagaataaaaaaatagaatttaaaaactgtgtgtatgattggaatggctatcttgcacatgaccatacatttaatctgaagccaactgctggtatgcgctaaagattttgaacacttacttaaattttcttctttctgtaattaagaactatccgttttgtttttgctttttttttttcattttattgtcttaggaactactctttttgtatgactttgttccttaacattttttctgtatttacctttacctttcctctatttttaatcttcttcaaacatgtcctgctttatcaacctcaaaaatgttatttctataaaaataaaagtaacaaactatatgtttattatatcatgggtttaattatttgctgtcataacaagagtgattatactttaagcatcgcttattttcaaagtgaaatttcttgaaacattaaaaaaaattttaacattcaaaatgattaacatttacatacattactggtatcaaacgtatcttacctgaaatattttctgattgtcttcgaggtttcacaacaagttttacaccgcctccaaaaacagcagcccacattcgattatttaatgggtgggctgcaagccgaaataattcactggaggaatttgtggcaagagcatgtatcaataaacttaagtaaacagcaacaacagcttcacatagcaaaatgttcagttttggctggtcttcatcttgggctgaactcaaaagattaataagtgagctcacacctataagggtatataaaatcataagacgtatgtcaggatgaagcaccagaaggaaaaaacatccaaatttgcaacttatccaaaattatgcatttatattttacaaaatatttccataatttgagcaacaaaataaacaagataggaatggattatagcctatagaataaaatcatccatttgtctacactgatataataaatgagtagataaacaaaaggtaagaaggggaagctcttccttaaagtacaatttcaactaatacataaaatgagtgatagtgttagaaaatcaccagctagtaaccccacagtaatacctgattcaggcaaaaatcatcactagatgctaaaattagcaagtgaaagtataatattttacacagtctcaaactaactcttcacaagatactgattaattacaaaggaaaaaaaaagtaactttacaatggagaaacttggcagaaaccaccttaacaagtgatcaaagttaacagcagctggggccaaatgacatcatatgcctcttgatatctcctactgagaaagacacatcttttttgtggtatccctgccaaaaaatacgtaacctgaatccaacattaagaaaaaaatcagggctgggcacggtggctcacacctgtaatcccagcactttgggaggccaagacaggtggatcacctgaggtcaggagttcgagaccagcctgaccaatatggtgaaaccctgtctttactaaaaatacaaaataattagccggtcatggtgttatgcgtctatagtcccagctactcaggaggctgagacaggagaattgcttgaacccaggaggcggaagttgcagtgagccgagattgcgccactgcactccagcctgggcgacagagcaagactctgtctcaaaaaataaaataaaataaataaacataaggaaagatagaaaaaaaatcagaaatgcccaaattgagggacacttaaaaaaacaactggctggtactcttcaaaagtgtcaaagttgtgaaagagaaagaaggaagactttactcaatataagaggagactaatgagacatgacaactaaatgttacatatgggcccccaaaagcacattagtgggacaactggcaaaattcaaaaaaggtctgtagattagagaacataaatgttaaattggataattatgtgagaatgtctgtttataggaaacacacattgaaatgtttagatggaaagggatatctggtctgcaacttactctcaaatttttcaaaaaaaatacacttagatacacaaacagcaagtgagtgagagagaagaaatgaatgacaaagcaagcatggtaaaatgttaacatttggggaatctgggtgaaatttagtattatgtttgcaattttttgcaagtctgaaattattttgaaataagaggttaaaatgaaaacaatgtgtttctacaaggcaatggttacagtaatctgaaatatacacttaggatattgaagagagtggagaagttttgaaacaactgatgtagagaatgagaaagagagccaacaagaaaaaaaggactgtcagacagcatgatatatgtaccacagaatagtcactcctaccccaatacataaatttacacgcccgagaacaactaactgtattttctatggtatgtctgtgaaaatatgtctgtgattttctaagactctaatttaacatttctaagaaagataatgtgctccatccttatgaaggatgttaagacattgcttttttatgttggttaacatagctggttttatgaagccttaacttcctgagtcttcagacaatattgcagtacttaatagttcctaatccatagcagaaaaacatcatcaaaaaacaaagaaagaaaggaaccactcactaaatccagcaacaagcaggaaactggtcagtaggcttttaggaagaaattgccaactagaagattttttttttttaatcatttaaattctcaccaggccattgagcaggagatgaatttggtgttgcgtgttcttcaatgctttctgtccttagtcttctacgatcacttaaaagaagtccttgataagccattcctgtaaactgatttccttctgtttgactgctaaaacaaataggttcagttatttatcatcctgagaggtaataaaaaattgcactttatgtatatcatctattttagacacctattttaagaaacaaaaattcttaaaatgcattcactgttctaataaaaatttattttagaaaattactgaaattagttacaaatgcttattgtttcttttaaacaaagtaacaaattttattatgttgggcagatgacacttattcctttagaattttttccagatgccactttaatactttaaaatcttttctatttgcagtaatttttattttgtgtttttacaaagtctgaggtaaggagactactgctggtactaggatacagtaggcagaaagtttcagggactagtaggttgcatttcttttctctgcaaagttgtgcaagtttaaccctaaattaaagttatgaactaaaacccagagaatcacattttagaaatacctaaacctaaaaccaaatgtccctaaatattatttaataatatttacttccctctctataatggctatctttgtgaagttggggaaaatataaaagcggaaagtcaagctgagtctagtaaatcatagccgaccaactggaaaatatatatttaaaaacaatgtatttgcattttcatttggtgccattttaatggtgactgacatcaaacaagttatctttgatcatttagatgacaacagtcaactaaatcaacttttttccttatttacatttccaatctttggagttatttagacacagcctaattaagttacaatcagagtacaggccattttgatagataattctttacttgataccaaatgttcccacaaaaggctgctaccattacaagaaagaaagccagaaatatatttaatatcaatttaatgtgaatctactattataaacttttcatttattaacattattcatttaaatctaggttatctttccaagtgattcaatttcctgctacttacattgctctagtcattaaaatgcaaagtacacactaatgaaggcaattatacatttagaaaaattcaatccatttcttctaattgatatcacttccaaagacttttacatcatatgtaaatgggtaggtaaaagtaatttaaataattccattttaggaatgtactttttcatttttcaaaagtattttttatttcaatggataattagttaaatagctgctaatccaatgcaaaaagaaattgtttctaaggaaaaacaattagaaaatttcatattataagttattatggacagtaaactcttctttcttaaaaacaaaaaggatggtaatgatggtaatttacatttactatttgttactttctatatttctctgtgactactaggtgacaactaaacaaataattattttatttctgattctctcgcatgtattaaaatatcatggctgtcatatttagggatttttcagtccctaggaaatagaaacttaatataactctggaacagtttaatgtttttgctgtattaatactattttgggtgatttttttttacctgtagctatgactgtcacataatgcttggtaaattgatgcagaaagtgatgctgctagtgaatgaagtgtgtgcacctaaaaccaaaacagtcacaattacattttgtactaacatttctacacaacagtaatatttcaaaaattagaaaacatccaggaaacctagcaacatcataaataagactgaatcctagatgagactactaactctgctttaaatcttctaaagtaactgtcacccacctttatacacatgccacaataaagctgattgtttcagacacattttaatcaaacagttacttactgtgagcctgccgtttacgaggccctgagcaaagtgctaatgttcatattacaggcatttgtcctaccctaacaattagcttaaatagtaatatttaaaaaaaagcagaagaaaataagaatagaattttcagagtttttatttaagcttgcctcacgaaattcgccttgatgaaaataaacacttaatcttatcaatgaaaatgaattaaatctttttagtaaatgtgtcaatcactgtgtgaaacagcagattttccagaaagtaatttacttggtactcatgaattgaggacagtcttagaattttacatttagaaagttttaaatttctccatataattaaaaaaaaacccaccaccctgaaatgctatactgaatcaatattttcagactcacaaaatctttaaatttgaagggaccttagaaacagtttcataccttatacagattactctttgaaagccttatccaaatgtctaggaactagaaatgtttactttgaattcatatgctttttatgccttttctgcgtgtccctattcacctaacaaatgatttaaataatctctgctaaaatactaatacaggttaattcataatatggatgagaagtccctaattggttatgaccaggcctttagaagaatgtgctgccagagagtaaatgtgcctgtcaaacaaaacaaataaaaaataagaaaacaggggacctgaattgtgcatcagccagtagaactggaaaaagcatagcacaaatacactcaggctgggacagtgaaaagtctgatcagctagctccccagatcctgccaagctccctagtgtttcttggactgtatcagtttttaagatcttagcacagggtatcaatatagttcgcagtagtaactgccaaaactctgattgcctctaactattgcctccaataaacacaaccaccaaggaaacagtaataaggacactctctctgggaccatttgtgaccagtcatgcttccctcccagatactccccaacttgtattttcataatatcttggcatgtaaacaaatagtcatatttccaacttaatggttcatttaaggggaatggaggatctaaagggatattaagtagcaagaatactgtcaagaaaattagttttattgccaaaagtatttgtctgtcttaaaggaagacaataacttctccagaagtaagaacacttacttttaaattacattcattggactaatagtcttgaactgatcatgagtgagaaaggtagcactttgaaatatttcccctaagttcgaattaaaagacaggtataacatatttaccttctcagggtgtataatatcaaatgatcataaactttacattaccttcacatcttcaatactgggatgaggtggtgttttcatctgaacaatagtataaagtatatcatggatgtgattatttaagtacaatacaggattagctatgactgtttttgttgacgcaatacttgctgaaagcagaggtagggtggtaggcagtggtagtggagactggagctgctttactgtagtttcctgtgggtgatagtgaattatttttttcaaagtagtttaaaaaattttatcagttctctgacagaaatactggtgataaacattgtgtaaagggaatatgttcgctcactcattctacacaaatttattgagcacccagtatgtaccaggtactatgctagatgtagatggtatatagataaatatgacacaagaatactctcaagctgttaagcctactccttattatcaaaacttcagtctaagacacatagagtataaatatctgcctcctataaagagaggagctgaacatatttagattaactagtaaaaagtagtaaaagagctttatagctataactggaagagctactgaaattactgaaataaccaagattgaaaaaaaagtgatattcacacctgttgtgattcttgtagcaaaaatttgagttccatccttactgaagccaaaccaccaccttgggccccatgaaggctacagtagctgagaaatactctcaggagatcttggtttttctgcaaccacgactttcgtctttctgcatgctctcgtttggcctgcaatcttcttctttctatttgatggcgctcataggaaccaatatctggtttgtctaccatttcttcctgatccagcagatcactctctactttggaatatgtcttactggaatactctttaataactgattcatgattacatatctcatgcaaggcagcaatttccttttcaagccagttatagagttgaaatctgagttttcctccatctacttcataacctgtagccaatgttcttaattcagtcataaggatctttaaacaagctctgaattttagttgttcagcaatcacatcaacttcagtatcaccttcaggatcatcctcttcctgaggtgttaataacatgttagggtctgaggccttctgatctgattgtttatctttttccctggcatctgtacttttcatcactaaaccaacagcatcgtcttcctcttcatctaaggcactgtcgtgatcttcaccccaatcaagattaagaggttcctcatcaacttttactattggctgactccagtcatactgtgatgaagttacatttgaccattcaatgccagaacttccattgccatcactcagagcttttgaatgtgaaggtacatcatccatcctgtgagaaatgaagtcaggctgatctttttttgcagataaggcagatgttttggttacttttggaattttggagagtacctccaaggctaaaacagggcatccaactttaaaatgagcatttgcagtggtaaagaataattttctttctatgaggttaattttatcaacaaagttcttctcagttttgagacctaaggttgccaaagttccttcaggggaggcaagatttcttcgaatgagcaaaggatgagttcgaaggtagttataaaaactaaatgccaccgggttacaagacttgatgataactatagaaatcaaacagataaaatcacaaagcattgtgttaatatgtatttacattacaaaacaataaaatacgtcagcatttcttcaaaaaaacaacatgtaaatattaacctacgataggttacactatggcatatacaatcattacaactgtacagctgaaatagaaagaatttcccaatatgctacggagtgattcccatcactatagagtgatgtccaggatacactaagaaaaagaagatgcagaaagtacatgtagtaagctaccttttatctatctaagacagtgaagaggaaatacaaatacacactcatgcatattggcttatcatttttaaatggaagacaaacacaaaaaattttaattgattccttaaaaggggagagcaaaacagggaaaaaaagagctagatttctctgaaaatacactggttttatatattttattttaacaccatgtcaacattttacataattttaaaataaaaccaaatctaaaccacaattcacaaaaggcaaaattaaacaaatcagtctatcaagttggtagcataatcacacagagatgaactctaaaaagtgagttaaaaacaagtaatttgactgtacatccttagcagaatgtaccataaaacaaaaaaattctgcaaaaaagcttaaattatgttcagaatcatgttattataaaaatatctatattattattctgaaacttatatgcacatagatagcaaataactatgttcatgccatgagaatccaaacatttcattataagacacaaacttaacatctaagaagaaagaaccctataatctatatgtgcatgagaaatagcagggtaaactcctaaattctaaggaaaaaaaatttcctaattccattcattgcaatagtctagaaattatgacaagattagtaccaatgaggatcctggtgcccaaactatagtttctaaatattattccccactaaaaggaagcagaatgctttggaggaatggtcatttccaggtctggggcaggaaatgtacaagatgacccttaaacattttgtagtaccagaaagcaagaaaactatcaagaaataatgccagaagaattcagaaacctgaagaagttcccatttgtgaaagaacaatctgagcatccataaaaataaaccaagagaatgatgccagcaagatggctgctagacacacctggcattcatcctccgaaaagaaaggaccaaggcaatgaataaacagctaagatttgactggagtgtcaaagggagagcactagagtgcagcaggggagtggagatgcacctgtggtgactgcaagtctaggagagcagtgtggaggtacccggcctctgcagccctatctcccccacccagactggatctgcccacagtcaggaagaacttctcattgcagaggggaaaaggtaaacagaagatccccatcagccctcatggccaccacaaacatctacagtccttacaacagaagaatcccatagtacttgcaagccctgtgtccagtttggagagacgtcagaagttcacgcaacggcactgacccagattaggagcataaggtgtgtgccctccacctaccgccagtgagccaagctgctgcagcacaagcactatcttgagaccagtcacctctggcatgcgcactgctctgggggccaggagtcactgtacctctccaacactggggacccgtcttcattccaagcctacatgggtagctgaatgctacaatcccagctatgcagagcctaggaccatgactggctatgactttggtcctgcatggcagggaaatcaacccctaccatcacacttttggtcagagaaacaatctggcagtcttgcccagggtgaacctgcccttgagccagccaaaccactacatacataccctcccccaaatgggagaggtctccaagcctacgagcagctgatatgcccccaggccagcaaagcagctacatgcccacactcaggacctcagaaacagcgtgcagcgcccctgctccctgcactcagagttctggcctgccaaaggccctgcgcctgcaatcaacgcctgagaaatagtccttcgagccgcccctggcagcacaccaccaggccagccaagcagccaagagcccacttccacggccctgtgggctatccctggtggacacatcccagcctggtcaaacagccctgcaggctgctcccagtgtgcacaccccttagccagctgaacagccttgcaccagtctcagacctgagaaatagccccatgagcccctaacagaaacgcccccatgccagctgagcagccttatgcccacacctcaggcctgaggagcagcctcactgccaccccagctaacatagtaccagaccagctgagcagccctgcacctgcatcacaggtatacaaataacccatgggcaacacctgcagaaacacccccaggccagctgagcagccatgcaatcgtgtcatgggcctgagaaatagccttatccccacccctaacagacaaaaccccaggccagctgagtagccgtgaggccacatatgagccctgtgggctgcttctggcaggcacacctccaggctggccaagtgaccatgtacccacactcctggccagagtaacagacctgtggccccaatcccagccaaccagaccctaagctggctgacccattgtgtgcacatatgcaccccaacctgaaaaactgcccagcgagcccacctggcaaagctacatggccatcaccgcaaactctttcagcctaggcaactgagaggattgcaaatgccactaatgtggattacaggtgaagaagctacatggagactacactactgtatccatctaaccaatgcactccaccaaaccaacacctcaggacctattcatagtaacaagtctttccctatgaaacctactccataaaattagaagaggcaactttttctgccagatacatagaaatcaatgtagaaacacaccaaccatgagaaagcaaggaaatatgacaccaaaggaaaagaatggaaaggaaaatactaattctccagtaacagaccttagtcacaaggaaacatgaaatgccagaaaaataattcttaaggaaatcatagtcttaaggaaactcattcagatacaaaagaatacagatatacaactaaatgaaatcaggcaaagaatacatgatgtgaatttgaaattcaccaaggagatagatatcatacaaaagaaccaaacagaaatactagagctaaaaaattcaatgaatgaaataaaaaatataatcaagagcttcaacaacagactagatcgagcagaagaaagaatttctgaacttgaaaacaggtcttttgaaataactcaggcaaaccaaaaaaaaaaaaaaaaaggaagaaggaggaacagaaaaaaaagaatgaagaaagcctacaggatttatgggacactattaagtaaacaaatattcatattatgggcattccagaagaagaagaaaagggaaaaggtgaggaaaacacatttaataaagtaacagcccaaaattcccaagtcttgggaaagagataggcatctaggtccagggtgttcaaatactcccaaatagattcaacctaaaaagatcctctccaaggcacatggtcaagttgtcaaaagtcaaagacaaggatctcctcatttttattcccaaaaggtagccagtgaccaatgaccagtatttcatttcttatgatttgtttcaggaaacaaccaaaggaaatggaggaggcagacataacatgtgtgcacattcaggtgcatgtttgtacaacatacatatgccaaatgcaacaagaaccacactgctgtgcatcttactttttttcacttaaaaatacagcacatattaacatatgtatctacctcaatttttaatgacacactgtttctatatgtggatatattaaaacgtatttaactattctattgacaaaaacttaaaatgttccattcctttcaaattattgaaaacaatgctgataaatatcctttaagtgcttgtaatatctaaattatttaggataacaaggaaaaaagaaaatttaccacagaggcataaagtttttccaggcccatgtgacaaaccaatacgtgtaacagccaaaatttccatttaaaaaaaatggctatatgattatgtaaaaagagctacagaatgtggcaaacattttgtatgcttgttaaatatatacgtaattagaataggatggtaatcctatctaatcctttagacacacaagaaattttaataataaattctcaaagttgaaaagcaaatctggtaatgatttttcttaatctaagtgaacattagttcagaaagtatctcttcctttaaaaaagaaaaaaaagaaatccacaaaacgtcctaccttgatgttcatcatcctcctttggtgtttgttccagtaatgtgtccaaggctcgggtgtaatctttcattacccaataggcaagactacgcaggaaaggatcaggatgtaatcttttgcaactgaatcctgagccatccttttggcaacccaaaatcttctgatttaggatggatatataagtggatgaagtctcaaattcagattcatataaacgggcaataaccatggctagctgaatatcttccattttttcaagacatacctgcaaatttaaatattaatacttatcttacttaatgataattatttagagagatgaaatatcccatcaataccctgaaattatctaccatttatatcctaatggtgggcgaagggacagtgaagggtagttaaatgattgataggagattaaagaatagcaaaaagagtaacaggttggaacccagtagcttccaaactagacagatcatttataaaataagcatgaaacaaagtatattaatatcatctcagacttaagatcaacttaaataacattcatttttaaattaaatactatatatgacactagaatttatataccacttcctcttaatttccaaacatatttctgcataatcataattattactatctgcctcatatttaaatagtaaataaattatgaaatacagccatatgttctattcatagtctctgggagcctgtattctaatgcaactaccagttctgagcatttgaggtcatttaggcaatatgagcatctctcagtcaacacttctctttgcttgaatatcttctaagctaaacttccaattttaaaatcttaagtatttgttatttaaaaaaagaaactcatatgcctgggataattgtaaaaaaaaacccaactaattctaaatttaaaatactaaagtactttcacttaattgaatatttcctgtttttctatcatatattattcccaactgtatttgtcctttacctgttcatattgttcatgatagtaatctaagaggaagatatcagaagtaaacacaaacatttgtaattactctcataatcagctgctaggattacatatcaaaaagtgggaagttttacctcctcacatcgttttctaatataatattctaatattataaactattataaaacagtacaaactggagtttcagttccttatttatgaatttcatttaaaaaaacagcttaatgtatctgcctttctgcacagaataaggaggttgtgacctatgtactttaaacagttcagaatcacaagatggtctggaagaagacattcataaactatttttcagcatttttttcatatattttacacatagtcttgaaatgcaatgtgccatatatgaaatttttctttttttctttttgagatggagtctcactctgtcgcccaggctggagtgtagtggcacaatctcacctcactgcaacctccgcctctcgggttcaagtgattctcttgcctcagcctcccgagtagctgggactataggtatgtgccaccacacctggctaatttttgtatttttagtagagatagagttttgctatgttggccaggctggtcttgaactcctgacctcaggtgatctaccttccctggcctcccaaagagctgggattacaggcgtgagccaccatgcccagcctgaaatttttcatttgtttctcccttgaatttattcatattttcctttaccacagtgccactattttaagtacagcaacctctgtagttattctgtgtcctaacaaacatatgaccaaaagttacaatctcctctacaaccttcttaggttttcaatcttttacaagtattatatagtgtgttttcttatttatacctctatggcatctttcaatgaaccagctagcaagaaaaaagcagccgattgttcaaagcgttgttttccaagtaaggaaaaagcatttttcaaagcagcttttcgccatctatcttcattaaagttgtggctgaaaaatgttgtcattttttcatcatgctgtgacctggggaccgagcataaacataaagtggttaaaccaaatttaaaatgttctacagaatgtataataatataaaataaaaacctcaaacagaaatctaaaagaagaacaataacttcaaggacaggcatttgttatcaagcatctcttcacttcttctaagaaggaaggtcaataatgccttatgtatacataaataggaaacagcattttttactttgcaaagtgcttttatcaacttttaaaacatcccatcctctagattaagctgaaaagatattttacccatttttttcagctaaaggaaccaggtcgcatagaagtggatttgatgaagctcatatacctaattattttcaaaagcattaggtttcttactcacagcacaatcttcattctgttgaatcacgttaagtgtcaaggcaacttacctaaacagaccccacactactgctttcttcttcattgaaaggtagaatagtgcagcatctaaggcatcattgttcctttgaaaagaagctttggcaacctaaatgataaataaaatattaaattcacaatttgacataagaattacaatcaattaatcaacaataatgttcccctgctacttccatggctgatagaaactgtggagacagaaaaagttggttctgtttcacaatctccagtaggttataatattaatacatgctcctagagataaccattcgcaagccagtaattatggtaaaaatcctaattacagccagcacttattgactatttaccacgtcctgggcacgagtctatgcaccttttgttatcttattgcatcactacaaaccatgaggcactatcattattcccattttatagataaagtgactgagacagaaaggttaagtgaattgcctacagtcacacagtaagggttagaaaagggaatagaaaccacgtagaactgaaactaacatagaaagcaataaagaaggcagaatattcaatagatgtgagctttttcttgaaaattcaacatgttatattgtatgcaatcatactgtcttaaacataagagcatataggccataccttatttttccaagatgctgagatatagcctctgcaaatcattaagttgaaaggcataatgacaaaacaacagtggatgttttattaattagctcacattgatggcaaagcaggaagctataatactaaggtatgggagaaagggaaaagacatctaaaattacatcatgaaaatgctttactctcgggccggacgcagtggttcatgcctgtaatcccagcattttgggaggccgagacaggcagatcacttgaggtcaggagttcgagggcagtctggccaacgtggtgaaaccccgtctctactaatactacaaaaattagccaggcatggtggcgcacgcctgtagtcccagctacttggaggctggttgggagaattgcttcaacccaggaagaggaggttgcagtgagccgaaatcacaccattgcaatccagcctgggcgacagtgcaagactctgtctcaaagaaaaaaaaaagaaagaaagaaagaaaaagaaaaaagaaaatgctttactctcaatactcttttcccttcccccttttaattgtgttgtctgccccctatcatttaacttagtgcttcaatatgttagataatttttagaggaattttatttgtattcagctgatttataatatacattttgaggcagaaaatgtacatatccctttgatttaattttaagaaataaattacttgtggaaataaatcatgtgtatattatcacagataatcataatgacaagacacatgttgacaagaagtaaaatctttgtgggatacatctgaaacatttcagataaagtatgtcctcttttatccagtgctttggaatataaaacatttaatgtagaaactgtatcatttatatcctttaacaattaacttttcctgtacatcagagatcacattttttagttggtgcaggaatgaattccttcttatatctgtgcttattttgagaaaagaaatactgatattttgttggcagccttacacgtaacagtaaaataatacttttatactcacatttaaaactgtgatctgagaaccatgcacaccagaatcatgggatgctgattaagatgaagaaacctcagccctaccactaccaaattaaaatctctggttatgggatggagaatatgcattttacataagtttaccagttgagtcttctctggggaactactattaaggaataaatcaggaaaaggtctttgcatccttcggagaaacaaattcatacttcacaaatatagtaccactgattgtactccagggaattccaaaggactaaaaggaaaatatgaataagaattccactttcctaatcctgctaaagtagaaaaggcacaggctaaatctaacatttataaatgactggagtttgggcttgttacccatcctctctgaatcttagttccatcatatgtaaaatggagatgatgacatggggttgattagaacataacatggaattatttatgaaaagcaactggcaccaaacctggtagagagctgaactgaatttttttcctaaaaggaatctaccagaaaactgactccaaaaacctgccttaaaaactttgatagccatttcacttgctgccacagatatgttcttcaagtacatacaaatcaaaactgtttttatccaatgagatttcaagtgtgcaaagaacgtttgctacttattcaactagtgatgcagagagtcctttgtataaaaagagttttttaatgtattgtaaataacaaacaagaactcaagtttactttctaaagttagatttttccattttcttaaaccagggcatacctcaactaataacagaaaatattattattccacggatatattataaattcagcctatatagaaagacacaatatcatactgcatggacattttataaaggtcaagtttttgtaatctccaaaaaactttatttaaaaaagtctcaccaggcatggtggctcatgcctgtaatcccagccatttgggaggccgaggagggcagatcgcctgaggtcagggattcgagaccatcctggccaacatggtgaaaccctgtctctactaaaaatacaaaaattagctggatgtggtggcgcacgcctgtagtcccagttactcagaaggctgaggcaggaaaatcgcttgaacccaggaggcagaggttacagtgagccaagatcacaccattgcactccagcctaggcgacaagagcgaaattccatctccaaaaaaaaaaaaattctcaagacctcaagatagacaaacaaatttcccactacaggttttctgggagatagtatctttttttcgttaggaaaaggtttttttaatataactcaaaatccactaaagaaaagttaccttttcaatgcatcttcgaagcgtgttaatgttcctcacccaccatcctatgcccatagctcttaattcagaccactgggggtcccctctctgaattgctggaatcatattaatcagttcttcttcagcctcagaatgaaaagcccaggcaaaatggcatgtagagacacctaaattggaaatataaaataataatctgcgtaactgtatcaaataagaagaaaaacaatttttcatgcagtcacatacgcattcattttggaaagaattttgaagcagaaagaaagaatgaaaggcagtctgtcatcattcaggactttatactataaaagtttctgaatacaagatcaataatgtgatacataaaatccaaatctctttttccccaaacatttgttttcatttcccctacaaaaatagggacactaaaacttaatcattagaaagaaaaatatttgaatatcaggccattcacatgtacggtacaccaaatttatcaagaggtcataagagctgcccaagctcacataactaggaaggtagggcccaggcccgattccaggtttctctgtcaccaggacctgtgaatccggcccgcccaagaggacacaaggtgtgttatcccccacaagagcccaggggaaggaaagtgtggtgaaagctttattcaagtcaaaagcacttggctcacagtcctggatgtcgattccagtgccactaccccattcttctctctagccatggagctaaatatcacttcaaagcaagctctaaacttcgtaagagttccagaaaataataaggataagttacaatcatgatgtacattcctctgcttttagtgccttcagttaaaagtttaaagctgcctaatactgatgctttttggtgaacattgttttttgttttgggtttgtttgtttttttttacctgggagaagactgacagggatctaggctgtttgaagaggcaacaaaatctttactgacgctattagacttttaagtactaatggatttatcaacagttcaattactgataacgctcttactgatattcgacttacagcaggtaaaaacgaaacataatgaatgtgaaccacacagaatggtaatcaataatgggaatgctggcaagaactctgggaagccttggaaagaagccaaactagtccaagtagccatctgtatgaattcattttagaaacaaagaaatgtctgaggtcaatgaaagtcacattacaacataggcctctcaatgctattaagtatctatattgttacacataattttttccattttcaactactatatagattttgtacatagtttaaagcttttctaataattactgcttcactgtaatttctttagaaagtataaaataaaaactattatgattattttgaataacaatcttaactcttttaaatttcccactgccaacactcatataacaactgtgtttgtaatcataccacaaaattaatgcaacatgtcttggctgccactataaatttaggggaaaacaccagaaaaaattaataaaataaatttagttttttataacctgaaaggcagactaattttttcactatttaaatctctgtctgctgtgagagaattactttatcaaataattgatattctgcttcagcaactaatatacggcaacacaaaatgcataattttgctgatataaaatatataatataaaatgacaatacatagcatattacattctatatccttaaattaattaaaattttggtataagaagaaacaaaaatacacacagacatgtcagaagaattaggttcagaaagtaagattaagagcagtgaatgtatttgaaaacctgcagaggtgaaaaaagttattagggaagaaaaagaacaggggcacgaataggcacttctttttatttacctaccaatggcaggctattctctgcagtttacctctgctcttgctcttctcagcttttctatctatgtactggctacttaacttttccctgaaaactgctcccaggaccaacacctacaacaccagtcacttctcatcgccaatgttttaactgcagtcaaagggaaaatggaatttgacacagctttagaaatttgaagtgttttagactgccctaggaaatgtacaaaattgtcattaactgattcaataccacttgactatcacccaaaactaaaacttaagagaacgtggagataccattttaaaaacctatccaaatggcatagattgcttaaaatgttaatatcaaatgtgggcaatggggttgagatttggcatcatcaaacttcttttttattttatattttttataattttttgttttcaatttttgttggtacgtagtacgtgtatacaaacttctgggaatgtaaatgagcacatttctgaagggcattttggtaatacttatcaagactgaagaattttcatgccttttgattcagtaattccactgctggaaaactagcatgaggaaataatcaggaatgcaaatatttacatgccaaggtacaaggttattcattagagtgataattcaaatagaaaaaatacctcagcaaaatctatttcaaaaacaaaggattgggcagatgaaatatagtttagacacagaatctcagatagctatttatagttatgttttcaaagaacattcataggttaaagggtaagtgccatgggtaagaataacagtgtatcaagcctagtgttctaggttctataatactaagacgtatattatgggactctttccaagatgttggtttcaaaagaaatatagtccactgaaataagctctggactgggattcgcactcccaactcttctaataaatagtcctgtatcctgggcaggtcacttttaattctatagtttcaattttttaatctgtaatacgaaggctgatataaatccttatgtctcaaatcaggtgtagcagtatgcctgaagtacacaaatccactgttatcaatatggcagatcttcctgaatcatcaactttacttgctggcaaataactagaacataatgcttacattaaagtaaatataaaaacacatcgcagagcaaagtttacataatttttcaaagaaaagacatcaagatattcagggctactctgtagacagccactttgggttacaacctcaggcataccacatttaccccctaagctactactctagtaaataaattctaaaaaacttagttagatgagcaaaagtcacagaatagagctgaaggatacatagaaaaatggtaagtgggtactatgtgacagaaagatcttaagccaagtgataggtgtgcacgtaatgacttacctaatgtttacacacaaacatgatacaccccatcgctccaatattaagtaaaagttgtgcaaagcttcaaacagtgagtgaattaccttgatgaagtagctgcactcggtataaaggaggcagcgatgtcaaaaggcatgtgtgtaggcgcatagctaacaagtatctcaaaccacactcatctaatgtatctcttcctgtaatttaaacaggaaatatgtttaaggaaaaaagaatgcaagaggccacaaactgataagctataaaacaaacattaaacttagtcataatttatataaaatacataagttttagtgtattccttcctgaacactttaacgtctttacaaaaaattatctttacaaaaaaaaatgtgactactaaactcttaaaagaaaaatgatttggagaaatacaattaactattagaatagataacaagaacatttatattgactcataataaatgaaagacatctggaaatccaataaaaaatatattaactatggtaagttaggtacaacttttaataatattttctacatgaattccgatgagatgtaatggaaattacataactgatgtgaaatcatttgttatatatttaagcaggtagtattttctactttggttaaattaactgaaatatggtactatcaaagatttaaaatttgaatacccaggctagttagtgttacatggttagtttgaaccttcaccttgattctacaaatttatttatacaaattaattccacttagtcaaagtatgaaggtatggcaagcgtaaccaaaactatagccactgctggataaaagcaaagcaaaaatacagacagcacctagcccaataactgacactttggaagtactcaatgattatagaatcaaatagtattttccagaaaaaaaaaaacaaaaacttttaaattgccaaagatcaagccccagctctgcttcccattacctatatccatccatccatctatttatttagctagatagatagctattaggttggtgcaaaagtatttacagttttgccattacttttgcaccaacctaatatgtatctatttatttatttatggacatgagatctcactatgttgcccaagatggtctaaaagtcctggcctcaagcaatcctcctaccttaacctcccaaagtgctgccattacaggtgtgagccaccatgctcattcgtccgtttattcattcaacaaatcaagcatctattacatgtgagggactcttcaggtactgggaattcagcagtgaataaggcaaagtccctactctcttggggatcatattttaggaggtagagacaaacaataaacaaataatatgtggaaattaatgctatgaagggaaataaagcaggactgagagatagggaatgctggagtaagagagttctatttcatacagtgtggccaggaaggaactctccaataagatgacatgccagcagcaatttgaggaagtaaaggaacaagccatgcatgaatctggaagaagagcattctaatagagtagaaatgagcatagatcgtgtggggccttttaggccactgtaaggctcttaacttttattctaaagtgagacaggaaggcaccagtatatgttgagcaaaggagagatttaatgtgatttggttttaaaagaatcactggttcctaagcaaagaacagatggaggtaaaaagaataaagcagttaggagatgacagggacttggaccagagtagtaactgcagaggtaatgagaattgattattggattctggatattaatagaactgatagcatttgccaatgaactggatactgggtatgagagaaagcagagtcaagaatgactgtaagttgtctcacctgaacaaatggaagaactcatttacttagaatccatttactgagatgtgtaactcatttaatctctgagcttcagtttcccacctgtgaaatggagacattcattcctgccttattacctcatgaatgtccactgtgtccaggatacactatttctatattgcttagccaatgatacagttttgtattagaaagtataaactattttttacaaatcatgccatgcctactttcttaatgtcccacagtaaaaactaatatatattaaacacacaacacaagcttaaggttgttctgggaagaatctcattcaactgcatacaacctcataatggttaagatttttcttttccaattaatagtgagaaaataagtcataggcaaaaccctagaaggtctctagttattttaacctgcagagaagaaaactttgggggatatactataaggatgtaaatctatatgaagagatattttccagctacctttcccccacagatctggaaatcatgaaatagttaaaagggtacaggctttgagtcaacagtttatccacatatgaactccacttctactccttaatgcctatgtgatctcagatgagtcccttaatttcttaaggatcagtgtcttcatctataaagttaaacataataatagctatctgctagaagactgtgataattaaatatgataaagtaaagaaagtgcctgaaacatagcaatttttcactcctccaaaatatttattgaattaatgaaattctgatcattaattttcagtttcctttgccaatgccatcatttacaatcaacaccattaccctgaactatgtgcataaaagagaatggaatctagttccaggaagcagccaaaaattttctagttacagaatgaattaggcaaaatacgtatgacattaactgtatggaaatctcgctgaagagactttttggagaaaattaggtaattgtaaaaagttgtttatggctagaaatgggaagaccaacaagttgagcccatgaggtcccaataagcctcatgattccatagtaacattaacaaatgggctgttattatcaaagaaaaaatcatagggatcaatctgtgttaaaaaacaagagacttggccagtccatggtgactcatacctataatcccagcactgtgggaggccaaggcaggaggactgcttgagctcaggaattcgagactagctggggcaacataaggagacctagtccctacaaaaaaaataaaaagaaattagctgggccccatggtggtgcacacctgtggtcccggctattcaggaggctgagataggaagattacttgaacctgagaggttaaggctacagtgacccatgactgcaccgctcaactccagcttgggcaacagagcaagaccctgtctcaaaaaaacaaacaaaaaacccacccaaacacacacaaaaaaacaagattataaatccaaaatgacacaaaggtttcagtgtaaaaactcatgagagaatgcacatggatctcacaaatccatgcattcatatgccggcctcaaccgtcttttctaactgagcatattatataatagtaattacctattaaggaggtcttttccctgcaaagtttgaaagttgagactgcaattcagtaaatgagtcagtatagagataatacaaatatttctattaggtacaactttataaatttttagcgagaatatttacctgagcaactcttatctctgctttcatcaagctcagtactagtagtagccactgtatcagccaaagctacaaggaacatctgctccaaacgggtaaggcctggtagacttgagtgcataagatgacttgaaagtacccttgcatgttcttggccaaagtaagctggtccatattgagaaagatttattacttttgatttgttttctctcttttcaggctctaaatcaatatcatccgttggtatatcctggatttgaaacagctctgaatactgatcctctggttgacttactgtctgatcttcatagctctgtggtatctttgtactttcttctgaaattctgtaggatgtatcttgatctgcagcaagtaatgcatatagtggtagtggagggatagaatctatctcagtataatctcgagtaccatcttttcctacggtgactgtttcctttgctgtactgccacttacactaatagttcgagagagatgtcgcttagttccttctccagcatcaggatctctaactattgctacttcacctgcaatacattttactaaatgagagagaatggctttagcccttcgcactttccctaaatccatcaattctaacagctgagttggatgatattgtggaagagtaggggaaagtacatgtgcagcctcaaataagccaccatcttgaattacagttggtgaacaaaaaacatcatcagaaatagctgttccttcaacaacactttttcttgccagcatattagatttaaaggtcgaatgatcttgcattgctgcctcttctgcattagaactatcagcttcagtgtctccaaatttgacagcatgcttccactgtgcatatacatgcatttcacaatccattcctaccaccaatatcccatctcttacccaagagagagaaacaggcagtgaaggagtaccatcaacagaagataccaagtctatagatctaagaagaacccatcttgacttaactccttgcttgatactaccacctagtggtaaagtgatgacagctactccatccttactgttggtttgctcagtcacaattcctgaaagccttccatacatgaagatattcgcaccgactcccactgtaagaatgtgggagccatcttcttttgatacccagtccaaatgtactaaatgtttgatattcggaataagatatctatccttgctcaagagtgcatctgacttgctatacacaaacagattactgtcgacgctgacccttgaatcaagtacactcccaaccttaaccaaatcatcaagatgaattgtttgttctaaaacccactctgatcctcctgtagattcacattcaaatatacaaacatgcatggaaaattctttagaaacaaaaccattatggtggataggctgcttataagccactgcaaggcgacctgtgtatgaacagctaacagcaactggtcttcccacaatgctcactgtactgctattatcttctccttcatcattcatcaaaggccatctcttccaatgataaatttctttctcatcacttttattacactctgggttggcttccatacaacatttccagaagcgtactttattgtcagaacaagttgtaaccactaaataaggtgcaaggcacactggataaattgaagaagaactcagatggccttaaaaaagaaaaagcaaatagttagttgtaataataataaagccacaaaataatatggtagtaatcaaattctggaatgtgatcaatttaaagtcactatgagcttcttcagaatatctctgcagtcttcctcttaactagtatcccactaaatgtccattggccaacatatctataaaggtcttgaagagcccatcagtgaaatcaaggtatgcaataataatcacttaatttgtttttaggtaattaagtttaaatgaggcaaccatttaattaaaataaaactcaaaagcactgaaacaagtcagcccttaatgtgtttctattatttatatttaccttcacaacatgcctccttagaatttcatactatatatttaatcattttcatcatgaatacttaactgagctttacaatttgcctttcaaatgcccctaaccttctctcaaataatccagaccccaggtggtacaccaaattttgtttcagaccgcaaaacagaccaatagatcttacccattttaccaagtttaattcatcctctcttagcactgaaccagaaccctcttatctattcctgactgccaaagactaacaatgcacatctgttgtcaactgtaagacaaggggatatagagattaaagatctgaggtcagaagatctggatttgagtttcaacccatcaataatttcattaacagtgggaaagctacttaatcatctgagcctattccatctaaacaattgggatcagttactgtttcccctagattactattgtcaaataagacattttataaggcgtctgtaaaatataatttattatcacgaactccaataaacttatttgagtataacccaaacctttcaaatattttgaaagattaacaaactggcctagatctgcaccagccacaaaagcccaagagtacactcttctcaatatgatctttccaactgtgaatgcaaacctgtcttacggatgaataagaaaacacctatactgaatatcattcaccagtaattttagcggccccgaacctccaattttggtttcccaaaaacactattctagaaactccccaattaaaattctgcaagtagatcactttaaacacagctgccagacttgccctcaaaatatctaccttgctaaagtcagtatcattccagaccacccaaactatagtcttttatcctacatttttcctcagagtatctgccaactgttgttcaaacattcttaataaaggtgagacgtgattaccacaatgtgaatgaagtcttaaattttaaaaaaagcctcagtggtttacaaatgaatgtatttgttcttcaaaattttactatcattatattccaaagtgtaggcaagacacctcacattaaaatattttcactattggctgggcgcggtggctcacgcctgtaatcccagcactttgggaggccgagtgggcggatcacaaggtcaggagatcgagaccatcctgactaacacagtgaaaccccgtctctactaaaaatacaaaaaattagccaggcatggtggtgggcgcctgtagtcccagctactcgggaggctaaggcaggagaatggcatgaacctgggaggcgaagcttgcagtgagccaagatagcaccactgcactccagcctgggtgacagagcgaaactccatctcaaaaaaaaaaaaaaaaatttcattattttggccgggcgtggtggctcacacctgtaatcccagcactttgggaggctgaggtgggtggatcacgaggtcaggagatcgagaccatcctggctaacacggtgaaaccccgtctctactaaaaatacaaaaaaaattagctgggcatggtggtggatgcctgtagtcccaactattcaggaggctgaggcaggagaatgggtgtgaacccgggaggtggagcttgaagtgagccaagatagcaccactgcattccagcctgggcgacagagtgagactccgtctaaaaaaaaaaaaaaaaaaaatttacactattttctgtcaagctgattacatttatcacaggaaattttgtgggtttgtgtgtgtgtgtgtgtgtgtgtgtgtgtgtgtatggagtctcactgtgtcgcccgcccaggctggaatgcagtagtgtgatgtcagctcactgccgcctccacctctcgagttcaagcaattcccctgcctcagcttcccaagtagctgggattacaggcacgtgccaccacgcccaactaatttgtgtatttttagtacagacatggtttcgccatgttagccagggtggtctcgaactactgacctcaagtgatccacccacctcagcctcccaaagtgctgggattacagaagtgagccaccgcacccagccaggaaattatttctaataaagacatgtttctaaccatctagacatatcattaatagaaaatcaatctttattttaatgtcaacatagaacatatttcagaagagttcatctattttatccactaaagagttcatatattttatcactctgagctaccactgcccagtcttaaagtgaccttacctgctgaaggcgttgctcttattacttcaactgattctgggagatcaaggggttggctatacaccagtctagaactcagaataagtttactggcagtttgaagattggcaattgatgaagaatgtggcatggggctcacactaggagaggtttctggagaagaatctacgttcttctgtccagggactgaaagtagactctcagaggaagccccttctgaagctttagctttaaaaataaattataaaattacaaaatgtatgtatatcattactataaataggagctagaatattactttgttattatttaagaaacatagcttcttaaaagtattttggaggtgaggatatagagaaaagagagctctttttaaaacagaatgaccatatgactcagcaatctcactactaggtgtttacccaaaggaaaggaaatcagtatatcaaagggataactgcactcccacatttattgtagcactattcacaacagccaagacataaaatcaacctaagtatccatcaatgaataaatggataaagaaaatgtcatatatatacacaatggaatactattcagctataaacaagaatgaaatcctgtcatttgcagcaacacagttggaaattgcaggtcagtatgttaagtgaaataagccaggcacagaaatacaaatatcacctgttctctcactcatatgtgagagctaagaaagtggatctcatagaggtagataatagcataatagataccagagaatgggaagggttgtggggtgggtgaagagactctttaataggtacaaacatgaaggtagaagaaataagttctattgtttgatagcacagtagaatgactacagttaacaacaatgtatatttcaaaagagctagaagagaagatctgaaatgttcccaatccgaagaaacaataaatttcaaggtaatgaatatcctaaataccatgatatgatcattacatattctatgcatgtataaaaatatcacatgtacgccataaatacgtataattattatgcatcaataaatttttttaaaaaaattactttgcagacaaggtcaattttcaaacttttgcttagttaccctgataagcttaaatttttttttttacaattttactctttcttagcaccaactccatcatgcaagactgacagggaagaatcacaacatgtaaaagctaaaagaaaccccttatacagtccagtgcttacaacctttaaaacacattaaaagcttgaggaatttgttaacatgcaaattcccaggcctaaccacagagacactgatttagatgatatggggtagatcccagtaaagcagcccaggtgtttttgaaatagatggatcatgaaccaaactttaggaaataacaatatactgcctcacttttagattaagaaatttaaactcagagagcttagtgattttcctgaggccatgtaattagctaggggcaaagaagacattagactagtagcctcctatcaagtactcaaatcagagaatgatttcaagaataaacacaaaaaccaaaagttctaagaaaatttaagatagtattagttgacagcctttgtaagccatattgacttgatcttccaaagaacttccagtgagtgtaaatctctgattcagttatctgttcttccgtgacatataagagatactctatatttatttatttatctgtctctccccattggactacaaattcactaaaggcagggatgatgtgttgttattgccttgtacatctcaaagagcaccagaatattcaataaataataatcctcttttgtttctgttaaacatgtcaatctatcttataatggcaggccactaagtaagaaatattttcacatttttttgtaaaatgaaataagactacaaacttggatccgtagtcagaagacagagtcccactcctggctttatcactaatgagatgtgtttcctttggccaggcacttcaccaccatctctggctactttctcaccagcaaactaaggttaaactacatcatttctcttcctgtaaatcatactattttctaacatatatctcatgctaagaaagaaaataagagcaggaaaaaaagcaaagactttagagtcaacaaggcctgattttgaaacttagttctgtgacaaaccatataatgggacttggtcaagttacatacccttactccattagtaaactggggataatatctattcacatatataaagcaccaatctcagtgcctggcacccagaaggtactcaacatgtttccttctctaacaaaatttaaaccaatcatttatcctctaacaggatattcactactgcagtaaattcaagcgttaaatgtgaatggcaggatacactgttaaatctgcagcaaagattagaacaaaaagatagatgctttctatcacagctaaaaagagtacattatttgcctctactgtaatctcattgtctgtgacctactgctgtcacaaacagggtaggcaagcaactcaactctagccctggctttagtgagacacacgcttcataagcagtggggacaaacaaaatcacatggttcctgtcctcccacaaggacctgttactacccctataaatctcttcagagccactcccatttctgtgcccaactctagaaattactacattctctgctgggtgaatctcttcctgatgaactggtttcagatcccttctcttgcatttctatcaaacaacatataatgcaaagaattaactccaaaggctttgaaagaatttttaaattcctggtgcctcaagaagattaggctcaactaggtgaaggtaaaggttctgtcacataatttggcttttctaatgccaattcatggcccagttagaactgctacaattgtgataatgtataatacatgtgaacaaaaaagtacaaattattctttcactgtattaaatgttatataaaaagttgtataaaatcaattaattacaagacataataaaatcttacaactcaaatattttgagttaacagtttaaagcagattcaatgtgatatggctatccatgcagttcttcattttaacaattatctctcaaaaaggaaaagtttgtttttaaaaaatctgtgatcaatttctttgcttcatactacagatttcccaattagtttagagattaatctaaatgtgtacagcaaaagaatggctgaagtaattttttaatcataattgcatttctttttttgaaatggaaaaattgacaagggtctcactttgtcacttaggctggagtgcggtggtgcagtctcggctcattgcagcctctgactccagggctcaagcaatcctcccatctcagcctcccaagtataggtacatgccaccacacttaattaattttttatttttttgtagagatgaagtctcactctattgcccaggctgatctcgaattcctgtgctcaagcaatcgtcctgccctagcctcccaaagtgctgggattatacgcatgagccaccatgcccatgcccagcctgtatttcttaatgctctacaaaaacagttctgcttataagtctcaggcactcaatcatatttcatcaaacagcaattctgctttttttttttttttttttttgagatggagtcttgctctgtcgcccaggctggagtgcagtggtgcaatctcagctcactgcaacctctgcctcccgggttcacgccattctcctgcctcagcctcctgagtagctgggactacaggcgcccgccaccacgcccggctaattttttgtatttttagtagagacagggtttcaccatgttagccaggatggtctcgatctcctgacctcgtgatccgcccacctcggcctcccagagtgctgggattacaggcgtgagccaccgcgcccagccaattctgcttattttaatgatgataaagctgatgatgtgcagtgtattggatgggaatgtgtattaacaaaaaagtacaatattagttctatggacatctagaacagtcataatgtacactcaataaatattcactgaaaaaaataaacaaagcttttattttttttcaatatgtctaatgtgcccttaggctggtttttagaattaaccagtttcattaatgatttatgaccttgtaattaaaagtttagaagagacataattcagcaactcaatttacagtttaatggaacttcattttacagaattaaccaaagtaaagcatattctataaaataaatttgttatgtatcatctctgtataaaactataattacttacctaaacatgcttgtacagatttaagatgaaggtgccacatatgcagaatagagttattattgctgtccttctcaattactactagaaagaacttttctgaaaatggtggtgggcggtatcctattattcaaaggaaaaggatatttaaattagtatgtttttatggggttaaaaaaacactttttaaaagctaccaccacctcttgatatgcatggaagttgggaagaaaaggcaagaaagactttaaggaggagttttatataatttttgtaccgaaagttagatagctatcaaggactaatgaaattacgtcaaaagtacacaaaagctaacatgaaaggatacctactagtcaaagaggggacattttgagcatcaaagaataaaactgaatacaatttgttaaaacgtatttatcctattacaaactatgagttcacacaaataccaaaaaagggtacataaaaaagaaagcaaaggaaagaaagcagcagcagaagaatgggaggaggatagaagggaaggaagcggggtgctgagcacacaaaagctcaagccagcctcacaggatgcccctggagtaactggggcacttacgccttatttagaaaactggcaattaaaaagaaataataaaataaacattcatcctgcttttcttgcatgaaaacagcattaaaaaaaaaaaaaacttaagttgtgggggaaggagcagtggtagggtaaagaaaaaattttgtagaaatttcatgcattttttaaaaaaagacattacttgtatatataattttccctgctgaaaattagattcttcataactgaaaatgagatctaatgcaggataataaaagctttccttaatcattaaaactcataatgacaacatattggtaatgagcgctgctagagttaaaattgtggcctctaaccattttcattagaagaaacagtctggcaccgcatgttctcactcataagtgggagttgaacaatgagaacacatagacacagggaggggaacataacacatcagggcctgtttgggggtagggggctaggaaggggaaagaattaggagaaagacctaacatagatgacaggttgatgggtgcagcaaaccaccatggcacgtgtaaacctatgtaacaaacctgcatgttctgcacatctatcgcagaacttaaagtataataataatttttaaaaaagaaacagtttggaaggatgattccattcttgcaaaggacagctacaagataaacccaggaaaatcttgctcctgaaagaaagtaaactattacaataatgaggttatgtcaaaaggacacaggacctacttcaaatgctacttactagcctaatatagcactatgtaagcatttaaaaaatgactgcaactgactgaaatatcctacatacctaaaaatccattgagttatatgagtacttctctgtatgtatattatagttcattaaagagttttcttaaaatgagttcatattgatacttaaaagacaaagaaatccaacaacaacaataaattcaacagtagcagctagagataaccagcgcgcagactcctcattctgaaactgtcaattaaatggaaataactaagcacttaacctttccaaaaagaactgtttttcaaagtaatccaatagccctagttgataaagaaatgcttttctttacagatgctttccagctaataaataaatgagaactgataaaattggaaaatcataatttttcaatccctaatgaaataactggtttaagatcaataatattcaatggaagaagccatgagataaagactgctgtcaaactataatgacaccaccaccaactgaatcttccgaatcttaatatgactaaaagtgagatatccaaatttttttttctggtatgatacatatgaagtacatggcatcacccagaatgttgaacccagatctaatcaagtctgtagagctaacttccactgtacaggcaatacagtagacaagaaaaagtttaaacaacatcacaagtaagtagtcagagaaacttctttaaaaaaaaaaacttgctctagaactgaaggagacagagatacaaaaaacccttccaaaaatcagtgaatccaggagctggttttttgaaaagattaacaaaatagatagactacttgccaaactaataaagaaaaaaagaaaagaatcaaacagacacaataaaaaatgataaaggggctatcatcactgatcccacagaaataaacactaccatcagagaatactataaacacctctacacaaataaactagaaaatctagaagaaatggataaattcctggacacatacaccctccaaagactaaaccaggaaaaagtcaaatccctgaatagaccaataacaagttctgaaattgaggcagtaattaatatcctatcaaccaaaaaagcccaggaccagacagattcacagccaaattctaccagaggtacaaagaggagctggtaccattccttctgaaactattccaatcaatagaaaaagagggactcctccctaactcattttatgaggccagcatcatcctgataccaaaacgtggcagagacacaacaaaaaaagaaaatttcaggccaatatccctgatgaacatcaatgcgaaaaacctcaataaaatactggcaaaccgaatccagcagcacatcaaaaagcttatccaccacgatcaagtcggcttcatccctgggatgagaggctggttcaacgtacacaaatcaataaatgtactccatcacgtaaacagaaccaatgacaaaaaccacatgattatctcaatagatacagaaaaggcctttgataaaattcaacagcccctcatgctaaaaactctcaataaactacgtattaatgaaacttatctcaagataataagagctatttatgacaaacccacagccaatatcatgctgaatgggcaaaagctggaagtattccctttgaaaagcagcacaagacaaggatgccctctctcaccactcctattcaacatggtactgaaagttctggccagggcaatcaggcaagagaaagcaataaagggtattcaaataggaagagaggaagtcaaattgtctctctttgcagatgacatgactgtatatttagaaaacccaatcgtctcagcccaaaatctccttaagctaataagcaacttcagcaaagtctcaggatacaaaatcaatgtgcaacaatcacaagcattcctatacaccaataacagacagagagccaaatcatgagtgaactcccattcacaattgctacaatgagaataaaatacctaggaatacaacttacaagaccctcttcaaggagaactgcaaaccactgctcaaggaaatgagaggacataaacaaatggaaaaacattccatgctcatggacaggaaaaaatcaatattgtgaaaatcgccatactgcccaaagtaatttatagattcaatgctatccccatcaagctaccattgactttcctcacagaattagaaaaaaacactttaaatttcatatggaaccaaaaaagagccctcgtagccaagacaaacctaagcaaaaagaataaagcttgaggcatcacgctacctgacttcaaactatactacaaggctacagtaacaaaaacagcatggtactggtaccaaaacagatacatagaacaatggaacagaacagagtcctcagaaataacaccacacacctacaaccatctgatctttgacaaacctgacaaaaacaagcaatggggaaaggattccctatttaacaaatggtgctaggaaaattggcttgccacatgcagaaaactgaaactggacccctttcttacacttcatacaaaaattaactcaagagggactgaagactgaaacgtaagacctaaaatcataaaaaccctagaagaaaacctaggcaataccattcaggacgcaggcatgggcaaagccttcatgactaaaacaccaaaaacaatggcaacgaaagccaaaattgacaagtgggttctaattaaactaaagagcttctgcacagcaaaagaaactatcaccagaataaacaggcaacctacagaatgggagaaaatttttgcaatctatccatctgacaaagggctaatatccagaatctataaggaacttaaacaaatttacaagaaaaaaataaccccatcaaaaagtgggcaaaggatatgaacagacacttctcaaaagaacacatttatgtggccaacaaacatatgaaaaaatgctcatcatcactggtcattagagaaacgcaaatcaaaaccacaatgagataccatctcatgccagttaggatggcaatcattaaaaagtcaagaaacaacagatgctggagaggatgtggagaaacaggaaggcttttacactgttggtgggagtataaattagttcaaccattgtggaagacagtgtggcaattcctgaaggatctagaaccagaaataccatttgacccagcaatcccattactgggtatatacccaaaggattataaatcattctaccataaagacacatgcacatgtatgtttatcgcggcactgttcacaatagcaaagacttggaaccaacccaaatgcccatcaatgatagactggataaagaaaatgtagcacatatacaccatggaatactatgcagccataaaaaaggatgagttcatgtcctttgcagggacatggatgaagctggaaaccatcattttcagcaaactaacacaggaacagaaaaaccaaacactgcatgttctcactcataagtgggagttgaacaatgagaacacacagacacagggaagggaacatcacacaccagggcctgttggggggtggggggctaagagagggatagcattaggagaaatacctaatgtagatgatgggttgataggtgcagcaaaccaccatggcacatgtatacgtatgtaacaaacctgcatgttctgcacatgtattccagaaattaaagtataataaaaaataataataaaaataaacttgctctaaaacaagtcagtggcataatgagggtgtatataaggtatcactttagattaaaatactctttaaatagacaatgaaaacacaatatgtaaactttgtttggatatagattcaaacaaaaacacataaacaaacaaaaagctcaacattttttagacaactggaagaaatatggagtagttattgcacgattctgaggaattttattatcaatttgataacagcaaatatgtaaggaagttatttttagaaacgcatatggaagtgaaacaacactgtaggtggatttgctttaaaatatttcaggggggccaggcgtagtggctcacgcctgtaatcccagcactttgggagtcaaggtgagctgatcacttgaggtcaggagttcaagaccaacctggccaatggggtaaaactctgactctagtaataatacaaaaaaattagccaggtgggcttacagccgagtagctgtaatcccagctactcgggaggctgaggcaggagaattgcttgaacctgggaggtggaggttacagtaagctgagatgacgccactgcactccagcctgggcagcaaagcaaactctgtctcggaaaaaaaaaaaaaaaattcggggggaaaaggaaaagaaaaattgtgtagacaaagcaagtgtgataaaatctttaacctacattatgggaatatggaggttcatttaattatgcactataattttgtctatttttggcatttttcttaactaaaagggtaattaactttaaattaaaacttagtacaaaataaagcagaggcagagaagaggagaaacctacacaagtcctttaagaacacagctataaaatcaggaagaaagagaaatttcacacaaaaactaaaggaaaaccaagaaagcactgaggaaatcttttggcctgatttagcagtggcataacaaatatcaaaagcgagaaataaagaaaatttttaatgcaagtcaattaaaatattataaagaaaagtaccaactttatataagcattgaattctggtaagctggcatatctttcctgttagaaataatgtgataaatggcagctacatttgttggaaaccatattaaaaagattaacccaggcaaaggtaagatactacagaaaagtaaattttaaattggtaaagcagtactgctgttataatgatagtgaaataaaacttaacataattgaataacacaaataagaaaagttttgtgtatgaagaaagatatacgaaagaaaaacaagttactagtctgacgagtgaaaagatgtttgagctaagcttcttagaatacaggacctcaatctgattttcactaaagcgaaggaaattgtctgcacaaattacatagaaacagtttccttagatgctatacataatttcgtgatgaagactacactaagaaaattaaatatgtccatctggatattcacaatttgtaaccacatgagattaattatctgaaaaccctttgtaaactaaatattcgccatagacacttaattcttaaagacatggcttttcaaatagaacatgttggttttataattatgaagttatatatatacacacaattttatttgccaatttaaaaaacttaaataaaagtttaacgtctgaagggaacattttaagctaagttataaagtttaaactaaacgtcatattgtttgtttttgaaagggttaaactacttactttcacaaaaaggaaaaaataccacacttcaaaggggaaaactgtgagatggtaccttgcattcactatttccatgaggtttctagtgtcccacacaacatgataccttatatcttatattcatcattggtctgaagcaatttactggtaattttttaaaacctgtaataaaattaactgttttccttaagataccaaatggaactaccaatcaaaataatttaattatagagttgaagaaacttactttttaaaacaaattaaggttcacagataccatttcttagtaaaagttgatgtcaccaatgaattgtcttgcaaaaagtaattttcacccacagccctcttcatctacaagcaagcaattttgacagaactaactggtgaatctgtcaaaaattatgagagtggtaacttttgaagatccatactcagtgaaaacttagagatcattttttagcatgaaggtaaacaaatgcagactatttttttaaagtaccttgtgatggctgaaaaaatatttctgtttcctttttctccatatcttccttatgtggtttatatcctataatgaagtcttcttgaaacacatgaagcaactgtgtatttgagccacactacaaatacaaaaaaaaatgaagaggttttatctttgaaattccctgtctcccatctcccatctgtcacctccccaatgctaatgcagaagaaatatatctaacaatttctattctttaccactactaattagaaagaaaaaagcaacagaagagaatcattaaaactatcctggtcagagaaaaattactttcaaaaatgtcacagccaatagcagaatagaagagctctagtacaaacaaatcaacaggtttgcttctcaggaaaaaaaaaaaaaaaaagatgctaaaaaacccaaattccaaatttaaagaacagttaagcaaccttcaccactttgagcctgaaagcatcagattcacaactgactagggagggctgcactatgtaagacacactagactactacacaacttgtaattttttcaattccactggagaaccaaaaaacaaaacaaaacccagaaagctcctcgaagtatcccaatagctctgtctagtgggaattatgagggatcctataacagccagcaggatgatacatctctagagaactaaacttacacataagtaactagaacccctcgaaggatggatgaaacatcactgtcaactgctatgctccatgaccatgttttaagactatcacgaatggctacttagaaccttaacaggaactgaagttcaaggaaaggctagatccaaacaaaagcttattttggaagtgtattaagacaatcaatcagatggctcccccagagatttcaagaaaaggaagcagctatgattatcttggcattggatgaggagtctataatcttatagaataaaggaaaacctgcctctttacataatagaaagaaataaaaggattataatattaggttgggccatacaattttatgaaagttatagggtattttgtgtttctctaggtagaaacattaaaaatctcttcacattcattgtctaggaggtcatttccccaagggacaaacaatagatgaaagtaaagagaagggtgatgtcttcacagatatagaaatcatacaacacattgggaacaaacctagaaagaattttaaactttgtcattcattattgcttacagtttaccagcccctgtgttaaaaataggcacaaggagcaggggaaaaagtgttgagcaaatatgaagtaaaaaaactgctttgtgagagcagactgtgttaatatcccatggtaatgagtgcaaaggaggctaaagtaggggatgaatttaacatccaatccattaaaaattaagttatctataggaaggaagccaacccactcttctacattcctattgagtagaaaaaagaaatcacaggctgaatctgaagaaaggtggggcactggggattaaaaagttaagcatttcccaggaggtattagcaatatgggtctggcagccccagttctgctatcaagagatgatgtattttatctatattagcagaaatgagtacattttccccaatagaaagtgcaagacactaaagaaaatttatgatgtaactctatacttgctttcaactatagttggctctttcttcatttccttgtttaaaactattggtagcttctttaccaaactaatccttttcacatttggaataaatgttagttctatcccttagaccataaacatagtcctaaagaaacaaatatcctgagggctaaaatgggttttacatctccctctagggagaagggttctccttctttcctaggtagtagctggggaggaatactacacaaaggacctgtgattaaaaagtatatgtccacttgaatctgactttcatctgcattttaaaggacctcacaaaagtacccaacatggggcctaacaaggcaaacactctgaaactgaggttaccctctattgagttgaaaagagtaataatataaaatgagaaaccacaacccgacccttctatgcagctgcactgtattttctctcagcatttcaagatcaaggtcatggtttctctaaatgaatcaaatttcctttgctacaaatacaattcaactggagaagaataattccttttttaaaaaattttacttaaatagcttttggggtacaagtggtttttttgttacatggatgaactagtagtgaattctgagattttagtgcacccatcacccaagtagtgtacactgtacctaacatgtggtttttcaaatctctagttccatttccaccctccctcttctgagtctctaaagtccattatattgctctgcatgcctttgcatactcatagcttagcgcccacttataaatgagaacatacagttcttggtttcccaaggagaaaaataatccctaaatcattagtagattttcactatgggaatcaacataagttgtctgcatttaataacaaacaagaaaattattctgagaatgacatatatcatatacatataaaacaccatgggataaagtatacgaatatcaccaattcacaagcatgtttttacttggttggttattgcgtcgagttcaataatgcagccaggtcgagcagtagactgttggctcacaatattaaacacttctccaataagtttctgtaaataaaaaacacaaaatgttaatggccaacaaattataatctaatgtcaatatgatacagcatcttggacatttaaggccccctctaaatattcactgattggcaatggaatgtaatacattcaaagaaatacttcaactttccatactcattctcatgttaagtctaaagttaagcagagagaaaactataatgtttacaaaaatagcatataacttcaaggtatcatatcttcttcatttttgcaaccttaaagcccaagacagacatggctgaagatctggcccaatgcctgagtggtctgcagatgtgcaatgccatttaaaagtacaaccctgccagaccgaaggtaagggcaagggttgagaagaagtgggactcttgtgccttgggataaggatgtatgaacaaacaaatgaagcctaactttggaaccccaaaatcccaaaactttctgctaaaaagaacagtcctcctcacccatgttccaaccagctttctcttgcataaaaacctttcagtaacttcatctgaaacggttgcctcagaaagaaatgcccattctcctcagcacccacctttaccacttttcactacctcaaaaaggccaataagaggggttagaggctagcttcgcctagagatataagtacaaggtagggagatataagtacaagcatatacactggagttgtagaaactttcttatttgtatcagtaggattccagagagcatgtaagaaaattgattctagggttattagatcaaaagaaaaaaatatgtagttaggtagggctgaatttactgatatgggtatgttcacccaagattcatgatttaaagtgttagctcagacatttagaaatggtgttaacagggccagggtggtggctcacacctgtaattccagcactttgacaggccaaggcaggtggatctcctgaggttaggagttaagagaccagcctggccaacatggtgaaaccccgtctctactaaaaatataaaaattagtggggagtgatggagggtgcctgtaatctcagctattcaggaggctgaggcaggaaaatcacctgaacctgggaggcggaggttgcagtgagccgagattgcaccactgcactccagcctgggtgacagggcgagactccgtccaaaaaggaaaaaaaaagaaatggtgttaacagtctgctgggtttgttcattgaaatctggactcaactgtggcctatagttggtgaggtgaaaacagtgaaatttttgtagcacacaacaaagctttgctactcaaagtgtagtcaatggaccagcagtgatgggaagctttttatgaatgcatacttactccctgaaactaagacatctgtattttaatgagacttccataggattcatgcgtatattaaagtttaagaaggactgctgtagatcactggttctcaatcttggctgcacactgaatcacctggagagctttaacaatcaatgatgcttaggtcccacccacagagattgaggtgcttccaatgtgcagccaaggttgagatcccctcacaagaatagttatgtattccagctaaggatttgctttccctgcccacaactctctgccagcactataattaacagactttctgaacactacactacagaattccagaattctacagaatctcactcaacatcacctccaaccaaggaactcattttatagtggaagatactactggaaattagaatgaagtaaagcattcgcccagggtgcaaaatttaaaagagtgctcaaaaattcaataatcaagaaaaataatattttaatgcaatattttaaaatcaaaattaatgtaaacaatccataatgagcaaaatatcaaacatttaaatatagaacccaagagtatcttaatgagccacactgataccattaatgtgcatcaaaactgcacatatgtgttttgatgtatatttttttttaatggttaacattcttcttttcttttttcagggtcttgctctattggcctccaactcctgggctcaagtggtcctcctatctcagcctcccaagtaactaggattacaggtgcatgcaaccatgcctgacaaattttttaatttttttgtagagacagggtctcactatgttgctcaggctagtctcaaactcttggcctcaagcaatcctcccacctcagcctcccaaagcactgggattacaggcataaaccaccacacctggctgtagttaacatttttccagaacatcaaagtagttaaaaaatgctaaaaaattgaaaagtaggtgcattaaaactcacatattactttaagtttaaatttatttataccagaaattggactaattatagttttatttttctggctttaatggaaacaaacacattaataatattttcaaaatctccttctttgcttctctggttttgacaaagtctcttgtttttttttttttttttttttttgagatggagtttcactcttgctgcccaggctgaaatgcaatggcatggtcttggctcattgcaacctgcgcctcccgagttcaagtgattctcctgtcttagcctcccgagtagctgggactacaggtgcacgccaccacacctggctaatttttgtatttttagtagagacagggtttcaccatgttggccaggctggtcttgaactcctgacctcacgtgatccacctgcctcggcctcccaaaatgctaggattacagggttcaccgcacccagccctgaactacgttttaagggcatcattctaactcctatgttgagaacagactttgagaaagcagagcaaaatcataaagaaagcaatacaaattttttcacaatctaacctctaacttcctatccagtctcagctatttccaacagccattcacattctatgctatggctgtaataaactacttacagtttactatgcacattcttctacctctgtgcattgttagttgctgttatctctacctgaaatatccttttcctccttcactttcatgtcttacccattcagtaagtcttatctcagatatctatctccaccagaaattctttcctaaccatcacaatctggattaaatgttgcttctaactataagaaaagccatcttaactgacagcattggacagagagaggacaaatcactcagcaaggtcagttaacccagagaatcatttttaaaataatatgtatactttaaacattttgttttattttaaacataaacgtatacaaataactgatattttggtgttgagtaagaccctggagtatgggcttgctaatgggaattacaggtctttcttgcgtatgccacccctgtaaggccctggctgtatttttcagttctttaaatgggaataggctgacacggtggctcacacctctaatcccagcactttggggggccgagctgggtggatcacctgaggtcaaaagtttgagaccagcctggccaacatggtgaaaccctgtatctactaaaaatacaaaaattagttgggcgtggcagtgcgcacctgtaatcccagctattcaggaagctgaagcaggagtatcgtttgaacctgggaggcagaggttgcagtgagctgagatcgcgccactgcactccagcctggatgacagagcaagattcagactcaaaataaataaataaataaatacataaatacataaatgggagtaaaaacataaagacacctacaaagcaattcgagtgcagtttttcttaaaccatttcctcctgaatcttttacagttgttttgaccatgcctaattagtgatttttagcaaaattgcttccaaagcacttatttttataaaaacattcacgttttttatactcacatttcatcaatttatataatatttaattaagttaagaatgacactaatatgtacaacttgacatatacaaggttgaaaataaacacagctggctcttgagtgacagccgtagttgtaagagtttggtctctagagctaggctgcttgggttcaaatcctggtcctaccattgctagctgactaaactgggacaagtaattaagtttctctatgcttcagtgtccttacctctaaagtatggatagtaatattacatttttcttaaggttaccaggaaggttaagtgagttaatatatataaaacatttagaagacagcctgacatacaataatcactagataaaagtttgctagtagtagtagtagtagtagtagtagtagtagtagtagtagtagtagtggtagtggtagtagtagtagtagtagcagcatttttttcaggttaaataactttcccagctgttattattgttaaggttacaagtcaacttgtggaatcaacaaagcctggtatactattccctatgagcatccatcctatattttatagaaggaatggacagcatcaatgaatccaatgagctggcttaagtggaggccaattaaatgaatttcacatcctgaaatcagccttttcttctaatttaccacttattacatactatatgtacatatttatatgactctatagatacaagatccttgaaagtagggactacttctattcattttaacactcttagcacctggtacaatatgcacatttattcttccatgtactataaggttatgcacagtgagtcctcaataaaaattaaagattgagtaaataagttactgagtgaaaacaaattacactttagatcattcctactttaaaagcttgtttttactaatagcagcacacactataccaccctatctttcatcatgacttctcctttatttatttgtagaataccttagtaagtactcactaaatacctgaatgaatggatctcaccaatctagcatctcaccaatctagatattcaaaagcttattttttaggcaccaaaacaactgtatctttgatactttaaatggaataaaaaaaacttaatccctgtcttcataaatagcctgctaaacataaatctcttcttgatgactgacagtcatatttatgaacattaactattactaatgcctttagagatctaatgacttcaagtactgtctttgtaataataaatcccaaatgtgcactggtacctaatgtggaacattaggagtatctccaatctaaaccaaacttaggggctgggcgcagtggtgcacgcctgtaatcccagcacttgggaggccgaggcggctggctcacttgaggtcagcagttcaagaccagcctggccaatatggtgaaacccctagctactaaaaatacaaaaattagctgggcatggtggcagacgcctgtagtcccagctactcaggaggctgaggcacaagaatcacttgaacctaggaggcagcggttgcagtgagctgatatcatgccactgcactccagcctgggctgatagagcaagactctgtctcaaaaaaataaaaacataaaataaataaataaacaaacaagccaaacttaggaatctaaaaccaaggtcacctcacattcaacatgtcccaaatttaactcattgtaaatacctcaaaactatcttgccatagctactggaacaactatcacacttggaatcctctgttttcatatccatattcaagcagctactaagctctgctcttctcctttcctagactatgaaatcccactttagatcaggtttgttttcccacatgcttagttggcctcaacagactccctgctatctccatgcttccagtacctaccaattctactctaccctgcaagttaatcactttatttcccttcctgtgcttcctaaatctacccctctacctacagaacaatatttatagctttcaagtatctgttacaaaatttttaaaaagctagcctttacttgtcatctactaaaaatctcatttaaggaataggagagcatgtgacaaattcttgctacattttgcctcacaattagtagaagaagtaagtaggagaactgctattgtattaagaaaatcaaaacgatgagcagaaataatggaaatgtgacagaaagtagtcatgtcatcttaagagtttaagactgaaaataagagcaagactctatagtctatattttagaaaggttaaaaaatcccagaatgccttatagcatgggggtctcaaagtcaaaatggctcaaggaagtctggaggctcaagagactttgaaagttcctgactatgcaactacaaatataactgatgagaaaagaaagttgatcagagtagtgggttaaatagtgtcctcccaaaattcatgtccacccagcatctcggaatgtaaccttgtttgaacgtagggtcttgcagacataactagtttaaaaaaaggtcacactggattacagtaggtgcaaaatctaatgacttctgtccttacaaaaaaaggatacgcagagacactcagatggacgaaggccatgagaagacagtgatgcagctacaagccaaagaacaccaaggactgccaggagcaatctaggaagaggcaaggaaggatcctccccttgaatatcagaaagagcatggccttgccaacaccttgaatttgaactaaatgtatatacaccaaagaacagtgctgaaaactatgtgaagcaaaaacttatagaagtaaaaggagaaacagacaaattcacaatatagttggagactgcaatacctcgctctcaagacttgatagaatgattagggagaaaatcagtaaagatacagaagaactcaacaacaccatcaatcaaaacaggattaattaacattcatagaacactctacccaataacaacaaaatacacattcttttaagtgcttagtgagtggaacatgtactaaaatagaccaggtcctgggccatgaaacaaacttcaacaaactaaaaaggactgaaatcatacggtacatttttctaccatgacggaatcaaactagaaatcagtaacaggacgcttggaagctaaatcttacacttctaagtaatcgagggtcgaagagaaattctcaaaggaaatcaaaacatatgaggaagttctcctctaggtttgttaattttcttgattcctcaacttgataaagagtatctacaaataacccaacagctggaggtaggaatagaggaagatggcagaatagagggctcccccaatcgtcccccaagcaagaacaccaatttaaccactatacgaaaaaaagcaccttcataagaaccaaaaatcaggtaagcattcacagtacccagttttaacttcattatcactgaaagaagcactgaagaggtaggaaacacacacttgaatcaccaacaccactcttctcccacaccctggcagcagcagcgtggtgctgagagagtttctgtgcactggggaaaggaagagcaagcaactgtgagcactgaagtcagtgctgccttgttatatagcagaaagaaaaaccagaccaaactcagctgacgctcacccatggagggagccctacccagaggggaatcgctgatcctatctgtctgagcttgattccccaaaagccttgccaccacaaggctcaggttctctggggccttaaataaacttgaaaggcaatctaggccacaaggtctgcaactcctagatgagtcctagggctgaactgggccaaagacagtgggctggggaggcatgcaacctactgagacaccaggcgggatggctaaaaaagtgctggcatcatcccttccctaaccccaggctgtacaactcacggctccaaaggagactccttccttctgcttgaagagaggcgacagaagagtggggaggattttgttttgcatcttggataccagctcagctacagcaggataagacaccagtcagagtcatgaggctccctttccaggccctatttcccacacgacatttgtagacacaccctgggccagaaaggaatccactgccatgaggggaaagacccctggcaggattcatcacctgctaactgaagagcctctgggccctgaataaccagcagcaatatccaggtactgtgccaggggtcttggatgagaccctgagactggctggcttgaggtgagactcggcacattcccagctatggtagctacagggcaagactcctgctagagaaaaggaggggcaatgtgctcgcttcgacagcacatatattaaaattggagagaagcagaggcaaaagtaaagggaactttatcttgcatcttaggtaccagcttggccacaagggagtagagcaccaagcaggctcttggagtccccagttctaggacctggctcttacagcatttctggatcttctgtgggccagaagggagcccaatgccctgaaatggtgagtctcagactaggcagcatttacaacaagctaaccaaagagctcctgatccttaagaaaacattggtagtagtctggaagtactccctgtaggcctgaagtcctggtggccacagggtgaagctcgtctgcctttggaaaggagagagaagggtaggagggactgtgtcttgtggtttgagtaccagctcggccacagtacaatagaacaccaggtagatttctaagattattgactctgctccctacctcccagatggtacttctagaccagcccagtgtatgagggaacttgtcaccctaaagggaaggacacaggcccggctgactttgctacctgcagactgcaggagccccagggctttgagagaacataggtggtagctggggagtggttacagcaggctttgggcaagaaccagtgctgtgctggcttcaggtgtgacccagcacagtcctagaggtgatggccacaggggtgcttgtgacactccactcccatctctagatggctcagaaaagagagagagaaagagagagggagggggaaggagagagagggagagagagggggtgggagagagagagaaagaaggggggtgggtggggggagagagagagggagagagagaatgggagtttgttaggaataaagtaaaagaagagaacaagagtctctgcctggtaatccagagaattcttccagatcttgtccaagaccatcaaggcagtacctcgaagagtctgcaagaaccacagcattaatgggcttggggtccccccaaagcagatacagcttagatcacaaaacccaagtccttctaaatatctggaaagccttcccaaggacagatacaagtaagctcagactgtgaagattacaacaaatacctaactcctcaatgtccatgcaccaaagaacatctacaactatcaagacaattcaggaaaacatgacctcaccaaatcaaccaaataaggtaccagagaccaatcctggagaaacagagatatgtgacctccagacagagaattcaaaatagctgttttgaggaaactcaaagaaattcaagataacacagacaacaaattcagaattctatcagataaatttaacaagaaatttaaataattaaaaacaatcaagcagaaattctggagctaaacaatgcaactagcatactgaaaaatgcatcagagtcttttaatagcagaattgatgaagcagaagaaataatttatgagtttgaaaacacacagaggagacaaaagaaaaatgaataaaaaacaacgaagcacatctacaggatccagaaaataacctcaaaagggcaaatctaagagtcactgaccttaaagaggaggtaaagaaagaggtaggggtggaaagtttattcaaagggatagtaacagggaaattcccaagactacagaaagacatcaatatccgagtacaagaaggctatagaacgccaagcagacttaactcaaagaagactacctcgaggcatttaataatcaaactcccaaaagtcaaggataaagaaaggatcccaacagcatcaagagaaaagaaacaaataacatacagtggagctccaatacgtctggcggcagaatttcagtggaaaccttataggccaggagaaaggcatgacatatttgaagtgctgaaaagaaaaaaaaatttaccctagaagagtgtatctagtaaaaatatccttcaaacatgaaggataactaaaaactttttcagacagacaaaaactgagggatttcatcaacaccagacgtgtcatacaagaaatgttacaggagttcttaaatcagaaaaaagaggacattaatgagcaataagaagtcatctgggccaggcgtggtggctcatgcctgtaatcctagcactttgggaggccgaggagggcagattgcctgagttcaggagttcaagaacagcctgggcaacacggtgaaaccctgtctctactaaaatacaaaaaattagctgggcgtggcagtgtgcgagtgagctactcgggaggctgaggcaggataattgcttgcacccaggaggcagaggttgcagtgagccgagatggtgccactgcactccaccctgggtgaaagagcgagattctgcctccaaaaaaaaaaaaaagaagtcatctgaaggtacaaaactcactggtaatagtaagtacacagaaaaacacagaatattacactgtaactgtggtgtgtaaattgatcttaagtagaaagactaaatgatgaatcaatcaaaaataataattacaacttttcaagatacagatggtacaaaaagatacaaatagtaacaacaaaaagttgtagcaggacaaagttaaggagtagagcctttattagttttctttttgcttgtttatttatgcaaacagtgttaagtcataattagcttaaaataatgggttgtaaggtaatatttgcaagcttcatggtaacctcaaattagaaaacatacagtgaatacaccaaaaataaaaagcaaaaaactaaatcacaccaccagcaaaagtcaacttcactaaaagaaacacaggaaggaaataaagaaggaagaccacaaaacaaccagaaacaaataacaaaatggcaggagtaagtccttacttactaattacttggactaaatggactaaattctccaatcaaaagacatatagtggctgaatgggtaaacaaaattcaataatctgtggcctgcaaaaaacacacttcacacataaagacacacacaggctgaaaataaagaggtgggaaaagatattccatgccaatggaaaccaaaaaagagcaggaatagctatacttatatcagacagatatactgatatcagtatcattattttctgatactatgtatcagacaaaatagttttcaagacaaaaactgtaagaagagacaaagaaggtcactatataatgctgaaggggtcaattcagcaagagaatataacaattttaaatgtatatgcacccaacactggggcacccagatatatcaagcaaatattagagttacagaaagagatagaccccaataaaatcatagcttgagacttcgacatcactcagaattggacatatcttctagacagaaaatcaacaaagaaacatcagacttaatctgtactatcaaaaacaatagatatttacagaacatttcatccaacagctacagaatatacattcttttcctcagcacatggatcattctcgaggacagaccatacgttaggtcacaaaacaagtcttaaaacattttaagaaatgaaataatatcaagcatcttctctgaccacattggaataaaactagaaatcaataacaaggaattttggaaactatacgaacatatggaaattaaacaatatgctcctgaatgacaagtgagtcaatgaagaaattaaaaagaaaattgaaaaatttcttgaaacaaatgataatgaaaacatgacataccaaaatctatgggatactgcaaaagcagtactaaaagagggaagtttatagctgtaagtgcctacatcaaaaaacaaggaagacttcaaataaacaacctaacgatgactcttaaagaactagaaaagcaagagcataccaaacccaaaattggtaaaggaaaagaaataataaagatcagagcataaattaaattgaaacaaagaaaatcatacaaagattaataaaacaaaaagttaattttttgaaaagataaaacaaaattgacaagttttttcccagactaagaaaaagaaagaaaagacccaaataaataaaatcagagatgaaaaaagggatactacaactgatgccaaagaaattgaaaggatcaacagtggctactatgatcaactatatgccaataaattgcaaaatctacaagaaatggacaaattcttagacacatacaacctatcaagactaaaccacaaaagaagtccaaaacctgaatagatcagtaaaacaagtaacaagatcaaagccataataaatagtctctaagtaaagaaaagcccaggacccaatggttttgctgctgaatgctgccaaacatataaaaaggaacgaataccaatcccactaaaattattctgaaaaatagagaaggaaggaatactttcaaactcattctatgaggccgtattaccttgacaccaaaaccaaacaaagacacatcaaaaaaagaacactacaggtcaataactctgatgaatattgatgcaaaaatcctaaacaaaacactaccaagtaaattcaacaatatgattaaaatgattaaaagatcatttatcataacagggacacaaggatggttcaacacatacaaatcaatcaatgtgatacatttcatcaacagaatgaaggacaacagaatgaaggacaaaaattttttagcatcaattaatgctaaaaaagcatgataaaattcaacagcccttcatgatgaaaactctaaaaaaagtgggtatagaaggaacataccttctataccctagtatcatgccgaatggggaaaaactgaaagcctttcctctaagatctagaacacaataaggatgctcactttcaccactgttattcaacgtagtacggaaagtgccagctcaggcaatcagacaaaagaaagatataaaaggcatccaaattggaaaggaagaagtcaaattatccttgttggcagaaagcatgatcttacatctggaaacacctaaagactccaccaaaaaccattagaattgataaattcagtaaagttccaggatatcaatcaacatacaaataccagtagcatttctataggccaacagcaaaaaatctgaaaaagaaattttgaaaaagtaatctcagctgggcacagtggctcacccctgtaatcccagcactttgggaggctgaggcgagcagatcacgaggtcaggagatcgagaccatcctggctaacacaatgaaaccccatctctactaaaaaaaaaaaaaaaaaattagccgggcatggtggcacatgcctgtagtcccagctactctggaggctgaggcagaagaatcacttgaacctgggaggcagcggttgcagtgagctgagatcacaccactgcactccagcctgggtgacagagactccgtctcaaaaacaaacaagcaaacaaaaagtaatctcatttacaatagccatacataatattaagaacctaggaattcatgaaagaagtgaaagatctctataatgaaaactgtaaaacactgatgaaagaaattgaagaggacaaaaaaaatggaaagatattccatgctcatggattggaagaactgatattgttaaaatgtccacactaccccaagcaatctacagattcaatgcaatccctataaaaacaccactgacattctttatagaaattttttaaagatttaaaattcatatggaaccacaaaagacccagaatagccaaagctatcctaagcaaaaagaacaaaactggaaaaatcatattatctgacttcaaataatactgcagagttacagtaatcaaaacagcatggtactggcataaaaacacacacagagaacaatggaacagaaaagagaacccagacacaaatccacacacctacagtgaactcatttttgacaaaggtgccaagaatatacaatggagaaaagacagtctcttcaataaatggtgccaggaaaactggatatccatatgcagaagaataaaaccagacccctatcattaactgcatacaaaaatcaaatcaaaatggattaaagatttaaatctaagacctcaaactatgaaactactacaagataacattggggaaactttccaggacattggtctcagcaaacatttcctgagtaatatatgacaaggacaggaaaccaaagcaaaaatgcacaaatgggatcacatcaagttaaaaagcataggatacaatcagcaaggtgaagagacaacccacagaatgagagaaaatatcttcaaactactcatctgaaacgggattaataaccagaatatataagaagctcaaacaactctacaggaaaaaatctagtaatctgatcaaaaaatgggcaaaacatttgaacagatatttcttaaaagaagacatacaaatggcaaacagacatatgaaaaggtgcccaatatcacagatcatcagagaaatgcaaatcaaaactacaataagatatcatctcaccccagttaaaatggcttatatccaaaagacaggcaataacaaatgttggcatagatgtggagaaaagggaaccctcatatgctattggtgggaatgtaaattagtacaaccatgatagagaacagtatggaggttgctcacaaagctaaaatagacctaccatacaatccagcaattccactgctgggcacatacccaaaagaacgaaaattggtatactgaagaggtatctgcactcccatgtttgttgcagctctgttcaaaacaaccaagatttggaggcaacctaagtatccatcaacagatgaatggatgaagaaaaaaaaaatgtggtacttacatacgacagagtactacttggccaaaaaaaaaaatgagattccgtcattttgcagcaacaaggatggaactggaggtcgttattttaagtgaaataagccaggcacagaaatacaagcgttgcatgtcctcacttatttatgggagctaaaaatcaaaacaactggacccatagagatagagtagaagggtgattaccagaggctaggaggggtcgtaagggattggcagggaggtagggatggttaatgtgtacaaaaaaatagttagaattaataagacctagtatttgatagcacaacagggtgactatagtcaataatttaattgctcatttaaaaataactagaagagtgtaattagatcatttgtaacacaaaggataaatgtatgcggtgatagataccccattttccattatttgattactaagaattgcatgcctatatcaaaacatttcatgtaccccacaaatatatacatctactatgtacccacaaaaattttaaaaaaattttttaaacctgcaactaacattatatgtaatgatcaaagactgaatgcttttcctccaaaaatgggaagaaggcaagaacatccaatctcacttcttattcaacatggagttggaagttttagtcactgcaacaaaataagaaaaataaaagccatacagattagaaaggaagagataaaattgttcccatttataatgagatgattatctacatggaaaagtccaagaaatctaccaaaaacactcctacacctaatatatgcattcagcaatgttacaggatataagataaacatacaaaattcaattgtatttgtatattcaattgtatttgtatattctggccataactacatggacaccaacattaaaaagacagcaccctttacagtcagtagaataaatgaaatacttatgtataaacctaacaaaacattcataggacatgcatgctgaagaccacaggagagggagattggggacactattgaaagttgtttactgtatatatttagagatgggggggtctcactatgttgcccaggctggtcttgaactcatggggtcaagcaatcttcccatctcattcccaaagtgcttggattacaggtgtgagtcaccgtgcctggctacattatattttgagtactatattattatttgaaggtagactatgagaggttaaagatgcatattataaaaccttgaggaaccaccaaaaacaaaacactgagtataatggagaacaaatagaaccataagaaaacacaaaatcccccaaatcatggagaatgacatcaatagcaaaaaactaaaaacaggcaaaaattcccattttcaaaaaggaaaagaacatacttctgcagggcagaccaaggagcttaatgtctacctagtacaatgttttggtcaccaagtgatgtcaaggtgtgcacattacacctatcatatattaaaacaaatcacctcatgtaactttgactttcttcgttgactgcagaagatagaaagactgtattttatttcagcaaagtatatggcaagctgtctcacagaaatccttgaaacaagctggaaaacattccaaaaaatgaaaatggagaaagatttcaaatgtatactgctaggctctttcttcagacctgcctatttatcatattaataactgactcagatggtgcaggtataacactcttcaaacaggctggtgacatagtcataaagcaaaaacaaatacattaaataacataatccagattcaaaaagatactgagagattggactgtttagttgtgcttagcaagatgaaatgtaataggaaaaataggtctacatttggaccccaaatccaaatgtacaaatacagaatggagaagacaaggtttagcagagagcagggagggggaaagacttcgggatattgacagtcagctcatgatgagtcaattacatacgaagaatgtggagtgactgtcaaaacataaatgtatctaatgagagaggtcacaatattgctatgttttagtcatcctacaaggctcagagtacagacaaactgaaaactgctcagaagagtaaccagggtcaaatgtaaaacagataaagaaacttgataggcacagggggagcagatttggcctgaggtagtaaggttcacaggttacaagaaagctgtcttttaatatcttgaggtactctcatacgcaagaaatattagatttattctaagtagaactagcactagcaagtagaatgtacacaaaacaaatagcgtttcaatatgattgtgtgagctattcaaggatagaatgagctgcatttagagttgagtctccctcatcgatggccagatgacaaattggcaggaatgaagcagaggggaataaagcatcagatggctggtgagaccaggtgacctttaaaatatcttccaattctagttctatgattctatttttctagactttctctatgtcaaaccttaagctccaatccaaatggttttctcactgtttctggaacaagctttacacatgtactttcctgtatctatacttacttccaggcaattttctcactcaggcaaagacaaagaatttatctttctaaatcttatccactcatcaagaatgaacccaaatattgtccttaataaagaattctatgcctaccttaatctgatctctctctctcctctgaataatgaaacacttctagggccatccttttggcaattaattacataccacccttagactcctcttcttatgtcttaaactgctacttaactttttattaataagctctctcttcagctaaattaaaagctccttaaaggtaggtctgaaacttatattttgtattccctctacatctaggagaacatagtagatgctcaaaaatagtcattggttttcaatactggaaacatttttattagaatagttgtttttataggtaaatggaaaatctactgttcaactctagatactaacatatatgacttccagctcagatacagaactatcagaatgagatgctgccacccactgataacaaattctaaccagagaattttttaaaatggtgaatcaagcttgaaaaagttccaattttccaacctaaacatacagcttggtaaagatgccttaaaacttcttttaagcaaagtaagactaacagaaccaaactagagagtaaaatatgttacaaacaaataatattttagaaaaaaatcctttttatttcttttcatgtaaaatgtattaatgtgtggtatgtacactaaaattttgattcatgtaccttggaacacagcttaggaaaaaataaatgtgtcatatatatgtcatatgcagcccagaacatatacttactccctaaacagcaactaacaaacacaggtcctagacaaagtcaaaagagaattctttatctccttagataaattaataaagattattaaatacttactgaagattctgggtctgacaattcatctaataatttccttgcatccactacagcttgatagagtctcagatttttgccatcagaagcaacaaagcaagcacttgcagaattgcagtatgtgcctgagaaaggaaaacaaggcctctgggttctaaacatgtagtgtatttttcttattggctaaaggataagaaacaagtattcacattttttttaggcttaaccatggtctagaatcataattaaacaggcacaataagtagatacaaaattattaacaaaaagtttaattaaaaaatggattatgagagaaaaggttaaaaacttctggaagttctaaaaatcagtctcatgcctgtattctgaatatttattaaaaatcaccttaatgaaaactgaatacttattaaaaatcttaatgacaacaaatataaaccatttcgtatataacaaataatagtttaaaagcttgtgttaatttcacaattacaatgaacacttacctagacagtaactgggaatgagagttggaagccaagccacattagagaacgctgaggtatgtaaagagttaattcgagccaattctgatactcctccagtgtatgacaaaggtcctattgggtctacacgccacagaataagttcactgtagattgcatttgggtcatgaaatgtacgagttgctgcatttctaagaggttgtttcgaggaaccttttatatgttttacagggtccattaatctacttaatttattgtctgagtcccactgacaatctaattcaggagtcaatagagcattatgatgagaggatgtcaataacagtggtaaaactgaatgacatgccaggtcattgaggtgaaatcgatgaccgcaatatctaaatttgtgagatacagttagaacagtggtaaaggcagacttatcagcaaaagtgactgcccactgatttaaagaaccatctatgtgtttagagatcatcattactgtgggagctaagatgttcatatgtgtactgtgggatctagagtgtggctgtgatccgtgaggactgcctacagacatcccctcctggtgtaacagcgtgtggtgagaatcttttgtcgcatttatacaggcatacatcatgatatttttactaagagagcttgcatcaccagagggaaatgcaacaggaatccgagaagaaaaagaaacctgaaaaacataattatatgattcagtgcaaatagtttacctcctctcaaaaaaaagacttctattctcaaaataccaaatctcagcttcttatcaaaaaatgtcattttcaacctctttatggtccagtccccttgctctatttaggtaataccatatctctattcatggcctaagagaaggctgaagaaaaaaagttcaagtgctttgcttgtacaacaaaatgaccacagccacagatctaaatagcaataaagttgagagagatgacaaaggcagcttcgtttagctcatcaaattggccacaaggaggagctcatcctgattcacattttcagggtagtttcttaatcttattcaaaatattattaattccctcaaaaatcaacacatatatttaaatattcagtactgcatttcaaggccaaattcattatcttctaactaatcaagtttgctaagcttatggtcactgatcccttctgaaagaaagaagtattctttactcagatgcttatcaaaaccaaaattttcagtaattctaaaaacatgctaactctacaaagcatttatttctttttactattttaagaaatgtaataactatttcatcaataaaatatacctgaacttgtctaaatattccaggattatattcatccaaatacttcacatgccacactagaaaggtaccatctacagggtgtattgtaaaaagcatatcaggattcttattccattcagttagcagcgtttcaatcttccgatcaagcagaaccgtaggcagtggcattggtacactaagtcgtgagtaagttctaggacttccttctctttctccatcttcatgttctgatgatcctgtacctgcctcagattctctatccagggataaatctgaaccagaaaatatatttatcaatacaagcattaaataattcatttacatactagactataaataaatggcatactatctttaaaaactaaatctcttttccaatttacagtcagaaaaaaaaacaaaggaaacttttgtctgaattgaatgttactacagttactacttttagataaattaaaacttcattcaccctatcattattactaccatttagcaaaacctgttccccagaaaaggatatggcttccaaagaacatatagagttagatgatgtttgcaggggctagcagagtacctgatccaaggcagatggtcagtaaatacttgtgtaacaaatagaaaagtaaaaaggaggaagagcgggaaggaagaattcaaaactaaaagtggtaccacagaaagctgttaactttggagtaagtaaaatctgaacacaggatactaaccatggtctaatttcatatgtaaaccccgttctctatcctcctgtgaatgttcctcatcttctctatctgcatcatcattttcatgatctacctgcttatcagaaagttttcgtaattgatgcataaatacttctgtagatgatgtaaaatgaaattccttgttgtttaaccaatgaactacaaagcccccatttccatcatcaacattaaatgcagtgccaaccaagacatttggaatatctgtggaaataaaagagatttcaatataattttttttatttctttaaaaacatgacaagtgcttacaatgactaatctatataaagaaaaggtgctaaacaagtcaacataattttagcagcatttgtaaaaactttaactgaatttaatggtaaatgtaaatcttaagaattaatgatagacatatgaaattaaactattaacttaaaaacaaaatacacgaatgcatcaaccttcagtgaattccagtttggggacaggggatgaaaaattaaagcagaaaagcagctataaaagagataactagagaagtttaaatatgaactggatattagatattatggaattacttatcattttcttaggtatgatgatattatgattatgtgagagaattttaggagatacttgctaatgtaagggtgatacaccatgataggtgtaacttactttgaaaagactaagaaaacatttcgaccatgtgcggtgactcatgcctgtaatcctagcattttgggagggagaggcgggtggattgcctgagctcaggagatcgagaccagcctgggcaacacggtgaagccccatctctactaaaatacaaaaaattagcccagtgtggcggggtgtgcctgtagtcccatctacttgggaggcttaagcaggagaattgcttgaacccgggaggtagaggttgcaatgagctgagatcactccactgcactccagcctgtgtgacagagcaagactccgtttccaaaaaaaaaaaggaagaaagaaagaaagagaaaagaaaacatttcatacacatacacacagagacatttgccacatataaagcaactgtggcaaaatgttaacaactgttgaatcaaagtgaagaatataaaagtattaactgtactattcttccaacttttctcagtgtttgaaactttactaaatagctgttgggaaataaaatcaagaaaaaaacacaagaaggcaggcaaaattctaagtataagataatttctccatttgaggtaactgaaatttatgaaattgatgagttcatgtaagagagtataaattggccaggtgtggtggctcatgtctgtaatcctagcacttctgaaggccaaggcgggaggatcgcttgaacttaggagtttgggaccagcctgggaaacacagcgagacactgactctacaaaaactacaaaaattagccaggtgtagtggcacacacctgtggtcccagctactcaggaggctgaggtggtaggattgcctgagccggagaggtcaaggctgcactctagcctgggtgacacagcaagaccctgtcctcctccgcccaaaaaatggtataaatcaaaaacttaatctccttaatttcaatccatattataaataattcattcaacagaaggaaaaattgtcctttgcaaaaagaagtgaaaatctaaagataaaatgcatggacattctggtaatgttctattacaataaatatgaatgttaaatgctctaatttgttctttctttccagttcctggatgactattctggttttgtgataaaaatgaaataaatcatataaaataggatttgtgaattagcaatcctataaaacactacatcacctatgtgcctatgtagtaatcttgctcagaatgttaaacctaaatcttattaacaaatattcagactgtgagacattttgaaagaaaactgagagacaactttttgagactaacagatttttttttgacaattgagaaagggactgttctagattggaggaatttaaagaaaataatctgcatttaagaaaggaatctatatttgtatatgaatggtatattacatgatattattttatctatgttcctcacatgcaataacagtattacagctatggaggcaaattccctttttactaaaagatacattcttaaatatttaggtaatggaaaatatttaggataattagggtatatttagggtattgtaatcaacaactttactttcaaatggttccgtcaaaaataagggaagaggcagcaaagacatatctatacaggcagaggaggagaacaaaagaataaatgacaagatgttaatatgtggtaaatctcggtaagtggtatatggatatttgctgtactattctttcaactttcttgtagtttcaaaaaattttttgaaaaaaaagtgaagaggacaagtcctaacaatataaaattatttgcatttagtaatctatttggtcaacctaaatgttatatttacatgcagtaactaaaaatgcatgatgttaaacatttttaacaaaattgtttttaaaataatatgtaggtaagttaggatgagcatggataaaattagtgaaggttagtaaagaagatggggaagaccaaggcccaatggctacaagaacatatccagtccttaggctcaaatgatgtgacagaatgctcatcctctgtgatcctattccatctaattaggatagtgtacacagttaaaaagccaaggtttctaatatgtattgaatttagtgcagactatcacgaattgcattttgttttgaagttgaatttttatcacagtaattcaagaaacggttcttttaaaaaggttaaaaattcataaaaatctaaaaccacattttgaaaacaaattataaagacattcttagaatacaattaagatattagataagaaaggataatataagcaaaacaacatttaatcagatggcaaagcactgcccaacagaaatataatgcagaccaaaaatgcaagacatgttaagtaattttagatatttcaatagccacgttacaaaaggtaaaatgaaacaggtaatagtaattttaataatatactttatttgactcaacatatataaaatagtatttcaacaagtaatcaatatgaaataaaattatttatgaaatatttttcattattttttatactaagtcttagaaattcagtgtgtattttacagcatatctcaatttggaccagccacatttcaagtgctcaaatagctaatacggggccagtggctactctataaaacagcacatatctagagttaccactgcagatcacccttttagaattctatttactaaatactgtatttacatacagaaacatttaaaaataaaagccccttcactctgaagcaacagacctccagttcaataacatacaactataactttatataaaactttatatagttctatgagcaatgtaatataaaatttatagcctttctcctacatttccatgtagaaggaaaacatattgcctttaaatagaagctctcaaatatgcatttgccaacacagaacctgcctcaaaatacttctcagtcacataggggaaaaagggaaaagaaaatattcaggttagaaggaaaagtgttttccttagtataggacaagaaagtctacaagggtagaaaacaagatatgctgagatataaggaaaactttgtaaaaatatatttagaggaggttataaagaagagttgggaagatttaaactgtgaagtgagagaaattacactaatttaccaggctgccaccacttgtgataccaggttcaatcacagctctaatttactaggaatgcttgttatagtctagacaaagatgctcagaaatagttactgaagttaataccctgagaatcacatagtcccaatcacataggcccaattcaaaaaatggtactttatattatatctctactccaattaagtattttaaaggcaacatgaaataataaaaaacaggttatgaaagtagttccacttttctatttatttacctgacttcaacatatttatgggaaataaaactttatcctttacctgtggcagggttgatgcttgctgcaatatgaaaatgacagagtgcatttgcatggtgggaaatgtgtctttgaacttcatgcattgctgtctggtcgggcattaattcagcatgagttacaagaacagatgacctcctctgtcctttccttaaatttttcaaatggtgtattgtctaaaatagaaaaatagttgctgagtccaactctggaacctctaataaatgccaaccaaagtactcttaattattaagaggtttaagatttttttctccataaaaacctgatcattttaaaggaaactttttaaattacagtagaactattttggatgtattctctacagttcttgtaaacttttagttcaaggcaaaaagcagtgtgcaaaaatacttattcatggtatctataaaacatgaataaagattcccgttaatattaggaggtccaaagatttttttttcaggatatcctagtactgagacagaattttctagtcataagagtaaaaaaaaaaaattcctgagtcttcctaccaggaagaatattgcctccccaatactgcctctcacttagaattaaacagccagctaaacaatcaaattcatgatatctattacaaagaacaaaacagggtatgaaaatacagaataacaaggggaacctacttagataggagtagacaaggaaagacctcattaaaatgttgatctttaatttgtttaaattgttttaaacaatttgcaatttggatatgtttaaatagagataaatctatatgattaaaattcttcattagcatgcgtgatcatgtggactattttagtcatggggccatgtcattcttggcattatcttttttctccatatcacggccccacctcacagtaattccttattctgtaacttaacccactccgaagaccatgtttcataataattttttattactttcctttgttccccacattcaattaaataaagtataaaatgttatcaattctttcttcattaaagtaacataactggcacatcctctcaatttctacagcccttctcattttgcatatggaaaacagtatcaggtcaatggtgtgtcccccacctctggtctcccactacggggttgctcattgctttgataatagggttaagattgacattagagaacccctggtcaaaactgcctatcaaattattttcactggatctttgacattaaccatcattttaaattagactgacaagactgatctaatactggctattttctcctagaaacaaaacatataacttaagaatatatacaattatatagaactaacagtaaggagttccataggaaaggataggatgtcagaaagccaagtggctcgtaagtcagacaattacgttttttcttttaaaaactatcttaacatattaattaataatattaataaaagacagtaaaaacttgtcaaatcactggttacatatttacttatatttctgttctattttacatggcaataattcaatttaacaaacacttgaaaagcaatatatcaggtaccatggaggatacaaagatgtctaaaagcccttagtttccaaaggctcatatataatttgaagataaaacacgttacataagtataagtaagtgatcacaaatatctacttaaaaattaagtactttgtcctactaaatatcaatatcaaaataaaagataactttaactgttttgacatctgcttttaatttcacttacattttaaatattgaaaaaaatgtaaaaatagcgcccaatcacagacagtgatatagtttagatacttgaccctgcctaaatctcatgttgaattgtaatccccaatgttggaggtagagcctggtgggagctgtttgggtcatgaggcggatcccgcatggcttggtgttggtattgcctttgcaatagcgagtgagttctcataagatttggtcatttaaaaatgtgtggcacctccccgcaactctctcttgttcctgcttccaccatgtgatgtgccggctcctgcttcaccttctgccatgggtaaaagatccctgtggcctccctagaagccaaccagattctggtgccatgcttcctataggaccatgagccaattaaacctcttttcattataaatcacccagtttcagacgtttcttcatagcagtgcaagaatggcccaatacagacaatacctgaggaggcctacttcacataaaacttttaaggaccacatccttaacttgtcaaagttgtataatatttctgcttggtaaaatggcaaagccactttgactatgcaacctttaaactgtcaatgtaaatatataatgtaaaagtatagtcaataatgtagactgtaaacaaattaagtataaaaaacttataaagtattactgcataatatgatctcaatcgtataaagaaaaatacacatattcacaggactagaatagttgaattataaattccgtatttcttctccttttcttaatccaattctagaataagcatacagtatttgaataataaaaaacagccacaagaaaaatagtaatctaagtttactataataaatttctgacaattcaaaataatgcatatatctcattgtattacctaatcatatgggacacaatcatttgtgctatgtgttataacgtaatttcttataaagcacttttatttcatactgtatttaaaaattataaaaattatttcattttcaaaatcttcaatcatggaaactccaaagcagttcatttgtgtctaatatcttaataaacatctttattcttaaggaacaaaatagtcatttttaactagaacaataagattttaatctttatgaaacaaaagcaaaatatttttaattacaactaatttcaaggatctttacatattttactaatacttagtcccatagattttcacatgtgacatgcaaaacaaaagaattaaaataatattatctagaacttgagcataaaatatcaatttttaaaaaacttttaataatatttacctataaaacatgtctgagatcattaatttctgcatttggcttcttagtggaataaatgagtagtcttacaagcataaatgagagtttattgctattaatttcactcattacatgtaccatgtgtgccatctgcatgttagttcatgaatttccaccaggctcacattatcttcaaaattcatttaccattttaaataatataatacctcaagagcatgctgtattctgtctttgtgtcttccagcatgagaaaggctgctggcaatgctggaagtggtagtctcacaaatctgctcacccaaaagacagtcttctggtaataaagtttctgcccagagccggcacacaccatcatgacatgaagttaacaacacattacagacagaacccctaacaacaaagagaaataaataaaggttaatgtgaatatcaatcccattaactaattaatattttggttcttcatgcataaagataacattagtgcaaaacactatggaaaaaaggaatcaatcaaagagcttgaaatcatatatagcatcactgtgaacatcataagaaccgggaaattgttttgaaaaaagaaacagaaattactgccagattatacattcaggctctagaggattattagtatctcctaaacaaaacatacaaactaaacagcaaaagaaaacctaatcattgcaaattagagaatgaccataataaaagatcattaaatgtaattaaactatctggcttatggcagtagtttcatcactttacatcctccttcctataacccaaacagttacaaacaaataattatcttcatcataaaactgtaaggagaatataatttcaaactataaatccatttccattaagttaaaataagcaaaaacggcatggcatggagcagctaaagtaacttacctgtttgttacaaaggaacaaaaaaatcattctccctttaaaaaaatgctcacacagaatctaagtcaaaagtattctgcaaatagatgcagatgacttaagcagaatatatttagattcaaaaagtatataaatttcccacattatcatttactgagcatctctacaatgtgtgctatatttcctatcaggcataaacaatcctcagatatatttagtaggtaaaataaccctccctcaagaacaaactagatttctaagcaagcttctgagtgcccaacagctttcttagacctgtatataataaaggaatcatttgtataagcttttttgcagtttatttaatcttctaaatacctttaagaggtgccacaatgatgaggaaaaaatgtataataaaaaatcctttgagaagcttctgttgacagctctcagatttaaaaaaacaacaacaaaaaaaacacaacctggccacttttttcagagtacattatatgctttaacaccatatacataattgacataatactgatctatttcccttcaatgtgtgctttcctgttatttgcaaacattttcttgctaggatctgctagtaccacagctactaccaacaatttcattggctggacacaaagtatgtgcaaaggcctgtactaagcacttcccacccacaaactacattttagtttcacagtaactctctgaggtaggtactattactaccctcactctacagagaaaaactgaggcatagacagcttaagaaatttagtcaaaaactcatgaagctaatagtaggatttgatttcaggcagcttgatgccagagcctatgctattaattgccaccatgtaaataaaaggactttattttcattatttttataaacatttaaggatgcaaactaaagctacatgattcattcatctaacctgggcatatacttgctagttttgcgccacgaaaaacctgtcacagctcggggatgtgccaagtaaacaaaagaaaattgagtagaggactgtctcctttttacttcatgatgatcctgaggtataattgaagacttccaaccagtcataggataccacactttcaaaagacaatcatcctgaaaaatacataggtcaatataaaattaatttgtacatacacaattcaaaatttaagtggtttgaagaagttttaaaaattaagttacatctaaaaactaatatgtgacttatacataatacaaaacttatctcaaaattacattactttaaagaaaactattcttgaaaaataaatgaacagtctattcattatcaatcttttctgtgtgatattgtttttcaaatgcagactgatgccaaattctcccatttagacataaattggtcagtacagaaaaaagattctgatgctagccccttgaataagttagttaagaaagaattagaaagatccatgctatcttttcagtcattgttatcctttcctttttgaagtggtctttaacagtgaagcccttcacccttcacctcacgaacatgaattgtttcttgctctatatcaagagtcagcaaatttttctgcaaagggccagatggtaaataagttaggctttgtgggctacacaggtctatgacacagattcttctttttttcttacatccctttaaaaaggtaaaaaacattcttagctcttgggccacagttctccgatccctactctaagtgatgataaagaatgcatggaggtagctgtcaggaaccacctcaatgcccacttaaaatatttacaagtataacaataggcactgacttaatcattttacttagtcctaacaatttagttaaaggctaaacaactgtattttaacagaaactatcttttatagtgctttataaccaataataaaaactgcattaaagggaaataataaatgttatcgcttatgcaaaaatataacctctgaggaattctgcaattatgtattcctgaaaagtatgcattgacccaaatattttcatttggactagacaaacaattctgtttttttcatcttggtactcattctcaatttgtgctgcataatgaaacaaaaatttccattaatgtctctttttttggatattttaattatacagcaaatcttttaagtgtttgcccttagacagccacttaacaatgtactagttgctttcctccaagtatcttcttcagcatagcatcattttcacataatcaaatttacagcacattctatgcagtggtttcagactacgtaacaaagaaattctacaggtacccgagagcccctcaaaagtcacaatggaaatacaaagagccccaggagcaggtgatactctagcccttctcccattcccaccaatctccccctcaaatgaagcagtccctatttcatctgttattgtctaaaactgtaaaaccacaacaaaattaagtaactagtaacagaaagttatctagaaaattcccaaatatttgaaaactaaaaacttctaaattacaggggaaattttaaaatatgttgaaaatatgaatgaaaatgaaagtacaacatatcaaaagggggagttgcagttacctgagtgcatgagggaaattcctagcttttttttttaagttcacttttgtttagtgtttttgtgttatttatttatttaatctccataggttttgggggaacaggtagtgtttggttacatgaataagttcttcagtggtgatttgtgggattttggtgcacccatcgcccaagcagtatacactgtacccaatttgtagtcttttatccctcactctcctcccacccttcctccctagtccccaaagtccattgtatcattcttatgcctctgcatcttcatagcttagctcccacttatgagtgagaacatacgatgtttggttttccattcctgagttacttcacttagaataatggtctccaattccatccaggttgctgcgaatgtcatttcattcctttttatggctgaatagcattccatggtgtgtatatatatataccacaatttctttatccactcattgactgatgggcatttgggctggttctatatttttgcaactgcaaattgtgctgctataaacatgcatgtgcaagtatctttttcatataatgacttctttttctctggatagatacccagaagtggatagctggatcaaatggtagttctactgttgttctttaaggaatttccagagttttccatagtggttgtactagtttacattcccaacatcagtgtaaaagtgttccctttataccacatccccaccaacatctattattttttggttttttgattatggccattcttgcaggagtaaggtggtatcgcattgtggttttggtttgcatttccctgatcattagtgacgttgagcattttttcatatgcttgtcagccatttgtatatcctccttggagaattgtctattgatgtcctcagtccattttttgatgggattgtttggttttttcttgctaatttgtttgagttccttatagattctggatattagtcctttgtcagatgtatagatcatgaagattttctcccactctgtggactgtctgtttactctgctgactgtttcatttactgtgcagaaactccaggaaaggacatgacaaaaaaaggaaaccacagaccaatatccctgatgaatatagatgcaaaaatccataacaaaatactagctaactgaatccaacagcatatcaaaaagattgtctaccatgatcaagtaagtttcatactagagttgtagggatggtttaatattcacaagtcaatacatatgatacaccatataaacagaattaaaaacaaaatcaaatgatcatctcaacagatgcagaaaaagcacttgacaaaatccagcatccctttataattaaaaccctcagcaaaatcagcatagaagggacaacccttcccctcaagaaatcttctcatcctagcccttgcaaaacccagtttttcactcaaaggcataatcttctctcaaagaaaatgctgcctttttaattataaattgacaacttataattgtatacatttacatagtatgaagtgatgttataattcacgaatataacatgataattacatcaagctaggtaacatatccatcacctcaaatacttaatgttttttatggtgagaagacttgaaatttactcttagcaattttaaaatatacactattctatcactaactatattcaccatgctgcatgagaactcaaaaaaagaaaagataaattccattttttgaagaaaacaggatactttaaattacttgcaaattttacaaaataaccaagtgttattttttaaaatgttccaatacaaactttatgaacataaacgaatagaatttcagcaaacatctcctagtaagcgaaccagagaaaaccaattcttaaactaaagatttaatcaggtatgtcacgttgggtagaaaaggctctttagtaagtaaggctttattttaagttcagatagaaatttaaaatactcttaagcctaagaaaaatttaatttaccacatttataaaaaatagatcttaccagccaaagtgctcaatggaccgtaatattaaaaatcctggaagtaattgaatttgagtctcacaacacctgaaataaaaccctgtcatgtgtagcagaggcggtggaaaatgccttctagtgggagatccacagtgaccatctgttttatcaattcaaatttggctttattaacagaagcagaacagattgtaccaaaaaaaaaaaaactgcccaacattccaaagttactttctgttctttttatcaggataatcttaatcagatgtggtatattctcaaaaatgtgagaaaatagctttttcaatccaagacacatttgcttaacctccataggatccttaccagaaaagcattatctttccataagaattatgaaacacttaactcttaggataactggatataagcagcttagggagacgtgactaacacaatgaaaataatactcaataatctagaaaataaaatttttgtggaaattttaacagttcatatgtctctttcagggaagggtaggcatcctgtagtttgtatcaagctactattcttaattcaatctaattacatatattttactatgtttcataagaaccaattattatacatttgattatgtccagatacagatttattaaagagccacatttcactctaagcaaactcaagggctttccaaccattctcaggcttaaaaacaaaatcagtcctcaacgtactaatagataatgatgatgtgccattaactgcctgtacaactatggaacatttacaagatttactcaaacaacaagtatttattgaaagaagccactatgtgaatggctggggatatagctgaggcagaggaagagacagaaataataaaatacatttcctaatcccacagagcttattctttagaaaggaaggcaacattaagtaaggatataaattattgttttaattacaattgtgataagcactataagaaagaagcagagggcaccaggaaagtatttaataaggagacttgaccttgcctgggagatcagaggatttcttaagcaagtggtatttaaactgagagttgaaggatacataaaagacgaccaggtaaagaataaggaagtctgggtattgtaggtattccctagacagagggaacagcacataaaaagacgtggaagcaggaaagagcttggcatattcaaggccttgaaaggacatcagtgtcgtaggcattaaggtgggaatgaagctggagaggcacggaagggccagatcatacagcagagcctcacaggccatggtaaagatcataatcttcattttaggagcaataggagtcattaaaaggtggtgaaaaggagaacggcatgttcaggtggctggctcctgtgggcagaccaatcagaggatgtttgcaggacatcacttaagagactactgtaaaggtctgcagccccgaagatgctgacacaggtagtggcagtggagggcagagacatggacttcaaaaaccttagctgcttctgtgatcactaagatcattaaaactttatgattccacaaaagtttctttgctttaatttacgcacagttaggcctgtactatctacagatgtttaactgttctcccatgtgttctaggtcttttgacaaaattaactgacattccctccttgaaccttttttcttggcttctctaatgtcacattctcctggttttcgttttatttcagtggttactccttcccagcatcctttgtaggtatctcccctctctctatcatttcttaatgtttgaggatcctgggatttgatcctgagtcccattctcttctctaatacacacgttctccctagttaatttcatccagacccataactttaaacaccgcctttggctaaagaattcaaattgccagagaactcctgactgtcttatcctatctgatatgttaactcagatgcatctcaaactttggtctaaccactacactccagctttctgttgctctttaacaagccctgctaattcctatttcagagcatttgcacttggtgtttgttcccttggccaaaaacactctttcccctgaacttcacagttgtctccttcgtagtattcaattctcagtttaaaggttatctcctcagcaaagctttctctatagatcactcactctaacagacacccaatcacactactatatcatcctgtcttaattttctggacagcacttgttaatacttgatatttttttctgtctttcctcaccagaaattaagtcctataagaacaaaagccttgtctatcatcttcatcataagactgccagcacacacaacagttcagggtatatggtggtgttcaaaagaatatctgctaaacatgtgaatgaaggttgttaatttcagatataatttcaaatcaactttttgtccaaaatgcactatcaattttacgtatataaagtctattatgatatgaatacaactataaaagattctcatgtgtctcacaagtgcagattgctagaattctaaaatgcattttctttgccccgttatatgataaaaaaaaatcaaacaatatatatgttaaagtacagttgacccttcaataacatgggtttgaactgcacaggtccacttacacgtgaattttcttctgcctctgccacccaagacagcaagaccaacccctcctcttcttcctcctctctcacctactaaatgtgaaaatgatgaggatgaagaccttatgaccatctacatccacttaatgaacggttaatttattttctcttccttaaggttttcttagtaacatttttcttctcttccttaaaagagtatagcacatattggatgccacatgcagggtttaaaaaaaaaaaaagagtagagtatacaatacctataacatacaaaatgtgttaatttattgtttattttattggaaaagcttccagtcaatagtagactattagtaattaagtttctggagactcaaaagttagacagggatttttgactgtgcagggggttggatcacctaactgccatgttgttcaagggttaactgtacatgagtcaaggaaaacttaagtgtatacaatacctatccatgatcatagtgccattaacgatatttaaaaggaggcaataggaaaacatgctccaaatgatgcacagtgtgtacaatatccaagctgacatcagcaatgattaactgggaatatcataaagctggattccagtatgactctccagcagctctctgacatgctgaactggtcctatattaaatcatccataggttcacctattatggatttgttaagtcaaaggaatgactggctttattaatcacttattaacgtggtaatcctaagaaatatgagtaacaaaaaaaagacaaatctgtgagttttttcagtcaaattttaggagtaatggggtatttgtttttaaagatccaaagttttaaaggtgactgcctgttttagagatcaagacatgaattacgtaaaataaaattaaaaaggaaaaaaagacatgaattatattatttctcaaactgtttttccagtgattctgacaagtgtacccttcatgagatacccacgcttctcaagacattacagaaaattcttcacgtgtctctacatttctatccagaaatactgttttattatttgtagattattgaactggcttatcaaaatttcagtgttttatttttaaaatctagtttaaaaacaatgaggcaaattagatggagtggagtgtgcaggggtgagagttagcagaagatgaggttgaagcagtgacgagagtcctggtaagcatggagcatgctaaaccatcacgaagacttggtcttttggtaaatgaaatggaaaagcttttgacggttttgtacaaaagaagagtgacaagatctgacaacattttaaaaagatcactccaggccaggaacagtggctcacacccataatcccagcactttgggagaccaaggtgggcagatcacttgaggccaggagttcgagaccagcctggccatcatgacgaaactccgtctctactaaaaatacaaaaattagccaggtgtggtggcacacgcttgtaatcccagtcacttgggaggctgaggcacaagaattgcttgaacccaggaggcagaggttgcagtgagccaagattgcgccacagcactccagcctaggcgacagtgagagactctgtctcaaaaaaacaattttttaaatcactccacctgctggtttgaacatagattgtacagaagtgcagcaaaaattgggaaaccaattaaaaatttaatacaataatacaagtgataaataatggtggcttcaaccagattataagagtggaggtggtaaagaagtaagcagattgtggatatattctaaaggtgagccatcagggagtagattgaggggttagggaagtagagatcagggaagaggtacaggcaaaaaatacaaagttgaatgtcatcagcatacaaaaatggcatttaaatggcatcagaaatcttaagactagaagagccctgggcactccaacatttaaaagtagaaaagataacagtaacaactaagcaggggtagccagagttaaaaacaggcagagtacagaagacttttagggcagtaaaaagacctacaaaattgataaactcttggtgagatgaatgaagaaagagggaaggcataaataatatcaaaactgaagaagaaatcactatacatgtattatagatattaaaagataaggtgttttacacaattttgtgctaataaatttgaaaatctaaataaaactgaaaaatcataggtaaatacaacttaccaaaactgacatacaaaagaaaaagaaaatctgaataatttaaaaaactgaatcctacaaagaaaattcctgatccagatggcttcaccagcaaatacttaagaataaaactatatcaatcttacataaactcttcacaaaagagagctttccaacccatttataaggccagcataacatcaacataaaaatctgtcaaggacattatgaaaacgggaaaattattggccgaatctcactctaacacataaatcttaaacaaaagatcagcagatcaggccgggcgcggtggctcacgcctgtaatcccagcactttgggaggccaaggcaggtggatcacgaggtcaggagatcgagaccatcctggctaacacggtgaaaccccgtctctactaaaaatacaaaaaattagctgggcgtggtggcgggcgcctgtagtcccagctacttgggaggctgaggcaggagaatggcgtgaacccaggaggcagagcttgcagtgagccgagatcgcgccactgcactccaccctgggtgacagagcgagacactgtctcaaaaaaaaaaaagaaaaaaaaaaaaaaaaagatcagcagatcaaatccagcaaggataacacattataatgaagttgggattgttccaggaatacaaggtttacaaaatcagtccatgtatttcatcttattaaaaaattaaaaagatggccgggcacagtggctcatgcctgtaatcccagcagtatgggaggccgaggcaggtggatcatctgaggtcaggagttcgagaccagcctggacaaaatggtgaaacttcatctctaccaaaaatacaaaaattaaccggcatggtgatgggtgcctgtagtcccagctacttgggaagctgaaatgggagaaatacttgaacctgggaagctgagattgcagtgagctgagattgtgccactggactccagcctgggtgacagagcgagattctgtctccaaaaaaaaaagataaaaattgtctcattagatgcagaaaaaatgcttcctaaaattctatatcgtttgtggtttagaaaaacaatctagcaaacaacaaatagaaggaaagtttctttatctgaaaaaaaagtatctaccacaaacatcaacagtaaacattatatttatgatgacacagtgaagggtatccctttgagactgggaacaagaaaaagatagacctgttgtcaccacgtttattcagcactctgctagaggtcctagacactgcagttaaaaaaaaaaggaaaaatatgaaaaatgggagagttacaaaagatgaactacagctttcattattcatagattatataattgtgtacatataaaatccaaaatgatctacagatgaattattagaattaatgagtttagtaagggtgctgggcataaagccaatatacaaaaactgcatttctatataccagtaacaattattttttaaaaatttacatgatgattccatttataacagtatcaaaaacatcaaatatctaggaattaatcccaaaagatatttgggatcttcacagataaaattataaaacattactgaggaaaaaaaggtctaaaataaatggatacatcatgttcataaacgggaagactaattatagtaaagatgtcaattctccccaaactgacctacacagtcaatgtaataccaatcagaatcataagaggttttctgtttgctttgtaaaaattatcatttattctaaaatttatatagaaatgcaaagggccaagaatagataagacgatcttaaaaaagaaaaacaagaggggaggacttgccctaccagatatcaagacttaatttaaagctatagcaattaagtcaggtgacactcatacaaggaaagaccaatgaactagagaaaagagcctagaaacagacctacagaaatatggacatttgattttatgacaaaagtggtaatgcagaacaatgaagaaagggaagattttttccaataaattgttcaagacaaccagatatccataaggaaaaaataaaacttgaccttcttcaaatcacatctaaacattatttcacatagattttagacctgaatgtgaaagataaaacataaaatgtccatattctagaccagaggctcttggcctgaggtcctctgacccaaaggtcctgtggatagacttcaagatataaaagatacttttgacacatcatttgtatcccatcatgccttagcattttggtgtgccagtttcaactgcaagcatctacatctttttgtctgaggtcttctaggagctggttatgagtgctgagaactgatgcctggccctcacctgccttcaaatgatgtgtgtaaagaacatgtgtaaggaacacgatgcaagtgaggaacacgggttcccagaggacccagagattcaagcttcttaatacacttaataaaggttattaagtgccttcacttccctccttccaatccagtatatttcgtgtgatcattccccatattaattacttacacttgaatccttatctcagggtctgcttctgaagaaaccaagaaaactaagacccaaaggcatcatgaaccttaatggggaaaaacaattacttctctattttcataaatgctaattgaaaaaaacaaagtagtattggcagtacatatgattttgtctctaacagaatcaaagatgttttcatatcacatgacagttactgcatatttcaaagtattttttacactcatttctactttgaaattgttagttattggaactactactaaaccgcacatgattgcagtcttcctgtctatattgttcatgcaaccgttaagcaactacctctgtgccaactaactgctgagcaataaaacagtaaaatttaacgtttctacaactagagatcaacccaaaaagccttcagtgaattttgttgttcttggaaagcctaccctcaccttagaaagtgagatactgaaattttaattccacatacaatagctaaacacaattaaaactgcccatattttaagtgcaatttttgttaccgaatgcattaatttaaaagtacataatgtctctatcacaaacgtattttttaatatcttgaagctgtatttcaataatttcttttgtaatgctacgtattttattttatgcatttaaaaacatcatactacgaggaaagttattataggcttcactagatttgcaaaggaatacacagcacaaaaaaacttaaagcaactctggcctagaagattatgtaacataggaaaaccctcagaatctcacagtatgaaaaacttattaaataggactcagaaaaacactgatatatttgacattaaaatcaaatatctctcatcaaaagataccattaagagaatgaatgagcaactaatggagtgggagaagatctttgcaaaacatgtaactgacaaaaagctcatacccataataaagaactcctacaaatcaacaaaagaccaaaaactattttaaaaacaggcaaggaacttgcccagttactttcttttaaatcagtcatccaaatacccaataaataaatgaaaaggtatttagcctcattaataatcagggaaatgcactttaaaactacaaggaggccaggcacagtggctcacgcctgtaatctcaacacttagggagtccaaaacaggaggatcacttgaggtcaggagttcaaaaccagcttgggcaacataaggagataacaactctaccaaaaaaaaatagataaaacttagccagccatggtggtgcatgcctgtagtcccagctacttaggaggctgaggcaggaggatcgcttgagcccaggagttcaaggttacagtgagctatgatcggccgatgtactccagcctgggtgacagagtaagactctgtctctaaaaaaacaaaaagcaaaaaaaactacacggaggtggtacttgacatctaccaaatttacaaaagtttaaaagtcagaccacatcagcactggctaggagcaacaggaactattgtatactatgagagtgtaaattagtatatcaactttggaaaacagattggtattatctactgaaattaaagatacatataacatataacccagcaattctattcctatgtatatacccaagagaaatccacacaagagcctaacagacatgtacaagacatctgctgcagcattatttaatacatgtcagaaatggtatggcagatcaatggaaaaagaatgaactattcagtaaatgttattgagacaactttcatttggattagggacttaattataagagattaaaattttaagattttaggagaaaataaaaaagaatacttttatagcatcacagtaagaaattttcctaaacaagattcaaactacaattaactcactatatattgtggatatttttgtaaaatctttatacttcaaaagtagatactgaaatatttacagacgaatgacatcagtgacacaagcctaaataatccaactgggggaggagtagtacagatgaaacaagattggctgagtgataactgctgaaactaagtgatgggtacataggagttcagtacctttctgttcatgtttgaagaaaaatttttttaatttagggcatcataaataaagggaaaagagaccagcctgggcaacataatgaaaccttatttctaccaaaaaaaaaaaaaaaaaaaaaaaaaaactagccagatgtgatggtacacacctgtattcccagctgaggcaggaggactgcctaagcccaggaggtcaacgctgcaatgagccgtgactgtgccattgcacgctagcccgggtgacggattgagactcagtctcaaaaaaaaaaaaaagaaaagaaaaaaaagaaaaacacaaactctgttaagttcagaactgtggaaaactaaatattaccttatttgggaatttagatgagtgaaacttttttaaataaaataataaacatgaaaatcaggattctggttgcctggggtgggaggggaggaaggagatgcatggagaaagataaaggacccatttgttttatgttctttgtctcaagttgaggagtagggtacatgtgtatttgtttattctttattatatcttatataacatgttttatatatacttttttaatttatgaaatattttgtaatttaaaaaaaatcagagaattttaaaacctcttaaaaattaaaaatttaatagcagaaaaaaattactttgaagttacatctgaaaagtcccccagaaattaaaagaaaaagatgaataagtggacaacagtaaagggggaagatagtaaaatagagaattagtgtaaaagtatccatatctgaataagaaaagattcagagagagaaagaaataacacgaaagaaataatataatctctcagaattgaaagacatgagtttcagatttaacaggtcccccaaatgtcgtagcgttagttggatagtgtgctttggctttgattctgggtgagtgcaggagagtagtcttcatacaatttcttcaggtgtagtcagtgtcagtggtggctgtgagttactcattggcttaggctgtggttggtagcagaggctgtagtgaggctttgctgcagacagggacaccagacaggccagttctgaggcacccgtggtggcagaggcaggccaggcatgcaggcccttgggctcccaggcagcatacaagacgccagtagtcacaggtccaggaggaccagtccttgggcctacaggcagcttgctcaggtgccagtggttatggaaaacagtacggagttttctcaaaaaaacaaaactagaactaccatacagttcatcaatcccactaatgggtatttatccaaaaaaaaggaaatcagtgtatcaaagggatagctacactcccatgtttactgcaacactattcacaatagcctagatatagaatcaacctacatgcccatcagtaaatgaagggataaatgaaatgtggtaaatatacacagtggaatactatttggctgtacaaaggacaaaatcctataacttgtagtaacataaatggaactagaagtcattatgttacatgaaataagacaagcacacaaagaaaaagtaccgttattttctcaatcttatgtgggagctaaaaaaggagatgaagagaaattggttaattggtacaaatacacagttagatagatggaataagttctagtgttcaatagtacagtagggtggcaatggttaacaataatatattgtacatttcaattaactagaagatttgaaatgttaccaacacaaaaagagataaacatttgaggtgatggatatcctaaatactctaatttgaccatcattacacattacgcatgtatcaaaatatcacatgtatcccatatatatatcaattaaaaagtttattgagatataatatcgaaggtcagtgatttttcaacccaattctatgcccgagaaaatcaagcataagaaaaaaatctttcagacacgtaaggcctgaaaaaatgttttttcccattcacctttcttcaggaacctattgggggatatctccatcaaaacaagaaaaaaggaagataaatgatgctaagaaacagaaaatttaacaaaggagagaggcaaagagaatttcccaaagttggtaaaagaaaatccgaaaatggtagctctgctattttagactggtagagcaattaagctgaatgagagcaaagagaactcatgttcccagaatacctcctatgtgggattatactgagaaaagagtcaaagcagttctaaggatgaattaggtatatagaaaaaaaagcaaaccataaaacaaagcaattactatctccaaagtaattactattaagaataatctgtacaatcttaataacataaacaataacttctgatttacccaaaatcatgagatacctacatcaggaagataggagcaagtgaaatgaatatgtgtatatattagatgtgaagatgatgttggggatatcaacccctcacctttatcaagctaaagcctcagcttctacagtgggaaggcaaaaaataatatatataactcagggggctgggcagaatcaagaaatgggagcacctgcaagttattgaaggacatggaaggaaatagcaaaatattcaacttgacaaataattgcctcctggacacaggaattagcgttggaataatgaggcaagcagtacatcttttcattgtgaatccagtattattttactttttaagttatgtacatatgctatttttaaacacaaaacttagtttttaaaaacgcaaataagccaaggtcaaataagagtaataagaatagccattatttcccaagcgcctacaacctgtgagcaaaataccaggtcttttacaaacaccacttttattcttcaggccagctttgccaaggaggattatcccagttttacagatgagaaaactgaaaataaaaataaataaggaacattttaaattcttttatttgtttatttcgtatgtttttgtttgatcctttacctttccagcagtagcaaaatattcaccatcaggagaccattccatcaaatgtacagatactgaggttctaaaaaagagagagttaggcaattagcccttttaaaatctggtgtactgtatataaaaatggtcaagatgagatttttgtaacatcaaagtcagaatcctcagaataagactgtttttgcttccctaaaaatataaataaaatatttcacctccataaaaatgtaaatttattaaaactaatccaacattcactttgggaaaagaagaatgtaagtaacatgaatacagtatatctccacctacatgtcccaccaacatcctaaatataacatgttaaaagctgagcttatcatcatccctgactagtcttcgtcacataatctatatgactgttaatagtacatcttccacttgaaagagtggctggcaactttcacatcttccccctctccatccttacctcaatctattaatgagtatttcctatgtatcaaccctgtcaactcctgtcctggggctataactatgaaaatactttcatcctttttttaaatgattaactatagcacaaattaaagaatgctattatatgggttttggttagaaaaaaatctactttctaggcatctaaatgcaatggtaccatcaaaaaataaagatctttgtgaaaggaaacatattttaggaagcacttgcttttaattaatgaatataacaatagaaatagacactaacttgcactgccagacacacttccaatcatttaaaacaggaggaactgtattatcaatttcttcctcctcttccagaatatcatctcctggaggagcccacaactgaatagaatcagttgctgtcaacaatctattatctgaaaattaaagaatgttatgatgaatatgcaaatattatatagggaaataaatgcacatgggcttctgtttagatctgtaaactattaatattatgtgaaaagtaagcaatatcgccaacgaaaaacacttggtatatatttttttaaagtcccttataagaaaaaagaatcttctggacaacaaagattcttaaggaagatttgagaacaacaaagtaaagcttactggcaaagagctattattatcaagcaagtcaaaaaaactaacaacaaatgtattaatagaataacaaagtccccaaaactctgatatataccacataaaatgtcctcgagatataaggcataactacaaattaataaaatgtggttttacacatgaaatataaaaagaatccttattaattgtgaatataaaaagggacaacagctattatcattagaaattcctaatttttcaaaattaaagatagtaatttcctgatacaaatgataaaatgaggtgaagtttttttggtctctgttttatttccaatggtgtttcttagcaaatacaacaagagtaaagggcagtacacattaactaggaaacaaatcataactgcttcttgaaataaaacacacaaaggcaggggaaaaaacagaatagtaaattaagcattgcacaaagcactgtataccaagaaggaaaaattatattcatcaacaaaaagaaaatataatacattgatcattttcttattatgggagactatatcacattattatcatacatttaaaacaaatatttaatttaaataattttaaatacaattgctaaataccttgaggatcccatgctaagttgtatgtcacagaactcaaaaaaaactgcccagttttaagccactggcacttgagttgctgaaatacgtagacaaaaagaaataagaaaaaagaaaaagatgtttttcaaataatatcccaaaacactaccattttatcattttcttcaacttaagactttaagatctggaacaaagatgaaaatatttcactattattttcatatactgtttttaacgtaactttcattggttccactactatttattataccatattgagctccttgccatgcccaaacaaagcaggttctctcacgctttttctcatgcctataaataccttcttatatttaggatatcctattcctcacgtctccatctgcaaacccctatccttccactaagattagctaactcatcatctctgctatgaagccttctctgacatcctggcagcaccaataccacttttacattctgccattataacactgatcacatggaattagtattggtctatacatctgactctcctcccactaaattgcaactcttcaagggcagaaactgtgtcataattttgttatcttcagcgtttgtaatggctggcataaagatgttaaatgtttacatatttctttgtagtacataaatataaaatgtccttttgtgagaggacatttgtgaaaagctttgcaaagctatgttaccttaggcaagctatatgttaacggcttggcaaataatactgtttaaacggtaatgccattttgtgttataatattttaagaatatttaacaattttaaaatgtatacaaggtttcctgactacctcaaggcagaattttaaaacatagctgcatcccaacagtttgggaggccatgacaggaggattgcttaaggccaggaatttgaaaccagcctgggcaacattgcaagacccccatctctataaaaactttaaaaattagctgggcatgggagctcacacctgtagacccagctactttggaggctgaggcagaaggatcactttagcccatgagtttgaggttatagtgagctatgatgatcacaccactgtattccagcctgggtcacagagcaagactctatatctaaaaaaaatgtgtgtgtggggtgtgtgtgtgtgtgtgtgtgtgtgtgtgtgtgtgtgtgtgtgtgtgcatctgcaaaccctgcacttcattatccaaaaattatttgatattttataatcagagaaaatgctatttttaaaccctaccactgctgaccaaacaacaatcacaacagcataacactaaatactgttcaacaaatctattttagtgtagtaattaaataattcctaaaattatagacatccctaatattctttcctttagtgttcctcagagtgcaatctgtggagcaactaccttgaagaaatttggggaatgagacctggaaacctaaatgtttagtatgtgctctaggtgactcttaagtagtccaaaatttgatatccatttcacaatactattatagggaaagattaatattttaatttatactgttttgggggaatgtaaaaagatatattcaaatacatatatttaatgaaaaaataccaaaaccatttgttttaaggcatttcacttaaaaatatactttaaaaattatttgtaaatatatactcagcattcagatttagcatttgcaattttgattatttctgagtgatggtaaaaatgtaatgcatgcaggatgttttaaagggcttaattctaaccacattagatgttttgaacattaagtaagacaaatataatatagcacccagtatgaatctgaatggttcacaatgtggtatgcttaaccacttagctgagctggtaagtgagctttttaaactcctaacttcttcattcaaccaacatttaggaatacctactatgttccagatacttttttttttttttttttgagatggagtcttgctctgactcccaagctggagtgcaatggtgcagtccaggatcactgcaacctccacctcctgggttcaagcgattctcctgcctcagccttcctagcagcagggactataggcacgtgccaccacacctggataatttttttatttttagtagacacggggtttcaccatgttggccaggctgatctcaaacccctgacctcgtgttccacccgcctcagcctcccaaagtgttgggattacaggtgtgagccaccacacctggctgttccagatactgttctaagtactggggactcatcagtgaaaaaagcttcctacccttatgtacctttagataacattttacatagtaaacaataaataaataaatgctgtaaaaaaatttttaaatagcaagataagtgggggtacaattttttaaagggtggtcaaggtaaacctcattgacaaggtattagtgagcaaagacctaaaggatctatgggagctatccttggagatagctggaggaaaaacattcctgacaaagaaaacaaacaacacaaaggctcaaagagggaaggttaactgagaaacagtaaaaatgccaatgtggccagagtagaaccagagaggacaagaacttacgaggtgagctctgagacatagtaactgtgctactgagtagaagggaagttgtagtctacaaaaggcttttggctttttatctgaaagaaatatggagcagctgggcatggtggctcatgcccataattccagcaatttgggaggctgaagtgggaggatcacttagccccagagttcaagaccagcctgagcaacacagggaaactccatctctacgaaaaatttaaaaattagctggccatggtggtacatgcctatagtcgcaactacttgggaggttgaggtgggaggaccatttgacaggttgaggctgcagtgagcagtgatcatgccactgcactccagcccaggggatacagtgcgaccctgtctcaaaacaaaagaaaaaagagagagaaatatggaaccattacaaagttttaagcagagaaatgtcatgatctcctctgttgagaacagacactggggctgaaggcagcaggaaaccagatatcagatagatattagtaatccagacaagaaataacagtagttcaaactagggtagatctcagttaacacagtaaatgtcaatttgcaatattctagagacttgggtttctaaaagcactagggatgtatccgtagtgaatgtaaggatcctaacataaagcactagaccaatttttcactgatactctagtctattttcagcactagctcctaaggagctttttattaacatcaattggattctaaagttaactagattctaaaagtattctattattggttaatacttacacaatttcttttatgagaatttatgcccaagggctcaaatatacaaacagcattaccatatgaagctgcaatctaaaaaagaataaatacagcattaatatctagaaaagggtaaaataaagatatcttccttttcataataatgtataaactaattacatataatctcaatacagtattcatggtttatttccttccataaatatacctggaagtgtactggagttaagagtctctcccctgttatcaaaaaattcagcaggctttattttacatatcatatacaaggttgacctattcaaagaaatcatatttggatggacagctgccaagatggctgaataggaacagctctggtctacagctcccaacgagatggacacagaaggcaggtgattcctgcatttccaactgaggtaccaggttcatctcactgggactggctggacagtgggtacagcccgcagaggttgagctgaagcagggtggggcgtcacctcacatgggaagcacaaggggtcagggaatttccctttgctagccaagggaagctgtgagagacggtaccgggaagaacagtacactctagcccagatactgcacttttcccatggtcttcacaaccagcagaacaggaaattttctccagtgtctggttcagcgggtcccacccccacggagcccagcaagctaagatccactggcttgaaattctcactgctatcacagcatctgaggttgacctgggacactcgagcttggtgggaggaggtgcatccgccattgctgaggcttgagtagatggttttaccctcacagtgtaaacaaagctgctgggaagtttgaactgggtggagcccaccacagctccccgagacagagcacgtgggggaaggggcggctgcaggcacagcttcagcagacttaaacgtccctgcctgacagctctaaagagagcagcaattctcccagcacagcattcgagctctgatacaggacagactgcctcctcaagtgggtccctgacccccccgtgtacccagactggagacacctcacagtaggggcctacagacaccacatacaggagagctctgcccggcatctggcgggtgcccttctgggacaaagctcccagaggtaggaacaggcagcaatctttgttgttccgcagcctccgctggtgatacccaggcaaacagggtctggagtggacctccagcaaactctagcagacctgcagcagaggggcctgactgttagaaagaaaactaacaaacataaaggaatactatcaacatcaccaacattaaagaaaaaaggtagataaatccatgaagatggggagaaaccagtgcaaaatggctgaaaattcccaaaaccagaacacctcttctcctccaaatgatcacaactcctcgccagcaagggaacaaaactggatggagaatgactttgacaaactgacagaagtaggcttcagaaggtgggtaataacaaactcctccaagctaaagaagcatgttctaacccagtgcaaggaagctaagaaccttgaaaaaaggttagacaaattgctaatgagaataatcagcttagagaggaacataaatgacctgatggagcggacaaacacagcacgagaacttcatgaaacatacacaagttatcaatagccgaactgatcaagcagaagaaaagatatcagagactaaagataaactcaatgaaataaagcaagaggacaagattagagaaaaaagagtgaaacaaatgaacaaatccttcaagaaatatgggactatgtgaaaagacaaaatctatgtttgattggtatacctgaaagtgacggggagaatggaaccaagttggaaaacactcttcaggatattatccaggagagtttccccaacctagaaagacaggccaaaattcaaattcaggaaatacagagaacaccacaaagatattcctcgagaagagcaaccccaagacacataatcatcagattaaccaaggttgaaatgaaggaaaaaatgttaagggcagccagagagaaaggtcgggttacccacaaagggaagcccatcagactaacagcagatctcttggaagaaaccctataagccagaagacagtgggggccaatattcaacattcttaaagagaattttcaacccagaatttcatatccagccaaactaagcttcttaggcaaaggagaaataaaatcctttacagacaagcaaatgctgagagattttgtcaccaccaggccttccttccttagtgaaggaagcactaaacatggaaaggaacaactggtaccagccactgcaaaaacataccaaattgtaaagaccatcaatgctatgaagaaactgcatcaattaacaggcgaaataaccagctagcatcataatgacaggattaaattcacacatcacaatattaaccttaaatgtaaacaggctaaatgccccaattaaaagacacagactggcaaactggataaagagtcaagacccatcagtgtgctgtattcaggagacccatctcacatgcagacacacatacaggctgaaaataaagggatagaggaagatttaccaagaaaatggaaagcaaaaaaaagcaggggttgcaatcatagtctctgataaaacagactttaaatcaacaaagatcaaaagagacaaagaaggccattacataatggtaaagggatcaattcaacgagaagagctaactatcctaaatatatatgcacctaatacaggagcacccagattcataaagcaagttcttaaagacctacaaagagacttagactcccacacagtaatagtgggagactttaacactccactgtcaataatagacacatcgacaagacagaaaattaacaaggataccagggcttgaactcagctctgcaccaagcagacataatagacatctacagaactcaccacaccaaatcaacagagtatacattcttctcagcaccacatcacacttattctaaaattgaccacataattggaagtaaaacactcctcagcaaatgcaaaagaatggaaatcataacaaatagtctctcagaccacagcgcaatcatattagaactcagaattaagaaattcactcaaaacctcacaactacgtgcaaactgaacaacctgctcctgaatgactactgggtaaataacaaaatgaaggcagaaataaaagatgttctctgaaaccaatgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacatattcaaaagctagcagaaggcaagaaataactaagatcagagcagaactgaaggagatggaaacatgaaaaactcttcaaaaaatcaatgaatccaggaactggttttttgaaaagattaacaaaatacatagaccactagccagactaataaagaaaaaaagagaagaatcaaatagacacaatagaaaatgataaaggggatatcaccaatgatcccacagaaacacaaactaccatcagagaatacaataaacacctctacacacataaactagaaaatctagaagaaatggataaattcctggacacatacaccctcccaatactaaaccaggaagaagttgaatccctgaatagaccaataagaggttctgaaattgaggcaataattaatagcctaccaaccaaaaaaagtccaggaccagatggattcacagctgaattctaccagaggtacaaaaaggagctggtaccattccttctgaaactattccaaacaataaaaaaagagggaatcctccctaactcattttatgaggccagcatcatcctgataccaaagcctggcagagacacaaccaaaaaagaaaattttacaccaatatggctgatgaacatcaatgcaaaaatcctcaataaaatactggcaaaccaaatccagcagcacatcaaaaagcttgtccatcaccatcaaatcggcttcatccctgggataagaagctggttcaacatacacaaatcaataaatgtaatccatcacataaagagaaccgatgacaaaaaccacatgattatctcaatagatgcagaaaaggcctttgacaaaattcaacagcccttcatgctaaaaactctcaataaactaggtaatgatggaacgtatctcaaaataataagagctatttatgacaaacccacagccaatatcatactaaatgggcaaaaactggaagcattccctttgcaaaccagtacaagacaaggatgccctctctcaacactcctattcaacacagtactggaagttctggccagggcaatcaggcaagagaaagaaataaagggtattcaattaggaagagaggaagtcaaattatctctgtttgcagatgacatgattgtatatttagaaaaccccattgtctcagcccaaaatctccttaagctgataagcaacaaacatatgaaaaaaaatgttcgtcatcactggtcattagagaaatgcaaatcaaaaccccaatgagataccatctcacatcagttagaatggtgatcattaaaaagccaggaaacaacagatgctggagaggatgtggagaaataggaacgcttttacactgttggtgggagtgtaaattagttcaaccatttgtgtaagacagtgtgggaattcctcaaggatctagaaccagaaataccatttgacccaccaatcccattactgggtatatacccaaaggattataaatcattctactttaaagacacatgcacatgtatgtttattgtagcactgttcacaacagcaaagacttagaaccaacccaaatgcccatcaatgatagactggataaagaaaatgtggcacatatacaccatggaatactacacagccataaaaaaggatgagttcatgtcctttgcagggacatggaagaagctggaaaccattattctctgcaaactaacacacaaacagaaaaccaaacaatatgtcctcactcatcagtgggagttgaacaacgagaacacatggacactgggggaaacatcacacactgaggcctgtcagggggtcggggggctaggggagggatagcattaggagaaatacctaatgtagatgatgggttgatgggtgcagcaaaccaccatggcacgtgtatacctatgtaacaaacctacacgttctgcacgtgtgccccagaacttaaagtataataaaaaatatatatatacatatgggaaaaaatcatatttttcataagaattttatttttaatataaaataactattaaaaaatacatttcaaaagcatgcatctttgtcagaaactttataatccagtgaaaataatataaaatctatgagaaaagcatcaactaataacaggtcttaaaaatatttcaaataaaatggcctaattataccatcaaacagaaaataccaattgggacaccatctagaggaaggaatacaaaaaacaggctaaggagaagtcagggagccataaactgcacctgggggaaagagctgatgaagacatctccagaggactgaagcaagaaatttagggaccaggaggattttgttccaggtcacatacctggtaagaaaagacataaatccctctgttcccagaaactaccacagcctgttttccaataatttcttgaaggctatttctaagttcactctcctcttggtaagatggaattaactacagggaatagaccaaaaaccgtcctttctgacacctctgcaccctggttaacctttaaaactcaattaggtatatattcttttaaggcctgccaaaaatatcccctgtgattttaaggcactgttataccaaaaagtgattttaactcttatccaacatctaacattctttccaagaaaaatcataatccacaacagaaagctacttcaaatgacacttacgcaaaaagtgttgtgaataattccattcaacatgtcaatcaatgaatgaatgattataacagactaatacaaggtcaccaatgtgaaagttatcaccacaaggactgggggataaaaggactaaacgaagatgtcaataaagacaataaagatattataattttgccttatttacattaaaccatctcaagaaaagtagaaacacaagttgctctgtttcccatggtatgaataccaatgtcttatatacttttttaaaaagttttacttccagagaatgtgtgttcattgcgattatcaccagcacttgagttatttactaaaattcacctctgacaactatcatacaactttaggcaggcttaagctaccttgcttggcctagagagaagagcaacaaaaaattaaaaagagaaatctgacactccccatgttttctaaactaagtgtaagcaatgcttgagggtggggagtacctggggggaaaaattagaaaagcaagaaacaagtaccaggaaacaccaggaaatcgtgtttcaatactaggtcaaatgtatcactgaactgtcaagtactggtacatttacacaaatattaaggcttgatatgggcagtaggatagggcaggataaatggtatgataaagtaaccataatttatcattcagtataaatttgtatgattactatttatcaccatgaatattctgatttaacatactcttgatcaaatttgttacccaataaataacaatttctagaacactaagattgtttaaactgttacaatgattacaggtaaaaaccttattactctattctcgtagagacattcaactcggctacataatactggccttactgaattgctggagtatacagcaaacatcctatatttacttgacatgccaccaaaatttgatgtacattatgtttgaaaattgggggagaggtacatatgatgaaattttaactatttcaaaataaaacctctgttttaaagcctgaatgaaccataagactcttcactcaacaaaaaatctttcattatgttaacagactttacaaagcacttcctatatgacaagcatgatattagatattaacaacttgcagagtttcttaataaaactttgatgttatagtatgagtgatataaggggtgctaggtagagaagaaaaaagtttacttccccttactggcttaatggctgctagaagtattaactggcagaatatcagtatgcacaggattgtaaggcctacagatctttgaagacagtatacatacagctgtagaacaattatcaaattatcagtttaatggcactttacaatttgtataaacctatcactttgcaacttctgctaataatcacccaagcaatacataagaaattatacgcaagctttgcataaaaggataagaagattctgagattattaaacacatttttaaatgacattcagtaaagaaattaaatcccttactcttccttgttggttagaacactccacacagctgacttggatgtttccatgcttagcaccaggaatgatctgtacacattcaaagtcatttgccaaaataacaatatcacagcctgatccatatgcctaaaaaaaaaaaaaaaaaaaagttttacaatacataagatatgtaacttttgaaatcttattacatactattttatcttagattttattgccattataaagtataccttgggacattttacaaaatagttaatataatatcaatttctaaataagaacattaaaagtcacattaaaaaataaactgatgacactccatgcattatcattcaacaactgttactaataggaaaagggttcttccagttcttagaacagccactgttcctgcaggtcataagtcattctgtttagactttctctccaaagttcatctcagtaaaccctaaagtataaaagctccatctaaaaatactaagccactgaagactgtaactgtgttcccagggttcaaaccaggcttaagaaatatcaagatagaaatcaggcatgcattttccaacacaattccacatgccttaaagagctagttaaataaacatgaacaacaaaggcagaattacatgcactaaggcaatggctaaacttaaatgcatcaagactcaaatgaatccacaacgcagcctgcctccaacatccaccatccatccccaacatcatcaggcctgagggagaaaggaaaccaacccaaagttgttttaccaaaggtaaaaaagtcaaataaaatagaaaatgaatgaatttatatagaatattgggcaaataccactatatgatcttgaaaatagactacaacacagaattaaattgttgggaaaattcccatgtccaactctaatgagtaaaaccacacatttcttcctattgcaacacttcttgctgtatgctattcctgttttgcaactttgtgaattttatgacctaagggtcagagagttgggacatatttctttttcttccaaactacttatgattaaatattcaaaacaacctaacaacccaattctcaaaagaaaagctccattaaaagcaagataaacataaaacttatgaaatggtatttttccgcactgtttccacacccttaagcagtgtggttacgacctacaaaatagagatatccaatagccagggctgacatgtgatgacatctgaatcagtgacccatgccctgaagggatccatataaggctgctaatgaaagagggaaatgaagataaagaccagacaggaagacattaattctactaaaacttccaatgttaccaaaatcctgccataaccactatataaaacatcttcaacccatgtgtttataaaaatcaaaaagttcaccaaaagaaaagcaaagacagaatttcaagcaagaaaaatatggagaaaatcactcacaggaggaaatgatcacttacattcttatagacaaggcagacttggttataccatgaattcaggaaagccaaactgaaggggaatattgagtatatgcagaagaaatgtttggatcaccatgctaatttttaaagtatagtattaaaataacaaaaatcatcttactcttgaggaacaatttcaaaatttccaacgtgccttatatcattatctcagcaaagtggattcatggaaaaagcagactttatctagtttgaaatcacacacacagttttcagttttggttatgccatgctgtgctatcttaagaaagttatttaagttccctaagcatttcctcatggtaaaatgaagcaaataatacttgtctcttaggatacttgtgaaaattaaaatggaaaatttacacagtcatttaagaaacagaacagtgcaccaagtctcaagtctgggctagggactgagaacactaaagtgcaagacatggtcccagttactctaatggggagatgactaggtaaattactaattacaactaaatgacaaactgccatgacagagacagtcataaaatagtagaagacagaagaagtactcaacaagtgttggatcactctctctttatctttgcaacaaacctggagggtagatactatcactgtataaagaaaaattcaagtgcattaatttgcccaagattactgttactaaatgcaaagtgttcaaactcaggtccttacaattcttacattcttttccctacattatatatcaaaaagacataaaatattccagataaatattagtacactttgtttctctaaagatgtgccatccctagcaactagtgctacttaagataaattcactcttacggctcagtcactgaaaaggctttttactcttccctagataaccataattgcctgatgttttccagagaatgtgtactatactccatttttctgatccggcaatagttcaaattggatgcatcaaaatcacctaggaaacctgttagaaacacagactgctcagtcccacaccagactaaattaaaatctacatggataaaataatttggcaatatctatcaaaatcttaagtacaatataccttttgatcaaatattccctattttaccctataagtatatatacaaaagtttgccaaaatatatgtaggacattcagagcctcagtatttatagtagcaaaaactaaatataatcataccactcatcagtgaggagtagttaaataaattactgaattacactggaatactacacagctactaaaagttaagaggctgggtacagtggctcatgcctgtaatcccaacactttggaaggccaaggcaggaagatcacttgagcctaggagttcgagaatagcctgggaaacacagtgagacttcatctctacagaacatccaaaaattagttgagcgtggtgtcacacgactgcagtcccagctactcgggaagctgaggtgggagaatcacttaagcccgggaagtcaaggctgaagtgagctatgattgcaccactgcactccagcctgggtgactaagtgagaccctgtctcaagaaaaggaaaaaaatggaaagtttaaagaccactggtttagaatggtctcaaaccccctaccaaactagtaattcccatcaaaatggaacaacttatgtctggtgctagtttcctgttgaaccagagttacgcaatgcctaccattttatataataaccatgattactgctagaatggaatctcttaaactattgcacactaacagcttgaaaaagtgcacaggggcattttctaaagagtctaatgcataaataatccaagggtggaagaaaaagggactcatataatcagtcagtactgaatcacatgcattctgtaattgagggcccatgagattttaatggttttaaggcatgtttaatgtctgtctggttcccactatactgaatggttcatcagagcaaggaccttaccttgtccttgtttaccattgtggtcccaacacctagcacataagcagctgtcaataaatagctgtatagtaaataaattattaaagtcttcctaaccgaatgtctggctccagaagtctaagtacctagaaacttagtcaaagaacttggagttgaaacactgacactgccttgttgctaataatttggccaacctatcctcataagcttaagaaaagagggagagattctgactgattttccagctaacagtatcaataaatgtagaagatctactagaagagaatctaccaaagccttccttataattcaccatttactgaatacctactatgatcaagctgttttgctagggtctttacaaaaattatcattatcttcacaggcctgcttttgaagacagagaagctgaggcccagaaagggtaagtaatttgccctagttcactgaatgaggattcatttgcttcacagtaaagttcctgctctttccattgcattgccctacctctattccatgaagatcctgttggtgctagaaggagtgtgttcatttttgtaatcccaattaatttaccacatcatggagcacagaataagcattctgtaaagaccaacagtttatacaaaatctataatttactcaaaagattcccattctctcaattttagagagatcaaaagtgattttgttccattctttttcagaatctagttttaccagaggaagaatttatagtgcaggaggaaaacagggtgttcgttaagactacaagcaaatactaaattgaccccagagagtatggatgtgggctcctttgtgttagataaatgaaatacttctgactaagctaagttagtaaagttagtaaactaacctcttcacatgtgggagataggccacaggattattatagggaggcaaggaaaaggactgcaagccttttctggagaaatggaatcccttgaccggattatccctccttggattctttgtagagctgacctgtgccagagcacaatatacgagtgtactgctcttctaacagtactgacctataaaacactttatcttgaaatcaaggatatggctcagcccctacacacagagaaggcccaagaaaagaggaagagtcttagaaaaattgctttccttccattcatgtgggaggatttgttttataaaaggactaaactgtttctctgatgataaagaatgattagctgatattagtaattcacagctcagagataattctgtagcataagctgttacatccaaaaaaaactttaaaaatattaaccctcacttgttataatcctattcttatagaccaaatccatcctattaggaaagagaaaagtattctctgctttgaacattgaaactaaaagttttcaacctgaagtctaatagacataagtcatagatggcctcagtaggtctctgaactccgaaaaattgtatttaaagttgtgcgaatgtgtttcttttctttgctgtggtactattaccacaataaagatattgctgctttctttagagcaggggtccccaattcctactaccagtccatggcctgttaggaactgggcctcacagcaggaggtgagcagtgagtgagtgagcaatactgcctgagctccacatcctgccagatcagcggtggcattagattctcataggaactcaagccctattgtaaactgcacatgctagggatgtaggctgtatgctctttatgagaatctaatgataaacataatgtgcttgaatcatcccaaaaccatccctctccttcacccctcgctgtagaaaaactgtcttccacaaaaccggtccttggtaccaaaaaggttggagaccgctgctctagagggtttaatgtcctaatgaacaatgcaaattttgagatcactgacaaccactgacagatgcgtctaaatttaagagacaaaaaaagcactgataagggagtattaggcatgttgagaggtcttttaaaatgcagtgtgaagaggcataacacactcattcagtcttctctaactttagttttatatataattgtcttaactacattattttcagaaaagaaaactaatactctaatcccacaaacactgttctaatttctcaaatttcctttatgtctcagataaattgaagtggagagtaacaaaaggaaaacttttaaaaagcttaaacaaacatgaccacatttcctatgaaactatagcatacaatagattaattacattagcatttactatagaatagttggatgttttaacatcccggaagttacagggtcaaagtttgagatcattgacaactactgataagtgtctaaacttcaaagaccaaaaaaaagaaacaaaacctgataaatcaaggtgtactaagcatgttgagaggtttaacaaagtactataatcttaccaagaatactatatcaagagtgttactattaaactcccaccgctccctgggagtgagttttgatcaatgtaaatatgtctacttttctactgaagaaggtacattttattaagagttagaaaaataattacaagaaggaggtaccatttattaaaaacctactgggtgacaagtattatactattttcattctatattcctaatctttctttcaagactgccacaatcctagaagttggttattaatcccaccttaatatttttgaaaaaggaatttcacaggatttaatcaaattcctatgtcacaaggtaaatacatgactataattcaaactcagccctctttactgttttttccactttactaatgacatttttctatcgtttcgttttctgttgctcaaattttttgctctttattaattgcatttaaattcttcacttctgctgtgatctttgctcataaacaaaaaaactaacaggaaggcagggttgtctgggctttgatggttacttggctgtaccaagagatcttatagaaagtcttaagaggccagtgttgacatatgaaaaatcttacaaccaagaggacaaaacacagattaacaaagatttcccaggaaaacacccattccttctctccattttagtcacctaattaaaaccctagctctttatgatactctcagaattattaatttctaaaaaggacaaataggtttccttaatacgttcctgattaagcaagaaatttcacaagtcacatatacattgaaatcatgtacaaggtaaataaggcacataaaatgtttaatattaatgttttcagtaacaagattttctttttcatagaggaaatcacacatatattaaattttaaaattaaataagaaaatgaagtcaccttctcatccttttcacccttcttacccctcccctcctcattcccaggaagcaattacttaataattacctatgaacccttcctgaaatgttcaatatataaaagtatatcttttatatatcttcttttaacataaatgggatcatgctatacacaattctgccacttattttccacttagttaacaatgtatcttgaagaactttctacatcagcacagaggaaattacttcattcttcttttttttttttttctttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgttggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcgataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccacgttgtaggttgcctgttcactctgatggtagtttcttttgctgtgcagaagctctttagtttaattagatcccatttgtcaattttggcttttgttgccattgcttttggtgttttggacatgaagtccttgcccatacctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcatgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatattcattcttcttaatagctgcacagtattagtatttcatgttgtggctttgccataattaattttggttgtttccagtcttttactatttcaaacaatgcttcgatgaacatgtatgtatagatgatatatgcgtatgtgtccaagaatccctacaggataaattctaagatataatatgctggatcagtgattaaaattaattgcaactgcaaattgtcttccaaaaagattatagccccaagctgtataaaagtacctatttctccacttactcactaaccccaatcattatcaaatgttttaatctttccattccaacaaaacctgacatctccctgttctaatttgtatttttattagaagataagcatcttttcacatatttatcagccatttatatttctttctctgtaaactgactattcatattattggtccatttgtctttctgcagtttttcacacctacaaacaaacccttaccattattaactcccacccaccacaaggcaccgccaactccaagatacataaaactcctaccattgagatgtaagtccacactacagtaagaaaagcagggaaggggtagcatttgaataagttcttttgtccacatgattgagaacacactttactgacatgattcagttattctaactgcccaaagtccactcgagagtgctgaataagcaaaataaatacatgaaaaaggaactagacagtatgaagaaagcttacagcaaaaaagtttaacctaagtcaatgatgagtacggaaatgttggaaataacctaataacgactgcttgtgtggtaatcaaagggactgttcctcttagaaacaactcatatcagaaaatgcaaaattaacaaaatttatgcaagagcagtagaaaaacgcaaagctgtgggtgctatgtcgagggaaacataagacaaagcttgactacaaatatgtaaaaacaaaaatctatgggaagaaaaaaacaacagaagaaaacttaagaaaacgttctaagcgtttatgagtaagtggtaaaaggcaagatgatttcaaatttcttcctaactactccaaaacagcaactggcctgaaagaaagaactttctttataaaagtaaaattttaaatttagactttaaaaagagtaatttaatgttactaaaaaaaaactagccaattttgataatttactaatagatggagctataacaaacttctaagtactaagctaaagagaaacaaacttgtggtccaaactaagtctatttatatacctctgataaagaagaaaaacgtgtttttttcactggtggtagtaatatctgaaaggaaaatgagaccttgaaaagcaaaatatgcaataattaattatttgctctaattaaccattataaaaccaactctatctccagcttgcctgcattctcaataaaaggtagatccggaagtggaaatcaaaaatcttatatcttatattttatatgtcagtgcttttaataactatttatatgtcagtgctaagaataaaccattcaaagtattcattgtcaaaaatctctaaaaaaaaaaaaaatcaatactgtaaaaatcagtcccatggcctggccaacatatacaaaaacctacagtcaccttttagcctcaaatttattctcaaaagcttggagtatgtaacaatttgcttcataacaaataatgaagtaaaatactactttttaaaatagctacttctaaagaaataaaaataactttttttattatactttaagttttagggtacatgtgcacaacgtgcaggtttgttacatatgtatacatgtgccatgttggtgtgctgcacccattaactcatcatttagcattaggtatatctcctaatgctatccctcccccgtccccccaccccacaacaggtcccggtatgtgatgttctccttcctgtgtccatgtgttgtcattgttcaattcccacctacgagtgagaatatgcagtgtttggttttttgtccttgagacagtttgctgagaatgatggtttccagcttcatccatgtccctacaaaggacatgaactcatcattttttatggctgcatagcattccatggtgtatatgtgccacattttcttaatccagtctatcattgttggatatttgggttggttccaagtctttgctattgtgaatagtgccgcagtaaacatacgtgtgcatgtgtctttatagcagcatgatttataaacctttgggtatatagccagtaatgggatggctgggtcagatggtatttctagctctagatccctgaggaatcgccacactgacttccacaatggttgaaccagtttacagtcccaccagcagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcagatgttttttggctgcataaatgtcttcttttgagaagtgtctgttcatatcctttgcccactttttgatggggttgtttgtttttttcttgtaaatttgtttgagttaattgtagattctggatattagtgctttgtcagctgagtaggttgcagaatttttttcccattctgtaggtcgcctgttcactctgatggtgatgacccaatattgtttaggggttttttttttttttgagatgaggtctcaccctgtcccctaggctggagtgcagtggcacaatctcagctctcttcaactgccacctcccagactcaagcaatcctcccacttcagcctcccaaatagctaggaccacaggtgcaagcaccacaccctgttaattttttgtattttttggtagagatagtatttcaccatgttgtccaggctagtctcgaactcctgggctcaagtgatctggccaggagcgctgggattacaggcctcaacctcctaaagtgctgggattacaggtgtgagctgccacacccagccacaatactgtttctcaatttgttcttaatacattttacatttgaaagttttaaagttaattgtatattatgtcatatataccaacataaattaatatttatgacaacttcaaattatttttgtaactattggaaatttctggaaaaccatttaatctaaatgttgatattttgagggaaatagtcgtaacagtgtcccaaaaactttgctcaaatagtatgattaaactattaaattgtgattatactattaaactgtaattaaacttccaacaccttcagtatgatggaaagagcatattcctgagaatctagaggagctaacactgtaacaatgggtatatcacaatcttcctatagatgtttccttcagcagccaaatgaaagatttcagctagatcatttgagaccccttttttacactgtatttctgtggctgtacacaaatttgcttcaaaaagtctccaaaagattaaataatccagtgtgcactattttacatagagccgtaggtaagcaggcacagtatgttctttactttgtgatgtttcccctcctcacagatggcagaattagaggatggtccagaataatgactaataaccatctggaaatgacggtggctaataaccagctggaaaagatgagctaagccaatcaaagtctactccgggaaatttaaaccaaaagacccagagttaccagaaagagtggagctgaaaagtcatgcatattcagaaataaggcaactattaagaatcatgtgcaacttgaagaggaactcacaagtttcagaagcaaatagatcagatgcccaaagacaagaaagacctgtaagaaaacaatgcataaaatccctaaaacaaagcagttgatactaccagctttctatttccaattactctgaagtccaattgctcttccttgatggtttattgtgtatcttaaaataaaccttgctcttacttcagtacatttgcctcttgccctgactagaagcaaaactggtacaaagattagggatatacagagcagggcttcaaagaaaatgtggatttggccatgaaattagggtaaggagtacaatgagaattctgggaggaaagagagcaaaacaggatgcatacagtgatagcagttactaaagttatctgtgattgcttggaacccagaatatgtgattgcaaggcttttgagcattagatagctaaatgtactttttttcagcctttaataaagtatagaaaaagcaatgagctagagtatggtacagcatcaaaccatacaacttttctggaaaataattcgatattatgaattaagagactataaagagaattaaatagagtactttgattcagtaaatctctttttaggactcgaccctaagaaaacatccagacatgcaaacaaagatcacaattagtattaagatgtttattgcaccattatgtaaagcaataaaaaagcaaacaatctaaacaacacataatagaaaaattatgctttatcatgtcaaatgtattgttcatcttattcacaggcctttctagagaaaagtgccccatctacagtccttctgaaagagcagccctggcagaccacgtgatcaacagtataaaactgactggatctggcgttgacacttgattccaaagaccaagaatttaataccaaaagccataggctagccagcaagctatgatgtggtctggcttaaaagagtgaactgggtcagattctacttcctagatattcaactagtaaaatcaagaaatgtagcaggtattaacaggcactaaagccaaaatggctttatgtacacagaggccagggaagtcactgtgattctcatgtaagccagttttaatagacccaacacaaaaagaggaacagacactgtaagagaccacatagcccactagaaagagtaagcagtccacagaaatgagtccctgataactgaggctcagctgtactacaacttgtgttacaagactcttggaagatttgtctactattctcttttctatatccttacaataaatttcccattactaaggtaatctgccttgactagttccattttaattttttttttttaagagatggggtctcaatatgttagttggactcaaactcctaggctcaggtgatcctcccacctcagcctcccaagtagctgaaactacaggcatgccactgcacccaacttccattttaactctttattcaacaactattcataatacgataactgctaagcattaagtcaacaaatgtctgttgagcagttactctagaccaggcacacagggcataatgtggtagaaaatacacacaggatcctgccacatgtgcttatattttgctaggacaggaggagagagagagaagtggacagtaagtttttgtttgtatttttttaatttgtaaaggcttgagattctcattaaaaatagcagacaaggggggtggagccaagatggccgaataggaacagctccagtctacagctcccagagtgagcgacgcagaagatgggtgatttctgcatttccaactgaggtaccgggttcatctcactggggagtgtcggaaagtggatgcaggacagtggatgcagtgcaccgaacgtgaaccgaagcagggcgaggcatcgcctcacccaggaagcgcaaggggtcagggaattccctttcctagtcaaagaaagcggtgacagacggcacctggaaaatcgggtcactcccaccctaatactgtgcttttgcaatggtcttagcaaacagcacaccaggagattatatcccgcgcctggctcggagggtcctacgcccacagagcctcgctcattgctagcacagcagtctgagatcaaactgcaaggtggcagtgcggctgggggaggggcgcccaccattgcccagccttgagtaggtaaacaaagcggtgggaagctccaactgggtggagcccacctcagttcaaggaggcctgcctgcctctgtagactccacctgtgggggcagggcacagctaaacaaaaggcagcagaaccctctgcagacttaaatgtccgtctgacagccttgaagagagcagtggttctcccagcactcagctggacatctgagaacggacagactgcctcctcaagtgggtccctgacccccgagtagcctaactgggaggcaccccccagtaggggcagactgacaccgcacatggccgggtactcctctgagacaaaacttccagaggaacgatccgctgttcaccaatatccgctgttctgcagcctcagctgctgatacccaggcaaacagggtctggagtggacctccagcaaactccaacagacctgcagctgagggtcctgactcttagaaggaaaactagcaaacagaaaggacatccacaccaaaaccccatctgtacgtcaccatcatcaaagaccaaaggtagataaaaccacaaagatggggaaaaaacagagcagaaaaactggaaactctaaaaatcagagcgcctctcctcctccaaaggaaagcagctcctcatcagcaacggaacaaagctggacggagaatgactttgacgagctgagagaagaaggcttcagacgatcaaactactccgagctaaaggagaacgttcgaacccatggcaaagaagttaaaaaccttgaaaaaaaaaatagacgaatggctaactagaataaccaatgcagagaagtccttaaaggacctgatggagctaaaaaccaaggcacaggaactacatgacgaatgcacaagcctcagtcgctgattcgatcaactggaagaaagggtatcagtgatggaagatgaaatgaatgaaatgaagcaagaagagaagttaagagaaaaaagaataaaaagaaacgaacaaagcctccaagaaatatgggactatgtgaaaagaccaaatctacgtctcattggtgtacctgaaagtgacagggacaatggaaccaagttggaaaacactctacaggatattatccaggagaacttccccaatccagcaaggcaggccaacattcaaattcaggaaatacagagaacgccacaaagatactccttgacaagagcaactccaagacacataattgtctgattaaccaaagttgaaatgaaggaaaaaatgttaagcgcagccagagagaaaggtccacccacaaatggaagcccatcagactaacagctgatctctcggcataaactctacaagagccagaagagagtgggggccaatattcaacattcttaaagaaaagaattttcacccagaatttcatatccagccaaactaagcttcataagtgaaggagaaataaaatcctttatagacaagcaaatgctgagagattttgtcactgccaggcctgccctaaaagagctcctgaaggaagcactaaacatggaaaggaacaaccagtaccagccactgtaaaaacatgccaaattgtaaagaccatcgaggctaagaagacattgcatcaactaatgagcaaaataaccagctaacatcataatgacaggatcaaattcacacctgacaatattaaccttaaatgtaaatgggctaaatgctccaattaaaagacacagactggcaaattggataaagagtcaagacccatcagtgtgctgtattcaggaaacccatctcacgtgcagagacacacatacgctcaaaacaaagggatggaggaagatctaccaagcaaatagaaaacaaaaaaaggcaggggttgcaatcctagtctctgataaaacagactttaaaccaacaaagatcaaaagagacaaagaaggccattacataatggtaaagggctgaattcaacaagaagagctaactatcctaaatatatatgcacctaatacaggaacacccagattcataaagcaagtctttagagacctagaaagagacttagactcccacacaataataatgggagactttaacaccccactgtcaacattagacagatcaacgagacagaaggttaacaaggatatccaggaattcaactcagctctgcaccaagcagacctaatagacatctacagaactctccaccccaaatcaacagaatatacattcttctcagcacaacaccgcacttattccaaaattgaccacatagttggaagtaaagcactcctcagcaaatggaaaagaacagaaattataacaaactgtctctcagaccacagtgcaatcaaactagaactcaggattaagaaactcactcaaaaccgctcaactacatggaaactcaacaacctgctcctgaatgactactgggtaaataacgaaatgaaggcagaaataaagatgttctttgaaaccaatgagaacaaagacatgacataccagaatctctgggacacattcaaagcagtgtgtagagggaaatttatagcactaaatgcccacaagagaaagcaggaaagatctaaaactgacaccctaacatcacaattaaaagaactagagaagcaagagcaaacacagtcaaaagctagcagaaggcaagaaataactaagatcagagcagaactgaaggaaatagagacacaaaaaacccttcaaaaaaatcaatgaatccagaagctggttttttgaaaagatcaacaaaattgatagaccactagcaagactaataaagaagaaaagagaagaatcaaatagatgcaacaaaaaatgataaaggggatatcaccactgatcccacagaaatacaaactaccatcagagaatactataaacacctctacacaaataaactagaaaatctagaagaaatggataaattcctcgacacatacaccctccaaagactaaaccaggaagaagttgaatctctgaacagaccaataacaggctctgaaattgaggcaataattaatagcttaccaaccaaaaaaatccaggaccagatggattcacagccaaattctaccagaggtacaaggaggagctggtaccattcctcctgaaactattccaatcaaaagaaaaagagggaatcctccctaactcattttatgaggccagcatcatcctgataccaaagcctggcagagacacaacaaaaaaagagaattttagaccaatatccctgatgaacattgatgcaaaaatcctcaataaaatactggcaaaccaaatccagcagcacatcaagaagcttatccaccatgatcaagtgggcttcatccctgggatgcaaggctggttcaacatacgcaaatcaataaatgtaatccagcatataaacagaaccaaagacaaaaaccgtatgattatctcaagagacgcagaaaaggcctttgacaaaattcaacaaccttcatgctaaaaactctcaataaattaggtattgatgggttgtatgtcaaaataataagagctatctatgacggtctgtcatatcacagccaatatcatagtgaatgggcaaaaactggaagcattccctttgaaaactggcacaagacagggatgtcctctctcaccactcctattcaatatagtgttggaagttctggccagggcaatcaggcaggagaaggaaataaagggtattcaattaggaaaagaggaagtcaaattgtccctgtttgcagatgacatgattgtatatccagaaaaccccatcatctcagcccaaaatctccttaagctgataggcaacttcagcaaagtctcaggatacaaaatcaatgtgcaaaaatcacaagcattcttatataccaataacagacaaacagagagccaaatcatgagtgaactcccactcacaattgcttcaaagagaataaaatatctaggaattcatcttacaaaggacatgaaggacctcttcaaggagaactacaaaccactgctcaatgaaataaaagaggatacaaataaatggaagaacattccatgttcatgggtaggaagaatcaatatcgtgaaaatggccatactgcccaaggtaatttatagattcaatgccatccatcaagctaccaatgactttcttcacagaattggaaaaaactactttaaagttcatatggaaccaaaacagagcctgcattgccaagtcaatcctaagccaaaagaacaaagctggaggcatcacgccacctgacttcaaactatactacaaggctacagtaaccaaaacagtatggtactggtaccaaaacagagatatagatcaatggaacagaacagagccctcagaaataatgccacatatctacaaccatctgatctttgacaaacctgacaaaagcaagaaacggggaaaggatttcttatttaataaatggtgctgggaaaactggctagccataggtagaaagctgaaactggatcccttccttacaccttatacaaaaattaattcaagatggattaaagacttaaatgttagacctaaaaccataaaaaccctagaagaaaacctaggcaataacattcaggacataggcatgggcaaggacttcatgtctaaaacaccaaaagcagtggcaacaaaagccaaaattgacaaaagggatctaattaaactaaagagcttctgcacagcaaaagaaactaccatcagagtgaacaggcaacctacagaatgggagaaaattttcgcaaactactcatctgacaaagggctaatatccagaatctacaatgaactcaaacaaatctacaagaaaaaaacaaacagccccatcaaaaagtgggcgaaggatatgaacagacacttctcaaaagaagacatttatgcagccaaaagacacatgaaaaaatgctcatcatcactggtcatcagagaaatgcagatcaaaaccacaatgagataccatctcacaccagttagaatggcgatcattaaaaagtcaggaaacaacaggtgctggagaggatgtggagaaataggaacacttttacactgctggtgggactgtaaactagttcgaccattgtggaagtcagtgtggcaattcctcagggatcttgaactagaaataccatttgacccagcaatcccattactgggtatatacccaaaggattataaatcatgctgctataaagacacatgcacacatatgtttactgcggcactgttcacaatagcaaagacttggaaccaacccaaatgtccaacaatgatagactggattaagaaaatgtggcacatatacaccatggaatgctatgcagccataaaaaatgatgagttcatgtcctttgtaggaacatggatgaagctggaaaccatcattctcagctaactatcgcaaagacaaaaaaccaaacaccgcatgttctcactcataggtgggaactgaacaataagaacacatggacacaggaaggggaacatcacacaccggggcctgttgtgaggtgggaggaggggggtgggatagcattaggagatatacctaatgttaaatgacaagttgatgggtgcagcacaccaacatggcacatgtatacatatgtaactaacctgcacgttgtgcacatgtaccctaaaacttaaagtataataataataataaaaaagcagacaaacatgcacctacataatccctcataaaacctcacaaaacccactaagacaatgttttaaattcagaggtgtacctaaaacatcctccacaaagaataaattaaagtgagtacatgtgtaaccaccacccaagaagagaagagtatttccagcaactcaaaagattatctgtcccttccaaattacacttctccgtctcaagcaaaagtagccactaccctttttgggaaatcacccccttatttttctttgtagtttttcaacctctgtatgcatgcctaaacaatatggtttagttttgcctcccctctgaactttatgtaaatggaatcatactgtatgcttttgtgtctctttctctgaacattaggtcagaagtttatcctggtgtatgtaactgtgattcactcactttcatttcttattaatattccctggtatgtaccacaatttatccactctaatgttgatggacattttgcctattacatacaatgctgctatgaacattcttgtagggaaatctcgcatacgtgcatgcatttctctagaatatacacacaaaagaggaactgatggatcacaggttaggcgtatcttaaattttggcattaatgctaaattgttttccaaaatagttgtaccaatttatactgtcactagcagtgcatgagaattcccatcactggacatccttgccatcaccagatacatgtgagagtaagtaattttgtgcaaatctgttaggtatataatagaatctcctgatttcaatctgtctttttgtgattattaatgagctatggctccttttcaaatatttaccggtcatttagattttctcttgtgacgcacctgttcaaatatttcatccgttattgttatcattttcttatttgtagatattgttatattctggatactagtcctttgtcaaatatagatgttgcaattcttttctccaactccacaacttgcatttcacttttaatgctatctttgaggaagttcctaattttaaagtagtccaatctatcattaatctccttttatgatacagtacttcctttacttttagttttttattttgacataatttcaggcttacaaaaagttgtaaatttatacagttatacaaagttataaaaagttcctgtataccacattccccaaatgttaatattttacatctgctttacccttgtctctgtatacatacatatatttttttctggaccatttgaaagttgcaggcatgattcctttttattccttaatactttaatgtttccccttaaaaatgtcttatatgaccacagtacaattatcaagatcgggcaatggatactgataaaatactattatctatagagcttagatttcttgaactgctgcaatagtgtcctttatagtaaaagaaaattccagattaagtgtttagctatgtctttttagactcctttaatctggaataattcttcactctttctttgtctttcatggcattaacacttttgaagaacacagatcagttattttatagaatatcttaaaatgcaggtttctctgatgtttcctctcaattagatttaggttatgggtttggggcaggaataccacagaaatgtagcaatgttcttattgcattttatcaggtggcacttctgttaatttgccccatctctgatgatgtttactttggacagcaaatgcagatagtatcttccaggtttctcctctatgttgtttttcctttataattaataagtatactgtgggaatatattttgagattatgtaaatatcctgttccttactaaactttcatccattagttttagtactactatgatggctgccaaatggcaattttctaattccatcgttgcatcatttgtcagtttccctctgtaaagaagagcgttccttatttgtgtacttatttatatcagtaaaaattcatggatttttatcttattcaaagggttataatccactatcatttattttcatacccagattgtcccagatttggccagtggaagacctttaagctagctccagtgtcattatgacatgctatgaccattctttgagcaattccttactttctggcacaagaaattccagattcatctcatttttcatgctccagcctaaaatcagctattcctccaagaaatagtggttccttttagtggacaaaggtatttagaaaccaagatctagatgccagttgtgttcactgctacaggggtatcactgcttctaggcctctcagctgacagttaggaaaacaaatgtgtgtgtatgtttatgtatgtatctatagacagacacacacatatctattttcaactgtccactgaaagggcttaggatcaaagacacaccaatacaaacatccgtatcatatctacatatctctatacctatacatcactgctctatgtctgtttaaatatacacaaatatatgcatgtatacatacacacattattcatataaacatgtaatatattcatatgtgtatagacacatacacatctatgaggtcacactaatgcctctaatgcaattatattgacaaggttcattctggccttcccactttctctttttttgagatggagtctcgctttgtcacccaggctggagtgcagtggtgccatcttggctcactgcaaccttcacctcccacgttcaagcgattcttctgcctcagcctcccaagtagctgggattacaggcacgtgccaacatgcccagctaattttttgtatttttagtagagacagggtttcactgtgttagccaggatggtctcaatctcctgacctcgtgatctgcccgcctcagcctcccaaagtgctgggattacaggtgtgacccattgcacccggctgccttcccactttctacacttgtaactctcttcttcaataatgagaaacctggctcacaatatccaaaatatttctatctgcaattgtggtttatttgtgtagtgaattcctataattttaggttgccttggcattcgtttcaagtataagtctgactttctcattcaagaatcagggctcagtcacccttgacacagtttttagttctccatttcctcccaggtcctcaatgtggtcaatcaagatacctgccttttacaaccacctcctggttatcacctccttttaggagagctaggtagaatctacctgactcaccctaatgaccccaaaccctgcacagatatgcctcagtgaccacctcttagtcacagcatgactcatgcctgcttgctccaacctacaaattagaactcctcataggaaacttgcttggttaagaacaccctggaccccagtaaaggctttagttccctaggtcctttctctttcatcccatccactggttgcacttgcgtgtcctaggtggcacccctcttcctgttgaccttgcaaggtgtgctactttctcttctctctaaaatctgaaattaaaactgcttgttatttcatgcgttttgttttaccatctcctctgtagctcacctgaccaacacacctgaacctaattctccgcttggtcagggttctcctagagcgtggctgtcttggtcaaataaactggacacggataggacaagaaccacaagggtatctgccagtataagtttcctgtgagaagaacacctggccataggtctgacatttaagcattaggacatctaccaagataaaaaactatctcatgaaagacagactgtaaacatccatgaccatctcatatggtcatatcccagctccacaataatccctggagccccatcaggacagacatacagttaacagccactctccagagagtttacagacactctcaagaaagatcaaattagaggaaaataaaacaatttggccaggcatggtggcttatgcctgtaatcccagcactttgggagaccgaggcgggcggatcacaaggtcaggatattgagaccaccctggctaacgtggtgaaaccccatctctactaaaaatacaaaaaattagccgggcgtggtggcaggcgcctgtagtcccagctactcgggaggctgaggcaggagaatggcgtgaacctgggaggcggagcttgcagtgagccgagattgcaccactgcattccagcctgggtgacaaagcaagactccatctcaaaaaaaaaaaaaaaaatttgatgttttaagaaatcttttgcaacctcaaggttagcaatacattttcctctacatgtattcctctgaattctcccttctaaaatatgtattgttctgtcttgcacatctctaatctacttggagttaatttttatgtatggggtgagatagggaccaagtcttccttctttcctatgtagataacaagatgtcccagcaccactgattgaaaagatcaaccatcctgttactctaccatgccaattgtgatataaatcaaacatcaacaaatgtgtgggtctctttctggtgctgattttggtgtatttgtcctcagactgccatctcactatcttaatgactacaacttttataagtcttgagctggtagaagtcttctttattgctcttcaatattgccttatctattcttggcactatctagctccataaaattttagcatcattctatcaaattccacaaaattctcttaaaattttgattgggaatgcatcaaagatacataaataagcttggaaatggttgatatttttacagtagtgaatcttccagtccatgaacatagtatttatctcctttaagtctctcaataaagtttattaattttgcttataggagttttacacatatatcattagatttgttgctaggtcctttttgatggtatgaaaaatgacatcatagctccagttccaagtaaaataaagtaaccacagtgatgtctctcccacttgatgcagccataaaacataaacagaaagcacagaacagctatttgaggactcttaataaggtgaattatagcagataaatgcggtaagaagaatggagtttgaagttcactattctagcagagtttcccattttactgaactaagttaggcctggactgtcaggcctaaaccaagcagcaaaaacagagagctccaggagaagccatttacttttggctcaaggaatgggaaaggagactcttaatgttcacagaaagggaggaaaaattctccctttatcttttttttcccttttctctattttctgatatcacagcccccaaataattccacagttctactctgaggtgccatgaccccaagagagtagagtggatccacgttgctctttttctttctctacaggtactttggcactgaatatagacaggtacagtcacaggaagtgactggttttccagccagaaaaccagaaagtaccaggaaagtcacagaaagaggagtctggaaaggcaactcaacaaacttgcttgtaaactcccgggctcatccccaggctgtgcaagcataatcttaagcttaaacagcagagcaaagaccttgagaccactgcccaggttccatactggccactcagtggcacatcacaggatagagtatattcagctagcactgcaaaggctttgaaaatggaacttacatggaaactacaatatacagaaggttggtcaaacctttccatctcaacccagccagctctaattcctgctaaaacaaaaatatcaacattctccataggatttacaaaaggcccagagtcgcataacgtaatatttttaaatgtccaggcataatccaaaattactcatataaagaactaagaaaatctcaacttgcaagagaagagacaacaagacacagatgttgaaatcaactgacaaagatgttaaaatggctagtagaaaaatgtttaaagaagtgtgggcactccccaaatcaataacataggtttccatcttaatcaattagaaaaagaagagtaaaacaattccaaatcacatagaaggcaggaaacaataaaaaagcagatatcaatgatattaacagaaaaccaagagtgaatatgaatgaaatcaaaagagcaatataacataaaaacttcagcaagataggcaaagagaaaagacacaaattaccaatatcaagaataaaagaggggtatcagtactaaccctgcacacattaaaagtataataacgaaatgccacaaacaactctatacgcaaacctataaaaatgaaacagatgaaaaagaccaattcctctaaaaccaaaaacagtaaaaacacacccaagctgaaacatattactaggatagtcctttaactattaaataaattaaacgtatagttaaaacccttctgaaaaagaaaactccaggcccagattgtttcacttataaattctactaacatttaaaaaagaaataacacctattctacataatcctgagagaaagtagaaaaggacaaaatacggccgggcgcagtgactcacgcctgtaatcccagcactttgggaggcccaggcaggcagatcacgaggtcaggagatcgacaccatactagctaacatggcgaaaccccatctctactaaaaaacaaaaaaaaattagccgggcgtggtggcaggcaccagtagtcccagctagtcacgaggctgaggcaggagaatggcgcgaacccgggaggcggagcttgcagtgagctgagattgcaccactgcactccagcctgggtgacacagtgagactccgtctgaaaaaaaaaaagaaaaggacaaaatacttccaaactcatgaagctagtattacaatgataccaaaaccagacaaaaacagtacaggagaaaaaacataataaaaaatattcttaatgaacacagatgcaaacacactcaataaaatattagcaaatcaaatccagccacaaataaaaacaataatataccataacgaagtggggcttatactggtactacaagactgattcaattttcaaaactcaatcacggcaatccacacattaataatttaaagaaaaaatatataaccatattaatgcatacagaaaaagcacttgacaatactcaagattcctttatgataataactttcagcaaacaaggaataaaaaagaatcttctcagccttataaagggcatctataaaaaaaaaacctagtactgcaataaggaaaaaaaaaaaaagaacacatacattggaaaagaagaattcaaactgtctaatttgcagctagtgtggatatctacactgaaaatcccaagagatttacaaaaaaaaaaaagaagcctagtgctaataaggtcacaggatacaaaatcagaatttctgtgcagccatgaacaactggaaacaattggaaaataaaatgtttaaaaagataccattttaacataggtctgaaaaattaaatacttctaacaaaacatgtatcagatctatatgcataaacactgatgaaaaatcaaagaagatctaaataaatatagacatatgttcataattggaagactcaaagatgtcacttctccacaaattgatctacagatttaaaagaaaggcaatcaagttcattcccagtaggattttttttgtagctatggacaaactgatcctaaaatttaaatggaaaggtaaaggaactagaataactaaaacaattgtaaaaaaagagaataaagttcaaagaatcacactactcaattataagacttaccataaagtcaataatcaagacagtggtattgtggcaaaaggatagagacatagatcagtgcaacagaatacagattccagaaatagacccacaaaaatatagccaattgattttttacaaaggtacaaaggcaattcaatggagaaagggcagcttttcaacaaatggtgttggaacaactggatgttcatatatcaaaaaaaaaatctaatctgatattttacacaaaaattaactcaaaatgaatcataggatctaaatttaaaacacaaaaagcttcatgaaatatacaaaaaacatcttagcatgataccaaaactcgacaaaaacagtacaacgggggaaaaaaacatataaatatatgtattttttttaaacagcgtctcactctgtcactcaggctagagtgcagtagcatcatctcagctcactgccacctctacctcttgggttcaagtgattctagtgcctcaacctcccaagtggctgggactacaggcgtgtgccaccatgcctggctaatttttgtatttttagtagagacagggtttcaccgtgttggccaggctggtctcgaactcctgacttcaagtgatctgcctgctttggccttccaaactgctgggattataggtgtgagctacccggcccagcccatacagattaatattctttttttttttttttttttttttttttttttttttttgagacggagtctcgctctgtcgcccaggccggactgcggactgcagtggcgcaatctcggctcactgcaagctccgcttcccgggttcacgccattctcccgcctcagcctccccagtagctgggactacaggcgcccgccaccgcgcccggctaatattttgtatttttagtagagacggggtttcaccttgttagccaggatggtctcgatctcctgacctcatgatccacccgcctcggcctcccaaagtgctgggattacaggcgtgagccaccgcgcccggccccagattaatattcttaatgaacatagatgtaaaaacactcaaagagctaaaaaaataaaaaatactgtgaggaattagtgggccaaaatctaagagaaaaggagaacataaggctgtgctcagcactgaatgccaatttgtcctaacagcatttgctaatctaaaagagtgagggtaaaactgagctgcattttgatggtctcttggatctagaggaacaaaaatgaaagtgctccatctgacaaaagatgggactccaataaactacccaacactttaaactgaaatcttgaagattaatccacataacattagagacctagaattaaaccaacacacttatagagattttgtatgtgtgtgtgtgggggtgtggatgtgagatgggagttttgttcttgtcgcccaggctggagtgcagtggcgcgatctcagctcactgcaacctctgcctcccgggttcaagcaattcttctgcctcagcctcccgagtagctgggacgacgctatgcccagctaatttcgtatttttagtagagacagggtttcaccagttgaccaggctggtctcgaactcctgacctcaggttatccacgcaccacagcctcccaaagtgctgggattacaggcatgagccatggcgcccggccacttgtagagattcgcatctgtctttgcatcatttagatggtttagaaaatttcaagccttgcgcttgaattaatgtcttccctaaacagtaaaatccccaagacatgtcacctaattaaattaaaattcccttttgggtaagataccaccatcttgggccttaggttattcctaaaagtcttttttcaaatacacaaagtcaacaatatctatcacacaaggaaaaaagacctcatgaaagaaccagtgtaacaaccaaaactaagaacttacggatggctttaacagcaaattagacatggctgaatataggatttgcaaattgattagaaaaaaacatctagaatgttgcacaaaaggataaaaagatagaaaacatggggccgggcaaggtggctcaggcctgtaatcccagcactttcggaggccaaggtgggcagatcacctgaggtcagagttcgagaccagcctagccaacatggcgaaaccctgtccctactaaaaatttaaaaattagctaggcatggtgatggatgcctgtaatcccagctactcgggaggctgaggcaggagaatcgcttgaacctgggaggtggaacttgcagtaagctgagattgctccactgcactccagagcctgggtgacagagtgagactctgcccccaccaaaaaaaaaaaggccgggcgcggtggctcacgtctgtaatcccagcactttgggaggccgaggcaggcggatcacaaggtcaggaaatcaagaccatcctggctaacacagtgaaaccccgtctctactaaaaatacaaaaaattagccaggcacggtggcaggtgcctgtagtcccagctactcgggaggctgaggcagaagaatggctcgaacccgggaggcagagcttgcagtgagccgagaccgcaccattgcactccagcctgagcgacagagcgagactccgtctcaaaaaaagaaaaaagaaaaaaaaagatagaaaacatggcaaaaggtattagtcacagaaataaagtcagaaagtctgaaacatatttatttgttttataaggtcaatcagggcagaggcaatatttgaagaaacagctgaaatttttcaataaatgatgaaagatattaatttacagatttgaaaactcccaagcagattttttaaatgtatacatagaccaaacacagcaaaacttcagaaacacaaaggaaaaaaatctcaaaggcaactaagagaaaaaaatatataactttcaaagaaccaacagtaaattagcagtttacgtctcaacagaaacagtagagaccagaagactataatcctcaaggtgctgaaagaaaacactgccatgctctacctacctgtctacctgctaaaagacagcaaaacggcctttcaagaatgaaacaaaataggctgggctcacacctgtaatcccagcacttttggaggctgaggtgggcagactgcttgaggtcaggagttcaagaccagcctggccaacatggtgaaacccttctctcctaaaaatacaaaaattagccagatgtggtggtgcgcacctgtaatcccagctacttgggaggctgaggcaggagaaccacgtgaacctgggaggcggaggttgcagtgagccaagatcacaccactacactccagcctgggcaacagagcaagactcagtctcaaaaaaaaaagaatgaaacaaaataaaaacagaactacaattcaacccagcaatcccattattgggtatatggccaaaggaatataaatcgttataccatgaagacgcatgcatgcgtatgtccactgcagcactattcacaattgcaaagacagggaatcaacctagatgcccatcaataatagactggataaagaaaatgtggtacacatatgccacagaatactatgcagccaaaaaaatgagatcatgtcctttgcaagaacatgtatgtagttggaggccattatcctaagtaaactaaggcagaaacagaaaaccaaataccacatattctcatttataagtggaagctaaacactgagtacacatggacacaaagaagggaacaatagatgccacagcatacttaagagtggaaggaaggaagagggagaggatcaaaaaactacctatcgggaactatacttattacctgggtgacaaaataatctgtacaccaaaccaagcaacacacaacttacctgtataataaacctgcacatgtacccctgaaactaaaagtttaaaaaagaatgaaaaaaaaaggcttttttagacaaacaaaagacaacattacaacactaacagattgataccaaggaaattctaatggagattctccaggaagaaggaaaatgatctcaaatggaatgtaagagaggaaggaagaaacgaagagcaaagtaacatatgggtaaatctaagtaagcattgactctgtaaaataataatgtcttccagggttataaaaataggcttaccatagaaggatatattataagcaggaagggagttaaaaagcaatacaaaaggttcttgaattgtctacaaagaatgtaaaccctcataaggcttcaataagtgaaataagttaagaatgcatcctgtaatttctagagtaactagcaaaagaatagaaacagaatatggagtcttaggactagagggaaaaaactgaatgaaaaaattcatttcaaaagacacaagaaaggagaaaaaggagcaaagaacaaaaggaacaaataaaaagcacatagtaagattgtgaatttaaacacaaacatgccagtaattacattaagtataaatgaagtgaaagttctagtgaacacagaaattgtcaggctgtatttttaaaaatccaactatgttttacagtcatgtgccacgtaacattctacaacggacccggtctacaatggaccacacataaactatgatggtggtcccataagattataatgccatattttcactgtaccttttctacatttagatatgtttagatacacaaataccaatgcagtacaactgggtacattattcagtacagtaacaggctatatagctttgtagcctgggagcaacaggctataccatatagcctagatatgttctaggctatactatctacgtttgtggccgggtgtggtggctcacgcctgtaatccctgcactttgggaggccaaggaggatggatcacctgaggtcaggagtttgagaccagcctggccaacatggtgaaaccccacctctactaaaaatacaaaaattagccaggcatggtggtacatgcctgtaattccagctatttgggaggttgaggcaggaaaatcacttaaacccgggagaacggaggttgcagtgagcagagattgcgccattgcactccagcctgggcaacaagagtgaaagtcagtcttaaaaaaaaaaaaaaaaactatctaggtttgtgtaagtacactttatgatgtttgcacgacgatgaaattgcctagcaatatattgaatgcatcttcattgttaatcaatgcatcactgtatttggaagaacgatctgaaacgtaactatgcagaaaagttgaagtaaaaagataagactgtacaaatgccaaccaaagaaagctaataaaactatattaatgccagagaaagtacactgcagaagcactgttagaaatcaaaaagggttacttcctaatgatcaacagatcaattcaccaagaagatataataattttaaacttgtaagcacaaataaataaaacaaaattaacaaaaccacaagataggaataaatgcatatttatagtagattttaacacatctctcagcaaaatgaataagcagacagaaaagcggtaaagttttaggagatttaaagaacatgattaacaaccttgacctaaaatatataaaattctgtccaacaattgaagaggacacattttctttaagcacatatgaaacacttataaaggccaggcacggtggctcacgcctgtaatcccagaactttgggaggccgaggcgggcagatcatgaggtcaggagatcgagaccatcctggctaacatggtgaaaccccgtctccaataaaaatacaaaaaattagccgggcatggtggccggtgcctgtagtcccagctacttgggaggctaaggcaggagaatggcatgaacccaggagacagagcttgcagtgagccgagatcgcgccactgcactccagcctgggcgacagagcgagactccatctcaaaaaaaaaaaaaaacttataaaaactgaccaactgaaatttcaataaacttaaaaagactagaagtacataccgcatgccacttgcacacaatacagctatgctagaaattagtaagcatatttgtaactttaaaagtctcatatattcagaaatttacttccaaattacttatgagtgcatggttttaaaaacagctttgtagaatgcagagaatgcagatcttggaagaaaacgtacattctaaattcatctattagggagaaagacaaaaatgagctaagcatttagctcaataaggtaggggaaaaacagcacaattaatataatatagaagaaaggaaataataaattaagaaaaacattaataaaatagaaaataagtatataacagagagaagtggtaaagctaaagtgggttctttaaaaaagattaataaagttgataaacctttgctgaagaaaaagggagaggcacaaataaccaatggcagtaatgacaaaagaagcaacagagatgctgcagacctaagaagatattaagaggccgctgtgaacaactttatactcataaatttgaaaatctacacaaaatagaataaattattagcaaaataactacccaaaaatcattcaagaaagaaaattacaggtaaacattctcaaatcagtaataatatgagcttcctccatgaggcctcagtccaatttaccaaaatgttaagtggggttatctctggattgtgccattataaatgattttctctttcttcagcatttttcaaattatctacaagggcatatgttactttttacatcttgcggggtgggagggagaaatgggagctttgtgttccagtcttaattctatcacagtactaactaggtggccttcattaaatcatttaacttctcaaaagtattagtatccccatctatgaaattgagaggtgaagctagctggacttcctgggtcgaatggggacttggagaacttttctgtcttacaagaggattgtaaaatgcaccaatcagcgctctgtaaaacacaccaatcagcaggatcctaaaagtagccaattgcagggaggactgaaaaaggggcattctgatagcacagaaacagaacacaggaggggacaagtaagggaataaaagctggctaccacagccagtagcggcaacccgctcgggtccccttccatgctgtggaagctttgtccttttgctttgcacagtaaaccttgctaccactctttctttgggtccatgccatctttaagagctgtaacattgaccgcgaaggtctgcggctccattcttgaagtcaggaagaccacgaacccactggcaggaaccaattccagacacaaaatgaagatactagactagatttaatttgtaaagcagacttaatttcacgtaccaatttaatatacaagataaatattaatcctactacttttaaaaattgccttgttttctatataccaaccacatagagatagcactatttaatactgccaggaagaatggctatagttcaattattccataatcaaatcgtcacattagtacatgatccccaatttaactaatttatagctaataacaatatcgggggaaattcacccccaatatttcatataggttattttctattttccctaagtgtcggccagtctgggaaataaagggaaagagtacaaaagagaaattttaaagctgggtgtccgggggagacatcacatgtcagcaggttccgtgatgccccccaagccgcaaaaccagcaagtttttattagtgattttcaaaaggggagggagtgtacgaatagggtgtgggtcacagagatcatatgcttcacaaggtaataaaatatcacaagacaaatggaggcagggcaagatctcaggaccgggttgaaattaaaattgctaatgaagtttcgggcatgcattgtcattgaaaacatcttatcaggagacagggtttgagagcagacaaccagtctgaccaatatttattaggtgggaatttcctcatcctaataagcctgggagcactaagggagaccagggcttatttcatcccccatctatgaccgtaaaagacagccagccccaaagcagccattttagaggcctccccttagggacgccttctctttctcagggatgttccttgctgagaaaaagaattcagcgatatttctcctatttgcttttgaaagtagagaaatatggctctgttccacccagcccacaggcagccagactttaaggttatctcccttgttccctgaacattgctgttatcctgttcttttttcaaggtgcccagatttcatattgtttaaacaatttgtgcagttaatgcaatcatcacagggtcctgaggagacattcatcctcagcttacgaagatgacgggattaagagattaaagtaaagacaggcataggaaatcataagagtattgactggggaagtgataaatgtccatgaaatcttcacaatttatgttcagagactgcagtaaagacaggtgtaagaaattatgaaagtattaatttggggaactaataaatgtccatgaaatcttcacaatttatgttcttctgccatagcttcagcctgtccctccgtttagggtccttgacttcctgcaacataacaacatacaccaagtcctcttatacaacagtacacttcaatagctagtttatcctgtatgcacaatgtctaggtgccaaaatattttttgaataaaggataaccagtaagttatacgaattcttctgggaactggaaactttcagttttactttctatatttcaacactgttggaattataacttttttacaatgcagatattatattaattttttaaaccaaaaaaatctgaattctttggggtttttatttgctttttgcttctaatggccaaactgtgcttgtaattatgtctatataaaatttgtccagcataaaattatcacagtcatgtttgaattttccatttgtccacatattagcatattcttaaaatttctttaacagaatcttgcttctatccaagagtactcctttggttgagctgagattaccaccaagtagggtggccacctcaatcatgtctttgctaggctcctcaattttcaattccaggaccagctcagctgattgttaacatgtgttgtggactatattgtgtaaccccaaaattcatagcttgaaactctaactaccaacgtgactgtgtttggaggtaaggcctttcaagaggtaatataaggttaaatgagatcttaagggtggggccctataagactagcgtccctaagaagagaaaaagacaccgcaagtgcatgtacacaaaggaaaagccatatgaggaaataacaagaagggggcaatgtacaagacaaggagaaagtcctccagataaaccaaatctgctgacacatagatcttggacttccaaactccagaactgtgaggaaaaaaaatctgttgtttaagctacccagtctgtattattttgttatggcagccccagcaaattaatacaacatattaaactcctaaagtacagaatctctacactccaggtatttgtcaggctaatctctaattcattatatacttaagtctttcaaaagcaccactgaggaaaatttgagaaccacctgtcaattcctcctgatacattaatatatatccttggagtaaaccagggcagcacagctttacacctatattatatcaaagctctctgccttcatcgtataaaattgatttttctaaatatgacttaatgccactgacctataccaagaagtattataaaaaaatagccttatgaaaagatcactgtttttactatgtgtgtattacactaagtatcctttccatttactaatttattgagtacttttttgtaccaccttctgttttaggtgctaaagaaatagcaatagagggcattgcaggcactcaggtttttattctgagtggaaaaaaaagccacgtgaaagtctggaataaggggctaacaagattttatttgtattttaacaggagcattctagctactatgttgaaaataaactgaaggaggataggctagagtcagaaaaggcaggaagaccatttaagattcaactgccattatccaggggaaaaaaatgatgctgtcttgcaccaaggtggcagcagtagagataagaagtaatcagattctggacgcattttgaaggtataaccattagaatttgctaacattagatacgggacataaatggaagagaaaaggtagattacaaggaaagtaaagaaaagtggagttgctatttattgatttagggaagactggaagaggaaaatgttatgaggtctttgtgatagctattagaccttcaaggaggagatgtcaaagaaacagctgagtatacaaatctggaatcaggctgagaagaagcaattaagcatggtaggagaaaactaagaaggctaaatgaagacagtgtttcaatagagcagaaaaagcatttttatgagagaagggagaaactgctagaatcatgcacttgagtaggaaagagagatgcaaaccgtaaggtacaaatcagggtttgtcacaacttcagtactactgacattttgggcttggtaactcttcattgtggaggactatcccgtgcactgtaggacgttttatctaaatctctggcctctcctcactagttggcagtaccaattccccacctccagtcacagcaatcaaaaatgtctccagacactgccaaatgtctcctggtggacaaaatcacacccaatttagaacctaaatggaggaagtggcctttgctgaaaacattggttattcatccacataaaaggaatgatgggagttattatgggaaaggtacatgatgataatatgattacctcctgctgattagatcctcttaagtgtggatgcagtcaaggccagagatgatatgaagaagttgctagcacaaaaccaaaatcattactcctaagaaaatgtatggaattttgtttttgaactacagctaacggatgagctacatatatctgtgaaatgagtctaagccagaatgtttatgagttttttgtgtccatctatgcttacttgcaaaacacacttacgactttttgagtttctccttagatcacaagaagaaaacactactgatttagtacgaaccaatgggtttctcctaaaatcacaggaagaaaacaacaattatttagtatgaattaaattaaatgttattactcccaaggctcagtttttagaagacagtggacctaaaggaacatctctccaatgataatccatctaagagggtattatttattcccctaaaatcactcccaccaaattaccatgtatattatttagaggggcctaactctgttttctgtatctgaaagagataaatgataaccattacattttttaggtgttcaggactaggggtagatagcattaaaggaagcctcaggaatcatgaaatgagaggatttgagagtaaaacttgcaggcaaacgaaaaaaaaagaaatttaagaaaacaaaaacccacacacacaaaaataagaagtgcaggcaactggtttcatatttacatcaaattccaggattacatgagctatctttaagagagagtgaatatagtcatgtcacctttgttaagatgtacttgtccctcaataccaagttacatcatggatcagggtttcagagcactaacataatgcaaaaggattctacaaactcgaaaggactgaaaaccctaaaacttctactgaaatatttggcttccaaatttgttttaaaaaattactgacaaatggccgggtgcagtggctcatgcctataatcccaataccttgggaggctgaggcaggaggatcacttgaggtcaagagttcaagccagcctggccaacatcgtgaaatcctgtctctactaaaaatacaaaaattagcctggcatggtggcacgcacctgtaattccagctactcaggaggctgaggcaggagaatcgcttgaacctaggagatggaggttgtggtgagcagaggttgcaccactgcactccagcctgggtgacagagtgagactccatctaaaaaaaaaaaaaaaaaaaaaaaaactgacaagctagagaagtctgactaaatctgaattttagatattctatattatatcccattttaagtactgccttggtttcacagaaggaaattaaattggtcaggcatgacttgtttttctactgtgccattatggttgtcacccaacatcctgtgctctttcagataattaaatactgagactctgatttgttctaaaaatttaccaagatccaagttaagataatctgattataatttctaaagtaatattttaaatagcccaaatcctaagaacagaaactaaaataaaggcattgcacgggaaaaggaaagctgcgaaaggagaacctaaacaccatcacactggtcccatctcccacccaatactgtactatgacagtcgcaggcaactatcatctgccaggtgccaaggaccaaaacctaatcaagaggcttctcctcagctgtaagcccaaagactcattcctagacccactacttcataaatgctctgaatggcctatctactgagccagaaaggaggtcagactccccgactgtgaggtctgatcaaatcttgtaaatacaagtgagatctgatcaagtcttgtaaatacaagtgagaagcaatatacgataaagactccagacctacaacttcaacacaaccactttatgtttctagtccattttctcttttgacccctgaaaatctctagagaagtccatataattttcattcgtggtctaaatacttaaagaatatctttaagaacttcttttacagatcaaagacctaaacatgtttaagtgatttcaccaacaccatacaagtagttggtctctgacctcccatttttggggaagacattattcagaaccttaccagagtttctgagtagttgctaggagtcttcttgctacaagcaagaaggctaattaacaatctacgcagggacataagaacttataaaccctatattcacttactggttgacactaagcccaagcccacaaggttttaaatgtatccgtttaaacaaacaagaagctacactccaagaacaaaaaggccaatttctcttagaaaacaagtccattctaaattcttgacttctgtctttcactttcctctcagcacaggttaacacattaataaccagccagtacagaagcatgtttctaaccaaccccttgattcccctggccaaaagttctcttagtcttcctgaattcccacttaaatgctggtaatattgcacagctggcctactgtggttaggtatgtgtcttttactctcgtattagactaccaggttcctacacttcttcaataaactccctgaaatcaagactatgtcttgtaattctttttttttttttttaatacccacaaagcttagcacacctatgtgttcaacatttgctaaatgtataaactggttgatcattttcaaggtttggtgttaccataactctaggactgaaattttattctacaatagagttaagacatatctaaatgccataaaagaggttatacaacattattttctaatttttaaatgaatggttttccatttatttccaaccttttgttggtattttaatttaaaaaaaaaattgaatgtcagaataccaggtacgttttcctgaaaagctacaggtaatgtttgcatattatattttttcaacattctaagagtgtctgttatttaatgaagaagtcctgtgattaaaaagtaacttttgcaaagaaaacagtcactcaataatttatccttcgtattatgccattcctttgcttctgttgttcttatctttccaaaccttactcttccataaaacctcttcttgttttcccaactacaatctcttccatctgccttatgttataattatataaatcattttaatctctgccagtatattataaattccctaagagtgcaaatgacttactaatttttgtaaactttgatcaatgtgttgaaatcatgtcacactggaataatagtaactgcccctatacatctcaaaatagtctgcaagccttaaggccaaatgaatttttaatttaaaaaatcatcacgtatgatcattatttcaattaatattttaatatgtgcagtaaagtttaaaaaatagccaaggactatctttcagaaaagtaataacataaataatgagaaatttacaatatctgttgcataaaccctcaaaacattcactgaagggtagtaagaaatgtcttaaaggcaaaataaagtataataaagctcatacacgggagaagatcatctctttgaactaccagagatttgacttattgcaggataacatttcgaaaacctagatcttacactgaaaagaacaaaattgttcaaaaggtgatgttttaaaatgtgatatctacagctacatttacgaaatcacaatcgaatgtttaaggaaacagctgtatactgcctaaacacaagtgaaaagcatcatagcttacgtgataccactaaaaccacagacatcagctgagattgtccactacagactgcagtaccatgtcaatattgcacaaattgggacatcacgacatcaagtagtcattcacagccaaccaatcacgccacccaccatgcacagcaaaatatataacacacatttctttcaattattacactgtcataaactcaaaatccttttagaacaattctgttcttcaaagatgtatcaattttagactctgaaataaagtatgtattgtattttgaaaaggttctcaggctaccatgaaacacaacatcagctaagaatcatgagttagttgcaagacagtagttccttctacactatgtctgggaggccttccatccatccactaacccacctacgcacccacacaccctctccagagcaggcactctgatattaagaaggaaatactaccaagaaaagcccacacaatgagaagtcacaagaccttcattccaagtcctggctggtcccccttttaatcatctgatccagaactaaagtttcttcatctgattgctctaaaatcaagtgacaggctccatgaagaggagcttgctttttatttttactattatattactttattttattttactattattactatttattattcctatatttacaaacataggaacttaagtatttgttagttgattatatatagactgcttgaaagcagcttgttttttgttttgttttgttttgtttttcaatctgtttttcacaaagcccaagagatcatttctagttcatggcaaaattaaaactggatcagtgcgctcaaaactaaggtagttaaatgagatggtgtgcaaaatgggtttgtatttacatttgtcaaaagaccaaaataacagtgtcacaggcaggcatcctaaaccacgtaaattttgagtcgaatttggaaacccaaaaggactgtcttgttgcaacataaaaatgcagtttagagtaagaagatcagtatgtaacagaggggccaaagtgaggagtacatataattaaaaataaagtcaaagatggagaatacttgacaagtttacatttcctaacacagctattaaaaacaattacatattcttaagccaagagtaatatagtaaaatgacacttgaagaaaattatcctagcagcggtgtggaggatgaagaagttatcggacatgacagttttgaaagcttttatattaataccaataagattgtaaaataaggtggtggttaaggatatgaaaaggagtaaatctggtagacagtgcagagtcaactagacttcgtgaaacgctgaattagggaagtgcaagaagatttgaaaatgactctaagcatctggtcacaagtggcctacagcataaccacacctgcacagcactaacagttcttacacaggcttttccaggctgcatctgaacccgtttatttagttctacataccagacctgccgtgagacagcactccactttagatggaagcagaaaactaccaccaccattctagcaggaaaatataaccaaagattccagctttgtttcttgatgaaagaggcccactcttctaaccctgaggaacttcctatctgcactactggggaacagggaaatttcttctctctatccccaaaaaccaagattctccacacacttgaagacaaagctcagctctatatgaatattttaagtcacatgtacataaaacacagatgacaaaaggggtcgttctaaactggagctaggccaagtggattacactaaaaaattaaaatggctaaaaagcaatcttctggggttaatgtatcacaaaacgtcaaaaaataaattctgttccagaatgcactgctacataatgattctgcagttttgctgaagctttattttccgcagttttaaaaacactgttggaaagcagacatcaaagggttttccttgtctaaaaagcataccattacggaatttccagttttatcaagaagaacagtttacaaaatatatttaataaaggtctggctgcctacagttccttataaggaagaccatgtataaatttcattctttaaaaaagaactcaatttatgggagtctatctatgagtaaacgaagctccaaggcttggtttaaacatttccactctcaaaaaggactgatgagtccaatctccttgagaaacatgtctacttcatctagcttttaaggagattctaaaacgttatgtatacatacacttttctcaaacaagcactgttgtaaatttttcacattgccttactatattaaaaaaaaggctaccttacagattaaaatattatctaggaggattaccaaactacgacctcctgataaatgagacagctctccaagccactgtgactctaacctttccattctaaatctttcgggcgcggaggatgaatttttctatctttttgttggaattaagatcctgcattatcaggagatacagagtcaggcttaaagccacagactccagcagctcctcgctgccctagcacagcgggcagggggagccaaggcgcagcatcgcctccacgctccgagaccaacaccaagtctcttcacctccacgctccgagaccaacaccaagtctcttcgcctccacgccgagagcagctgcgaaacggacgctctggggtttcagccgcaccaccactttcctccaccgcagaccgaagggccgccctaggaggagccttctagtccagtcacctcaggcccgtttgcttggggtggagagtgcggtggattcctaagcctttcccctaacgggtgatttcctacaccagacgcaggacccacggtcccacgggtcccagggggaactaaaccccaaggctgcaaaggggccacgggtggggcccaccaacatctcacagcctcctgaggaggcgtgcgccctggacaggaggtccctgcccccgcgtctggcccctggtatcttcccctagggctcccggccgccgctcaccgtgaaggggacatccccgacgctgcccacggagtagcagttgtctccagggttgacagctccggtgaggacctgatgcagatgcatctccggagcccgggctggacagaatgcgcgggaggtgcgacaagctccgcgcctgaccctcctcgggctgcgagagccgtttccctctgtgcctccctcggaaacccgccccgcggaggctctggcttaactcctcgcccccctttcgccttccctccgcctcgtccctgccatgggagctcctcgaccgccgccgccgcccgggtcgccgctcagctgcggaaatgcccggatgttcccactgcctgctgcaccggcgcacaaatgcgggagggcaagggtgcttgtgaggcgggggagggcaccggggggaacgcgcgagccgggagcgtgcagcaagggagcgggccagcgcgcgcgcccaccgcgggggagcgaggtagagccctccccccgcggcaaagctctcagctcagtctttcttccccccatcacccgcgtttgcgcgtgcgcgcgccgtggtttccagggcaattgcgcgcgccacgccgacccgccgtcccgtgattgcgcgcgcagacgtgcgggagttcccttggagcctcccgggctgtagccgctgcggactggggcggaggtgggggcgggggcgagtggggtgcaggtcgctcggggccacgcagcagtcggacgccggggacgcgccacgagccggttttgctgtgttgaacgtattccagaatacagtgtgcaatggtcagtgccgttgacctcagaaggacacccgtcaccgggaatttccacctggagatatcttagatatcttcagtcttttcgaaagtgcagtacataagatattttattttacataaacaatgtaggcatcttgcaactatttagagaagccatactcccctgaaagctaattattttgctcccaccttttgtcacggttattctagacagcaaaaagccgccttagagacgggtgactcctttcgactttttttcatgagtaatttcatgaattagcagaatcgcctgattttccaaactatctgctaaactttgaatggttgataacaaggatcatcagctccctgccacaggccaattcatggcaaatgttctaacccatactatgcttaaatcacagggtaaggaagtaggggacaccaagacataactatctgtaaaaccaggcagaacgccaaaggtggtgtgattgagatataaaagtctttatgcaccacagaagaggaagaagaatgttgactaagggcgtggataaggcattatggagacataacctgacataaacgctgagtttaattttgacaggctgagatagacaagaaatgctgcaaatacagtacagaaaatagagggggtgttgaaggtacaaagattaatgtttgaggcagatgatttatagggtagggaaagtaaataatacttagcaagagatcaaggtatccaagtggtctaactcttggcctaccaaaacatattatggagagtcttgaatgctccaagaagcccagatttcactctgcatgcagtgggggtatatcagatgtttctgagcaaaaatttatataatcagagctgctttgggaagatgactttgtagcattttgaagcataaagggaagggtggggaagattggaggcaaagatctgtcagtcgttggtaatcttttcagtagaaagttgcaggaggaatgaaaaataatacctaatgacctgcggcattctctctctttctctctctcccccctccctccccttccctcccccccccttcctcccttcccccgcgccatatccaagggttcctttttgttactactagattctagatgagtctcttaatctttgaccttcactgcattagaaaccaagtcaaaactatcatcaaacaacaaattgtactcaggtttccaagagtgttactaattcacattatttaaaccatttcacatttggctcttgttttacagcattccatgaagttttggcccattcacacagttgtgaagttgtgagcctctttcttcctctcggtatcaaactcaaaatctgaagcctgtatccacctgttctcttccctcatgaatcctttaaatggcttcttgatagctgtatcttaaggttgcaaatgactaattaagtctcctggaattacagctgagccttttattgtccaatctgatcagtcaaaactcactccagactaatatggcaagtttccttggtagcccaccagggcagctagaccacacttttgactgtccacaatttcatctcttccttgttcatgcaaattttttcatggacctaaaaacaaattggaaattctttcttctaattttggaaagggctttcttttaaaaattagaaaaagtagcagttttgtatcattaacaaaatatgctaatcgaattgtaagatataatttatcatgtccacaactcttttttttttctttttgctttgatttgagatcccaacacaactcttaatagtacctttggggttgggtttaatggcccattgaatgtgtgccattaaatgtgggacttagtttcccagcagtatcacctaccgatgtgtactagttatcaattactgtgcaataaattaccccaaaatttatcagccaaaaataacagtagagattcattacctcacagtttctgtgaatcaataatttagtagtagcttagcaggaaagttctggttcagagtctttcatgagatggcaatcaaaatgtcagctacatgctaaataaaagaagctggacacaaaagaccacataattcgtttgtatgaaatcatttgtatgaaattttctgaaaagacaaatctacagtcacagaaaataggttagtggttgcctggggctgaaggtggaactgagagtgactgctaatggatatgaggtttctttttggcatgagataaacattctaaaattagattgtggtcatggttgggcagttctgtaaaattactagaaatcattgaattgtatacttgaaattagtgaattgtatggtaattaaattatactttcaataaagctatctaaaaaagaaatagccagggatacagtcatctgaagtcttgactgaagttaaaggccctgcttccaagatggcaggctctcatggctagcaagttgagcctaatagatagatggaggcctcagttcctatgtgttcctctccatagtgctgtgtgagtgtcctcaagacacggcggctgactgctccagcagcaagtgatccaagagagagaccaaggtagaaactgcaatgtcttttataaactagccttagaagtcacacgccatcatttccaccatattttattgggtgcacaggccagctataacttagtgtgggagactatttcccaagaaagtgagtgccaggaagggagagtcgtgagcagccattttggaggttgtccactacaccacggaactcaaggactttatcttcaagagtcaaggggcagccaggcgcagtggttcacgcctgtaatcccagagctttgggaggccgaggcaggcagatcacctgaggtcgggagtttgagaccagcctgaccaacatggagaaaccccgtctccactaaacatacaaaattagccgggcgtggtggtgcatgcctgtaataccagctactcaggaggctgaggcaagagaatcacttgaatccgggaggtggaggttgctgtgagccgagatcacaccattgcactccagcctgggcaacagaaagtgaaactctgtctcaaaaaaaaagagtcaaggggcatgacttgtgtcattattactcttacctacagaggtaactggaatttctactcataaatctacagcatcgtaatgttgatctttgatatatctgttattagttcttgttgagctatctatataatttaaatattaaattctcaagtgattccatttgtttgaggatctaatacctattttttaaaaatatttcttccagttgtggggaccttacagttttcctaggatgtctaacactttaagcttctggtttcttcagtagtatagcaatggaagccctgactttctgttaccagttcattttgcagtctattgtgttaaagcctgaaattgatgttgtaacaatacctgtattgcttttcagtcataaactatagcaatgatgcattttaatctaaaatatcataggtgtgaacctatatcagttatcactttaacaaacccctctgaaacacagtggcttaaaacaacaattattattatttcgtatgttctgtgaattggttgggaagttctgctggtttcactcatacaactgcagtgaactgtggtagaaggtccaagatggcctcatgtctagcagttgatactagttgttgtctggggtgcctcagttcccctttatgtggcatcttgccctccatagactagaccaacgtttgtacatggcagtctcatgcttagccttgaagggcagagtcacttctatcatattccttggtcaaaacaagtcacagagccagcacagattcaagaactaggaaaacaaatccacctttcaatgggaagaacagaaaagtcacattgaaaatgggtatagaagaagttatcggcatctttacaaaaaaatctgtatcacagcctcaaactctagctttgaccatctctgtggcctctgatttgttatatttgcttttgctttaggtaagaatgccacttataggatgaaaaacaaaaacttacgtatctgctctctttctctgctagaggtagcattaaattattgtctttttggtgactgtaactcagactcttagctatttctcattcattatgcatttggctttttatctctaatgtaagtgcattggacatggggcagtttttacatacctttctctggtgtaaaggtgaatctttatgcatcttataagcaggtgaatacaataagttttcatctagttagattattttgttgctaggctcagaacactgaccatttagaaggagtacagagaatattggttcatatttttgcaggtacctatttatgattgtactgtgaaaagtaatatgctctatgtatacaatttatttccttaatgatcactgattagcacttttataaactcatttaagcaagagcttaagtggtaactaattttttaaacattttatcgtatgaatgattatacagagtagaccagacacaaaaactattcacccttgcttatcttttcaacttcatctttcaacattcctgacctctaaatgtagggtacaaccacactagtatacagtaattcctttcaagcctctggccactggctaatttccctttccagaaactccctcactattatcattaccaccatttggtcgggcgtggtggctcatgcctgtaatcccagcactttgggaggccaaggtgggcagatcacctggggtcaggagttcgagaccaccctggccaacatgatgaaaccccgtctctactaaaaatacaaaaaaaaaaaaatagtcaggtgtggtggcatgcgcctgtagtcccagctacttaggagactttgcttgaacttgggaggtggaggttgcagtgagctgagatcgcaccactgcactccagcctgggcaacaagagtgaaaactctgtcaaaaaaaaaaaaaaatccatactctttgcctatttcactctttcactcctactcttccctaaaaattcagttcaggcacccccatttctggaaaactttgcacagtgtgaattagattcctttgttatatactcacagtattctcttaccttttctgcctagagggcagggactgtgtcttgatgttgacaatttctgattgccttacctattatctgttttctcctcatcaggaccctcagtttttagctgggaaatagatgcctggaataaagaatacatttcccagcctaccttgttgccacttggttatatggctaagttgtgatcaattagatgttgatcaaagcagaagtacagtagtttctggaaattttccttaaaaggtagctatcataccttttatgccttcttccttccttcctccatcctgtttccctagaacatagatgagatcactgaagctccattttggagcatgaggatgagggttcaaccctagggatggtggagtagaaaactggaagctgccgggttcggttgatcacacctgtaatcccagcactttgggaagctgaggtgggtggatcatttgagctcaggagttccagaccagcctgggcaacaaggcgaaaccctgtctctacaaaaatacaaaaattagctgggcatggtggtgcatgcctgtagtcccagctactctggagaccaaggtgggagttttgttggaaccccagaggtggaggttgcagtgagcccatattgcaccactgcactacatccagcctgggcaatagaatgagatgctgtaaaaaaaaaaaaaaaaaaaaaaaaaaaagaaaagaaaagaaagaagaaaagaaaagaaagagaaaaaaaaacaacaactggaagcttgtcacttgtcactgaattccaggcaactgtggagccttctcaccagccttggtcttctccatctggatttttacattagagagaaataaacttctatattatttaagccactgtgttttgtgtctctgttagagatgttgctaattctaactcatactcttagctgtgtgtgtgtgcgtgcgtgcgtgtgtgtgtgtgtgtgtgtgtgtgtgtgtttaattgctaaagcctggcaaagtacctggaacacagtaggaactcaagaaatgttaactaagccaagtagttattaactgtatcagggtacattatgtaaattttgtgaaaatgtcacaaatattttagaacttacatacctttccaaggcctcagaaaacaaaatactacatcctgtcgggagggcagatggtagttgtgggatagaaagccagtagtgttgagataaaggataaggactgaacaaaagttgaagttagttactaaatcaggcatggcctgctgggtagtcaacagaccattttgtgcatctgaagaaatgaattaattttgctggcatggtacttaagcaaaatacaattttaaagagagagagaaacaagttcattcggtgctagacttagagagaaaaatgaacttatgttgttctggttgctgagagaaaaatcagtcaacaatcaggcattgtggtgttgaaatcaccaagtattgcacagtactcttaggggtgggccaggatggtcacactcctaaagggaagtgagaggggagaggaatcagcacttcctcatggtgaagagatggcatccctgcctgcaggaaaaaaattgtatctgggggcagcagaaacaagcatgtgccagagggtctgggtccagtgtttgttttttgttgttgtgtggtggtggtggtggtttgtatttccctgcatgtgggtgtgcccacatgcatcaggtgttaaccaaaaaaatctgacgttatcaattgactctccttttaatctagttctatatactgcaagcatatttgtataggcatattcctgtgaccattaacccttttacatatgaagaaagattatgaaaaatgttcaggatagattaaggtttttattgcatttttcaaaaagaagattgtaaaaagagaaagctgaccaccaacatatgaatggataaattgtgctatctacatacaatagaatattattcagccatgaggaatgaagtactgacatatgccataatgtggatgaccttgaaaacattatgctcaataaaggaagccagacacaaaggccccactggctacacatttatatgaaaatttccagaataggtaaatccatagagatcttagaaagcacattggcattgccagggcccaggggaagaaatgaataggggtacagggtctccttgtgtagtgataaaaatgtcttggaactagatagagttaatggttgcacaacactgtgaatgtattaagtgcccctgaattgttcacttccaaatggttaattttatgttatatgaattttacctcaataaaaagaaacagtcattttttgttaattaacagaaactccatgtgtgtacaaagaaaaagttctagaaagtatgttaacagcactcatgtctagttgatagaattataaacaagtttaatttcaatttttttccacatttgtttccaatttttctgcactgaatatatatgagttgcttttatattgggaaaacaatgattttaaatttttaaacaaaagatggcctttctttaagtctatgaagaagtttaagaaactaggaaatcatgctcagattaacattatgtattccatatcagttgcaaaattaaattttaaatgaagatataaagttttatggagtatatttcattatttttaaaacacaataatttgtccacacttatatgtaaaatttcaaatgcaaatgcaaaagacatgtttaaatttgtttaaaagacaggcattgcagagggttcctaaacaagtctatgggcctgctgggcctttgatcttggagtggatgatgacttccatagctctacaacagtgtcagtaggcctacaacctcaaaatctcaccacctttgaaaagcagttggtaaggagccagtagtctttctggtaaacagagtccatgaaccccaccgtattaacagtttcttttgcctagaggtctttctcccttcccctcttcaaacacggctccaccccaattcaacattgtcttcaaagcccagctttaaaatcacctaggtaaaacctttcctcccaatgatgttaaataaatttatcccaccctctgttcccctaaatctttgtgtcttcactatgagatttatcttattacttatatcacaatatactttttcagtgagttagcagcacaactcccatgcaaatataaaatgaaattatgccaaagattttgttcaactcattccttgattaagaaaccagtaagatgttaaaatagttcaaataagaatttgacttatggagatttatatcttctacctgacagttcatttgcattgcttatgaaaatgagttagttatattgctatcagttttccaaaaatttagcttttattctcaatgtttttaaatagcctagttaatagcaaatcaatcaaataatatcagacaatccttaaaattctcctaggcaatgcccagctcttcactgaaggtatacttgacaatttattttgcctatttccaagtcttgaataatttttcttgacaattcatagcttagatctctgtctacagagtctgtttgctagagtatgagctcaaaagtatatcttcagagattggttaaattaaatactgagagcgtcttcattccaggcagcaacaaatactctagggatacaaagatgaggcaaaggcagaaaaacttctttccctgacttcagggacttatttagtacatattaaagcacataaacaaataatttatatacgatatgaaagagctataccttaagataaatctgtggcaagtacaaaatggaattgtaagagagcacgattaggattatttttagggaatcgatacacatattcctaatgcaaaaactcattcatgacttccctacagaaaattcagttcaagcacacacaaacattttggcacgtgaggaaagaggctataaagaaaaaaagataatatgataggtaatatttatggagcacattatctttaatgcttatgactacctaataacataggcagttttatgaacccctttttatagatgaggaaacagaagcacacggaagtcgtacaatgcaagactctgtagacagaaatctaagctatgaattgtcaagaaattcatgggaataggcaaaataaattgtcagatgtacctttggtgaagaaccctctaagaactgaaagtctaatgaagtaggaaaaatacaaaaatgatacaatcccatacaatgtaacaatggtattaagagtacagtgtaataattatgccaaatatagtggacacgttttgagatgccaatccaaatcatgccccctttgaaatttcctccatctatcatctctgctaaaagggggatcctaactgactatgtttgtcccatctgatctccacaaagtcctggatcagctgattgaattg

SEQ ID NO: 1069 - DNA, 34781 bp, Homo sapiens
aaagatcagtagggattctggagagcctgcaagaatcttttcattaagcaaatactgcagtagctggagaatctgagtgttacgtaggagggctgtgcttgtcatgacagcctaatatcctaatggaagttgacaaccatagttacgaaatctataatagaatgcagagcctgttatctctgtgaaactgcttggcaaaagtttgtaaattatatacatatatttaaagaatgtgaagtaaagccagatgagggtcttttagactcaaatggccctgttatgtcctcctgcctcactcacgcacctccccccactgctgttctgagaagctgcaggaaaagacagcgtctctcttggggtctgtgttaccagccctcccaccgcccactcaggaaggatggagatacaggtcttccttctgtgctcttgattgtctcagcagaaggagagatactcaagcttgtactgagcgcctactatgtgccaggcactgggctgctttgttatttccaccctcccagcagagctgcgcaaggctgttaatccttcccactttgacacttgaggaacctgaggctcagaggagttcaatatctgctcaggttcacacagctggtcgtagctcctgatcgcaggaggagtcgcagcgaaaacccgagtccacccgtgtccaaggcccggttctttctacctttcagttcctgccccaggcagcggcgcagcttggtggtggcggtgcgtgggtggcggggtgtgttacgatctccttgctggagacatgtggctgcttctcaagagggacagcgctggatggagagtgagtgagatcggccacatacctctgtgtggtgcccatttctgggacagtcctggatccatcgacccgccatcctcccaaaggtgctccctctcttcaggtggtgcccatggtcctatcaaggttcaagaagtgaatgatgagtttctttcagatgccacaaggtggacccccactcaggtgacctcagaggttcatgagtaacacacttaagagcaaggactctgctgggcaatgggagtgcctcccggcatggccatggctccctggccggctccgcatgggttctcaagtgcagactgctctgcctcccagtgctctggttacggagactctcctctgctttgcctctgaggttcctgtggctgcagctgcctgcctctggttcttggtgacttctgctgccttctggctcctgcttcctgatctctctctccaggcaccttccaacccaacctgccacctctgactctgtctcccattcaaactctcccagaaagcgcctcactgggtgggcaattccccgtcctgtcaatggcagctcttacatgaaagggcctcacaggcctctggctacctgtgggtcaggagacagaacagttaagaccaggtttggggcaagtaatggagacttcaaaaatagtggcttaaacaagataatcatttctctctcagaaattataaactttgcttatttctctctcaagataatcatttctctctcgctcgtcctggactgcagaggcggttcaggacaagcagggagccccacgctcacattcacactccaggcagcaccacggaggtgatttttttctttttttttgagatggagtctccctctgtcgcccaggctggagtgcagtggcaccatctcagctcactgcaacctccccctccaggattcaagtgattcttctgcctcagcctccctagtagctgggactacaggtgcccaccaccatggccggctaatttttgtgtttttggtggagacagggtttcatcatgttcgccaggctggtcttgaactcctgacctcaggtgatctacccgcctcggcctagtctttccctttcaaagagacttttcacaagttccacacaagaattccacttacgtttcatctgccagaatgtagtcatttggtcacacttacctgcaaggaggctgggagatgttctactttagctgggttcatggccacccagataacactcgaggctctttgccaaagtaaaggggagaataaatattgggaggcaagtagaagtcgctatccagctccagacaaagattcttggcttgaccaaacttcagtcaggctcctgaaccttcttctcggcccacctgtgcacttcctggtaaaattgagttttagcaacaaccctgctaagtcagtttatcaggaactcctccctgcccccgctcccttgcatatctgatcaggtttctcctcctccacccttcttcaggtgatatcgagccatcctggcctgttttcagcaaaaatcctattaggctagtttagccaaaatccctcttatccctgatatttcctcttggtaattttccttccactaactctacccctctccttgtctataaagtcccacttgtccatgccgtattcagagttgaacccaatctcttcttcccactgcaaaatcccactgttgtggtccccatacccatctcggtggtcctgaagtcttcctttctgtgctttaacaagcatcaccaatttttttttttttaacagggctcatcctaatgcagccgtctctggctaggacagcagatccaccctgtaaagagtttgtgaggccaggaatccctcagaaaggggtgctggcacgatgggtgccttgcacaggctggacagagtgctcattcatattcatgtggcatggctgcaaaggaaccagaagagcctcttcaccccactcccaagcttcccccttagcactgctgcctgcaagttcatcactcaaatgaagtgatgccttctccagcactccttttaaagtgtgcccctgatcctgggccctccctcacaatcactatccaagtcaggatggtcctagcaatcactatcactaagctggagcccacaagcctagtctgacggggtcatagtcatgggtcccaggagccccatcacaggctcagagggtccaggaggcaaagcccaaacacctgcacaggtgtgaaagggaaagggttctgaggagggagcgggagggtgggggtgggggaagaatgggctgatggaaggctctgaagtagcagccggagcgcagaaaatctcagaggaggggaaatgctagcagctcccaaggagagagaccaggctgacctgacatcatacggatcaagaagcacggatgaggagatgaatgcagacacctgggggaatgagctgagaaaagcagagtgatctgaggcaaaggagaataatggtggtggttcctcctgcttggcagggagggtagtacctggggaggatgtcatggggtaggccagttccccttgagttttccccaaccaagtttcccccaaggcctccctggttacggagtccacactgcaactgccctccccaccccagggcagaaagcagaggaggcagtcatcaaggactggctctgagctagaggccagcagaacccccaggaggccttgccgagggcaggaaggaggtctcgggcctctcagctggagtttattgtcctgggaggaaggtaggatggcgggagcttaggaaagagctggggatgtggatgaggagtggggaaaggttctctttctggtagcctctccaccctccccatctcaaggcctttgccaccaatatcccccttgggcccctaacatctttcctggtctccagtggagctctattgccgtcttcattcccctgtagacacagggcctctcatctccatgcactcagcaccggggtgatggatgtagccgccctgtcgcttcctcactcacacactcctctggaggctaatgaagtggctacaagccagggctgctggtcagacctggctctgcccctgtgctgcttacccattgatgtgtaacaaactaccccaaaacttagtgactccaaacaagagcattttctgatatctcattttaggtcagtaattcaggagggttcagtaaacaattttgctgttccatgtggcattgacagaggtcactctgtggtatttcgctggcagatatgctggtatggagtaaacaagaaagggtcacacaaatgtctagtgtctgggctcagtgaggctgtcaaccagttggcctacccatgaccagtccagcatggcagagtggggcacaggccgacttctacagggtggctcaggattcccagagagcacattccaagagacccaggtagaagatgcaaagtgtcttatgacagcctcggaagccccagaatgctgcttctgctgcattctcctggccagcaagtcactaaggccaatccagaatggaggctcacgaagtgtttaagaacacaggttcactgactgagttggtagtatgattctaccctgctagctaagcaacctgagaaactttacttaagctctttaagcctcagttttcttatctgtaaaatgggaataacaacattatctacctcttagggtttatgagagtttaattgtatatacatatatataatttctaaattaatacaaatgtaaaaattatacatataaattatacatgtgtgtatgtgtatgtatatattttgtttgtttgtttggcatttagtttttatttcataatcataaacttaactctgcaatccagctgggcatggaagggaacaaggaaaacatggcacccaaagggaactgcagtgagagcacaaagattctaggatactgcgagcaaattgggtggaaggatgctctcctgagttacagaaggaatggtctggaggttaagataaaacacaagtcaaacttattagagttgtccacagtcagcaatggtgatcttcttgctggtcttgccattcctggaccctccatggcctccacaatattcatgccttctttcaccttgccaaaggccacatgcttgccatccaaccacttagtcttggcagtgcagatgaaaaactgggaaccatttgtgttgggtccagcatttgccatggataagatgccaggacctgtatgctttaggatgaagttctcatcatcaaatttctcccagtagatggacttgccaccagtgccattatggcatgtgaagtcaccaccctgacacataaaccctggaataattctgtgaaagcaggaacccttacaaccaaatcctttctctccagtgctcagagcacgaaagttttctgctgtctttgaaactttgtctgcaaacagctcgaaggagacacagtctaagggctcgcggcgatgtcaaagaacatggtggggttaaccatggctgatagtacagggctcctgccagtggctgtggcgtctgcaaagcctgtttttgttttttttaatgcccgctgtagaaagctcatgatcatcaatatctgcagtttcctcttcttcttgggcaccaccctagactatttcctggcttcccctgcagttaggtgtggccatgtgactggttctggcccatggaacttgaggggcagtagtagacctggcctccattcctccatgcttactctcctggccctccatctacctgtgtttgaataaaaaataaagcatggcctggccaggtgtggtggctcatgcctgtcatcccagcactttgggaggccaaggcaggaggatcgcttgagtccaggagtttgggaacagagtggtaacatagggagaccccgtctctacaaaaagtcagctgggcgtggtggcatgtgcctgtggtcccaactacttgggaggctgaggtgggaggaccccttgagcccagaaaatcgaggctgcagtgagctgtgattgtaccactggactccagcctgggcaacagagtgagtcgctatctaaaaaataaaaatatcaatcaatcaataaagtgttgctgagtttaggtcactcaggttttggggctgtcagagtcattggcctagcctgactgactaaggcacaggtagataataaagttctcaatcaatactagctgctgttctggcctaatctccctgggcctgtgttctcacccataaaatggtgttcacacgacccaccctacaggattgaggagtgaaagaaatgatggagagtatgacttactggcttagcttctcttcaacacggttactttatctaaatactaccaactgagtcatcattaccttttttcttaagcaagattatttgtaatatagcctctttaaagttttatttttatttatttagtttttggagacagagtctcgctctatcacccaggctggagtacagtggtgcaatcttggctcactgcagcctcttcctcccaggttcaagcgattcttgtgtctcagcctcccaagtagctggaactacagatatgcaccaccacaccacgctaattcttgtatttttagtagagatagggtttcaccgtgttggccaggctggtctccaactcttgacctcaagtgatctgcctgcctcagcctcccaaagtgctgggattacaggcgtgagccactgcgcccagcccagaatacttcctaaaatccatttgacttgatggtttccaaacctaaatacagagtaggatgttcctaatttagaagttagtagatttatttatttttaatttttaaagtgatgaaatttttttaaatataaaaaatcatataataaacacctgtattcccacaactccataaatatggtcaaatcttaacattttgctgtatttgatacttgatttttttttcctttttagagacagggtcccactctgtcgcccaggctggactgcagtggtgcaatcacagtttggctcactgtagcctatagctcctgggctccgattcatgtgttttcaaaagacataaaacattatggatgaaatttgaaaaaaaaaaatttgtatctaaagaacttggcacagtgcccggcatatgcaaagcagttggtaattgtcagctaatttttttatttttgaaataattttagatttacagcaaacttacaaagatagcagagacatttcttgtatatccactcagctttctctgatgttagcttcttacataaccttgctacctttatcaaataaattaacattgctataacactattaactaaaccacaaactttattcagatttcaccagtttttccacttatgtcctttttctgttccaggatccaatccaagtccaggtggggtggctcactcccgtaatctcagcactttgggaggctgaggcaggcagatcatttgaggtcagaagttggagaccagcctgaccaacatggtgaaaccctgtctctactaaaaaaaaaataaataaataatatgccaggcgcagtggctcacacctggaatcccagcacgttgggaggccgaggtgggcggatcacctgaggtcaggagttcaagaccagcctggccaacatagtgaaaccctgttcctactaaaaatacaaaaaatagccaggcatgatggcaggtacctgtaatcccagctactcagaaggctgaggcaggagaatcacttgaacctgggaggcggagtttgcagtgagcagtgagccgagattgtgccactgtactccagtctgggcaacagagcaagactccatctcaaaacaaaaagcaaacaaaaaaaacccaggatccaatccaggataccatgttgcctttaagtcagctaatttttactcattcatccattcgttcaatgcactgagaatgctgccagctttcagtccaagactggagccccagtactatgtgctgtgatgatgattgatcacagctatcatttaattatgtattttattatttttataaatgacatggggtcttgccatgttgcccaagctggtctcgaactcttgggctcaggcgatcctcctgccttggcctcccaaagtgctgggattacagacatgaagcactgcacctggccacagctaccatttctgggaactcaccacatattgtgcaaagcactttctatatgccccacttaatccttacagcaatcctatgtggtggctgtcattaatcctgtgttatggatagggaaactgaggtatggagagattgagatcatacatctgacaaggggcagaagtaggatttgcacccaaagagtctggctccaaagtggtgctcctcacaatacaccacttctttcacaaggctgctctatagaagagggagatatgttattacaggctgccctgggtgagtgtggcaggcaggaaggcatcccagaggaggtaccagcctggagctcggcctcgatttcctcagtacttggggaatgtttggcttcccctccacctgcctcctcatggcttccttcaatctccccctgcagcctcagattctgcacccaatccacagagacccaagaaggtgacctgctggaacccaagccccaggcccagagtgtggctctgtcgcagcctcagtgcatccaccccagccaacaggggcaggctgcccatactcagatggggatgactggcttctggagccactatcttgggtcccactgatggtgcatgagcaagaaaccgcaacaagcattgagttgtcaggtggaagagggatccaagggaattgggaatgggcaggtggggctactgagctggaactgggtttgtctgctccagagaatcatagactccatcaaccccaggatgaattgagaacagtcttccattcctagggtggggagcccaggggtgtttgcacctgccaggagggggctgggccctgtgactaagctagacacggcagcaccagccctcccaccatcctccacctaagacatatgtatatcctctgtaaaagacccagagagcacctgaggcagccaacagcaatgtgggattgggagcaagtgttgcagagaactgagagagcagaaacactgcaggagagaggaggcagaggatggaactctgagaaaccttgatattgaagggccagccaaaggaggcaaggggccaggcacagtggctcacacctgtaatcccagcactttggaagcctgaagcaggagaatcacttgagtccaggagttcaagagcagcctggacaacatagtgagacctcatctctacaaaaaaaatttaaaattaactgggtgtggtggctcacgcctgtggtcccagctacttgggaggctgagatgaaaggattgctcgaggtggggtgtggggatcaagactgcagtgagctgactgcaccactgcactccagcctggaccacagagtgagaccctgtctcaaaacaaccagaaaacccaaacacacacacacacaaacagaggaggcaagacctcactaacagcagccagagaggtagaggaaagctgcccatttaaaccccataaataccttgggtttttatgatgtattttacaggtgaggaacctgggagggggcctttctttattgttttattttatgttgtgccaagataagaactaagaaactcagagctattttgttccatcatataactgtcctttgcctagtatttctggtatgtctccttcccaaccccatcatcctcttgtttaatgctttaatttgttaggagtctaattttaagcagtccgtttgaaagcagagtgctagtgaaaagactgactggtttcaagagatgctactagtggacagtgaattttgatatttagccttgggtaggatgggcatggagataatggtgatgcattgaacttgggtctttatcagacaacctaactattgggtgagggtatgaggaggacaagatgaggaggacaagatgaggacgaggttatctaatcctcacacttgtacccccaaaccttcctcctgcacccaaggcagatatcacgaattattcccacctgtactcctccccgaggctgccatcccactgaatcagagttggcaagccatctggaaccttgtgaccatcccgagagtaagtccttgccccacagaccaccaaaagatcacctgtctttatgacgatgaatattttattatagagatggactgaactcacttttgcataaagaatctctgaattgggtcagggaaatccacccgctaagaggtcaccacccagctatccctgcctctgcctcagcccccacttgctgtttacatctcagggtcactagaaacagcagagcctgctgttcccagggccaggctggtggggttgggccaagggtcagggatcctggctgcctgccagatcagaaccgccccgtctcccgccccagtcggttgtccagaacctggagctgccggaggaagcctgagttagggcagatattgcggtgggcctgcaccgtctggatggcctctaccagcgtcatgttctcacagatcatgaggaaggccaggacaagtgtggcagagcggcttacccccatggcacagtgtaccagcacgcggcctgtagggagaaccaacttagcatcagctacctgcccttgaaccacccacccctttgggaagaagagacacccatggccatcctctacagtatcctggaatactgacactgtctactctgtcaaatggggcaactgaagcccaaagagaggaggctggctcaaagtcacatagcaagttagaggcagggtttaggttagcagccgggatttccttcttccagtccaggtgcttcctcaggcatcctttgcaactctgggccaggggaagggggtttactgaattcctgaggtcactgggtttgcatcagattatagggggtgtccatctacctccctttcccccgagttctgccctctcgactgcccctgcagctctatgccaaggcctcatcttagaggaacccgctcaagagcttcactgggtcctataccttctgtccagtgcctggcctcttatggagggatgtggtgatgctgatgaccacactgcatcttagttatgtctgcaattgctagcctccagggtgtccctgaaggggacactcactgaatggtagtagctattttccctatggagtgggagggttactgaaagggtttgtctctctggactcccacccaccagtgctactggaataatggagagtcctaaagcacaccctccaccctccaccatgcctgatccagaagtgcaccttggggaacactgagggcagctcggatgtatcgagcaacaggcagaaagtagacactgaggtcgaagaaggggttgtcgtccgcctcgatgccatagtactccagggacattccacggtagaatttggcacctgtgtccacctggaacttgcctgcagcggcattcacaacgtgggtgattcccagctggatcagcttgctcttgtcccgggctgcgtacctggaggagagggcacaaggggttaggagagtggaggtagatctcactgtggcagctctggctgggttgaagtttgcaaacacccccgcccaccacccaccaagggtagagacaagagcctgcaaattggcccagggtgaaggggctcctcctgttggagtttaagactccttttcgggctgggtgcggtggctcacgcctataatcccagcactttgggagaccgaggtgggcagatcacttgaggtcaggagtttgagaccagcctggccaacatggtgacaccccatctctactaaaaatacaaaaattagccaggcatggtggtgggcacctgtagtcccagctactcagaagactgagtcaggagaatcacttaaacccaggaggcggaggttgcagtgagccaagattatgccactgcactctagcctgggcaacagagctagactccatctcaaaaaaacaacaacaacaacaaaaaatagactccttttcaggccaggcactgtggcttatgcctataatcccaacactttgggagactaaggcgggaggattcattgagctcaggagttcgagaccagcctgggcaacatggcaaaaccttatctctacaaacaatgcaaaaattagccaggcatggtggcatatgccagtagtcccagctacttgggaggctgaggtgggagaatcacctgagcctgggaggttgaggctgcagtgagtggagattgcactactatactccagcctgggtggcacagtgagaccccgcctcaaaaaaaaaaaaaaaaagaaaaattagctaggtgtggttgtgcaaacctgtattcccagctacttgagaggctgaggtgggagaattgctgagcctaggaatttgaggttgcagtgaatgatgataatccctgcattccagcctaggcaacagagagagaccttgtctctaaataaataaataaaaattttaaaatgaaatattactaggatcactgttcataatagtcaaaaagtggaaacaattcaaatgtccatattcagtaaaatggataaactgtggcataatcatatgatgactccagcagtgaaaacatgaatgaacttcaggtacacataacaatgtgggtgactcacaaatttgagcaaatgatcccaggcacaaaacacacacaacatgattccactcatatcattttaaacaacaggtgaaactaactacactgtttagatatataggtggtaaaactttacagaaaataattaattcaacagatagtgattaaccacagagaatagaaaagttataatgagaaggattcagtaggggcttctgggagacaagtaatatcctttttcttcactgggtgatgaagctgttcatacgtgctctgtgcacatttcctttttccttttttttttctttctttgagacagagtttcgctcttattgtccaggctggagtgcagtggcacgatctcggctcactgcaacctctgcctcctggattcaagtgattctcctgcctcagcctcctgagtagctgtgattgcaggcgtccaccaccacacctggctaattttttgtatttttagtagagatgaggtttcaccatgttggccaggctggtctcgaacttctgacctcaagtgatccacctgtcttggcctcccaaagtgctgggattacaggcgtgagccaccgcacccggccctgtgcacttttcttatgtgcattctagttccacagttaaaagcagtaataatataaaaggaaagaaacatagggaaagagacggtgggaggcaagcgtgccacctctgccctagagggctctgagagaggctcatgcccccattcccgtgtgaacctcacacccttccgccatccccactcctaacgtgggtcttactcacgcatctcccaggaagaggctgggccagacctcatcgatatggttcagtgtggcagcctgacggacccacagcaagcgctgcagcgaagccaatgtgggcggctggtagggagatgcctggactgccccatggatcttgggcctccggaggtcctgcttctgcagtgagtccatcctggaacagagtggacaccgcagtggctggaggcaggctcccagagggtggatccagctgatggggaagcccatggtgcagtgcctaggtgccacggggatgctgcaggaagggcttcatctatttcacatgaggtattaacaagctcagctggggctgaggcctagaacccttccccagggaacaagggaatcaagcctttgtcactgctatggagctgggcagacctctctcctgccctctgctgagctgcagatgtatgaagctttggccaaggggcccttggagttccctgtttgtggcactagtcagtgcagatctcatccctaaatcagcttggactttgtagggatgaaagccccagatggctgtggctctcagggcacccaggaagcccccaccaacctaagcagctcatctcaagccccctcacctgctacttccagtactcatcctcagacccccgtcccctcccactttcaggggcttggagatcagagcctatctccaggtaagaggccaggactgtgaactggtatttgttagcaactccgcatggaatgagctaatgcctcttataagcctgatgcctctggctgggcacggtggctcacacttgtaatcccagcactttgggaggctgaggcaggcagatcaactgaggtcaggagttcgagaccagcctggccaatgaggcaaaatcctgtctctaccaaaaatacaaaaattagccaggtgtggtggtccactcctgtagtcccagctactagggaggctgaggcaggagaaccttttgaacctgtgaggcagaggttgcagtgagctgaggtcacaccactgcactccagcctgggcaacagagcgagagtccatctcaacaacaacaaaaagcctgatgtctcactcgtgggatatctgttcctattttacccaggaggaagctgaagctcagaatgttttaaaagtgatgcccaaagccatacggctcatgagtagcaaggctggggttttagtccatccccaagcctttcagttaccatctttggggcctccagagagtggtcactaacccatctgcttcctcaagggagcctggtactgctgagccacacacctgcctacaggccctgggttttcctccttacccccacgactcaggccagcactggatgtcaggccccacccgggtcaggtagcttgtttcaggcatctgctggctgaaggagtcagggaccctgcggagctggattttcagcggcaccagaatatgggcctggtgccgtgttggagagggggtcctgtctttgctaactgcccctgatcccctggaccagtgactagggaaggtgcatactgggaagaacatcttttccctttggtaggcagtgccaggaccagaaaaagaaacaggcacccaggaggctgccggcttggccaggctcacccagtgggaggctgtcgggcaaggcggaagtgaagaccaagctgtcctcctcatcccccactgtgacctctccaggtggctgagtggcctgccacctacctggggcatggcctggggccgggaatgggggagtgggtgcaggggcaggactctgcctgagcggaacagggctgggcaggttctgcccagaacacaaacactgtgaagcggctagaattccaggtgctggctggggcgcccatggggggtggggcctgagagccgactgaggccttgtggactgcagtgggccctccggtccctctaaacccccaggcctcctctctgcttggtatctgtttgggattgaagaccgttggttccataaacctccatgaagatgggagtctacctgaagaggtgggaagagaacttctgaggcagggaggagagcctggctcccccagcactctgccataactcattctgtggccacgagcaagtctttgctcccatctggaccacagtttatcttcccatgctagggatgctggacttaattttcaggatgctctgggggtctgacccgagaatgagagaggagtgtctggatatgcggtcactgcagggcagagggcagtgtagtgtggtggagttggggaagcccccaggacccagaggagtccaacagccacactggtctggagccatcaggtggggctgcaccaccccaggcaggagatggggctttgggaagtgggacaggctccgggctcaggcctgcggagcttggcatggggtgaggctgccccctggtggccaatgggtgtgtcacagcccagccttgccagggagcaggcagccaggctccacccccaggaggctccagaggggtcaaggatttgggggctggtaggccacagtgcatgcctctgcctccgaggggacctaggcccaggtctgaagaacggggctctcccctggacttagcgctatgcctggtcaggctccacctaatgccttgctcccgatgctcagggtgttgccccacctgtccactctaacccactgggacccagcccatcccatcagtcagagtcaggcccggccacccccccagggactcgtcctttaagccccagtccctcccaaggaggggaagtcggtggttgtggcagctccgccggtttctgacacctgagacttggtcttcggagggccctgcctgacactacattccatgtctccttgtccccagctgggtgaagcacaggcccaacgtccagcagggccagggcccggccgagctcccctcccactccctgcagtcttccttctctccctgatcccgtgctcctcctcgcccccttcctgcctcccccgctcagcagagcagctgcctctgtaggcagggcttttcctggctgctcctgtgctgctgctgtttgcaagtccatgcacttcttttctgtgtttgcatctctcctccctgggtcactcccccgtttgcctctgtctcccatcctcccccaggaagctcatgtgcctttgcagcctcccatgacgctgctctgtgtgcccaagacatcgggcagaggcacaggcttccttggggcagggggcagctgtttgccatccacctctcagctgcagtttcagatagtcccctggactttcttcctgcccatcctttctgactccactccagggaggccagacagaagtgtggccacaggccatgtggggctggagatctcagggcaggaccagtgaggagtgtggggagaaggcctgcagaagggtggcgtgtggctgccagtggggaacagctgtgggtctctgtgctcagcctgagggtcttggggagggcagacctgggtagaaatctcaggtctggtacttgcagctatgtggtcttgtcttcaccaagccagtttcttcagtggggctgctgtgagaattccatgtaataattaatgtaaagcacctcccacagggtctgtcttatggtagatgcccaataaatggcacgtcttactattattatcactactataattactcttaccctttccagccccagccatatcctatgtggagggtaacttccctacgggacagtgagatttcttctctatctctgtatttcttgatatttctttctctgtccagcaataattgttatatttagcactcatcaaggatgtactatgtgccagacagagctaggtgctcacattttctcattgaatcctcacagtgcctttatggagcaggtaatattatcatccccattttacagatgaggaaaccgagactcagagaggttaagcaacatacccagagtcacatagccaattgatgtgggagtcaggattcaaacccaggtctctctgactctactataccttgtctgcgccttcatctctgacccagtcggttctctacccaacccaaaccccacccctccccacacaggcacaagtgtcctggccctcattacccagcatgctcagggaccacatcctaccccccccaaattaggagcactcacccacctgtgggagtatctggcccaggctgtgcacttctctgacgggcagttcgtgctgctggctttcagccgcctgtctccgcacacttgatgctgtttctattttttgatttgagtttaattataaagcatgctgtctactcccctcttccagcctcccctgccactcccaacttgtccactggttccatggcatggccagtgccaagcacagtcaggcacctttccctccaggcccaggcctctgtcccagcactgctaagaatcaaggcagctcagcccaggtctgactgtggcatattgtgtacatgtatgttgatagtgggagaaggggccgggcgcggtggctgaagcctataatcccagcactttgggaaaccgaggagggtgggtcatgaggtcaggagatcgagaccatcctggctaacaggctagccgggcgtggtggtggatgcctgtagtcccagctactcaggaggctgaggcaggagaatggcgtgaacccgggaggcagagcttgcagtgagccgagatcgcgccactgcactccagcctgggcgacagggcgagactccgtctcaaaaagaaaaaaagaaaaaacaaaaagaaaaaaagagatagtgggagaaggaagatcaaataaaccattttaaaaggtcccttggccggatgcagtggctaatgcctataatcccgacactttgggaggctgaggtgggaggattgcttgagcccaggggttcaagaccagtctaggcaatatagccagaccctgtctctactaaaaatacaaaaaattagtgagttgggctggtcgcggtggctcatgcctgtaatcctagcactttgggaggccgaggtgggcggatcacctgaggtcgggagttcgagaccagcctgactaacatggagaaaacctgcctctactaaaaatacaaaattagctgggcgtggtggcgcatgcctgtaatcccagctactcgggagcctgaggcaggagaatcatttgaacccgggaggtgggggttgtagtgagctgagatcacgccattgcactccagccttggcaacaagaacgaaactccgtctccaaaaaaaacattagctggttgtggtggcacacacttatagtccctcctactcgggaagctgaggtgggagaatcacctgagcccaggaagtcaaggctgcagtgagccctaatccttgaccatgccattgcactccagcctaagcaactggagtgagaccctctcccttggccttcaagggtattatagaagaagggcaggaagttcaagttggaaggatgttctgtggaggaggacagtgaagaggctagccaaaaatcacatgtaaactggtggcattgccaacagcaggacccaggtccggggccctcagttaggggccaaggccgatgggacaggtccaggataaagacctagaagactcaggctgagggaagcagcacaggcccacacacagacacaggtgtagagcaggtcttcagacagccctgggctgcaggcagaagcagtgtgtccagggccactcccaccctctgccaagctcctcccccaacccaaaaggcagggacacccaggccccactgtcccctgaggccagagagatggtctttaaggtctctccccatgctaactgtggtcagctaggaccttcaattgggcctactagaaatcttctctgtcatccacagacctttgtcatacacacataccttgatactactccccgcttgcactcccagatggtgggaacagggcacacccatgcctgcagccatacctgcactgggtctctgaggtctgagctccagggagctaaggctcagcccctcctggggctctctgagccctgaggggagctgctggagacagctgtggccaacagctatcacaaatatctggaacccccttcctctctcctcccctccccactttcccagggaacttggggtccctggccaagaagcctgagggcttggctgagaggggagcccactcccacctgtggagactgaagacagtggctgagagggggtgtaggcgccaggaggagccagatggagtagcaggctctagggccgaccccacgctgggcttccaccatcttctgtgtgtccgcctgggccagagcctccagcagcaccagcaggatcagtgccagggtggcaaagtggcagagccccatggcagggagtaaggaccagctctggaagagagatgagctctgtgttacaggcaggtgaaccaaggcccaggctggctgggacttgttggggcagggataagagctgtcacctaaacctgcttctgccttgagccctgtgcataaggtcaagtgagtgcagctgctgggagagatgaggaggtagatttggtatccatggcttagggacagagatgacctctccccatgggccccttatctttcagagtacctggacccagagctgctctgtatggctgcacaggctgcacactgcataactcctggggcctccagttgcacagtttggtggatgacacctccatgaattgtgcaatgctgtacccctgcctatccaacttccccaaagtcagctgcctgatgggaaagatgctgaggtcagaggtcagggagcctaaggccccaggctgagggagaagggtgactgggcatggtccgagatctgatgctccgccaggttcctgggtcctgtctagaggagagagagcaggcagggaatctgccattccatgggaaacatgcccccttcagaccttctacccacagagctccatgccacagcttggctacaggccaatctcaagcccagctataacccaaagtttcttatcacagtcacccccaaactctaaacttagcccctgatccttccctaatcctgctcctcaagatgcttatcctccagccagcacaggggaaggggtcgatgctgctgaagggcctcccttctgcttgggctggctatgccttcagagacaggaactgctcttaggggtgggaggcagggagagagtcaggccctgccctgggaggtttctgggaggaaaaagctactgctgttccagctcccaagcatgcccaggccagtcacccacccccaaatggcagcccgtctgtggcatggggtggtagggacagccaaagacaggcttgaggcgagacaggcaaggagttgtagaggaagcagaggtggaggcaggccctgctgggtggggagccaccgtggaggcctggccttagctcactgatgagaattagctaagcctggaaagttttctctgtggcactgtacctggggtccagacctagggggaaggggatgtggaggttcaggagggtccaggctggctgtgcagatgcctcagtgagatttaggggagcccccacaggctttcagctgaggcagggcaggttggccccaagaccaggtaggaaagtctcccctcttccattttatgctttccacaccctcgcatcctagtccttctcttctctttggggtctgaaggatccaggtggggtgggggatatgggttgggggtcctacaggagaattgcctaggccaggcccttgggtgagaccctgggtaggttaagggaacccagcagtttggagagagggccaggccccctttaatcctcacttccagccacacacagccctgccaaccaatcctggaagaatccaatcctatgtctgcagcctaggccctcacctggcctcttccggccaaccacatccagctttgccccctgaggcctcacctggcccctcagctctggccggcaccccgcagttgctggtccagcctgcagagctggtgcaggaagcctcggttggggaagacccatcggtgctgcctcacggtgatcaccgcctggcgcagggacagccgctggtgcagcatgaggtaggccaggaccagcgtggcagagcggctcacgcccaccacacagtgcaccaggaccttggctgaggaagacatcctggtgaaaaaccctgtcccacacaccggcccacccacgggctgggatggggacccaagttcctttcctgaccctgccttgggtgcactctgtgatcctgagcaagtcactcagcctttatggacctcagtttcctgatcggtaaaatgggtagatcaacacctgttctgcctacccttgggatagggtccgaatttcttttttcttttctttcttttcttttttttttttttttttttagtagagacaaagtctcactatgttgcccaggctggtcttgaactcctgaacttaagtgattctcccaccttggcctcccaaagtgttgggattacaggcgtgagacaccgctcctggcctccaaacctttttaacacttcaagagctggcccctgtcgcctcatctcagattgtccctcccccaccttcagctcgagaaacatggaggaacttgcagttccttgaggctgccatggtttctgacctccagccttaccacatgctattccaaatacctgcaaattgtttcccctggtctcggtctgactaacttccactactcatccaccaggttttggctgagacacggcttcctccacaggctttcttgaccgctcaaagtattgcttgaatcacaaagcagctcatcttttttgcatattacccatggatacctttgtagagggaagtccccccaccttcccgatcctctgggcttagcacccccgccgtgtgctcccagagccctccacactggcccactcttatgagtagctctcactatactattcgcaatttggctgtctttccaccagttccaagagggcagggatcctgcttcttaaagtctggattcccagtatttagctcagtgccaggcacgtagtggatactcagtaaatagctggtgaatgaatggataaatagcaaaagaatgtcaaagtgtgttggatactaaaaagtcatgtgagctgtaatcttgtcattcctgtcacatagatgaggaaactgaagtccagaaagggacactggcttgcccagggtcacacagtgagggacacagctgtcttctaggatggacacaaagccaggacaccagcctccctgggctcctatgctgtatcctgagtatttgaagatatatttcttttctagttaaaagtactttgggggccgggtgcggtggctcatgcctataatcccagcactttgggaggccgaggcagacagatcacttgaggttaggagttcgagaccagcctcgccaacatggtgaaaccctgtctctgctaaaatacaaaaattagccgggtatggtggcggatgcctgtagtcccagctacttgggaggctgagacacgaaaattgcttgaagcccagaggcagaggttgaacccaggaggcggaggagcagagatcgcgccactgcactccagcttgggtagcactgagactctgtctcagaaaaaaaaaaaaaaggagaaaaaaagtactttggggcagacatctaggtaccaaatggtgctttcccaaagttgagtgttgcagagaaagagctgttctgctgtttgggagaaatggctttcagcctcagggttgctcctaactcatggcatgaccttgtattccaggcctcagtttccccatctgggaaggaatcgggttcgacaaaatgctggagcactaagcagaggacttttttttggcggggggggatggagtttcgcccttttgcccaggctagagtgaagtggcatgatctcggctcactgcaacctccgccccccatgttcaagcaattctcctgcctcagcctccagagtagctgagattataggtgggtgccaccatgcccggctaatatttgtatttttagtagagacgaggtttcaccgtgttggccaggctggtcttgaactcctgacctcaggcgatccacccacctcggcctcccaaagtgctaggattacaagcatgagccaccacacacggcctaagcagaggatttttaaaaagcagggatgggagggcactgatgactgagaggaaatgaggcatcctccccatgaatgagcaagatgggatatgggcttggaccccaagtcctacccccaggcgtgttgagggcacggtggatgaagtcagccgcagaggagaagtaggcactgatgtcaaaatcagggaggtcgtgggctggcacccccaggtagctcacactgctgccgtagaagtcagggccgccctgacagtagaggcccttgtgggcggcgttcagcacgtgggtgatgcccagcttccacagctcaaagcggttgtttgccgtggccctggggagggcaggaagggcacttgatgccggccaagccatgggaccaggagggaggctgtgcctggccccctgctgcagagggaccgagccattagggtccaaagagagtccaaccccagcaagctccaagtggggtctgactccacagccctatacccagagccccgcactttctggtggctgagccggcggtgtgtgtgtcgggggatctttagaccctctttgcttcctcaatgcatctgtccctgccttggccaggacaggaaggaagggattgcttcagccctggaacctggctgcccctcccttcttgccccatgtcctcccacgcatatccgtcctctactggctaccacctcatacctgcttctaacctacaaatgtttagaggcaacaccttctctgattcaccttcagtcaggcttctccaccgtctgtatccagaggagggaggctgggcccagaaacagggggctctctgtctaccttatctcatgccccaaatactatttcctgggcctctgcctctacacttgacagttgtcctggaaatgtttcctggaactcctgggagactccctgctttcaggcaggcgaagtccctgctctccctggtggccatacctggtcactgcactgacctcagcacccccgggggtcctggagaaggtccctggcctgggatggtcagagcagagctatttctccttgtttccaccctcctgtgtctggtaaagcgaccaagaactgcctctccacgtccccacccccatgccccttggccagctaccactcacgcatctcctatgaaaaggttgggccaaacttcgtccacacggctgcaagaagacttccctgcccgcaggagctcctccagctccaggatgctggggcaaggcgtggctttgtcctctccccccagctctgggagagaggtctcagccatgggccagcccgcccacccctctgcctctgtggtcactcctctctgcctctccagtgtcatttctccttcccagagattgacagggacaggtgacagaagcaagtgactcagcaagtcacaggggcctctggagtggacaagaccttttcctccccaagcctccccccacccccaaactccatgagaacacagaatcagagagacctctgcaagtcagctaccaccctgaacctcagtttcttcatctgtaaagtaaggataatcacacctacctcagagaatttgaggattagatgaaacaaaggacatgctgggtctgacacatagtaggtgcttagaaacatctgtggaattagtagatgtagagccctgcctaaggctattaggttctgaggactgagttaaagtagagatccagggtgcagaggaggtggctggttccaaggatgaatgatagaaagaactgaaagaagtgtacagtctaggtgggccacaaattgggcaggagctggattggatgtctgttggatgagtctctgaattacggaggtcagggacagttttctgagttgtagagtcagagaaatatgggtaagagacatggagagcttcctttaaagggtgcccacaagattcatggggggagggggaaggtgtttttttttgttttgttttgtttagacagggtctcactctgtcacccaggctggagtgcagtggcatcatcttggctcactgccactaccacctcccaggttcaagtgattctcctgctttagcttcctgagtagctaggattacaggcatgtgccaccatgccacactaatttttgtgtttttagtagagatggggttttgccatgttggtctgactggtcttgaactcctacctcaagtgatcagcctgcctcggcctcccaaagtactgggattacaggtgtgagccgccgtgccgggccaatggggcaaggtttgaacaatggtcctgtagtgaagatggctaacttctcagaagagaaggctgaagagggccttgtatgtcaaatggggagacgggaggtgagtgttgccctagactttgagagccaaaggggctaactgtcatcagaaacagtgggagggagattcctctgcctataagggctttgggtcccaaaatagaaactgagaaaggtcaacctgtccttctgccagagctggttatcagcaagagagatgagatgtctcaccctctctcatgtgacttctcagtggccctaatggagctgggaagggtatgagctgcagtggggaggttcccagctgcccttggccttaagaccagtttgaagggaaaggccacaccagggcatcccatggaagcagtctacactcatgtctatcccattcagaaccattgaagtcggcccggcactgtgtggggaggcaagaccaaggaggggctcgtgtccaggttacagctgggtttggacttggtttatgccaatgctagacctggcttgggaggagaccttccctcagggtggtgcagcatggtggagtgaggaaaatacaggatctgatgttagagagatttgggttggaatatcagtttgcaatatgtcaggcagtatgtttctttacttttctgtgctataggatcccccttgcagaattagcactaggattttttttttgagatggagtttgctcttgtcgcccaggctggagtgccatggcgtgatctcggctcattgcaacctccatttcccgggttcaagcgattctcctgcctcagcctcccgagtagctgggattacaggtatgcaccaccacgcccggctaatttttgtatttttagtacagacgaggtttccccatgctggccaggctggtctcgaactcctgacctcaggtgatcccgcctcagcctcccaaagtgctgggattacagacgtgagcctccgctcccggccttagcacaaggattaaatgagatgtttatatggcgtttggcatagacactgtcaaagagtaaatgggcaataaattataacaatgatcattgggggctggctattggagaagagctggctctctccagaggaattcggattacctccttctaggccctaaccccatttactgatcccacaggccccgccccggctccgctagccccgcttcctcctgtcgctttggcctccggcatgacgcatgcgccctcgggctcctccgcggcagcatctcggttctcctctcgggcccatctggagcctcgcgtcttttccagtgtgggccccgccccctgccggtagaaccccgtccccggccggtagggccccgcctcccgaagcagttccggttcggctccgagcagctgccggcgcggcggtgacggcggccgggacgatgcctgcgcgcagtcgccaccgcccccgcctccactccggctccccgccccgggctccgcccccgccgcttgaggcgcttcactccggcgaggcggggagggccccggactccgacggcggctcggacgccgactcggaggtgggtccggggagcccgactcggaccgcggaggtgagcgggagctgaggctgaggagaggggagcttggggggcgcctgctgccaagggtgagtggggagtctgggatggagccgggggctgccgagggaccgcgacctggaggggccccggggagacggttgagggaaccgggatagtcagctctggaatggaatctgaagcaaatggaggttgtcgaactgagggcctgaaggctgagggataagtggaggccgaggaacgagagggagagagcgagagggggaggcttgaagagcccagagcttgggggcttttgaaagctgcgcagtgggggaaaaagatcgaaggtcctgcgggaatgtggacccggaagaagagatgctctgggtttggcagcggggatgaggagtcagaggagcaagacctgggccggtgttcccttcccagggcgagggagggcgatcggggctgggactggagccctctcatggggttctcctcttacggagccctcttatccgcctcccaccccgggtggggctggtggtgatggagggcaggatttaggtttgactagaaggaggagggctgttggatgggaaatcgtctggcctcaaggggtgagggaggcactgaaaaagagaagtgtggtcaagaaagaaaaggagcccttggggatctaattttgggctttggcatttttacaggtgccttttaaaacatcaaagatcactagggcaatgtacttggatcgtggggctttctcgttcgtgcacagtggatcattttaagaatcttgggtggaaggggcggtgtgaatcactgatttgcctaaaggactgggggaagtagtggagaggaagtgatgtttgaagaaggtagtggaagacgtgattctgaaaatgaagatatcatttggatttattgacagtaatggtgtcctttttttcattgtaattttttcgtagctaagtttaaataccagacatgttaagatcctaaaaatttactatattacctttaagttttaaaaacttgaaacaagactttggatactcagattttaaaaattaaacttgaaacaagaatttggacacttggattttacagatactcaacatggactggttccactttcaaagttttaagttgacacatgtatttgccacatagtaaatgtatggtcaatgcaagtttctgggtgaagggggcacagtgaacttgccacagtctaggcgcaataccaaatcttcctctcactgataaccccaggattggacttatctcttgaaaattggagaggtacctttgactgattggcaaaaccaatattgaaatactattttgcaggtattgtgtgaatagtatttttagtagagtgatttggaaaaataaggacagaggatgcttgtagttggcagccaacacaactgggacaggtgggtatacagatgctttttatagaagacatagttccaaaacataattatgccagaaaaagaatgattgcaatatttatattcactttagtagagataaattgacttccttttgtgattgttaagtcataacatggttccatgaagtctttgactttagccacatgtctcatatgttttacaactttttatgtgattataggtttgtaaagttgttggccatttcttttctcttccttcttttcttttctttcctttcttttttttttttgagacagagattcgctgtgttgcccaggcttaagtgatcctcccacctcagcctcccaagtagctgggagtagctgggactgcaggtgggcgccaccatggctggctaatttttgttagcatcaagcgttttctaaatgcttgattaaatctaaatggatatctactgtttaatcttcatgagatgataatttgatttgcaacagcttttaaattagtttatgtgtatgggctatgtgacataccctcagatgcacagtggaatagtaattgtttcttcaaaggatatgtgaattcttagctaaaaatgctgagattgttaaagtattaattcccttttctttaacttaatacaaattatcttcagttgaagtttatgtaatattactgtttgttggttttatctttagagtgagatcctctggagaccttatcttcatacttagttgtgaataaaagtcatggcatgtaaaaatttgctgaactgcaatataagaactctattaagattacagcttaatgttattgcaaaattaaagagaaactgttagatggagttgtacaattaacatattagcatgtctaatagttttttaatttttgtttccctttgtcagttctcacacccattgaataaagaaaatcagtttttggctaggtgtggtggcttactcctgtaatcccaccactttaggaggccgaagcaggcagatcacttgaggtcaggagttcaagaccagcttggccaacatggcaaaaccccatctctactaatactataaaaagaattaatcaggtgtggtggctcacacctgtaatcccagctactcaggaggctgaggcaggagaatctcttgaacccgggaagcagaggttgtgagctgagatcacaccactgcactccagcctgggcaacagagtgatatgtctcaaaaaaaaaaaaaaaatcggtttctctaaggcagaagaagccatcatgactgcgatggcagaatatgcagacatatttaggtaaatcagttttgatttcagtaccataaccccccttctgcaaaagcttattcacattgcacagttgcttataaacatttttttattttgttaatcattagatcctcaatacttcttcaaaactttgctgttactgattaagacattttcatggcttttctaagaattgaaatttgaacactttttttgagaaacttaaatcacagatgtttccatgaatagtattattattgttttataagaatgccatgttaacaagctattctttcaagatttttacttccaggcctgatgtaatatatggtgttaattgttgggtgtacctagcatgcccgttaatttatggatggaaatctttcctgtcttcagattctacccccttcatttttcatatgccagtggattgttaatgaactaagattgaattcactttttaattttaaagcttctgtagctttgattctctttggacatcaaactgatttatacgagatatgaatacaattgcatattctgctaaattacctatgaagctcttttgaatgattgtggtatttggtgaaaaaatacagtatgagctaatcaaaattcttttaagggatttaggttatagaggaggactatactatttcattcccagattagattaaatgttttacttatttgcagagatgacaggggagagccttgattattttcacgtctcatgtatttatatttgtttacaaataaagagttacttatttgcaaaatgccgtatctttaatacttgcttacatgtgattttgggaattcttttggaaccagtttttgttcttgtttttgttttgctctaagggtatgatgtaacacattgaggggttaatagtagggcaagaacagagaaagccatttgacaacagatatcatcaggacagtgatgcttactttaggtcttgtggttttcttggccttgagaaatcaagatgttaactaaaaataggagagcatgggccaggcacactgggaaaacagattggtgtttacatgctaccgctgttgcttcctggtaatttgccatatgaatgtgtgggtatggatttgtaacagacctgtgatgtgaatattcctgaaccccctcctcccatacacacagtaccatcatcacagatctgaagcctaacctttagctgagttcagtgacttcatgtttccgtattgaaatgttctgttattgggtcctcacaatactatagaatgtaacatactgcgggcacggtggctcacgcctgtaatctcagcactttgggaggccgaggcgggcggatcacgaggccaggagatcgagaccatcctggcgaacacggtgaaaccccgtctctactaaaaatacaaaaaaattagccgggcctcgtggcaggcgcctgtagtcccagctactcaggaggctgaggcaggagaatggcatgaacccgagaggcggagcttgcagtgagcggagatcacaccactgcactccagcctgggcaacagagcgagactccgtctcaaaaaaaaaaaaaaaaaaagactattaactaagaaaaacttggttataatagtttcaccacagtgtttcaccataaaacaatgttttatgatatgtacctcagaaaagagtgttgtggggcagggcagtgaattatatttatatttgtctaagtattttttggtagttttttttttttaaagatagggtctcactgtctcccaggctggaatacagtggcgcgatcatggcttatgcagccttgaactcctgggctcaagcagtcctcctgcctcagctttctgagtagctgggactataggcgtgtgccaccacacctggctaatttttttaaatttttcttttgtagagatggggtatcagctatgttgaccaggctggtttagagctcctggcctcgagcagtcctcccacctcagcctcccaaagtgctaggattacaggtgtgagtgtcttaaatttttgaagtgcatttagttaagcttatgagttgtggcagaggacaagaggtagtaacatgagtatctgttatcttgatacttgttctgttgtcttgaaatttttgacagataaattctagttggaggtgagaaccatggattctgctaatttagggccttcctataggttaactggtgtcactgagtttttggaaatacttgcaaatctgttttagtttggaactttgagattaaatggaattgatgtcagttccatcaatataatattagcatgaaagccagagatttccaaaaccatacattaaaatttggctgcaaatccaatccattttcacaatatttaatggagtttgaagtcttgagccagtttctcattttccattatattgattagattttggatgtagcatatttatttatttatttagagacagagtctcacttcgttgccgaagcctggtgcagtggcgtgatgtcagttcatagcaaccttcgcctcccgggttcaagcaattctcccacctcagcctccccagtagctgggattacaggcgcgtgccaccatgctcggctaattttttgtgtttttagtagagacgaggtctcactatgttgctcaggctggttttgaactcctcggctcaaggcatccaccccccttggcctcccaaagttgggtttacaggcgtgaaccaccgcagcctgccagtgtagcatatttaaaaataaagattttaccagctgggtggggtgactcatgcatgtaatcccagcactttgggaagctgaggtgggtggatcccttgagcccaggagtttgagaccagcctgagcaacatagtgagacctcgtctctactaaaaatacaaaaattagccgggtgtggtggtgtgcacctatagtcccagaactcaggaggctgaggtgggaggatcacctgagcccaggaggtcaaagctgcagtaagctgtgattgcgccactgcactccagcctgggtaaagagtgaggccctatcttaaaaaaaaaaaagggtgggcgtgatggctcacacctgtaatcctagcactttgggaggccaaggtgggtggcttacttgaggtcaggagttcaagaccaccctggccaacatggtgaaaccttttctctgctaaaagtacaaaaaaattagctgggcgtggtggcacgtacctgtaatcccagctgcttgggaggctgaggcaggagaattgcttgatcccaggaggcagaggttgcagtgagccgagattgcgccattatactccagcctgggctacaagagtgaaatgctttctcaaacaaacaaacaaacaaaaaagattttaccaaattgatatgttaaactgctagcctggttagaataaaaattagaattttagatacttagcttctttactggtttgctgtggcattgcagccaggtcaggaaccctttaccaaatttatcaccaaagtcctatcatcgtggaaaaatttttggtataactgagaatataaaatggacggtaatatctgtcagattcttactcattgaggggagacagttctggatttggtgtagataacttggtgcagcctgatagtagaagttagtttaaaggctatttggaaccagaaaaagatgttatttggtatatatgacaactttttttgagtgaaattataagagttcacggttagagcagcaaaaaagtccaagaactgaagtgcagccaagagaatgatgatgtaactgaggagggaatttaattcttttaaagatgctgccctaaattctactgctcagaagtgggacataacaaaacagaaaatcaccactaaagagtttcaaaatggatggtaggagttagtgcaaggtctttgaaactgttttgtaattattgcagattttatcgatgttttggaaacaataccctgtgcttgctaagaaaatgcaaaataggctgggcacagtggcttgcgcctgtaatcccagcactttgggagggtgaggcaggcagatcacttgagatcagagttcgagaccagcctggccagcatggtgaaatgctgtctctactaaaaatataaaaattagccaggtgtggtggtgtgcccctatagtcccagctacttgggaggcagaggcaggagaattgtttgaacctgggaggcagaggctgcagtgggctgagatcacgccgctgcattccagcctgggcgacagagcaagactccgtctcaaaaaagaaaaagaaaaatatctttctataagtataaagagaaaagagtagtttttgtttgctgaatgaaaatgttttcatttatggtaaaaattttaaaatagtatggaaaaaagttggataatcccaaatactataaactacagagttattaatcacaaagtttagccatatatgcccaaattaaaccttatcctcctacatcatagtttaggctttttgctttcataagaattgtttttatgttctggtttatggatctgcaaacatgtagtctttattatgtggatattagataagctaaatgtatttgatttagctgtatttcagcttcagtgcatctataatatataattgccctaagaaaaatttattaactctagctttatataatgtttgaagtctcttcctcagtgtttatcttgggatatggatcttaatttttttacgttttatacatcatttggaagctgtttaacttttaaattttgtaaactaaatcagtaatgatttgttttttttttttaatttgagacggagtttcgctcttgttactgaggctggagtgc

SEQ ID NO: 1070 - DNA, 33564 bp, Homo sapiens
tctttgttgatgtttttcttttatagatcacaccttgctatcattttaaattacttttcaccaagccgtaggtcccgaagatattctcttatgttatcttgtaaaagttttatttaaatgtaaaggggtatttcatttaaatataaaagcttcatttaaatgtaaagggggtataaaccctttacattttaatctgtgatccactttgagttagcttttgtattaagcgtaaggtttaggtcaaggtacatttttttgcttttggatatccaactgacccagcactatttgttgacaagactatcattctttcattggactgctttgcacctctgtcaaaaatctgttgaccacacctgtgtggggctatttctgggctctctattctgttctattgataaatgtgtctctccctctaccagtagcacagagtcttgagtaatgtacctacgtattaagtatcggagtctgataaactgataggtctgattatattttttatcttcagaattgttttagccattctagttcctttgctttcctatatagattttagaataatcttatttatgttcacaaaaaatcttactgaaattgtgatagtaatcgtgataagcctgtttaccaatttggaagaattgacacctttattatgttgagtattccaatccatgaacatggtatgtctgtctttatttttatttttgatttttcttttcagctttgtctttttcagcatacaaatcctgtaagtgttttgttggatttacacctgataattttattttgtgttactgattgtatgagatattgtatttttaatttcagtttccatatgttcattgtgagtatataaaaataccattgggttggtcttatatcttgcaactttgcttattagttctaggaggtttttattcatgtgcttgtttgttttgccttgtgttattttgttttgtttttgtagatgccttgagatttttcatgcagattatcatgtcatctgcaatagggacactttgtatctttcttttagatctacatgccttcattttcttttattttcttattgtgctggctagaacttccagtgctatgttgaatagaagtagagagaggggacatcttgtttttttcccagatctcaaaggaatgcattcagtctttcaccattaactatgatgatagctgttgctttttgcagatgctgtttatcacattgaggaaggtcctttctatttctaatttcctgagagttttatcataaatgggccttgaattttgtcaaatttttttgtataaattgatataatcacataatttttctcattaagcctattagtattgtagactatagggcttgatttttaaaattttaacccagccttttatctttggaataaacccaacttgatcatagtacataattatttttgtatattgtagaattatatttgctgtattttcttaagaatgtttgtgtctatatttttgaggaatactggtctgtatcatgttttggtactgtctttggttttggagtaagtatcctacttacctcataaaatgagttaggaagcatctctacttattctgttttctggatgagattgtgtagaatggttatgaaattttttatatgtttggtagccttttttagtgacacaatttgggccttgagtttcttttatgagagtttataaattctattttcttaatagttaatagggctattcaaattgcttatttcatattgcgagaactgtggtagctgtgcttttcaatgaattggttcatttcatctacgtcataaaatgtatgtgtgttgaattgtttactgtattcctttagtatccttctgatgtctgtggggtgtgtagcgatagcctctgttcactccttatattggtaatctctgccttctctctctctctttttttgtcagtcttgctagaatgtgccaatttattgatcttttcaaagatgtaccttttgtttcgttgatttttttctgttttaatttaatttctgcttttatctttcttgtgtccttccctgcttgcttgacatccattttgctagctttttctagtttcttgaggtgagagcttagattatggagacatgttctctcttaaacctcagatttagtttttttttttaattaagaggtaaggttttgcatggtttcaattcaactaatatggaaaaaaaacttttcactcatgtgtatattgtgtaaagttgtagaatcctactattcttttaaatgccccaatatttaacattgtactgatcgctagagtgtaccattttcagataaggacaaacccaaaggttaaatagtttctttattaaccaagagttatggtgaaagcaagacaagaagcaagccctctcccctctccccacccccacactgctcttcccacggcagcatccagcctgtaatggctgtcctcaaggtctgcagctggggctgtccaaaaggaatctgggtgggctccatccagtctcacccaaaccagcccatggtactccagatttgagagtagatgtggggagtggcaagactgagggtctgtgatggcatctgtcctccccactctgtccttgggctccagccagaccccctggctctctgcaggcaccctgggtggtggtcatccacaaaaaaagtcagcccagtgtctttcaggagttgcaacctccaaagggttaaaatgcatcaacaaacttcacctggacaaggcaccccagccatctttacagtatccagggtcaattcagagctctgccacctaccagccatgtgactctgagcaaatgtacaaagtttctctgtaccttggttttctcatcgaacaatgggatgatattggtattggtctcacagggttgctatgaggagtaagtttgtctctgtgtatagagctctctgaacagtgcccagcatggcataagcactagatcagcagtactggctggcatttgcccttattgccccatcaaaactccttcagtcctctctgcttaaaatccactggctttgatgtcagaagaataaggaaattggcaattaccctttatattcatttccaccctctctctccattcctaccataaagtaaaccttttggtagccaagaagaagaaaagttattccacaacattgtcgacacttgttcaaagagccaggggcaggggaggaatacgccgaaccagtctatgcagaatgcaaacaggtttgtgcataaccaccccatccactgcatgccattgaatgaacgattcaaacacaactgggcacttttgttgacttacagtttacagtgtgtataaacagtttgtaagtgaagagcactcctccagcaagccagcccccaccacaccccctaggtgtggtatccacaaagacaagaaagttttttggactaatttgactcagagcatcaagactgctaaagatggcactgcccgtttgtggaattcagatgcaggcttcactatgagtctccagtaagcctcagtcaaaacagtagagagggaatcaagagtgcctcccccagcagtgtgtcttctaacctttctcctggctctcagaatgtacaggctcttaacaaaaacacatgtgcaagaacatattagaccctcatcacctctgccagctgagttcttatttccctgtctgctcccactgcatctgaaaaccctacatcctgcccagtgtaagtccgattcctcatgccagaataatttgttaatttttttccagatcctaaagtgatgcttcaggtagcaaactctgagtttgatgtatgttctccgagaatgcactgtagataacaatgctcaattcatagtgatagggcatctctgagcaaatgtctcccgccagctgtttgctgcaataatttggatatttgctcctgtgcctttcacgttgtggttaaacagcatgtttaccatcaatatcactggcaagaggttgggaacagaatggagagaggagacagggtgtggttctataagaatcaatggctctcctccttatgggttgtgtagacttgaatgaggtcccctctccaagcctttatttactcattgctgcaatgacagcaacctctctgcttcataaaagggtatatgaagcaaccctagcatggtctccaataagctcagtgggcattccttctctgtccccaccatatccatatggcctttctacaactatttctatgtttaaaagagctaaacctgcctgttatcccatttattataattctttcatttcgtatgtctaactgcacttgagtcctcacaattcagatggatagagtgaaggcttttcagaccctcaactgattaggtgaggcccacccacactcaatggggccacctgctttcatcacatggatatgctgaagacagattgttgaaatattctttgtttttaatttaaacttgtttcatcatactggttcttttgaggtgattttcatctcactttcaggtcgtttgagagtttcatcttactatataatggttgaaaaaggaaaggaagtcatcacttgcccaaggtggtggtgaattcccattctgttaccagccaagggaagggattaggggaaaatatttcacccagaaaagtgctgtgttgtttgagttcgccttttggttattaagggtactaatatatttttcatcaacaatgacttaaggcccctagaagttcatgaacctggtgtgggtgtgtgtttcccactcagatgtgctgtgtaacttgcacctgagggtaacacgaactctccctgggcaagatgtaaccagggaaagaaaggagaaggcagagctcagagcaagcagaaagccaagcaggagaccaaaagaggcctcagaggccatgtttgcatcttccacagagggacagacacattctctgcctctccagtaaacacaaacatgcaaacatgcacacacagagacatgcacacacacggaccatacacaccacaccacacacacacacacacaactacttatgtttctgaatattacaaacatcattacaaaatatgaaatgtacaaagaacaattcccggtggctcatgcttgtaatcccagaactttgggaagccgaggcaggtagatcacccgaggtcaggagttcaagactagcctgatcaacatggtgaaaccccgtctctattaaaaaatacaaaaattagccaggcacagtggtgggcgcctgtaatcccagctactcaggaggctgaggcaggagaattgcttgaacccaggaggcggaggttgcagtgagctgagattacaccattgcactccagcctgggcaacagagcaagcctccgtcttaaaaaaaaaaaaaaggaacaattcctgaagcttctgatgatttctggctgaccatgaggttggaagtgggaacacattaagggcttaatgatgggacacagtgatgtaaccactgtggagccacaattgaagtgctgagattcagcattggaagacatctctgtcaccaaatgaacacgcctccctaaagagctctggcagtgagtcaaaggcttcatttgggtcaagacagagttattatacaaaaagccaagtttcattctacaaatccacatcggggtcaatattttaaagtgatttcccccaagttctgtgtagagcaagctgacagagaagaaatggctctgagatatctggcaaggtgcagatggactgaccacaagccgcttatccccactgtagctccgggctcccttctgccacagtggccatatctgtgaggttctgccctttccctggggccactgcatcagtcagggctctccagagaaacggaatccacaggaggtatacctatagcatacacaaaggctttattataaggaattggcccatgcaattatggaagctgacacatccaatgtctataggtccaaggtcccagttccagtcctaagaggattctcctagttagagacttctctctaactagggagagtgttggctttttgtcttcaataacagtctactcaggccctcaactaattgggtgaggctcacccacactaggaagggccatctgctctcctcagtctactgactcacttgtcaatctcatccagaaaccccctcacagacacattcagaataatgtttgaccacatatctgggcaccccatgccccagtcaagttcacacatacaattaaccatcataactatctgttagaccccaccttgcagggggcagtcctcctctggaaaccttcaggacttgaagtgtcaagctcatgtgtgcaaactgtgaccaacacacattttcctgagaagaggcctcagacaaacaaaaaaatatcatgcatgcacatttactcagataatgactgtctgttgcagcctttacgctaaacagagctaagagtagagatagtgcagattaactcagacccagaaacttggggaggcaccctgggatcctggaagcagatgctgggagggcagaggggaccgagaaaggaggtgcatttactcagctcttctgagacaattctgctctcctgcggtgcactcgttctgctggagaaagggctcactttgagtttgaatcttaaaactgcatgtcctttaaccacactgtacctgctcaccaggctgtggacactaaattgttgggaaagtgaatatatttcatttttttaattaaaaaagcatgtaaggttatattacataattgtgatatataatacatttattcaaatcatatttaagtttggggccacatgattttcaaaagtatacagatataactcatagtatctttcaattttattcccataagcctagatttgatttaaagtctaagcgcaaaggtagagaaattttttagttgtttagtacctgccattttatttttctccaactttttattatggaaaaagttcaaagatacaaagaaggagaacagattgtacaaccccttccctaaatccaccacgtagaaccaataatcaccaaccttttgtcatatcagcttatgtgcacgtactgtgctgaacaatttaaaataagttttagacatgaagacattttaccctttaatacttcagcagcacctcctaaaattaaagccattctcctaaacaaacattatgccattatcacacctaaaaacattaacaataattctatactatcagtcaatatcccctccaatttgtaatttcctccaaaatgtttttgtgtgcgtgtgtgtgtgctgatttgtccagctgggagtcaatccggatttgtacttattgttatacttcttcttttcagctgttcttataccagaagaatccttcacccctttttcttgacattgattttttttggaagagctcaggactgcagaatgcccacactctggtagtccagtttttcccatggtgtcatttaactcatggctcaaactcttccatttcctgtaaacttgcagtaaagtctagaggctttgcaattgattcaattgaagcatctttggcaagcacacagcaacaatgatgttgtgtgtttcttttgcatcacataatgccaggttgagccagtattagtgacactgagtttgatcttcctgtaaggtacagccagatgtctccataaaaaaatggaaaatggaaaacctttttcttttttttttccaattagcacccgttcgcctgcacactttcacctaagggtttgacacccactagtgcacactgcctgatttaattatttcattaagggttacagaatggggatttcctcattctcgcatttctacgtttatgagctggcattcttctgttaaactgctttcacttgtgaaacaggatgcagaggaggagacttattcaacagaattgtagggagggctgtttctctcaaaaggagtggtgagagaagatggtctctaccggggcatggagggctccttgtcagagtctagtgtctgagctttaaggcccaggaagagggcagcagatgggggtggggcagtgggtgagtgagaggcccgtgtgtggggagacccactgaggacagggatctttaggcaaacggagcctcactgaaagaggaatttcagtgatgccatgggtcagatcctgggtctctcttagggaaacctgccataaagcatgagagccacattactcctcagggcttctgggctccgattccgcagactagttttggaggcatcaccacgcctcaaggttgctctgttatatcagggtaactgactttctctaggaacggagacttgggtgccccttaaaacaaccctcagccagtatcctagcagtaaatttttcatcacgggaagcaactaattgaacagaggtgtgatgaacctactgaccactttggtaatatagacacagtggccacagtatgctgtattgttatcctggttgtgaccaatgccaaaggagcatgtttccttcttttcttgacttgatgctgtaggagtccaacaaagggaagcacattcaggcccacatgaaacttgggacagaagtggcttctcagagccgtgcaccaggcactttgaacaagttggaaggctacagtgccggaagactccacagtagcacaggcgaagtggcttaggcgaaaacgctgggaagtaccccagctcccgggggccagagcctctagggctggcagcctcagcaggcagagtcacttgcctccttcagctcaattgctgagggcttgcgtttctctgcagggaacaggagtgccgccgacttccactcttggtgcccttcaccgctcaaactgcaccccaaataagcgtatgcaccctgctccaagagaaggatgcgctgggctgatcctctggaggcaagagggcaaaagacagaaagtaacgagcggcctttgcacaaactcaactctctgcagcggcccctgcggcccaatcctgccggcccaggaatgcacggtcggataacaggcctctccttgctttttcgtcttcttcctcccgcttctctcctctctccttttcctcctcctcctttttctttaattttctcctttctccccaagcttctacagttgtttctgtgttcgctcaatcatggcctttggcattgattgaaaatttggcagttccttctctcggaattctgtttgaagccttcatatggatttattattattattattatttttgccacacaaaaggggcaaatccgcgtgaggaagggggtcgcatgggggtcggctgagatctgctggctgccggtctaggaggggcgctgctctgtgccggagtgggctctggtgcaccagcagaggctgggggagagtgctgcccccgcctggagcccaagtctctgcgtgcctgggggtagagcgcggagagggaccaggcaggcgccggaggggacccgcgcggaaaaggaagaagcccaaacaaaaacgctgtccggcgccaggcgcccacctgcaagcccaagccggtgctcggccagttacaaaagaaatggtcaggatctggacaacgataatgatagtattaatcctcctattaagaatcggcccaaacaaaccctcgctgtcagggcgacaggcgcccgcccaagcccagacctcggacctggttccaagcctgttcccgctgggtctctgggcgcccggtttctgcacctggagctcgcccgatgaggacaaggtctggaggccggcctgggaacaggggccgaagggcgagccggaccctaggggattggtagggtcggggagaaggggtccaggctaggggcgggcggggcgcacggagaccaggcggcttgagcgggaggtggggagctggaggagtgccgggttcgcgggcgggggacggggagaggggggcggggagaggggcgggagtcgggggcggcgaggggaggggcggagcgcgggtcccgccccggcgggccgctggaaaagtttagtctctgactcgctcgggcagaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggaggtgagaggcgggcccgggcggggcgcggaaccagggtggggggctgggggccgaaggacccacctttccaacaaaatccccaccgatcccgggcgcgacggggacttgggcgcgccacggcggccggagcgctccacatcagcacccctcccccagagccgctgcaggaacagggaggaggccttttccaccgcacccggagcgtttacaacgggctggagctgaatacctggatgaaagtggagaggctgttcgtggagaagttccatcagtcgttttccttggacaattaacaagttaggcttccacagtgccagggcctggggatgctggacgtgggagagggttgtggtcgttagcctgggaaaatcattcttttaaacaatattcgccggaaaattagttttttcctaacatttctcaaacaaggcaattagggccgtcagaatcggtgctggaagacgaagtccccacagtgcaataatgaggttcccacggaaaatcagtacgttgtgttcgtaactgagataacagctagagaaggggctttgggctttttgagtctcccaatagtcagtctctctctctctctctctctctctcttcctctgactttctggctttggacactcccaatggtatatttctttgtggtgtttttatatttggatataagagaggaacttcttgttggatttttaagggaacacacttcgttttgacccttccaataaggaaaggggagctacaggaacagagagctctttagaaggttacttttaaatggaggcccccccattcatggtacccactcccacttggacctctgagacctccagaattaggcatcattctaaaatctggacattagaagtcacagactttgtatataaccacatattcataatttatcttttcaatgttttttattcatagatgaaaatcttgcaggcatagttaagaaaaatataattcctagaaagtacaagggaaggattatgctctgcagatacatgactaacaaggatagctggccatgcccagggctggtgttggttgaggaggtggtgatggtgcggggcatgtgtgtgtgtgtgtgtgtgtgcgcttgaggagttgtggaagtgttcatatctgtaaagtattatttcatggatgcagaccttaatgctaggttgaataactttgttgccatagaagaagaaccgcacgtcaggcttttttcattagcaaaccagtaagcactcactttgggcctctgaaatcacttccatcacctaacaccagagatacaaactgaagctagcccttaagagcctccccctaagatttagagagaatgatttctcaaccagttttcatctttgaaagtgccatttctccctttatcattgtgatttttattcaaatgcatgagtctctgattttctaccatatacaaagggtagagactacagtttcctatagaagaaacttcacatagtggccgaaggatcttatttctcaaaattcaggaactggtttcctctttctggaaattatgacattaacttgatttcatggtatctctttcatcttcctcaatgcctgtgctgtatgtatatttttattatatactgtaggtatatttttattaccaaaaaaaggagaatttgagcatgccacaatcttgaaaaatctgaggttgccctgctgtagaaccctttaactgccaggactttgtactgtttcccaagtgttaccagagccaggccgccagccttatgcagtctgtttaccttagctggaaccagggtgctgtgctgtgggttctatgaaactttctgtttcttcatatttggctttgtaattcctttcttatcagttttggaggcatttcctattattcctctgccatatgttttctgccaaattaattgccttaagattttccttaagcttttggaaatgtataatgtttgagaaaaaagaaaaagaatagactgagtggaatcgtatctagtttcagttaataacatgtttcagttgatgttactgttatagctactgggcataaagtctccttcccttttttgaatcctatttttgaggcattgaagctgtgtctgtaagagacaataggccagttgggttaaatcagtgacgagattgtccagtgcagattggtgcccagtgagtggatcttcactgctcacaggccggactggggtcagctcacacagcgaggtgacggtccgctcctcaagcagtggatggtgctcttcggccttgcagatgccgctccattttcctggcttcaaaattttccagatatttcagtgcccccagaatgacatgctaacattctgctggcatgggagcatgaggcagtttgtctctaaaacatgccagagaatctcttgtcactacctaggcaaagaaccagtggcaaggtggcagcctcccaaagagctcatccctaatgtgacatcctggaatcagatggcacggacaccggcccagccccttcccagctctgtgactaaggacaagtgacaccccccctcccccagcctcggtctcctcctgtgtacattcagaaggcagatgctgccatgaggccatgtgtgctatgtccatggtgcaaggtggcacgcatgccgagtcaccaggtgagactgccgctttgggaagggataggaaggatctccggtagccttcgtgggcaggatgcctcttatttgaatgtgcctttagccacctcacagagcctatttccacatccctgtggattcatccctgtggaaatcttgagaatcatttatcctatgctgtcatgaagcagcagcagaatggagaaggtttaaaaagactcatggacaggcaaagcggtcaaacacctcctggctcagacgcacttgccttcccacacacaagtctggaagctcaggatggtgttcacggaggcagatgctcggggccggggcctgagtttcctggggcacagcctccatatctggggttccctggactatgcccagatagctcataatgtcccagccttatttgtgatggagaaggacttggggaaaagccaccgggaagcagtaagtctaaccagggaagtgcactgacttgcatgctttgaagaagagaagggagaaaagatacaaaaccctcacctggtttgtctgtaacagttgttatttctcaggggagctgcattaatgggccaagcctgtgcagctgggtgtgtgaagcatgcattttgcaatggactgtctccaaaagcagagcgaggtcacccaagaaatctagagcaagggaaaatactcattagcaaaggaattttgctggagccttgtaacggccgactcattatttcctttccaagttattttaaatgaaattttaaaaaacatcttgctttccaagaaattttgcttgttggcatatgtttggtgttttgattcagtttggaggatgaactagttaatttccctgggagtacatgcctattaaaaatatagcatcctgcatctgaccaagatgctatcttactatcttattgtgcctatcttttatgcggagagagaaaggggggtgttgggaaggagaccagactgtggaaacattttctttattttttctctttttcttccttttatagtttgtttatttttcaacttgacatgggtagagaaagcgaatcgctagtatagaaagcacatctggaatccatccggcctcctctctctggctcaccctcctcccagcaatgtttctccttggaagttgggggaaggtaggcacctctgaccttggcagggtctaacttggggtcatccactgcatactcatcttccagaaggcgtcttattcctcctcgacaaaaaaaaaatgtgttggtattaaaatgctttgaggtaggctggatgaacccagcttagtgaggatgacatgaaaacccttagctaatggggtctttattgagtagaactcaggtaagttcagatgtaagcagtgtctctcagtaaacatgaaaagactgaagatgcagacaatcaaatacttaagtctcttgaagagctgggtggtgggcgggggtcttcccaggtggtcagggagatgtgttagtgtagcacttggaagagagtggaacgaccaggcaaggatgtgccgtggaggtgggcagtgggagcagcccagtgtcagcatctgtattggttagaagaccaccgctaatgaggaggagcgtctctaccctgcagctgtctgtactcctgtgtcttccgtaatgtgccaagctctctgaatatatgcaaaactagtctgcaaaaagccatatgtctcagcatctggctttatttctaagtgttcaggtggaatttaagccgcgatcaaatttacaatgtcactgccagctctggacacttacttttggaataaagcaaagagtgaacactaatactgcatcagtcttgccctctgttaggggccgccccttctccccacaccagttttgcaagatgggctggctggggtctgagaaacccagtgcctccgagtcatggttaaagcccatctcagacaccaacacaccgctcacaaatcaacatcgacctgcgaaaacatggacatgtgttcgccaagagaacatcctcaatcaatcccagcagtgctacttgatgataatcaacacatgggccatggaagaaattaccccatgtccataaacaagaatgaatagagggtagtgtatctacccacaccatgagagcaagaatattcagcatgcaggtgcatctatgtgcatgactcgtacaagcatcatggggagaggaaagcaatggacacaattgtatcctgtagggtttcattcacgtgaaggtcagaagcaggctaaactcacctaggggagagtcctatcccaggtagtggtcatgcttggggacaggtggtgactaggaggggcacaaggaaggctgcagggtccggcccatcttgttgctggcctgggtgctggtctcactgatctctgtgtggtggggcaggtcagcctcccaggcctgctggtgcctgcagtgcccagcactcctgccgtgcctggcagtgttagtaccaatccgccagagtgactgactcccctcttgccctgagtagggcttgctgactccaggagcctcagggcggggtgggctttgagctttcttctagcaaacttgaggtctgtggctggtacccctcaggagcggaggggaactcttgtccatgagatgcttttaaccgtgcgcaataatgtgtagacgcatccaaaatcaatctggcctttagcccagcacttaactcttgggatgaggcctgctttgtaaatgttgataatccagagaaaatgagcttttagattccaaagacagccagatatcttccacttatgcaaaatgcagagaatcatatttaacaaaagatgttctggacaaatatgcttcttgagggatgaatatttaattataagggaaatgataaatcaaacattaatgggaaaatatgtttgccctcaagattcatgattttgatgggtctctggcaaatcttatactatgtttattggggttattttattgctggttattagtttttaattgtttgcttgttttctgctctgatcaatttttgtataagccgtgggtctattcaccctcttctctccattcccgggagcaagtccacatctggctgttggatgcatggcaaaagcaaaggtgtggagaaggttcagaggagacaggacatgtataaaatggtagggtcaggttgtcatgggggaaactgaggcacaggaggcaagctgagttagtacaagaacagtctgaatcataacgacatgccagtattacctaaaaggatgaggaacatggagctgtacttgaatccctacgtgagctggggaaaaggggcctcaggaatcactgacattggaaccaaggtttgtctgcagcttgtcggtttctgggacagaaacccaacatactggagtgggtatcccagcaatctgtaggataaaccaggacactgtggtgtcatggatagctggctgtctgccaggtgatggcccctctggttgcaatgtgagccgggcaggtcatccatttggcagcatggtgagggctctggccccagttgctatgggagggaggatgctggcacagggcactgttcacagactgcctttgctccatgccttttccatgagcatgagtggctgttcgtgtgggaaacggcagagccctcgcggtccccatcagcactgtgcagtggtaccggaggtggcaggagacagcctgatggcccaggttgtcttcatacccggcttcatgccagggtgcatgccgggcatagcacatgtgtccctgagaggcccctgatcaggggtggaaacccagcaaagtgaaaatcagaaatagtgattctccagttcctgttcacagataaagaaagaaagaaataataagcaatactaggcctggtgtggtagttcacacctgtaatcccagcactttgggaggccaaggcaggcaatcacttgaggtcaggagttcaagaccagcctggccaacatggtgaaaccccgtctctactaaaaatacaaatattagccgggcatggtggcgggcgcctgtagtcccagctactcaggaggctgaggcagaagaatcgcttgaaccggggaggcggagggtgtggtgagccgggatcgcaccgctgcactccagcctgggtgacagaatgagactccatcccaaaaacaaaacaaaacaaaacaaaaaacaaacaaaaacaactaaaaggacagtatctttttagcacccatcagtgtacaggatgctggggagggtactgtgaacttacccatggtgaaagtccctgtgttaatggataagctcaatgctcagaaaatgctgctgactgtggtattgccccatttaaagagacagtttgcagtacgttttcagaagtggcatgcagcctcagagaaaagtcaccaggggctggcatgattccagaaaatgttacagagcaagtggaatttgacttgaggcttgaaggatgggcaagatttaaataaaattcagaaacggtagagagggaggggctggggggaaggctgcccactggactgtcctgtttgcctccaggagaacctacaggcaagacatggtctcttctcaggtgaatgggaagccaagtagggctggcatgggtgagccacagctcgaggaggcaggccccgggccctgcgctgcctgtcatggctcatgagtgatgggagagatctgggcaggcaacctcctctcatcctgcatcatcagcctggacttggaacttggctgctttttctttctgcagttagcagagggccttggccaacacataagcctttctgccagcacttggcattccagctgacctcgacccaaggcctctgtgacttcaggaggcggcagctgggaagggtcagggcagttccaggcagagcacagacgtcagctcagacatcctaccccccgccaaccccccgcccccggggtttccagagcaaccaacaccaccaagctccaggacactggaaaaaaaatctttgcaaagaagcaaggggccatctcagaaaatccaggtcccccaaattgatgtagggagaggagggctttgacagcattcagcactccagagggtcacgaggatacagaaaccatttggagccacctctgcttctcagccccacccaggcaagccctggatcttcaagggactgatttgtacctgggaataaactcatgcatggatgagattcagagtcaatcacaccctaaaatgcagagcccatagtattggtgagttgttcatgtgtctctgaagcaaatttagggctgtggttcaaacatcgtaaaagttaaaaaaaattcactggatacacacagtaggctcttttaaattagcctcatttgaacttaattacatatttaaatactcaaataataaatgatggctgggtgcggtgtctcatgcctgtaatcccagcactttgggaggctgaggcaggctgatcacttgaggtcaggagttcgagcccagcctggccaacatggtgaaaccccgtctctactaaaaatacaaaaattagccatgcatggtggcgggtgcctgtaatcccagctacttgggaggctgaggcagcagaagcacttgaacccaggaggcagtggttgcaatgagccgagatcgcaccactgcattccagcctgggtgacagagcaacactgtgtctcaaaagaaaattttttttaataaaaataaaaaataaaataaaataagtgagtccactgaaagcggtttctaccttgatagttgggtgtgtggcgtcatcaacatcacagaaggctgatcgatattaccaggtgtggttgagtgcaagtgtttgaggtctcgtgggggaagagtttggaattcagaatccattgaggccttcactcaccactttccctctctcgctgtgttcccaaatgtgccacttttctgttggctcacatgcacccatgctctatttgatattcagggctctgaatttcaagccagactcagtcagtgtgattgtcactgctttcctgtccttcctttatcatctgtagacttgggtcccgtttttgcaggttgatgttctgtcttcgctgggctctggactcactgctcacgagtgcggtgtctgcatgggcactgcccagacatgcactgttggtccctcgatggctgcatggtcaggcctcagggctctctgccaggccgacctacagcccatacagacctgatttctgggcctggatccaggggatgccatctgggaagtgcgggatcttcccacgatgtcactgtaaaactcaccagggaggttttagaaattgaaccggcatcattcagattccatcctgctttttggtcctgagaaaatcctgcttttccctgagtaactgggataatgggtcaccagctcccatgccctagatgaggactagttagcattttctagtgcctggagatttccagatggaagctgtacttgggtctgtgtatctttgttacaggattcaataattcatgcactgaatttcccttcccggcaactccagacaccaaatcgcttcccatggtgtcccccaatcacttaggaatttagcctgtgtctaaagaccctctctgcagcctgacgtggctagccatcccagtacttccacgtttttcatgcctttctccaacagcgttgccgtggccccttaggcggcgatcgttttatcaatggtcgctccctctttttatctgttggcaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccgctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaacccactcttcgtagtccatgtgatgggattgttttatcgttttcaccgggtgccctccccactgcaggggtgcgcactgttgttgcaggcttgctacccacctgtgtttcttagcatttcaggaattaaaccacattcagaaccccaaataacctttcccctttcttcttacccactatcataggtggtattttaatgaagcgtctgtgccttgggtgctatttacaccaattttggtaggtcatactattttgagaatggtcttttgatagggagaaatttctaagacccatggtaataaaagtgcagctcaaagacatgggacctcttgtcctgccccatttgctgttgtttatgcagcaggagagaataggtcagaaccaacctttgcacactagctttctcccacacaaacggtccattttagcctctctgtcccacttgctatgtaaagaggaggccagtgctcggcataactgttctggtagcgatgcttgttacaactcatgatgaaatgtcccaacgcaagtgaggacgcagctgcccgccccagagctagaaggtaaggtgagttctctaggagtacatctgcccggatgcattttcattccgcagccttgatgaatgggacgaggctttgttgtgactgttttttaagcagtcccccagggaatcactgaaaatacctacttcttagagaaaagtttcaagctcccctcctctcttttgtgaggcaatacaaaatccatcatccaaatgaaagatacttttcacaacagcctttattgcctgcagacttacatgtatagtcctttaaacaattaactgtttagaaaatggttgtttctctcaacccttgagccagttattccacgctggtaagaccctttcacagaaatgtaacaaggtgcattttatagaaaacatctaattaaatcaccagtttcatgcttttaagttgtatctacaagtgcaaaactgcaacacccaaatgtttttagtatctaagtcagatatccaaaagttagctccataatcagaaatgcgcacaccactgttctgataataaaggcacattttccaataaccaattataacaagaagtgcagcattacctaaattgggtgtgtcatcttcccctcctgggtcacaggatgacacctggggatgcgatgccgtgcctgcacttggcgatcccaggagcacagaaatgcaccagacagatcatgaagggctaatgcttggaaaccacaccatttcctgacagagtgaaggaatccctgtggatttatcaaaagggaggagggaatttaagctaattctcttcacctgctgtattctcaaatctccaaaacaccagataacttaggttttttcatttgtcatagaacaaagattagagaacttgaaattcgttttgcatttccactcctcagggatgtcaaaaaagccagttctgttccagcacaaagtagaaagtggtgaattggcaatacgccaagacatagactgttacagtaattctttttgtttcacaaaagttaatggaaacaaaacaactttcagataatattcatttgtcagtatgtataatttgccatccaaatgctttttaaaaagttattatcttattattacacattaaatttacatggagttgtctcctaatcctgggattttaacaccaaatgtttaattctgaatacaaagaaacattcacatacttaattttacaatattctggaacaagttatattcaaaagtcaaatgaacagagaacattccacttgcaaccaacacatagctgttaacaaaattaaccccattaatatttaaagacggatttatccattaatgcctgttttaattgtcacttgattttgatggttagaaactttggttatggtaaaaatgatcacatgagtgggaattcattacctcaaagctcaggaccacagctccccatgtgcatgtttttctgtctgcagtatttcaaggtgagacaacaaaatagacacctaaaattgtatgagattttattcctggtgctttttcagcgagaaccatttttccagacctagggaaggagcctgtgtgtttttggcctgaaggattcatcaattcagagcatctgtgacagccaggaggaggaaagaagggaggctgggatcacctcccgccccttctagcatctctactgagagtgacaactccaggctgtccacccccatcctgagccttccacactcttctccgtgccactaacactcagtatctgacgcctgcagtgcgaagcctccagagtccccagactgacctgggcactccacccttgctggttctactttacttggacacacgggtaccttaaggcttgtcacactccaacacctttgtgtgtgtgtgtctttatttctttctaggttataaactcaggcagaggcctcatacattcacttctctatcccaccatcccagtacagggccagccacatattaactaatgcacaaatgaggccaagaaactggctagaaatcccaagaaactgtgccaagtatatgcagctgcacctgggaatacacgaaagcatgacatcacgagcacagcctcctccaccacaccttccctttctcctccttccctgctggcctcagacagctatgcatggctgcatgaaggaagatctaaatctggacttgttttatcctccccttcccttcttctcacctttattctgcctccaccttcttctttctttgtcttcccccactggcttctctgtcatttcccacagtgggttcccccaatccctgtggtcctcatgtcctgttcttgttctctttgtgctggatctcacatcctacagcatccaggaccatcctccatggctgatgccacagcctgccaattcccaaattcttcacgtttgtttgacttcctacttagctgtaaaaccaaagcccagggaggagtcccaaggtgcacaacacagagccaatctgcgtgtgtacagagatgcagatccgtttttaatcaatgtaagtatatgcgtatatgtatatacatatgcaattcacattcacaagtcctggtataaagttgcaatttttctggctgctataaaatgtgccagttttaaaactgtgcatttgttgcttgcaaacttataaatatgtataaaccccattataaataaattatggctggcagatggcatttaagctgccagcaatggttgcatggagttataaatgcttattaattctccacttttaaattcacagcacggaccctgggatctgtgacatgaagtggtgtgaaagcataattataaattagaggggggaaagccatcaataagagacaggtaagggctggaaactctcactagtgagtggttctcaaagtcaagacttcagagcagctgcaccagcatcacctcgagattttttgaaatgcaaattcccgggccccactccagacctagggagtcaggaacttggcggggccaggggggtggaagggcctgcaatctttgtctgaaccagctcacagggtggttctgatgcctgccttccactcgaagtctgcttgtcacgaacgcctgtctcagctcagggacatccccggcttaggaagtatgctcaggtgtgtgcagggccagtcagaaattgtttccagaaacagcctttcataagtgatagacttggtgaataaataccccagctgtctccccgccttgctgggtgaactctggggtgtcagctctgtctctcggggttccccggtgggattcagctccagttgtgcacatgacggtaacttacttgataatgcacgccttccccgtcagcttccttctctccctacttccgggatcttcactcaaataaactacataacctcaagtcctctctcagggtctccttctggaggaaccccaactaagaggaagtagaaacactgtctctcccatctgaatgactcaggcttttatgcattttgagatggagcacagatgtagaacccctggagggaagcactgcttgccatttccgtggggcagggggctagctttacgtgcaggcccaggactgtgagtcctgtgctcttttctaagttgatccccaggcccttgcatggctccagtttcctcttctgaaaagcagggccccctactgggctgtcttaccaagctcccttccctgtgatcctgtgtggagctgacagttctaggttggcactatgtccaggagtgggtttgtcctcttcatctttcttagagccagctttgaaagttccatgggagaacctgagtattactctgaaacccactgcaaggtctgtctgagtcctgcaatgacctctttgcaatctttccacaatcttcccactcactcccaatcctactgtcaccgtccacagaaagggatttatggacagcacacaaagttgggccagcgagagagaaccaatgggcacgctgggaatgcacaattttagaaaatcattgcgcttatatgtttcatatatttgtcaatccccagcacgccctcaagctgggaacatgtatagccctgcagtgtagagcacgccaaggctcagagaaatccagcaacccgcctgagtccacgccgttctgggtgtgccagggtggaggctggatggaggtatctactcgtggcccgcattgcctctgccctggaaaggcctatagtccgaggcttctgcccagctcagcccaacagaaaagaaatgtgtgactgccttcaggtagcagccagtttggaggaaatgaggacccagacgtccatcttcaagcattgcttatagaaagaagctacccaagtgtcggacgctactgaaaaggaaagctttattttgggagctgggggccaccttcagaatcccagcaccagacatggaggttgggctggacacacatgtccactgttcccctggcacatgggccctttagggtccacccttccctaggcctgtccttccttttaagttaggactttacctacacacacggcttgtcatttcccgtctttattagaaattacccacaacttcctccacctccaggaggccctaaagaaggccatatatggcccaatcaggcctttgtccattatcccaacatcatagatggcctgacaaaatagctgctcgctcatcaaggctgagcggacgcccagtctttgggtgcttcaaatataaaaaacagcaacagtggtgtcttaagcacaggattaaagattgagtcatttgactgcggtgtttttcacctccccacccgattctccggttagctactcagaggcagccttggaggtcaagaatcaaagctgacttaaaccacaatgagcacccccatgagaggcccagccggcctccgtgggacagagatgtcatttgaagcacagctgattcattcgtggggttaggggaggtgggtgggggtctctagggccactcggtaagggcagaggggccgttttaggactgctggcccccaccttgtactcccagaagacatagagtttggggttaagtgttgggggtgcccattggagggacagcagggcccaggtgcactctgcaggaccagggtggcccagcacagcagcagcgactgtgccctggaagcctgaggccctggaacgcaaggcctaatgccattcccgctgcgttcattgttcagcttccctgccctgcccaggcagagatgtggcctgagaaagtgtggggaagaggggcccaggctagacagggaggagcctccattgcttttgccttggaatcctgagctcaaagcacaggctggcacacagcagggctcacgaaatgctgagtgagcagaagagctctgcagccagatgacaacatggcctccaggaaggtgtggcaccagccccagcctcactttccccatgtgtctgtgaggctcacaggaatggcccaccacacagtgctggagggaagagttgggataactaatgtgtgctctaacccactttacaaatgggagggaacaaagattagaaaatcgctgccatctgctatgtctgaagcctgctcacttcactggcactattctagtgtaaccaatatataatctgagcttaaaaatgtatattttgaattaatattaaaaagaaaaaattcgactccaatactttaaattttctaaattgattctcatgcaaaaaatatatatattttctatcaccatcgaactagacactgacttcacagcaagagctactaaagctgcaggttaccattcaagtccccccaagagaaaaataaagtaaatcaaatgttacagcattcacagctcctaacttgcatttcctactttgctattgtccctgaatgttataatagcattttgacctttcacaagtggggaatgcatgaatgtagaaagaaggtcatttcgcacatttttctatgtggtgcacattcatgcacaggtgggtcagagctgtgtgtgtctctccagggctcccagcctcccagaggacagatgtgcagggcagctctcagagcacccaagtctatgctgtcttggggcaggagcctgatgcagctgctgccagcaaccccgtggagccgtctgcttctggatcactaagcagagtatccacatgatgcctgaagccaaaaccatttcagaaaacagcagtgcagtctacagtagtgtcagactctccagagtttcaatccactgcagaacattctagaacactgacttcactgtcatctcaaattcactggaccctcaaaggcaaagactccctagaaggccatgtatgaaggctggggcctgccctgactcatcctcactggttagctctaacctgtccttccatctggccacacgcacaccccaaggcagaaatggggctcataccattggcattagaacttagcagtattattatctgccagatttttcagtctcctcataactctccttacaggatcagatttatcactatccaactctaagcgtgtttagtgtgtctttctgttctgctgacccataccctacagggtgctgtaccctgtggggtctcaccagaacaagagccacgctgccagcaagcaaatggatccatctattctttaaagggcatctgtgaaaatcacagggcaatctcagcccagatagtatttgaaaggtataaacattgccagctttctaacaccaaatgactcctcaggaaatgacagtattttacctggaagaaagggagtcaagacaaagagtgggggcaggcacatgctcttccctgcagcaacggagaaaccttgttgttgggacagcaggcctttcccccatccctcatgccagaggcagtacctcaaatggattccagtgactcctgggtttctggcacatgcagccccagaagcctcaatacctgagtcttcgggactgagctctgggatgggtgcctgctcttgctgtcacacaggcttctcccctattgtataaggcgggcgggggactttactagcaattaccataagcagcctgtagtcaaccgctgactagagggagacacaaaccaggaatttgccccgaccacccttctacaaatacccattttagcattagatacatgagaacagggaagcacttgtcaatcaaaatcttggttggtgaagcttattttgtgccattttggcatgaaatgaattcccaagtactcctcgcacaactggggtcaagggtggcggggccctgtgctcagcaggacccggagaagctggagtgccacctgttctttagtgaagctgcagcgagttgtgtagacaccccaggcacgtggagtgcagtgcagggagcacaggaggtgtcccagggaggccaagggaggatgcccgctcccaccagcaagcacagccatgcctcagaaccagtatctcatagctttcagtgcagggctaggcatgctctgagcagcatgccttgcgattccctcacaattctgtgtttctattcccctccagttgtgcttattaggtaaaactgcaggctacaccttcctagtggcatttcccggtgggatgggtcagttgaattaaatttttgcctggacaactacagttaaacttatttttttttttcattaaaaacatacagcacagaacattagtcttacatctttcttagtcttaaaaaatataaatatagagggataatttgtacaggatgtataggtatgtacacctttaatatgcatatgagaaattcagaaccaagtttatgaaacttgaccttaaaggaagccttccttttgaagcttttgaagaaggctctgagccacaggcagctgtcccagttccagcagccccgattctagtccactccaggtcctcctgacctggtgcgcagtgctgggagcagtgctggccaggtcactgcttcctctccactggctgctggagacacagctcactccctgcagagacaatgggcaggctgctttctaggtggtggttgatgaggtggctgatactgtcaaagactctgtcctttgtccggatctatgaatgaagcaaaggaaaggttaagcacatctcacaggcagcaaaaagagaaaatggtttgctcagaatcagccagaccatctgaactggcccagaaggaaaggagggggggacaaggggcttccaccactttagagatgctgtctgcaaagagcaatggccaatccatttcattggttgggctcacctccaaactacctgaagacctttcagtaaccataagcccaggcccctaggactcagttctggaatgtcccagcccactgtcctataggcatggcctcctccaccttcaccaaccaaggtcacctcacctgtctctcctgctccctccctggccctctcaggatagccctgaactgggctctgcaggctcccatgaccctcccacctctaggcctttgcatggacatctcccggcccagaattagtgtcttccacctgagcctggccctacctcaatgccagcacctccaggcagccttccttcctctccagacatcctgggcacccaccaggggcaagcctcacagttccccagaggagctcctgttgcccctgcagtcccccactggagagtgagccaggctgggtcagaggtacaggctccgtgttcctgggctttcaattctacagcctgcccataaacttttaatgccatgtcaggggagaggaggttgaacactctgccctgcttgctggcctgcactgtggtccctggggtccatcagccgcctccactctgagccggcacattcacagatatcactcacacttgaaaaaggtggagtggggcctgtcaggagcaatttttcgaggaggtctggacacaatctcctgggagttgcatgtttgataagtgggagatgggggcagaaagcagccacctggctaggtccattcaccctcacaggccaccctcgcggctatgctcgagggtcagctgaattccctggctttgctctccagccttagcagtggtctcctctccatcagtgtgtgcagatgagtttccaggagcccatcctttcatgggacacccagctctcctcgccctcctgcagggactcctgaggcaatgttcattctcctgttttccccaatattctcttttccccaaattctcattgtgactcctgcttccactaatgtggccactcttgcccctccctctccatcaacctaccaaagaaacatcagcctctggactttcaacccccatcctgctcccatcccaaatctatacttcaggtgtgcatattggaaatccccacccaaggtgctctgagaagttcataccatctgctcatggctctaccaattagcacctgaaggaacagaaaaactttgaaattagaatgttttccccctgcaggaaccctctccccccatctctgtaagcaccagagggagaagagctctcaggaccaga

SEQ ID NO: 1071 - DNA, 26127 bp, Homo sapiens
gcactattttatttaataatatttaactactttctcctaacacattttcataaattagaaaatcaacagtcttccctctctaccttcttaagacactttagtgtgctgctttatctctacacaatcttcagtgctttgccttatatctacaactcaaaagaaaatttctgtaataaatgtagtccctggctgggtgcagtgattcatgcctgtaatcccagcatttttggagcctgagacggacggatcgcctgaggtcaggagttggagaccagcctggccaacatgacaaaaccctgtctccactgaaagtacaaattagccagacatggtgtcctgcgcctgtaatcccagctactcgggaggctaatgcaggagaatcacttgaatctgggaggcagaggttgcagtgagccaagaacatgccactgcactccagcctgggcaacagagcaagactccatctcaaaaaacaaacaaacaaacaaacaaaaccaaatgtagtccctaatgaagaaacaatgataggaaattaaagtaaaaatgccttttttctcagatcaattttttctttttaagatacttgcaaattacattttctccactgcctacttcatagctcaagtctggcaatttcagctggaattaggaagagctcgtgtgctcagcctcaaaaccatgtctacattccgactgcctgattcttcctcttacagacctctctgtacaacgtctgttgtgtttcagctttttgactcttcaaattagcatctcttccataaattggattttgatattgtttcaccccagtcaacattcagtaatagaacttatgtgaaacagttcttcctctgtcctttgcacattttctttcatgttctgcatttgatgatactttgctctttccttttcttctgaatccttgatttgaaaaaaactttgtgtagctctctgtatatcttactaactaaacttttccaattgatatgactgtctccatcatttcacctacagcctcaatgaaacactttcctctaggcatcttgagataagtggcacatgatattttctcattctataatggggaaaggcagagagaggctaagtgccttgactatctgagtgaggagttgatctccaaggagctgtttaatgagtagacattagtttctgttgagttggatgatctatatttggaccatgtcattattaatagtttcactttcctgaaaattaggtgttctcataatttggagttctggctaaattaaagattgtcattttccttagttatgttctatttttctgatatgttatatttgctcccacctctacattagtggatggtggcttttccaaaggttgttgctgttttcagattctgtgttccctagaagggatcgaagcccttgaaacatcactgagaatttattacttattgattatttctttcattttctatctagggttttgaattgatatcatatcactttcaatgtaaagaaataaagtgagtatagattagattaaaaaaaatgaaaagcataattagaattaggatgtcctagatgttttctggtcatcttttgagagcagaaaataatcaatatgtagatctacacatataggaaaaaatgctaaccagtcaaagtggagaggtgggcatttgcttgagtttctatgcatgttagaaacagttgctctttgctccattttgttggatccaagtcataacaaagtggtagaatgttccttgaaaggggaggagtatgggagagaattgggaaaaatgaagccactggtacagagacctggtcattagtccaaaaagatagtttcttccagataatgtacaaaaatagaatggatgtggtgggagaaagaacagccagaaagaaacaaggctgtgcaaatgctttatctagaaaatgttagccctccctggctaatcttgaaactgtttggaaaaaatcgtttaaacaagctactttccagttcatgagatcctttccactttgtagcaagattatgtgctttacatacacattagcagctttgagattgtctaaatcatgcttcattgcttttctcacactccaggaagaagggaggttgagaatggggccagggctccaggcctgatcctttctcctcttcctcctcctccttcttcctctcctcctcttccttcttcttctttaaaagtaagtcttcagtactgcttcccttaaagtcttgcaataaccttatcttgagctataagcacacacaaatgaagtatattccttcatttgatcccatttttctttttcccacatttctctaaaataaaccaacataataaagtcataatttggagttctggctaaattaaagattgacacacaatgtcattactcttcattctttgcttttgcaagtcacgtgtgagaaagaaacatatttctatggccttttgactgcccttgataaaatctgtacttagggaaatagcaatatcaataaatgctaaataatattaacacaatgtatgcaggggtttttaagcttcacagaaaaaaaaatttaagacatgaatttccaggaaaattattcttgtaactatcccaaatggtttttctttccatcaaaagaacaaatggaaaaaagtgcaaaagccaaatcaaacaaaatccttagtgtgaaatatattttggagcatgtggaattaaatttgcattttcaaataaaaacaaatgcccgtttaaaaagtcatctaacttttgtcctacgaagacaaccagtaaaatatactgtttcccttttcccagcatactcatgtttgggaaaacatgattatctgaagagaaatttacttttactaaattagagtttgaggggggagtgtggaaggaataattacagattatccttttattcaatctcttctcttggaaagaagagaagaaatgttgaaagccagagaacttttctaaaacgctgtagggaattttttttttctgtaaatatccaagtccaaaaggagatttgcaaaatgtggagttggagatttgaactcatacaatatttcctaatacaaataaaaatctgaaccttttaatggcgacacagtccacaccatgaatggtcaaaatcactggagctaatgtacaggaaggggttcctcagggaactgtggcaaattttagcatcttcctttccttttagggactggacactcatccttaggacttgagaatcatatgtgaaaattatatagacttcccacagtctactgacacattacagagatactggaaatattaaccacacatgttgtctacatactctctttctcatcatcataagccacctgtgttctcactgacactgcaaatccagtaaccaaaacatcctgttaaaattctctggcccttcttatccatgtgctgtcctttgccacagctcctaaatcctcttacctttgaaaatctttcctgctaccctttagaacctccattcagcctctttctcaagttgctttgtacatagtgtcttcatagcagccttgtaggaacctcagcttcctcaccccaatcattgttttcttttctccatttgtattgcttttcctccgggggtatctgttaatcctccatcagtctattgacttatgaatataaaatccatgctacctttacattggaacacataaggtacctagaattccttttgacacctagtggtggctcgataaacacggatgcacatcacgttagagaaaaggagttttctgagtccagatttcttacatgaaaacaaatttcaaatgaataaatttctcactgttattttaggatagctctctgccaaagaccttttattatacaaaagttgagaatgattgaagttattttgcttaattttttgccactaaatttgatgtgccaaagaaacttctaaaaaacaaaaaagaaatgcataatattcccagctactcaagaggctgaggtgggaggattgcttaagcccaggaggtccaggttgcagtgagccgtgattgcactccagcctgggtgacagagtgagaatttgtctaaaaaggaaggaaggaaggaaggaaagaaggaaggaaggaaagaaggaaggaaggaaggaaaagcaagcaagcaagcaagcaggaaagaaagaaagaaagagaaagaaaggaaagaaagagagaaagaaaggaaagaaagaaaaagaaagggagaaagaaaaagagagaaagaaagaaagaaagagagaaagaaaggaaaggaagaaagaaagaaggaaaggaaggaaggaaggaaggaaggaaggaagaaagaaagaaagaaagaaagaaagaaagaaagaaagaaagaaagaaaccatgaaggtagctgccgtatttctatgaaaccttccctccagaattagttccttttagcatctcattcagacacatggaaagcttgtttaaaatgacttcacaaattagacttaatgaagtgacttgactcaactcccctcaccctcaagtggtctttccctgcatcagagtccctttagtttcggatgtcactcatgacatagaatgaacatttaaaagatgaggaggcagccactggctatcacatttttctgagatgtgtgaaatatgattctaatattaataataataattaacaaacaataatatcctaatataattattaatcatgaattattaatacataatcatatcattattttctcttagtctaatttataggttcagatgtgtgcatgcatgtgtgtcagtggcactcagagaggagatttaaatagagagtgggaagggagataaaagataactgctgcagcactggagcaagaagccaaggggaggtatccgttaaaaactttttgggatgtgaaccttttgtttttctagattctggatgccggaacatctgttttttgagatgcatctgtaggagcatttttgtgtggaatatttgaaagttatcttgaaagtaaaggtcagagacaggaattgaaacagggcttaattcttaaacaagaaggtataagatattgcagttgatggaactgtggtgagcatgttccccaagggtggtgagcatgtctgtgtgggcatagaagatacatgtacgaacatttttattttattttatttagatggagtttcactcttgttgcccaggctggagtgcagtggcgcaatctcggctcaccacaacctctgcctcccgggttcaatgattctcctgcctcagcctcttgagtagctgggattacaggcatgcgccaccatgcctggctaattttgaatttttagtagacatgggatttctccatgttggtcagggtggtctcgaactcctgacctcaggtgatccacttgcctcggcctcgggattacaagtgtgagccaccatgcccagccaaacatttttatttttaatagcttaatgaatgtataatgattaaatgtttagcatgtattaaactatgatttcatgtagtttttttaaccataccaaccatgatttcatatggattatttaagcataccaaccataatttcatgtacattattgcttaagatagtaatgatataaaattttcttaaaattattcatgtaaaagaaacaagtcagttaaaaggaaaatattaagtaaaaatgtacaggtggcacccaaatatggtaaaaattgtgaagcagtttaatgaataactgaactttgggaaatgctagattagagaattggaaatactcttttaaataaacacttgctatctatgattatcctatggatgagtgtccaagaaatagagatgcatatgttgtatgtttttaaaatgtacaggatgaatttacattgaccatcatatttcctgtgctaaatcaaccattattttttggactatagggagaagctgtgtttcttcatagctcctggagatgtgtgatgtgtcacaggcctaataactatattacacattttttcacaaaagtgctacatagagtagaaatgtataatagttaccaacccaagactaaatcaggcctagtggtgtggatagcttcactttgcctatgataaaatacttcctcattctttgtgtgattttcaagcaacttaacgactgttagctttgctgagctaaatgcaacatctcataccaaatttattggcttggcaaagttacaaattttattacgcaaaagttgagaaaggaaagctggagaatgctaaaaacagtacaatttgctactgtgtagtatctgtattgggggctcagcatgttttatttatagatatctattaatacagagatacagaaagaaatacataaaaaatagttttatcaaatactttccagcattcaagtgtagcctcaaaagcaagaataggccaggagtggtggctcacgcctgtaatcacagcactgtgggaggccaaggtaagaggattgcttgaggccaggatttcaagaccagcctaggcaacatagtgagatccctatctctacgaaaaaattttaaaacttagctgggcatggtggcttgagcctgttgtcccagctactcaggaggctgaagtaggagtgtcacttgagcccaggaggttgaggctgcagtgagctataactgcaccactgcactccagccttggagacagagtgagaccctgtccccaaaaaaattaaaattgagaaaaaaaaaaaaggcaagaacagccacagcaaactttctattggggaaaaaaaaaaatcctcctctttacatctctcccttccttcccttccctttctgagagtgactgtggccaaaaggagcattttccccctgcagtcctctgaggggtggggtggggctatgaagctatccttcatattcactcctttgtccagctcttttcacctctagttcttctccccgcatctctgtctagcagtgccttaagtggaggaggggtgggggcatcaagcttgtaaaactggtttgttggggttctccttctcccctcatttcttgattcttgggaaaatgtcttgctgggaggctgcctggcagtgccctagctgccttctgtgggcttgaatggggcttccctctgcccctacaggaggaaaagggagctgctgccagagggagaaatggagagatggacagagaaggcaggtgccacccctcgcccctgacacacaaagaaaaagacacggaaattctctctctctcttctcttctcctatctctctctctctccctctctctctctctctctctctctcacacacacacacacacacacacacacacacacacacacacaggcgcgcgcgcgcgcgcgcaggcacacgtcttgcaaattcaggattcaaagagacaggggcaccattatatttggcacggtggggcccttccaggtctgaaatcctgcattcttccttactatttactttccccgagctcgagaagggccaggtgtgggcggatggctggccacgttttgtgtttccaattcatattcacgggatgacacagacggggcgtggtgagtgctgttggaggcgcttgggcagtttcattttgccccacttctccacctgaaggctgggcgttgctggaacctgcaggggcagcctcagcaaggtggggtggcgtggagtggggtgggagaagggactccagctgaagtagaacccaggctggacctgagaatattggggagggcatgggcggtggtttccgggtaggggccttgagaacatgttggtcctgactgttgtcagtgtttggtcaaagttgccaaaaggttaaaaaaaaaaaagtagggggagtccctgccaagacatatttcccaggccacctttcttccgcgggagtgttgggggggaggcgctgcttggaacctgtgaatgtgacatcagctctcctctcctctcccaaggtcggctttggagagggaggtcagggcacccttgcctggcacaggcggcagcgctggcttccggctcagtgccgcctgtcctccgggagctgtggcctccctgggccccggggctaggctgaggtaagcgcacagcggaggccaggggccccggcagaggccctggggatagggtggaggcatctctgggtgtgggtgtgggtgtgggtgtgggagggagagttcttgcctctctctctcccatctccaactcttgcttcagtggctcttttagaggatgcatgtcattatggacctgtcgctgccactgtccctgttcccccagctgtgacttcgagggaggtctggggatctgagtctgtccaaacccacggctttgctgttgggataaaaactgtccttttgattttagaaggaggagggaaaaaaggtttcccagcatgtgtgttgtgccagtcttggaaattcatccgtgcttgaattccaccctccatccccagaaaaactggagtaaaacaaaaagaggagatggacaaagtgtgtatttgatggcatcccctgggaagagactctaaatttatcccataggtcttactgggccactgtgagcgctttggtggagaacaaacaaaaattctgggtgctcagttgtctaacctgaaaaatgggactagcggaaaaagccaatgtgttccatgcaccttttgctttctttattaaggcatgatgtcacctgtacagtaactgccctgtgtgtacttcagggggggatttcaaggttagatagacaggaaattgttttgaaaatgtaaacacattattaaatgtgaagtattatctgattccttgttcgaatggcatttccttctcagcaccaccttccttgcatattcacttaaccttgtacaagaacacctttttgccctaaatgaagacacccccccaaaaaaaagagtcccagaaaatatgtccctgcttgtgcggggaataaatagaatattctgaggtgcattcctccttcctatgttaggcaacattccttgaccctcctcggcccccaagccaggttgcgtttttttctgccatttagaagggttttcctttttgtcctagtaaaacatcagcccctgtagctcttcatctccccctggtgttcttctcccgccatgtcttaagattggtggcaccgaccaatcttaagatttaagttctgtgtgaaaaacacctttgcttttcaatcagtttatcagcctcctccgcaggggaagtgtggacacacaaaagaacttatcggggcttctcatcagtgatagggaaaagactgggcatgtgcctaaacgagctctgatgttatttttaagctccctttcttgccaatccctcacggatctttctccgatagatgcaaagaacttcagcaaaaaagacccgcaggaaggggcttgaagagaaaagtacgttgatctgccaaaatagtctgacccccagtagtggggcagtgacgagggagagcattcccttgtttgactgagactagaatcggagagacataaaaggaaaatgaagcgagcaacaattaaaaaaaattccccgcacacaacaatacaatctatttaaactgtggctcatacttttcataccaatggtatgactttttttctggagtcccctcttctgattcttgaactccggggctggcagcttgcaaaggggaagcggactccagcactgcacgggcaggtttagcaaaggtctctaatgggtattttctttttcttagccctgcccccgaattgtcagacggcgggcgtctgcctctgaagttagcagtgatttcctttcgggcctggccttatctccggctgcacgttgcctgttggtgactaataacacaataacattgtctggggctggaataaagtcggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacaggtaggcacgctcgttgacttgtaagtctcggaattacaagttagtgtgttcttatccaccttcatgcttttcttgcttctatttttccccgttctttttatgactgcagcttagagagcaagtgtctgagaattattgctgaaagctactttaagtcttctagtgtaaaatgtaaaattcctctattgaatacaattaggtgcaattgactataacatgacattaaaataacttatcgttttattattattattccattatgtgtttccttggcttttaaaaaatgagaagagtatggacatatacaatttagtcaaatgtatgtttgtaatatatgtgtttatacaggtacacaggccatataggaacttaaatcttatttaaacactattttaatagtgtgttaacgtgtaaaatatttaagcattccagcttgaagccaaggaattgtatccagtcgttcaagcaatgtatgttcagtaaaatcacctgcagagcaaaagtctgttgactaactaccgcctccccccccccccgccaccaccccccgcaggcggtttctgggtgaagcagatgttttctttaaaatttgtcatcattgactttaggtttcttttggcaggtttttggcacccaaaacagtgtgagctctcttttcagctttattcacctgtgctgggaggggagctaggataattcttggctgccgaaggatttaggcagtgcgtgtgcatctgcccgggtcccccccgtttttagggtcagtgcactttttttgtcttttcgtgaccctgactaaagagaaaggatgtcaagggaatgaaaatcctggaatgtgtctgatcatttgaaatgtacaaaattgggcagataagctgcatggctaaattgttaggaggaagaggcaaggcagtagtggagaagggggaggcagtggatcccacacaagcctgatgcccagggattcggaattcaaaatccccccagcctaccttcagtcccctgacctgcttctcagccccaccttaggtcactggtttctatggagttaccctcctgaattgaatattgaatagttaatttctctctccaatcattttccccacctaattttgaaagatatacatcatctggggtaccctgtgccctacacagcatgtgaagtggatgggtaccccctaaagagagggtcatcctgaatggggaagtggccccaaagctaggaataactgtgatttcttgtctttagtcatgtgccaatgttaagtaagcttcagtggatagtgctgtcctaccaagttccttgtagaagccagccggattttcaacaggcagcattccacagcatttccctgagcctgcttcaagaggggtgggggaagtcccttttcaggtgtttatctcctctgcatttgtgtaatctccctgaaggtggataagccaagggcatgagggggaggcaaaaggtgaactcatgttaaggagggaaaaaaataaagagcccttttttctgtgtttcttgctgatggcaggctgtgtgcttcatctgcttttatctgctctgctagctctgactctactgtgatccagcatgtctctcggcgtttgaggagacatcccccactgacctgctctttctctccccagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagtaagtctctagagggcattgtaaccctagtcattcattagcgctggctccactggagcccagttttagagtttcttttctagggactctgaaggtagtccttctaacaccatccaagtgcctcagtggggacagtttccctctattcctgaaaataacgacagcttcgttcttagcaaccaaggggagggtcttctgaggccccgtagctcaggctactcatgatgggacaagcaggaggccactgcacgtttcaaatgaggaactttcagtgagagggcctcagggggacactctcacagtggcatctgatggggtttcgggaataattgccgaggtcagatgtgggttagtgcaacctgtgcttctcatgggagggtggagactgagaggcagaagtgatgatatagagggttagaatcacttaattttacttacagaaaaacctaggctcaaagtgttgaagccatttgtgcaggagtgagtttgtagcagagctagaactggagcccggatttcctttgctgctatattttccctttagaaatgcccatttcagaactgaaatagaaatactgtccataggcttctctttcacctacagagaagaaaagcagatttcctccttctgccctggacactagttcatcatctgtcggaagcagtcataaacaagcacacatttactatgcatacaatgtaccgttatgacaaaggaggaccaaaatccaaacaatatcaaaccacaccaaaaaccacaaggagcctaataattactaaggtgatacttccaaagggaggactttatttcttagatgagaatgaaaatggacacattggaaattattggagagccctctggctatgagtccttccacaaccatatggtaccaccgactggcaggagaaatgtgtgaacatgtgcctcctcctcccccaaccactggggtcggtggggtgacggtggcacttttagcagtatcctccgtggtttgagttgaaaataagttttaaaaatcctgtgagtcatggttttgcattgaaacctcttcccactgtgtacccacaaatagttaactaaatagaccattagaaaaggaagaaaatataaagcagatgccaagcagagatgtcctaatttttgacaaaaaagcaatgttgcttgtgtcaagaagaaactgaactttgtgaagagttgaaatggaattccactgaattagaaaaacttgttttctcctgcctggatacatacagtcagggccattgatgcacaggtgttcctggctgttgttacactttaccctctgaaatgatgctcccaagtgctatgtgatgagctccttgtgtgcccagtggaataggtgtgtccatgtgtcattttaaagactattaattacactaatatagtttctttctctctttggataataggcacgttgttccgtatggacttggaagccctaggtccaagagagccttggagaatttacttcccacaaaggcaacagaccgtgaaaatagatgccaatgtgctagccaaaaagacaagaagtgctggaatttttgccaagcaggaaaagaactcaggtgagcagaaacacctttgcttttcaatcagtttaacagcctcctgaactccttcctatcatggtactgccttcctgttttagagagactaacagagacattgaaagtcagggtaaagctgaatataacattgctgaaatgtttttccttgtgtattttaacagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtaagagggaaggaagaaaaattaggtaagaggttcacaagaacaactagccccagtcagtgatgccagcagcctgttcctccagcccttcttacccgggcaggtgaaagacttagaaaacagtagcagaggagatctatgcatcctatagattaaaaggagcaaaagaatccctcttaaatatttccatgaagctctggaatgcaaaccgatgtcctctgtacttttagcacataccatttcatctacaggtagatttcccaaccaaaatatatccagagatgcctttgtcattgggttatatacagcctttgcctctctgagtcaatgtatttaccactttccctgagaaatcgaaaatcattttggggagcggacatttagaaaaagaatcaaagtgtcatggataatcaaattcttcaataagttgcagttattcagatggccaaaggaaaaataaagtcattagatagggttggtagaatttagaacatgctgtttttcaggtttatggtcttttttttttttttttttttaaatagggaaatgtgtttggtgcagagccaatgtcattccaaaaagctctctcttttcctggtcagtcatgtgctgggacagagaagggatctggattaggcaacatcatagagttgctctgagctgctctttggtgataacccttccaaatcctaaactttttggaattcacaagctcaaaggaggaaacctactctctgatctaccacatgttctgcatttttctatcatggtctatggaaacttctcttagaaatccagtggcaagaagttctatgattaaagtgttctgagctcaggccaggcagtcatgaactacttctgagttatttactactgatttgtggggcagcctcagctatcggtttcttcacacctgcttatgagagtatccatatttatggtcgcaggccagtaatgctccccacgagatcagtttctgaactaacctggaattttttatgggtttttattatgccaactattaaatcaacattacagttcttccctctgtatttctcctgtaaaacattaggcctgcaaaaaaaaaaaatctttttaaaaataattgccataaagtatttgctctgggcctactgtatgcttcttttctttttctctcttttcaactaagtcaccgtcaatttattaagatggccataactattcaaaacctatgctgagttcctcaaggcagggtcacatagtgatgaaggttgggatggggctacggaagaaaccagaacaactctagtttatttaaaacctgtatttactgcccacttccccttagacttgaccatatgacccctcgctcccattctaagcataggggcaggctttatttttacaatggtaatagatatcacttgaggttttatcaaagagttgcggcgggtggtgaaagttcacaaccagattcaggttttgtttgtgccagattctaattttacatgtttcttttgccaaagggtgatttttttaaaataacatttgttttctcttatcttgctttattaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgtactgatttggaatcattactgaaatttgtaaggagtgggccaacgtgattaagtaccataaaggcaaataaatggttaaagacggtttcatagaaaagtgacaattagaaggatattacggtctaagctaattatataaagaattttatctgtatcttaaatgttgattttatactgcattgaggtaaaaacacaaaacaaaaaagcagctttaacacctctgtcttctcttgggtagcagcctcctgcttctccttcacctgaaaaattctccagggacttcatccattaacttggctcaggctattaggcaggattcaacagtttaagctgatggtgtggtgagagatgctttatccatattaatggactgaaggaagtaatggcaagacaaccccccaaaacatacctaattatacaaagttatataccaaagttgcttttagaaaatggcctgctcagagcaagtagaggtttccaatggctttttattttctcacattaaggatgttgtttcttaaggaacattgagtaccattgcttcttcgtgatagcctaggactggccgtgtgcccatggaggtagagacaccaggtactgattctaggtcctctgccacaaagcaccacttcctctccactttgccttggctggccttgtcagctcactggagagcacagtattgcaattgcagtattgcaaatggtcactactaactgaattctctaagagcttgattagccctcgagaatcttccttgcccttctctaatagtgtctgaaggaattcctggcatttaacaaatattagcatgtagtgatcactgtcgtcctaacagtgacacatcagaaggatttcaaataacagtcttcaggcatgcgtaatcaatgtcctgtgcagagtctccgtcctcattgatcctcatttttctctttaaggcacagtccaatgtctttggggaattgtttataaagcttactttatccataaactgtttctcagtgcgtgactctgaagaaaattttgaagttttgcccatgttgacaaggtgcttggtctgaacttggccagtatttaatcttgagcaaacgattcaatttccttctatcgtgagttttctcatctatgaaacaagggagttgaggggagtttctttcatacctctgagaaagagtttgagattacataaagaagttgaagtggcatgaaaaaaaataaagatctgagcttagaagacatggatctaatacatttaagaggaagtcagaatcagagaagccactgaacaaaacagtccaaaggacagcatagtaagtcagattgatgagttttggttgggtttttcatcagtcaaacccttgagcccccctttcccatgcttcctgcttcagtatccagtaggaaaaatgaaagggatgatgtagacactctagggcatgaggatttgcagtaaataagttgggagactcacagaaaattaatatttttcaaacatgaagacgaaacattcaattatattacagtccacatcagcttgaagggtaaactgatgggatggtctgtcacatttcttgctctgtttccagtaaaagcatggtttctggaaacccacttaggacagctttctctctttacactgatagcccaggcaagctttgatctcagaactccagaaaccagagaactctaggtggaatgtggtaacttttgccagggcagagggaacacctactaataggtacttcatttgcaccaccagagattggcatcttttttgatggatccactggctttgatactgcctgtactcccccaaaacacagcttgggtattggactaatctagagctccctcaggagaactcttgctgacattaagaaagagcaacattttgtctttccaggtgaaaatccaaggcccaaaaagggaggtgactcacctaagatcacagaaggagctgtagcatctctggagcctgaacacttaagttaagcacgactatttcagccagagggcccctggaggtctgcagaaacagatgcccaggcaaaccttgctagaaggctctgggtactaaagccaaaatcagtctttctgaaagctttgcctcccagccttgtagacagtgctagcagacccatcccctcaagaggaaagagaagaaatgcaggggaagaaaaaaggactataaggaggctatctcatggcatcgttaagtaaatgtctataggataaaatagaatataaccaagaatttttaattattatttttagactttactcaccaaagaatctatctgagtgaagggggaaatctctcggtcagttctctttttttttttttttttttttttttttgagatggagttttgctcttgttgcctaggcaggagtgcaatggcgctatctcagctcaccacaacctctgcctcctgggttcaagcgattctcctgcctcagcctcctcagtagctgagattacaggcatgtgccaccatgcccggctaattttgtatttttagtagagacggggcttctccgtgttggtcaggctggtctcgaactcctgacctcaggtgatccgcccaccttggcctcccaaagtcctgtgattacaggcgtgagccactgtgcctggcccggtcagttctcttttactctacaatgcaaggcagtggtctgcttttttttttccccctctctgtttctaaggtcttgaaaatgcctgttttcacatttaagttctcaatgtgtaaaacactgctttcaagcttatgttcttaatagagtcccttctgcattggctttatctcacctttatactcacagttcctggggactttgggtctggagctcagaatttatctactgcaagtgaatgttacacatttcacagtaacctctcatctttgtagataatttggtttcctgtagcttttcacatcctttctctcattcgacccctaccctcacacaacaatcctttcgggaagctggaaccatatcatgtatccatcagccaaccaaggaaagagacatatcgagagggtgagtgactcatccagagtccaacatcaggcaaatagcaagaccagaacccgggacccctgaccctttcttcttaaactcctccagagccaaggggatacactggacctgcaacttggactaacgtagattatttccagcttgtgagtgaactgtgagtggaatgaacttgttcttattctcttaggaagatcaaagctccgtatgtaccctgagccctagttttgaacgtctctgtcgtatgattatttgtttactgcatcattcttgttatgacaatgcatggttggcagaaaacttgctggcatttacaaagcttgcctcaaatctggtgccatgaagccatgacaacttcattgacaactactggccacagagccaatacatcggaggaaatagagtgatgaatgtgatggcagcggccatcaaatttcctcaaatcttgggcagtaatcagagagagagctagggctggtgccactaggtagtaaaaagagaagggcttcggccttggagacaatgaatgatggaaatgttgggtcccagggatgacaggctgcccgtagctcagaaaggcagcacatcgggagtccggcatgcagttttgcccgtttagagttttctgggtttctgcatcctattgttatttttcacattccgagtcattccagtccccttctgtgtaagttgctgtggaagtatccagggctaataatcacaatattaagcggccattgacatggcatgggcactgaccaattagaaaaagctgggacagagctgttgggcaggctcctgatagactctggctgggctaggtcttcaacctcctgatgttggcctgtaggggaccttgtgatctgggacaggggtgggcagccagggtggaatttccaagcttcttgttgctagggctatttactaaccaggatgaaatcatttcactgttttacagactagaatagtctcactggtatgtgctcctgtgtacgtcagatttaaaagtatcgaaaccattctctgcttgataaattattctctttacagcttcactgagtgagatgacattatcttcatgcctgcggaggtttggcaccaaatctttctgctcatgcacctttggtgtcctgctgcacagtcatctctggcaatgcccctctctctgcatgttcccctccctcgtgctctggtgccctatgggagaagtaaaaagaccttaagggtctccttgtctccttggagattttactttaaattttttttttattttatgtgttttctatttcaatagctttaagtggtacaagtggtttttagttacatggatgaattgtgtagtggtgaagtctaggattttagtgcatcccttactcaagtagcgtgcactgtacccagtaggtagtttttcagccctcaacccctcctatcctccccaacttctgggtctccaatgtccattataccattctgtatgcctttgtgtacccatagcttagctcctacttataagcgggaacatgttgcatttgattttcaattgctgagttacttcactaagaataatgacctccagttccaaccaagttgctgcaaaagacatcatttagctcttttttatggctgaagagtattccatggtatatatatattacattttcttggccttctcatcagttgatgagcacttaggttgattccatacctttgcaattgtgaattgtgctgtgataaacatactcacgcaggtgtgtttttgatgcattgacttcttttcctttatgtaaattccaagtagtgggattggcggatagaatggtagatctactttttagttctttgagaactctccatactgttttccacagagggtgtatgaatttacatccttcttggagatttttagcagggcaattttgtggttgccaaagtcaagatctgccttagaccaggtcttcctagggccctagctctgcaataggaaggagcaagagggacgagctgcctgtaagattaaatcttgccctcttagattaatttgggactaggaaagggtggccccataatttactatttaaactgggacatatttgacagcacttagtgacattcttaacaattctcacggagctacacattggactgttgtggacaaacttggacatatggtcatcttagatcaaaataagccttgaatcagttcagaatttcagaaccgcctttgcttcttggatgtgcttggcactgtgtaagcacacgcaatgtctgtatgcctttacctgcagaccaggctgcagcagagcacctcccccttttctggtgcctacagcctcaagttcagagcttagggcataatatatcattcaataaatgcttattcaatggatgaataaatacagaggtgagttccactgttcagtaagagcggggtgaaagtgatactcttctagccagaatgcgactagacaacagaagatttataagacccatttccagggctctctttgcagagctgccatagctgaaatcttcttttattgaggctccacgctagtggtaaattatttgacacaatggggtattctttctacttctttctactccaacccatcctgcatttcaccataatcataataacaataatcttctccaaatgctttaattataatttcaataaatacagagctagaaggaaattaaaaataattttggctattaccctcatctcaaaaaccttccactgccactctgcctatacaataaaaatatgctatctactgagacaggcaccagactaggaagaaaggttgggaaatgttacaatttcagtattgagcatattaagttttaaatttttcatcatagtgtgaaagttgtcagagtcaaatgaagtcacctgtgttaggaaccctgacaaatggagccaggaaaggccataaagggagaattctcacacacaaatgcctgataaccaaagctatcacagaatactttgcaaaaaccacaatcttgcacaaaggccatcacaaccttacacaaaaaatacttcagtgaagttatctgcccagcaactgcctgtctagcctcggactggtgccacccttgttattgataactgtagccaagaataatgatctcaaaacaattacgttatcctcctgatttttcctttaacaatctttgttttgctttacctcctcgaatacgcacatagtttactatggcatgtgtattttcattgcaatgtccatccctgaataaaaataattttcttttcatttattaatgtatttgttttttgaaactgggtctccctctgtcacccaggctggagtgcaatggcacaatcacagctcactgtagccttgacctcccaggctcaagtgaccctcccacctcagcctcctaagtagctgggaccacaggtgtacaccaccatgctcagctaattaaaaaacatttttgtagagatagggtcttcctatgttgcccaggctggttttgaactcctgggctcaagcaatcttctcgccttggcctcccaaagtgctgggattactggagctgttgtgcccagctcaatttcttttagggagtctctctgtctgttatctaggttgacagtggttatcttcaaatatatccaacagttgagagaatagtataactctaaagccaatatacctagcatatagtttatatagttgttgagatatgctgggtgttgctttatctctacctgcatcctgccctccttccttgaattactttgaagccaatcccagctatcattatcatcttacctataaatatttcagtgtagttgtaataaacttgatatgctttgctcgatcaggtaaaatgtgaaatagtcaactagatatgtggacctagagcttacagtggatgaagaactcacaataacaaacgcctcacggaactcacaataacgaaagagacaatgcatgttgatagcttgtgtttatgtggtgcttactaatatcccagacagtcttttgagaactttgcatgcatcagctcattttattcttactaaaacactatgaggtatttatcctatgttgcagatgaggaaacttgaagacagaaattcagtagtaacttatgcaaggtcaggcagctagtgaagaggtaagaaccaggtaacctcattcactatgcttttttgattcagaagaatccaaagtgataaaggttacattatgggataatcaagtcctatgatggtatcaaagtgacagtgatcaactctgcctggggacagggaagggaagtggtggtttcagggaaggtttcatgtaaagaaacagtgaaaaatcagccttgaattcctaagaaggataccatttgagaaatttaaagctgaatcaaaggcgtgaagaagtctcaataaaatgctttgtcgatagatgacttgataaaaagaacataacctaacatgctcatgtgactgactcataagaaaagtaagcaggtatctagatcattaaaagatgatttatcttgcaataatccaatgatattggaaatcttaaagcaacacaacaacactaggacagaaatctctaattttcaagtggcattgattgaactgaaattttgaggtatgactaaaaatagcaagaaagcaattctaacagattttcactaaattttcagaagttaactacatttaacattataatacaatgaaataattccactgaaaatcactgtacttactgaatgtaagcttattttatagttcaaatgccctatcaacctcctactctttaatgcatggtcacaaatgacctctcaccatgtcaagaattccctcttgatgtatggataggaataacccacctgtcaacttaggtgtcttccttgtgtttgaacaatttgctaaggtaccattaccaatcgaccctgctctgacattggtcaccggtgtggttctttccatataacctcatcgttttgccctgatcagcggccacaggcaggcagtaaccgttggtttggtgaaagacaaaatgccctagacaattaaggagatgatcttattcaggctactacaataaggaaaatgttcattaatgaagactgtctcaaggaaaggaaggaaacctggggtttcatagagacagtaaacaagggagcaactgaatcttttggtagtcatgaggatggagatggtcttttcttaaccatgaagaaagggtggaaaggaagaggctcgagcagggtgtttccttgcagttagccatttctcaggacacaaagaatgaggagatattttgagggacacaggactcagataaatttcttcattgtcagtccctggtttttttcaagatgaatatcattcatcaaggaaacactcaatgacaatcataaatctcctgagtggggtgaagtaaggtctcagaaatcatttctcaaagagtcttagtgttattcggacaaagacagttgaagcatctgtagaaagataatgtcaaggtcagttgtgttgggattctggggactaggcaccgtaaaagaggattgcttaaaaagaaaaagagaaatataagtataaaaggtttactaaagagccagaaattgaataatgagggtaaccagttcagtggattccaagaggtcagtggaggaaaatctttcagttctgtaacactgctctttgagtctcttagagctactgaataggacatcagtgctttcagtggtgctgtccacagggcatgtctgactctagcattccacaggcttcttagtggcccaggcagtgcctttccagggagaaactgggcccatgaatggtctgctacagtggtgagtcctttgaagtatatatagcaaattttagcttataatgcttcttcagatcctagggaaaaggacccagatacaagacaaccttgagtccttacagggatccgggtagtcagattttagttctcggtgacactgagtcaggcagcagtgagaaaaattgaaaaaactgttggaaaccagaaagattgaagatctgaaaaggattgataatttgggaagtttacaggatccagtccaacttacagataggtacaaaaactaacagctagggagaaagtcaattacaattccaccagacaagacagtttgcctattaatcattactcacattaaaaaaaaacccaaacagctcaaaaacaatgaacaaggttagaatgagataacctgggagactgtgctatctgatgtatagtttttcattaaaatgcaaaatttatttgtgtagtcactgactcttgatcaagaataatctc

SEQ ID NO: 1072 - DNA, 70370 bp, Homo sapiens
ttggaacaaattgagaaataagaaatgggagtcagaggaagagaaaaatatccactttatcagtgaataaactgatacagagaagaaggttgactttttctccagtcagagactgtaatatttctccctgattggagagaacagcgggtctctgccttgttggggcagagcccatctttgcattctgagaccagttagctttcaaggtcagggaaaccaccaggggctggaccacacatgctcagttccttcttgtatcacccatgggataagacagttctctcttgggaaggaatgaatgagggttcagagagctttttcctacacttcttgctttgaaggagcaaggagaagttcccttccctccatccaagcatgaagaggaggggaaaagtattcccctcaataaggctgatgtcagaggcaatgttcgaccagtactactaaattctaatccatttaactgtgataatttctggtaaaatcatgagttttcatgacaatgtctatatccattatatgtgatctgttggaagttttggctagagaaacttaattgtgaggaaatttaaatattgtgtgatgcaagtacttactgaatttggaaaccccttgatagcattcccagcaagtgatagttcaacctttgcttttattcttccagccacagagaactcactgctttaaaaccattccattactgggtagctctgaattgttttcattgttttctcttaaactgaaatctgcttccctgtaatattaatgaatacagctaaggacataccgtgtggcatactatgagagagctccatccagggtgaggcatcaaaatcatgaacctttttaaaagttcatatgctcaggtgtctctcctagtgattgattttgatttgtcttggctaaggtggttcctggatatctatatatttattttgaagtcccaagaatgagtgataagcacctgaggataagaactagtactgaggttaaggatggagcaccaccattctttggatagagttgtgatcacctgtgtgattttatagctcacctgttagttagattgagcaagagaacaaccccttttattagaaacagcatacataagaagattgtaaaaattaacctacacttgctagggtaagataatcagtagtacaatttgtattaatctctgacctaatatgacctaattcacttttcaagtttaacttggggagctttacaaaatagtaataaaagggtcccatcccaagagattctgatgccattagtcactgtgacttgggcatcactgcccttgattctaaaatgcagcctaccttgagccactaatctagttaacttctgggcctcagttcttcatccagaaaactaatcattatttttatgaatgtaaatatgtgtatatatataatatttatatgtttggatgctattgtttaatatttacttttttgtttttaaaaaaattataaaattggctgagcgcagtggttcactcctgtaatcccagcactttaggacgccaaggcaggcagatcacttgaagccaggagttcaagaccaacctggccaacatggtgaaaccccatctctactaaaaatacaaaaattagctgggcgtggtggcattcgcctgtaatcccagctactcagaaggcggaggcatgagaattgcttgaacctgggaggcagatattgcagtgagctgagatcatgctgctgcactccagcctgggtgacagagcaagaccctgtctcaaaaaaaaaaattatatatatatatgtatgtatatatatatatatatagagagagagagagagagagagctattaataaaacagaggagtacattttacccttgcaattccagtcaatactgtggtgtcatttcagccaacataccaacattcagtcaaatcccaaagccaaatggataatttcagatggaatggagttagacaggaactggcttccctttctcctgttactatgaggacaacccacacctgctcagtggcctaaaatattttaaatatgttcatgacaattatgctgagaatgccaggataacactgatggaacccatgacttcaccaggattgtggtctacatttacaggcctagtactagaactagaccggcttagagagtgggagatatccctctgttgtccatcgaaagataaaaatacaggctttcagccgggtgcagtggtgcatgcctttggtcccagctactcagggggctgagatggggaatcctttgagcccagaagtttgaaaccagcctgggcaacatagtgagagacctccatcttaagggaataaaaaaaaaatcagactttcaatatgagtaacaagttatttttaggccttttatgactttataaataggcaataatgaacaccaagggaagcaaaacactgaaaagaattttaaaatttgttgtagaacattaatacgaaatttgaaactgcaaaacaatgtaaaatttaatgtcatgttgtcatttacttttgtgtatattgtgccatgtttattttcaaagtcctatctagaaattctaaaatgtctaattttcttaattaaaaatccagaattctgtagtttctgaaattcaaaataaatactttaacataccaaattggtttttctaataaacatttatttcaagtgttatttgttaaacatttaattgttgagatttgaaaatgaacattattatttattagacacattttataggctcattcaaaattcttaacttttgagttcctgctttcttcacagcagtgcactcactactttctggtatacaagaagaacagcttgtccccactcttacagtgtaatgaaattagcagtataatgaagaaaagtgctgtgtaggaatgactgagctctaagacaaactggtaagaacaattaggtactaaacaatgggagtactagggagaagattcattttgagtgggagatgttggaacactttggaaataacactgaatttgggttctgaaagatggatataattttgatatgcaaagttatgaggaaagagttactgtataatccagccattctcctaggaatatacatccaagagaaatgaaaacaagtccacataagatttgtacacaaaagttcatagtagcattattcatggtagccaaaaagtacaaacaacccaaatgtccatcagctgatgaatggatacataaaatgcgacatatccatatgatagaatattatttggcaataaaaaggaatgagatgctgattcatgccacagctgggatgcaccttgaaaatatactcagtgaaaaagaccacatgtatgattccatttatatgaaatgtctagcatgggcaaatctatagagatggagagtagattagtggttacctagagttgtgagaaaacagagtgaatactaacgggcatagggtttcttttgggggtgagaaaaatgatagttgcacaactctgaatatagtaaacactactgaattgtatactgtataggtgaattgtatggcatgtgaattatatctcaataaagcagttattaaaaaaaaaatgaagagaatttcagatagaaaccacaggagagagccactgagtgcaaaagcctgttgaggtaaaactgcagacctgcatgggtggggcttactcgggaaacactgaatatgggatgcatcatggaagcctccagaggagcatggccttgcccagtgaactgcagcccagtgaatctcattttagacttctggcctccagaacagaaagagaataaatgtgtgttgttttaaaccaccaagtttgtggtaatttgttagttatagcagccataagaaattaatacaggtccaaatcaaattaaccccataagagccacacagatttgagaagcattttatttgcctcacagttttgcctattatacagtttctagttatttagaatttaagccaataatgtcaccatataactatcaactgtgattcccttcatctatgactatttttaagaaatgtaagatttggataagtcataatcacagatcagaaactgcagacattgaggcctggatggccgtttagagagaaagagttaacatttcagtggagacctttcctatcttgtatttcctacagtctcctcctatcttcagtgcagtgttctggcagcacctcaagctcactgtcaccaaatgggattcaacgtctttcctcccaaacatgctctacctcaccatgtcgatagatgtacagtcgccccactactggcttaaattctaaattactgaaaaccatgtaacaggtaaaagtgtgagacaaagtacccctcaaatacatgtggctcttggggttcatctgactgagacttgtatttacttgaatggcatcagaatcctgctactaaccttctaacaaacttggaggtaatctttgatgcttacctttccttaatccccacatccaattagttgccaactcctcttggttctgtcctcttattgttcaggccctcttagtctttccacttctgacctttcaaatatagtttcctcctgctctattctaaacatgctagtttcaaagtattggttgggccataccttgctttaaagaaatactcatttgtcaactgtggaggttgctagggcactaactcactctaaaatttgataaatatttatcgcatctttcccattcagatttagagaaagttccttaaagaagaatcatagatgataaatgcaagaggtttgatagaaccagaaaatcactattttacaacccctgaaatgaaataatggatccaggcaacaattatcaatagctgctaaaaccatcaggtgaaagattgatgagaaactttgtagtagttggtaccaccagaactcattgatcaatattaaaatcactgaaagtggaacaatcagacatcatgttcctcctgaaatgatgtaagagaaagtgtatagcatcacctatggagtattcttgggggaaaataaatgaaccaggatcaaatccagcttctaggtctaactggacactctggggatactctcagtcaaatcctgagtggaggaaattccacaggacaaataaaagccgaaaagaactaaaacgcaggggtaaattttacagagtaaaggagacacatcaaccaaatgcaatgttggatctagatttcaacaaccaagaaaactgtatttttgagatagaaacaatacagactattatatgataattaaggaaatcttgtcaattttttgagtgtgacaatgatgctgtggttttgttaaaaagatttatctgctagagatacattttaaagtacttacaagtgcaatgatgtaacacctgagatttactttaaaatattccagtagggccggatattgtaatcccagcagtttggaagaccaaggcaggagaatctctcaaggccaggagtttgagaccagcctgggaaacacagcaagaccatatttctacaaaaaatttaaaaattagttgggtgtgttggtgtatgcatgtagtcccagctattcaagcggctgaggcaggaggatcacttgagcctaggagttcgaggttacaaggagctgtgatcgtaccactgtactctggcctgggtgacagagtgagatcctgtctcttaaaaaaaaaattacaattaaatacttcaccaaaagaaacaaacaaaaagtaaggggttagatgtattaagaacggtaaagtattgatatttgttgcagctgggtgatgggtagagtttcattattctatttttgtgtatgtttgaacataaagaaatgtatgaataatattgaaattattcaatattccataatgaaaagttaacatgccaagaatctcaaattatggtgaacactcagtggggactgcatattgtgagttatgtctctagttagttaacagatagtagagacctggaaaagcttgtatgtagccttttaaacatttcttctcagatacatacatgcatatatatgtattatataaaatacatattcatacacatatgtgcacacacacaggatggcttcatggacatgcaacctgtgcagttgcacaagactgtgcttagaagcaccccacacctaatttttgaacgagggccgtacagtttcattttgcccttagtcccacaaattatgtagctggccatacacacacatgcacacataccacatacccacatgtatatatgcatatattgtgtacatatgtatatacattgaatatatttaacataagtgttaagtatgcatgtgaattttatgtatgtatttatgttaaacatgtacgtatttaaataacatgtggtttagtgataaaaattccctaaaaggtatgtttctagggaggcaattatattaaaatggctctcaaaatttctgtgtgtgtgtgtgtgtgtgtgcattttaattagcaaataaggtcccaggctcttgcccctgtcctcctctgagtaagaggatactttttactttaattttgaggccaagaaaatatatactcacaaatcaaaagaagttgctaagaaatgctatattcatttaataagagtaggaatatatatatctttttttttcttttttttttttgagactgagttttgctcttgtcacccaggctggagtgcaatggcgtgatctcagctcactgcaacctccacctcctgggttcaagcgattctcctgccacggactcccgagtagctgggattacaggcgcctaccaccacacccagctaatttttgtatttttagtagagatggggtttcaccatgttggccaggctggtctcgaacccctgacctcaggtgatccacccgtctcggcctcccagagtgctgggattataggcgtgagccaccatgcccagccagagtaggaatattaaaatgaggtcagtaaagataaggctacattctcactaactggccacatcatttagtgtttcttttgaatatagcctcattaatcaaaaccagatattgtttttttaaaaaaagatttctctctacgcagaacatttccaaatctacagaaaagttcaaagaataatacaacaaacacctgtgtactgtcatctagatttaccaattgtacaatggctaatattttgccacatgtgtgccctctttctctctccatgttgatttttgctgaacattgaaagttgcagacatcatgacacacttggcctctaaatgtttgtgcatgcattgcctaaaaaaacatttttggctgggtgcagtgactcatgcctgtaatctcaacactttgggaggccaaggcaagtgaatcacctgaggtcaggagttcaaaaccagctgggtcaacatggtgaaattccgtctctactaaaaatagaaaaaattaacctggagtggtggcagatacctgtaatcccagctactcaggaagcagaggcaggagaatcacttgaacctgggaggcagaggttgcagtgagccgagatcgtgccactgcactccagcctgggcgacacagtgagactctgtctcaaaacaaacaaacaaacaaaaacaaaataaaacaaaacaaaaagacattttctacatatactattatcacacctgagaaaacagttatttggcattgttatctaatatgcagtctatattcaaatgttctcaattgtcccgaagatatctttatagctgtttgctgggttgttgctttcttttattattattattatttagatatgatctcactctgtcacccaggctggaatgcagtaacatgatcatggctcactgcggccttgacctcctaggctcaagtgatcctcccacctcacccccccaagtagctgggaccacagatgcacactaccatgcccagctaattttctgattttttgtagagatgagaactcactgtgttgcccaggctagtctcaaaatcctatgctcaagccatcctccccttttgacctcccaaaaatgctgggataacaggcattagctactgcgtccagcttttgtctttttaaatatccagaatacaataaagattcaaacattgcatttggtcattgtatcttacaagtctctcccctttttttttttttcatgacactgactttttgagaagcccaagtcaatcatcttatagaatgactacattcaggatttgtctaataatttcctcatgattaaattccagtttaacactttgtgcaagaaaactaaataggtaaaattcttaagtcacatcaggaggggcataatgttagggtgttccaccttgggtgatgctaaattgaatcacttggttattgtggtgaccattgtaaaggtacattttcccctgtataattgatacctcttctgtaggattatatttaaatccttgtagaagatcctattccacaatagcttttcatccaatagttttagcatctattgatgaacgttacgtgaaaaatctatgaactgctctttatgaacactttttaaagcctttataaaactattttctcttactgtattttcactttttgcttaacctaaatttggccctttttaaaaatcctaaaatcatatggcagttttagaatggtagctggttgctgctatagtttgcatgtttgtcccccaaaatctcatgttgaaatttgatcccagtgttggaggtggggcctgatgggaggtgtttgggtcatgggggaagacccctcatgaatacattaatgccgtccctgggggtggggtgtgctggggaggagaagcaaggagttctcaatctattagttccctcaagagccggttatttaaaaagagcctggcaccttctccctcgctctcttgcttcctctcttgccatatgatctctgcacatccggctccccttcaccttccaccatgagtggaagcagccggggaagaagcagatgctggtgccatgtttcttgtacagcctgcagaactgtaagtcatataaatctcttttccttataaattatccagcttcaagtatccatttaaaccaataagaaacaaactaaaacaattgccctaagttgaaattcaccctcagggtcgtcttctaagatgcaatttaaattatcttctctacagcaattcaggacaacaaactagcataccccatgttcctcaaatatatcttctccagagctcatgccagaccccttgtccagacttcctgggtggtctcctctctactcatctaacaccctggcatatagttggaaggcccactgggctgtcacttctagccctgtgctcagcagaaagccatcttacccttcccgatggactattttctgtttttagctactgccttacagcacggttgtctttaaagtggttgttacaatagatacaaaatgtatttaagataaaaggtataactatgcagcaaacactagtggacctaccatccagcttaaggaagttaccattacctttgaaagtccatttccccaatcacatcattcccctccctcaaagataaccaccatccagaatttaatatttctcattcccttccttcccattattgtctcatcacatttgttgggttttttatacaaaatgatttagttttgcatgctctggaactttatataaatggaattattctgcatatattttctgaaaacctgctttgttcgcttaacattatgtttctgagagttgtattgtgttacgttattacatttagctgtacttcaattgttttcaatactatatagtactcctgtgtgtgaatataatttttttaatccattcttcttttgatgtgcattatggttgttccctgttcttttggctattataaacagggttttatggacattcttgtaagcacgtatgtaggaatagaattgatagctatgtgggtatacatggattcaactttactagataatgccaaattgttttccgaagtggttgtacatcacttttttttttttttttaatgagtaccatatttctccagctggcttgtaagctatgtgaggcagagaacgatcttacatttttttggcctaaaagcggtagaaatttaataaatagatatgaattgattgattcattaatagtataaaaagaaaatttgggggtggtttttccatctttagaacaaagagatgaggctgggcgcggtggctcatccctgtaatcccagcactttgggaggccgaggcaggtggattacttgaggtcaggagtttgagaccagcctggccaacatggtgaaaccctgtctttattaaaaacacaaaaattagttgggtgggtggcacatgcctgtaatccagctactcaggaggctgaggcaggagaatcacttgaacccaagaggcagaagttgcagtgagccaagactgtgtcattgcactccagcctgggcaacagagcgagactctgtctttaaaaaaaaaaaaagaataaagagatgagccaggaaaaagtaaaatgtaagaatgtttttgaagcaaaaagaagaaaacctttctgtttctgcagaaagattagtaaaaatagtaaaaaattaaaggaaacattaaaataaaaggtaaatatctattgatattccctagcagattttagataatttaaggaaaactgcatatcagaagcaggatactttttcagaagggctctaacatgtgtgtcgttcatttttctctgggcttttcttccacacagtcaaggtccttagtatttcagatgtgttaggtcgatcctcaggtttctttgagagtaatttctgtagaagagttttctgcaatgacagtgagagtcaatagtaagaaataaaacattgaaataaataaaattctgatgattttcaagtgcttacttcttttttatcaaatatatctgagatgatgccatcccgtaggtctgtgaaaaactggaaaaaaaaatgataggtgtatattaggaaattatttacttgggaggaaagacagaactaaaggctgaggaatacctgaaatgtaggatatttccagattttttgggaaagtctctttagccaagaagcaagcaggattccctctctcctacactacccccaatctaataaccatccttgcattacgacatgaagtgttaagtgcatcatctttacaatctcccttcatgcattttggaaccctaagtgataggtacttctaactgttttacagaggataaggttattgactccaggaaagttccctttcctgagcttaagagtaggatatccagctgggtgcagtggctcacacctgtaatcccaacactctgggaggccgaggcgggtggattgccagaggtcaggagttcgagaccagcctgaccaacatggtgaaaccccatctctactaaatacaaaaaaattaaccaggcatggtggtgcacgcctgtagtcccagttacttgggaggctgaggcaggagaattgcttgaacctgggaggcagaagttacagtgagccaagatcgcgccattgcactccagcctgggcaataaaagtgaaactctatctcaaaaaaaaaaaaaaaaagagtaggatatccacttgcctactgcctttagtgactccccactgtctaagcaagaaggtccacattttttcctcaagttagcccaacctatctttctagcctcaccaaccactacttccttgtaacttatatactccaatacaacttacactgcctgctgtccccaaatacactctgtacattcccgcctccatgctagaatcaacttttctgttttggactattagaagccaacagatccttcagagcccagcttagatgtctccatgaaacctaagtccctacagctggaaagatctccctcccagctgcttccacagacttcatgccttctcctaaaatgcttatggcattctcttatattatcttcccttttagaaaataagctccttgagaacaaggctttattcatttatttatttagagatggaatgtcactctgtcacccaggctggagtgcagtggtgtgatcttggctcactgcaacctccgcctcccaggttcaagcgattctcctgcctcagccccctgagtagttgggattacaggtgtgcaccaccacacccagctaatttttgtatttttagtagagatgagatttcaccacgttggccaggctggtctcgaacacctgacttcaagtgatctgcctgccttggcctctcaaagctgggattacaggggtgagccaccgcgcccagccaaggcttgtttatttttgcaacccttacagcacttagcacagtgtcttacacaaagcagtcaatcaataaaatgttactgactgacaagtcttacaagtcttatgagatgtactaccttccagggaagatcaaagtttttggtctttaagaaagtgtttggtctctgccaaaccttgaaagacagaaaattcatatttcatttgcagtcagatactaatatgctcaagcccatcctcacgtgagggcaagaactgtctgcagcagcactctgaaggtggtagtcagtaatttttcttgtttaattctttctttgagataattttacctttgatgtttcaaaagcagtgtcacatacatgaagaagttcagcaagaattagccccaaagcgtagaggtccacttcctttccatagtcttgcgaagaaatctaaagagaccaaaatagatttacctttgttatgctccttacataaatatccagccttctaaagcccaaaaaagttatttgaccaaaacatcttacaccacaaaacaatgtctatttattagcaaaatctgtggagtctgactgcctaggttcaaatctgtaccgccgaatagctgaatcctctgtgtaaattaacgatcaacatgggaataatctcagttataaaacaaggataacaacagtatcaaccacagagtttgattgtgagagtgagatgcagcaggtaaagcagttaaaatagcacccagtaggcggcttgcattgcaactgttcatagcgtatttattcacaatattccataactggaaacaactcaaaggaccacaacagaagaatggataaacatgttgtggcatattcatacaatggactacgactcagcaataaaaaggaattctctgctggtatgagcaacaaagtttttccagaagatattattttgaatgaagaaattaaatacaaagagtacctactgtatgattccattcatatgaaggtcaaaaacgggaagaactaagctatggtgatagaactcagagtgctggtttcttctgatcagtggggaggaggcactgactggaaaggagcttgaaggagcaaaatgttctatatctttatagtcttataagttacagaggtgtatgcatttgtcaaaacgaaaaaatatacacttaagatctgtgcattttatactgtataaattgttcctcaacaaaatgttgccttttttttttttgagacggagtcccgctgtcaccaggctggaatgcagtggcgtggtctcggctcacagcagcccccacctcccaggttcaagcagttctcctgcctcagcctccagagtagctgggactccaggcacgtgccaccacgcctggctcatttttgtagttttgtatttctgtatttttgtttttttagtggagatggagtttcaacatcttggccaggctggtctcaaaccccttgacctgaggtgatctgcccacctcagcctcccaaagtgttgggattacaggcatgagccactgcacccagccaacaaaaggtttttaaatggaaaaaaaaaccacacacacataataaaaagtaaagtacaatgatgaatgtttttaaccaaatagtgtgagggcagcaatacaggatgcaggagatactgaaagcagcaggaagttaaagagagccactggcctattgtgttctatattttttatgccaactggctccccaaaaggaaaaagtacatgccttctccattctagactctcaaaccatcagatagctcagtatatctattcttggatgacaaaatagtagagatattttgaaagctgtattgtcagcaaaataatctttaacgggcatttacaaatcagaaattaaaataggataaacaacccaaaaggtaaaaaataaaagcaatcaacccaaaaaaaaatcacattcaaataatgagactatatatgagacaaatatttaaaactcaacagctgtacacccatgttcatcagcagcattattcaccacagtcaaaaggtggaagcaacctaagtgtccattgatggataaaaggacaaacaaaatgtggtgtatacatacaatggaattcattagtcagccttaaaaagaaattctgacatgttacaacatggatatatcttgaggatattatgctgagtaaaataagccagtaacaaaagggtaaataccgtacgattccacttacatgaggcatctagaatagtcaaatatacagacagaaagtagaatggtagttgattgggctgtagggagaggagaataggagttctttaacgggtgtaaagtttcagttttgcaaaatgaaaagtaatctgtggatgtatggtggtgatgaaagcacaacaatgtgaacacatttaacgccactaaactatacacttaaaaatggtgaaggtggtaaattttatgtttgtatattttaccacaattaaaaataaagagatatatttttaaaattaacggctacactaataacaaattagagatatggaatttcttttctttttttttttttttcttcagatggagtctcattcctgttgaccaggctgcagtgcaatggcgcgatctcagctcactgcaacctccacctcccgggttcaagcatggaatctcattttaatagcaaaatgcaatacagattctggagaaagcttcaaaaatataaacaatatgaccaggcgccgtggctcattcctgtaatcctagtactttgggaggtcaagacaggtggatcgcttaagcccaggaattcgagaccagcctaggcaacatggtgaaacccagtctctacaaaaaatacaaaaaaaaattagccaggtgttggtggtttgagcctgtagtcctgctactgagggggctgaggcaggaggatcacctgagccaaggaggtcgaggctgcgcagtggtgagctatgattgtgccactgtactccagcctgggtgaaaagcaagaccctgtctcaaaaaaaaaaaaaaaaaatatatatatatatatatatatatatatatatatcataataaatctctctctctctctctctatatatatatatatatagattttgaacagtataaaagtggctctgaggtaggttgtatgattgcccccaatgctgcactggcctcctagtgagaggattactcttctccaccctcattgccttgagctgggccatgcattttgctctgggcaatgatgtttagtgatgtatgccactgctgagcagaacatgtaaaagccatcacaaggttctgccattgctttctgccttgaggacggcagtgactcagatagcatttttcctacagcctgggtcttggaatgaaggagacactcagagcaaaactgcagccagccagactgctgccgacttgtcatgtgagcaagaaatagacccttggtattttctgcaccactaagaaactggggtcatttgttaccacagcatagtctggcaaaagctgactgatggaggactcgaataagtgagagaaaataccaattttggagaagtctcaaatatatgaagatatcaatgttcctcacctgaatcctcaaatttgatgcaattgctatcaaaacctcaaaaccagttatggaagatgacaatgtgattacagagttcatttggaattgtaaatgtgaatagctgagagcatttttaaattgaagaataatgtggcaggtcctgctgttcaaatactaaagcctagtttataatgctacaataatctaaatagcataatattaaagagagaaatataaaataaattaaggaaacagaacaaagtccagaaacacatctatgaatgtgtgggaattttatatatgataaaataatattttattgtggtaaaatagacataacataaaatttacccttttaaccatttttatgcctacaattcagtggcattaactaccttcacaatgttgtataaccatcaccactatctatttccagaacttttcatcaccccaaacagaagctatacccattaaacaagaagttcccattcctcccttcttccagataacctctgttccactttctgtctctatgaattttccttaaaatagcatttaaataattaactgcttaacacgtagtgatgaagcaactgcatattcacacggggaaaatcaagttagattcctttctcatacataaacaaaagttaattcaaattgcagttaatttttatgttagtaaaaccaaaaaatattttcataatcttgtaatagaagcctccaaaataaaaatgagaaacctagcagccgtattgataaatatgacaatttaaaagctgcagtgctgggtttggtggctcacgtctgtaatcccagcactttgggaggccaaggtgggtggattacctgaggtcaggagtttgagaccagcctggccagcatggtgaaacccgtctttactaaaaatacaaaacttagctgggcatggtggtgggcacctataatcccagctacttgggagactgaggcaggagaattgcttgaacccgggaggcagaggttgttgcagtgagctgagatcatgccattgcactccagccttggtgacaagagcaaaactccatctcaaaaaaaaaaaaaaaaaaaaaaagctgcagtaccacaaatgtcattataaacaaagaagtaacaatcaaggagaaaaattctataatatagttaacagatacgggatcaacacccaatatagatcaagattccttacagatacacaagaaaatgagaacttaattatgagaaattgggaaaggatatgagtagagaatttgcagaaaatgtttaagtaaatatatgaaaagagggcataccttactaaaaatctggaaaatacaaactaaaatagcaagatactcctaattcaacacactacccaaaactgatcactggagagtatgatgatgcagtattctcatacattttgacgggacagtattattagaatcactttttttagaatgacaattaaacagcaattaagtttgaaatgcactggtcaatctattcaatcactttacctcaagaagtctaacacagattatcacagaattatttgttcttgggacccaaaataaggaggaatgtctaagtgtatgaagttgtaaacaacctaaagaaatacccttcgataagaaaatagttaaatacaacctgggaaacatagtgagaccttgtctctacaataaataagtaaataaataattaataaaaataaaaataattagctgggcacagtggtatgtgcctctagagtcctagctactcaggaggctgaggtgggaagattgcttgagcccaagattttgaggctgcagtgagcaataatcatactactgcactccagcctgggtgacagagcaagaccctgtctctaaaacaaaataagaacaacaacaaaaaatattaaatttaaaaaaatagttaaattatggtatctccatattttgaaatataatacagttgttaaaaaaagaatgtggcagatctatttgaactaatatggagaaattatgctatatagtcacaaaataacaaaataagtccttgaaaaaatgtacacatatatatgtttctgtaaaaaaaatctgggtgtatatttgtgtttgtatgtttttataactcagaaaattatctaaaaggataaagaataaactgataagaagaataggggtagaaaagaatggtaaggaaaatttttagtatatacttctgtacagttttaattatataagtagtgtctactctttttataattttcaaaataaaagaagtaaaatatagacagacaggaaagagaccttacctgttctgggctcatgtatcgcaaagttcccttactccttgttcgctttccatcatttttcagagatgttacaagtccaaagtctccaatctttacttgttttgtatctactaagaatatattacttggctatgaaaaaaaaaaatttaacttacatgtaccaacttaacatactattaccacatgtcttaattatatacagaaaagactatttttatattatttataagacctttacccttacacaggtagccaaaatcagggaatttaatatgactcgtctttaaaatgccagctgaaagaagtcaggatttctttttttttttttttcttttgggccggagtctcgctctgtcacccaagctggagtgcagtggtgctatctcggttcactgcaagctccgcctcctgggttcatgccattctcctgcctcagcctcccgagtagctgggactacaggcacccgccaccatgcccggctagtttttttttttttttttttttttttttttagtagagacagggtttcaccgtgttagccaggatggtctcgatctcctgacctcatgatccacccaccttggcctcccaaagtgctgggattacaggcatgagccaccacgcctggacagaagtaaggatttcttagctgacaccagaggtggctctgggcacagctgccctcgaatatctgaaaagctgtcacgtgcaaggtggattcactctgcatggtccaagggaaaagatccaggactatagggtggaaatgacctaaagattagctttaaaatatcctaatatcctaatagtgttgtccaaagaatgggagttagacagttccccatcccaagatagggctgaacaaccacttgaggaaatgttgcaaatatgagtccatgatctgatagggactgaagcagacatccttaagatcccttccaactttgagattctcggaatgggtccattcccaacaatagtgcagattagcctgtgcagaatttctcttgggggtcttttctccaagcctctgacaacttcttaacaaacacatcccttccaccatgaaagcataccaagttaactggaagctaataactagctctgaaatatttttatccatgcaattctttaagcagattttttttttttaagggaggtgttttgttttgttttgttttgtaagatggagcctcgctctgtcacccaggatggagtgtagtggcatgatctcggctcaccacaacctctgcttcctgggttcaagcaattctcctgcctcagcctcccgaggagctgggattacaggcatgtgccacaacgcttggctaatttttttgtatttttagtagagacagattttcaccatgttggccagattggtctcaaactcctgacctcaagcaatctgctcacctcagcctcccaaagtgctgaggttacaggcatgagccaccacgcccagcccataggaggtattgaccaatattatttttgtttgtttttgagacagtgtctcattttgttatccaggatggatttcagtggcatgatcatggctcactgcagccttgacttcctcagctcaagcgatcctcccacctcagcctcccaagtagctgggaccacaggccaccacacccagctctactgaccaatattctaaagaccacaaaaacaggaaggtagttgatgagaaaattaatattttgctatttttgaaaaggctggacttttaatacaatcttaggctaaacacacagactctacgggataacacacttatgagagggcctacctagtaaggacctaagagggaagagaccataagcccagggaaggctgaaggaggagcttccgagaagccagcttgagatgacggctcatacagcaattagcagttggattagaattcaattaacagtcagattggagcctaacaccagtaatacagatggaaagctgtagacagatgtggagtggatgtggagagaaaacattcctatgctatgttcaagttgcaatgtgtaggaatatgtcaggattgcaagtgaaactgctagtcccacataaggctatcacctgactctaagaaacagaaaattgaatttgtgaagccgtgtaaatatctaagctggatgaggctatctagtgaaaatatcagatcactttttgtagttcattcaaaagaaaaagtgggcagggcgtggtgagtcacacctgtaatcccagcactttgggaggctgaagcgggcagacagcgtgggcccatcagtccaaggccaaccttgccaacatggtgaaaccctgtctctactaaaaatacaaaaaattatctgggcatcatggcaggcgcctgtaatcccagatactcgagaggctgacgcaggagaatctcgtgaacccaggagtcagaggctgcagtgagccgagatcactccactgcactccagcctgggcaacagaggagactctgtctcaaaaaaaaaaaaaaaagaaaaaagaaaaaaagaaaagaaaaagaagctgggtatggtggctcatgcctgtaatcccaacactttgggaagccaaggtcggcagatcacttgagctcaggagttcgagaccaaccagggcaacatggcaaaatcctgtctccacaaaatgtcaaaaattagcctgccttggtagcctgcacctgtagtcccagctatgtggggggccgaggtgggaggattgcttgagcctaggaggtccaggctgcagtgagctgagatcatacaactgcactccagcctgggcaacagagtgagaccttgtaaaacacaaaagaaataaaaacaataatgccacattttgtctaatcagttataatatgattagacaaaatatagggctgtagatcatataaaagggatgcaaacttcacctaggaggcacaggaacaggactgatgctcaggctgaggatgaccagagcctgggctttaggagactgaacattttagagagaagcagccttgcacaagaagccctcactccagaaacccctatgtcccttcccagcgcctttggtctagttcctaagattccaacagaaagtggtaaacacttggagacttttgtaagaggggctgtgttaggtaaagaccattctctggcaaaaccacctacagctgctattttgcaaaacacaaccccaaaattgtacaccttcattgtatcttttcttagaggagagaaatcaacaactgtagtagtgagagcctgaaaagttatagaagatgaaagaagtctcagtatcaaagcttgaggccgggtgcagtggagcacacctggaatgccagcactttgggaggctgaggcaggaggatcactttgagtctaaaagtttgagaccagcctcggaaacatggtgagaccctgtctctacaaaaaaaaaacacacaaaaatggccaggtgtggtggtgtacacctgtggtcccagctatacgggaggctgaggtgggaggactgcttgagcccaggaggtcaaggctgtaatgagccgtgattgtgccactgcactccagcctgggcaaaagagcaagaccttgtctcaaaaaaaaataaaaattaaaaatttaagaagaataataaagtctgacccttgagcaactgcagccagagtaaaaattctctgcaaatagacacaagaaaagatcagtccatgacacagggcacacacggtgtggggcatagttggcaggtaagtgggtaggcaccagtcagaattttgctaattcattctgaggactaggagcttaatgcctacacttctgcatttatttgcaaattattttatatagaaataattgtgcttatttgttatttaactatatgtatgatttatcccaaagtgaaagcataaccaactctacatttatccttttgaaatagttctgacaatgttccaccttcaaagaacaacttcagatattgtagaagagacatattggaaccagacagactcaaaacaccaatgcatcagacatccagcccctgggcagaccacggaagcaataccttttaagggctactcattcctctctgagcccaataaacaactgtgtatatgggaacttatttctctcaaggaatttttttgtttcattccttattccttgctgttttagaggggtgggataagcagatagccacataaataaggtacttctgcctagaacagaaaaaggcagttccagagtgatcaggaaaggctcagtaaaggaattacaaccaaagggggcaggcagaagagtgtcccatgagagagaagaacatgagcaaaggtccagggacaggattcaggacggccagcttgtgacaggcttaggcaagtcacagggaatagggaatggaggaaaggctgtgaagggctattctgtctctcaccttctgtcattttaatgagaagtaaaaaatagggaaactccttgtccggaccataaaagccagaggaaaatgaaaatactaagggatgatacactttcccagtccgggattaccgcaattttccaatcatggggttgaaatgcttaaccaagacagtattagactctggacccagtagctgtgacagccctcgcgagtaatgactgagagattagggaaccatattcctaaagcaacagtcaacagagtcccctctgcctctcaaataaagctgagtcacttagaggaggcaggaggaacaggggcagagcagccagttggctgtgccagtcacagtaattatttgcatggaaatgttcagataccattttctcataactatcaatcaaccactattctaaaactagagaaaaaaatatatatctatctatcttattttatatatatatataatttttttttttgagacaagtctcactcttcacctaggctggagtgcagtggcacaatcttggctcactgcaacctccacctcccaggttcaagcgaatctcctgcctcagcctcccgagtagctgggattacaggcgcacgccaccatgcccagctaatttttgtatttttagtagagacacggtttcaccatgttggccagactggtttcgaactcatgacctcagatgatctgcctgcctcagcctcccaaagtgttgagattataggcgtgagccactgtgcccagctgagaagatatattttaaaattactatattatatatatatcaattaataaagtacattttccacttaccttaagatctctatgaattaatttttttgaatgtatataatccaccccttttgttatttgttcaaagagttccaaagccaaaactttgtctagtttctcgcctcttcttttttcaatccattgttccaaggtccctttatcacagaattccatttggatgaaaaggcacttagtctttgacctgggtataaaattcacagtatgttaaaagtaacaataaatataaatttataaaaaattttttataactttttaaagtttttcataactttttaaaagcttataccttatcttcttaagaaccccaaaaacactttgggaggccgaggcgggcggatcacgaggtcaggagatcgagaccacggtgaaaccccgtctctactaaaaatacaaaaaattagccaggcgtggtggcgggcgcctgtagtcccagctactccggggaggctgaggcaagagaatggcgtgaacccggtaggcggagcttgcagtgagccgagatcacgccactgcactccagcctgggtgacagagcgagattccgtctcacaaaaaaaaaaaaaaaaagaaaaaaaaagaaccccaaaacatgtcacaaaatagaaatctaaatataataaacaaatttgaatcaaaatataataggccattttttatttcaatcataagttcccggatgtccagagctttatttgtttagctaatttataaaatatgagctgggctgggcacggtggctcacgcctataatcctagcaccttgggaggccgagactggcggattgcttgagctcaggagtttgagaccagcctgggcagcatggcgaaaccccatctctactaaaaacacaaaaattagctgggtgtggtggcgcggcacctgtagtctcagctactcgggaggatgaggcacgagaatcatttgaacccagaaggcagagattgcagtaagctgagatcacgccattgtgctcccgcatgagcgatagagtaagactctgtctcaaaaaaaaaaaaagaagaggccgggcgcggtggctcacgcatgtaatcccagcactttgggaggccgaggcgggtggatcacgaggtcaggagatcaagaccatcctggctaacacggtgaaatcccgtctctactaaaaatacaaaaaattagccgggcgtggtggcgggcgcctgtagtcccagctactcaggagactgaggcaggagaatactgtgaatccgggaggcagagcttgcagtgagccaagattgcaccactgcactccagcctgtgcgacagtgcgagacaccgtctcaaaaaaaaaaaaaaaaaaaaaaacgagaagaaaaaaaaaatgagccacccattcttcattgctgaagatctgcaatcaccattgctaacagatagaaataggaacatgaatacaatgcaggaaactaaatttcattattatataaagtaactttgaaaccttttaattcaccattgatctactaagcatgaaaggcacctagagatgagaaaatcagttagacactatatccttgccgtcacggggataatagtctaataggagagagtaaagggaaagcaaacctaaaacaatagggaaggtactctaagagaagtgccaacaaattactaagatacataaattggaggcttgattttttttttttttttttttgctaaccacgttttattttttttctgaattaagttagcctcaatattcatttatattctttgtatatatgtcagcttgaaaacaggaagaggtagccaagaatttgctgaaagctgaagtcctgtatgctgacggtcaataactcctgaactgatgataatgttctcacttacacgacatggagatggaggtggggcaggagaaaatgaatgaatgggaccccattggcctcaggattttagtgagaggactgtccccataataggttgggtgactttcaaagacagatgccagctctttaggatctccagttgtttggcaatggcttaactgacataaaacatgagggtgcccccatctcagcttgtggtcttaaaaatattttcactccccaccaccccagcataagtggtatagttacattccaaagagaccctctgacggcaccacaccaatcacagcctaagagagggacagaaaagtgttggtagctgaggagggagcccccagatgcagcatctatatgttaaaactctcttcacaagactacacttaaacagcctgcgctgaagccggcacgtgaacaaggctctccatgaaacaatggagtcaggaaagctgaacctgagattttgcagacagctgaggatgtaacagagggttgtgagagcaagtctgcagcaagaggaggagcaaggaagagattttcactttctccttaccttcggaatggagagataacagtgtctctcagagggaattgtgataattaatcgtgatgattaatagccttatccagtggcccatacatagtaaataacaatttccttccatcctattatggctatgagaatttatttttagttaccttgaactatttttgctgttctcaggatcataatcactgctctcaagagaatcatcactggtctcaggatcataatcaaatccatcccaacagccattgtagtgaacaatatttacatgatcaagttttgccaatgcttttacttcacgctccgccttcctagttaaaaggaacagggaacatggcagtgtcagtgtacatccctcataacaaccacaaaacacctcatgtaatagacaactgtctacattcccttattaaaccattgctgtggttctcacatagttttagaatggaagccaggacattcaaaaggaaaaagtgaacatactgaaaaaaaacatagcagttctcactctcaagataaaataaaaggcagtggccgggcgcggtggctcaggcctgtaatcccagcactttgggaggcgaaggtgggcggatcacgaggtcaggagttcaagaccagcctgaccaacatggtgaaaccccatctctactaaaaatacaaaaaatttagctgggcacagtggcgcatgtctgtaatcccagctacttgggaggctgaggcaggagaatcgcttgaatccaggaggcggaggttgcagtgagccaagattgcaccactgcactccagcctgggcaaaagagcaagactctgtctcaaaaaataaataaataaaaggcagcgacttaatgccaagcatcagacaatttaaaaatcatctgtagtactcttgaaatgccagtgatgtcattttaattaatttatttattttattgagacagagtcttgctctgtcacccaggttggagtgcagtggcacaatcttggctcattgcagcctcaaccttctagcctcaaacaattctcccacctcagtctcctgagtagctgggaccacaggagcacaccaccacacccatctaattttttctattttctgtagagatggggttttgccacgctgcccatgctggtctcaaactcctgggatctagcaatccacctgcctcagcctcccaaagtgctgggattgcaagcatgagccaatggacccagccagtgcaatttttcatagctaaatcatacattatgttttgcttagatttgtgttaaaatctttgtatttcacaagcaaaccacatttaggcagcaaggctaggtaacccaggcagtgtgaagtacctaattcaggattttcaatgtgtggcaaatatacacaaagaggataacttatgcagagaaggtgaaatggtggaaggctttacagggatgtgttgccaagacctaagaaaattccatgctaagtgcagtaaataaattggagatttcaaagatgaggaagaataatcattttacaattttattttttaatgcaagaagttttaaagtatatgacacaaatttgcaaaaataaaaaaaattactgatactttgacaatcctaaaataatgttattttagattcttccttttttttttgagacagggtctcactctgtcacccaggctggagtgcagtggcaatgttggctcactgcaacctccacccctagggctcaagcgatcctcctacctcagcctccctagtagctaggaccacaggcacacaccaccacacttggctagtttttatattttttgtagagacagggtttctccatgttgcccaggttggtctcgcactcctgacctcaagtgatccaccagccttggcctctcaaagtggtaggattacaggcctgagccactgcacccagccagtcattttttttgagaagagtcttgctttgtcgcccaggctggagtgcaatggcgcgatcttggctcactgcaacctccgcctcctgggttcaagcgattctcctgcctcagcctcccaagtagctgggactacaggcgtacgctgccatgcccagctaatttttgtatttttagtagagacagagtttcaccatgttggccagatggcctcagtctcttgacctcgtgatctgcctgtcttggcctcccaaagtgctgggattacaggcgtgagccaccatgcctggcccagccagtcatttttaatggctgcaaaacagccatcgatcaggggacagaacaaaatatatatactcatttctttactgctggatattttgtttgttctaactttttactgttaatgaatgacactgtgatttatatcttcttggatataaatccataatttgaataacattctttttttttttttggagatagggtctcactctgtcacccaggctgtagtgcagtggtgtgaccatggctcactgcagcctccacctactgggctcaaatggtcctcccacctcagcttctgaagtagctgagactacaggcgtggctaccacaccggcctaattactgtattttttgtagaggtggagttttgccatgttgccccaggctagtctcaaactcctgggctcaagtgatccactcacctcagcctccctaaatagtattctttttattatttttatttttatttttttttgagagggagtttcgcttttgttgcccaggctggagtgcaatggcatgatctgggctcaccacaagctccgcctcccgggttcaagcaattcttctgactcagcctctcgagaagctgagattacaggcatgcgccatcacacccagctaattttgtattttcagtagagaggggtttctccatgttggtgaggctggtctcgaactcctgacctcaggtgatccgcctgccacggcctcccaaagtgctgggattacaggcgtgagccaccacacccagtccctaaataatattcttagaactcatcccctagaatgacaaattacggggtagggcctatttggcctccccttgaatctaagctggcttcagtgacttgtttaaccaatataacttgatggtagtgacgttctggaactcctcagattaggtcaaaagaagccttgccactcactcctgatcttttggatgacttgttctggggacaatccttcttgaaacccagccaccaagttgtaagaagcccaatccccatagggaggccatgtggaggtattctgattgacagtcccagctgaacttccagcccacagccggtgtcaactgctagccagcttggatatccagcctaagataggctgtagtcaaggtttcagatgactactgactgcaaatccctctgagaccccaagtgagaattgtccagatgagcacaatcaacccatggaaccattagagacaacaataaattgctgtttttaagcactgcattttggagcagtgccttatacaataacagacaaccagagaacaattaccatctagcttttatcttagacaaaatcacttcacatctctggatcttagtttcctcatctataaaataagaaggtaagactagaacatctcaaagatcacctattttgtgggtaatgataggttctatctggtgccacggtttttaaaatacggagcatttcatgaatttgcatgtcactttaaagcaaatgactctatagcttcagttctgaagatagcaccaaaaggatgatcaatggtatatccatttttattgaaataaccacagtaaagtgagatcatctcggagtaagccaaactcctcttggtagaatgaaatgtttaatgaggatcagaaagaaataaatgataccctaataaagaagagagaagcataaaaaagaatagtgcagattcagcgtaccttgccattcaaaaaaatgtaaacatttactacttactcgttattatatttaacacgtttaataacgtaagtctttccgtcaattctgtgttttgctttgaaaacttggccaaatccacctgagccaattaattctatttctttaaaatccatgccaaaccttaaagataaaaaccactgttattttgacatttcatgctcaacccccacccccccgcctccccactcctttccctttaatgtcacttgtgaaatggacaataaaacaaatttgattctctccttctgaataagaaagatccacttggcagaaactcttgactcacaaagagtagtcctctcactcctcccagggcaagtctaacgtaacatatcaccccaggcagtcacagtcaactcctggcttttcaaaagtcatgataagtccaggtgccatggctcatgcccgtaataccagcacttcaggaggccaaggcaggtggatcacctgaagtcaggagttcaagaccagcctggccaacatggtgaaaccccgtctctactaaaaatacaaaaattagccaggtgtggtggcgagtgcctgtaatcccagctacttggaaggctgaggcaggagaattgcttgaatctgggaggcagaggttgcagtgagccaagatcacaccactgcactccagcctgggcgacaagaatgaaactccatctcaaaaaaacagaaaaaaaaaaaaaaaaaaaaaaaaaaaaaaaaagccatgataaaaatcctatcacaaatacaaaatgttcaaaggaactgctatattgtgctccacagctactatcatcaagcttttataagagaaatgggcatacgctctaagcctgcctaggtttctacttggttttctcttctccctcaagcttcgtgttccatcattaagacctgtcaattctacctccaaaacacattgctggtatccacccgctttcctctgcctccaacatcttcaccccagtccatgcttccattaggccatagcagtacctcgttaactggatccccacttcctctcttcccccactccaatctatgatccatgcagcaaccagagggatgaaaactgagtctggccatgtctctctgttgctgaaaccctccaacagccaacctttgcattccacaaaaacaaaaagcccttaaatggcctataaggtgccaaatgaggaggcccctgcctccctcagcatcctcatctcatggcactgtgcccctcctcattgcactcaaagcacacactcttctgtctgttctcgaactttcacatcaccttttccatctttaccttctcatacgcccttccttccacctagcacccactgctctgtgcccactcatccatcaggcctccccacaactgtgaccccagagaaacctcgcctcacccctgcttccatttctctccatgccattgctttcctttcacagctctgaccatagtttgttcctgcaatttttttttttttttttttgagacagagtctcgttctgtcacccaggctggaatacagtggtgcgatctccgctcactgcaacctccaccctccaggttcaagcgattctcctgcctcagcctccaaagtagctgagactacaggtgcatgccacgacacctgctaatttttgtatttttagtacagatggggtttcaccatgttggccaggctggtctcgaactcctgacctcaagtgatccatccgcctcagcctcccaaagtgctgggataacaggcatgagccactgtgcttggcctgttcatgtaattatttatttaaagtcggtcatccccatgaaactccatgacaacagggaccattttatttgttcctaccataaacctgatgcccagcacagtgccaattctatattgggtgcttaataaacttttgattccgtattgttttttaaagttttatattgaatgacccgccccactgatgcaaacaggtctccatcgtttcagacatttcattttaaatccaaacatattgtctacagcagagtagactttttttcaagtgaaatctgatatggagctagaaagtagaaaacagatacaagtggatcaattctaattcccacagaagtattttttttaatcactgatttacaggagtacttgttttcaatattaataacttgtatagatgtcagagaaatccacataagcatcacaaagatctacaattaccacattccatttggatctgtctagatattacttctccaagagacatgatcaatcgtgcgccggatagtgcaatgtcaattaaactgttcgggtggaagtataatttagccttataatgggccctcaagaaacttctgttgaatgaacaacacatctttaaacaaattctatttcacagttccatctttgacagaacaggagcattaccatcttggacaagcaccactactttaagttccccttgattataataactccataataaagcccctatacaaaatccagtggccaatgatgcagtcccccatagaggcccagatgggacttgccaacagggagacaatggcatcaggtgaagagaccacatgattacctgtctcctcacgggcatggacaaaaatgcccataaggcagttaattatgaaaagctcagagaaattacacaagagcaccagtaaaaccctgcccttttcttatcacacctcactgaagctatgctaaaatataccaatttggacccagaatctagagaaggtcaaacttttctctacctccaatttatttcccaatccaccccagatattcggaaaaaattacaaaaattagaggagggcccccagacatcttggtgggagctcctaaatgcgaccttccatgtctttaacaacagagatgaggaacaaaaaattcaagaggacaaacatctccatttaaaataccagatgcttgcctctgctgtccaaaagtcagttatacgaaagcctcctaataacccaaagggaaactcccccacctctccaggagtctgttttcaataaggcaaccctggacactgggaaaaggcttgtcctatcccctggcctcccaccaaaccatgcccaacttgcagtctttggggacactggacgatggaatgccctcaacagggacaccttccccattcgggtaccactcataatgaagccccccaaacattacaggaggaaatctcttcactgttggtgctgacaacggaagactgagggtacccggcatccttcgcccccacatctagtgagtccacaaaacccaggttaattgggacggtatctggtaagattatttcctttcttttggatactggggcaagtctactggcattaactgaataccaaggcccattagaatgttcatttgtttctgttgatggaatgaagggcatacaagaaaccccatacaaaacactgcctctatattgctcatttcagggagtcaccctcactcactctttcttggtcattcctcattcccccactcctttactaggaagggacatcctacacaaacggggacgaatcattcatttatcaaccctacaccaaagctacccctatttattatcatctcaagaacagaacccttcctcagacattccatatcaaacagacttaaatcccaaattcctcagccctgtaaatcccatagtatggaacactgactcccccatgttagctacccaccattctccaattcaaatttcaatgaaggatcctaaatgtcaaatagtggtcccacaatatcccctaatggactatggggactcaagtccatcatctcccaacttttggctgccaatattttattttattttatttttttgagatggagtcttgctcttgtcacccaggctggagctcaatggcgcaatcttggctcactgcaactcctgcctcccagattcaagtaattctcctgcctcagcctcttgagtagctgggactataggtgtgtgccaccatgcccaactaatttttgtatttttagtagagatggggtttccccatgttggcctagactggtcttgaactcctgacctcaggtgatccacccgccttggcctcccaaagtgctcggattacaggcgtgaggcaccgacctggcctggctgccaatattttaatccccacccattctccccacaatactcctattctcccaattacaaaaccagatggctcctatagactggttcaggatttgcaacaaataactccactactgttctgtttgtcctgttgtcccaaacccctatatcctcatattgcaaattcttcccaatactagctatttctctgcattagacctcaaagatgccttttatattatccctctatcttcctcctctcaaaacctttttgcttttacttggactgacgctgacacaggctactcccaacaactcacctggactgtcttcccccaggggtttagggacagccctcactatttcggtcaggcactttgattggacctttcccaactacctctacaacccagtgttttgcttcaatatgtggacaatttacttctttgcagcccctctctagaacactgtattcaacacacagccaggcttttaaattttttggctgaatgtgggtaccagatatccaaaaggaagacccaatttaacctctccaaacgtttcatagctaggattaatcataactccaaataccagggaaattccactagcatgaaagcaaggcatttaacaagtcccatttcctaagacaaaaagggacttattttctttcctcaaattagtgggatatttctgattatagatagcaaattttgccactatcactaaacctctttatgaacacacaagaggaaatcttgatcaaccactcactcctaccccagacctttatcatgctttctgtcacctaaaatgtgccttattacaggcccccactttaggccttccaaaccccctaagaccttttcatctatatttacacagttctcataatcaggcccttggactattagcccaatccatgggagattccctccaaccagtggcatattcttcaaaacaactagaccccatttacaaaacctggcccctttgcttaaaaattttgtccacagcctctttaattatccctgaggcacaaactcacattctatgaacctcttcaggtgttttcttctcacagtctataagatatgctcagccataaggcgctcacctccatctcatcctctcacatgcaagccctacattcaaccctccatctctcttcacagatgctcactcctaatcctgctactcttttatcttcaacactgattttggaccctgaccaacactcatgctctgatctaattgaaagttctcttgccgtgttttaccaccttacttccactcacataaagggagccccagattgatttatagatggcagcgcatcaaaaaaccctccccgccaagcaggatatgcagtcactgagagatattgtgatgatacccactgtcttccacctagaagagttgtagaggctgcccccttgcctttgggcacatcctcccaacaagcagaattagttgccctaatgaaagcattaaccctagcaaaaaacacacaagttaatatataccaccaattctaaatatgtttataacatcaaccattccaatgcccaaatttggagcaagtggggctatctcacagctaagggaactcctatcattaatggaaaactaatccattgtctactaaaggcagctctacttccaaaaaaggctgcagttacccattgcaaaggacttcaatcagataaaagccacatttctttagggaaccgtgaggctgactattgggcaaaacacacctcaaccaaccatccaattctctagtatctatttcccctcacacaacatatccccttttatcccaaacaccaaatacaacaactactcacagcgggggcacaattcaaactcccatactgtcatacaaaacaaattagtcctacctgaccctgaaaaaacaactcttggccaggtgcggtagtcacgcctgtaatcccaacactttgggaggctgaggcgggcggatcacgaggtcaggagtttgagaccagcctgatcaacatggtgaaaccctgtctctactaaaaatacaaaattagccagccatggtggtgcgtgcctgtaatcccagctactcaggaggctgaggcaggagaatcgcttgaaccccagaggcagagattgcagtgagctgagatcgtgccactgcactccagcctgggtgacagagcaagaatctgtctcaaaaaacaaacaaacaaaaaacaactctgttatgggacatccacaacctcttgcacactagccattcccctctacaacatttcttaagttcccacatacacataaccccagatataaaggaacagttgaaagccattttccatcaatgctctatttgccagaaagcttcaccccattccaacactggactcccttcttttccaacccatcaagccaggggacaccttccaagacaagactgggaaattgattttacccatatgcccccagtaaaaaaggttcgatttcttttggttctggttgataccttttcggcatgggttgaggcttttccgaaaaccaacaaatgagcttcgactgtcacctccaaattaataacagaaatcatccccaggttcagggtgcctccttcttttcaatctgataatggtcctgaattcatttctcaaattactcaaacacttgcacaagccctacgaatcacctggaagctacacatcccctatcaaccccagtcttcaggaaaggttgaaaaaatgaatggcattctaaaaatcacccgcaccaggtactcactccaaacacataaagactgggttacacttctagctttggccctcctaaaaattcgggcactctcacgtaaacctttaatgctcatcccctttgaactcatgtatgggagttttgagcataagtatttgaactcatgctccttttgttccacctcagggtcaagccccacctctaacaacccctctcatttctcctcttctgcatatcatctgccatttcatttgggaatatgctgacaaaatacaactcctttaatcccttcctacagtcaggaaactgggttctggtaaaaggtcccagccctacccccaattcccccctcacaccaaaatggaaggggccttaccagatcttcctcactacacccacagcagcaaagctccagggactccccagctggtttcattatacttctctcaagaacacagacttcccttcactacacatccaaacaatcaaatctaaaccaccttcagcctctcttgtgtctccacaggatccacttcccttcatctcacatgaatgccggaggaaaaggaagagaaattcacctaagcagctatgtctctttctctcccaaactttcattgcttcctaactagccttgttacagaccttcagtggtatccttatgaaactctcattatacatcctgatcagctccttactattccacgggatttatggcttcaaggaaccttccaggactttattcctacccaaactttttcctccttttgttgtttctttctatctaaattccctaatcacatcaacctcaccgatacaaccactcctcactgctatcaaactagaacgttctataaaccttacacaacccctcttgctgcaagctaactcttcctttgctccagaatgctggatgtgtttatcgctgtcttcttcagcttatacatcccttcctacaccccttcatgaccttttaacagaaaacgtaaccctaatctataaactccaaaaaggagcttccttttttgaaagagctgacagtctggttggcgattatcccacttccaaggtcaatcaggccaacacattatttcaaacctattacaactccctacaacgccttaagccacaaggccctcccattgaagggcccataattaaacacaccccacttttacaacaagcctcactttgcttttcagcctctgagggaaatttccgtgtaagatccttaaacctaaccaatgcaaccgcattatcattgttaaacaccctgctgaccatcaaactaaccgagttgactaccaagtatcacctgaaacgaatggagcatttctgcaacctgttcgttttgcagcctctccctcaaccaatgcctctggcctaatttgtgctgcccctagcgcccacctttatccatggctcaacatcaatgcaatggtgcaacatcaaatcgtattaaatgtgtaaaaaataactcttcctatatcgctactatagtgggtgtctccttgacctcctccttgaccacctggagtaatgaaccataggaaagaaaaaacacccatctttaattcacttgttttctttctgtatctccaactgtatttatgacaaaggcttattttttgtgtgagtggcaccaacacatatctttgtctccccactaactggactggaacctgtaccctagtttatctttctccctccattggactaattcctcctagccaacctttgcccattccatccatccaatacgttaggaagaggagggccatccacgtcattcctttaatggctgccttggatataacctccagacttggattgggagcaggcagattggccactcccttaacatactttaaagctctttccacagaattacagggttctttagaagatatagcctgaagcattataagagtccaagacaaactagactcctcggctggagtagtcctccaaaacagatggggactagatctaataatggctgaaaaaagggacctctgcctctcattgggtgaggaatgttgcttttatctcaaccaattgggcctagtaagaaacgctgatgaaaaacttaaagaaagggctaaaaagctaagggagtatcaaaacaaccaactagattcttggtttgggaacaaaatcataatatgggtcatcccattcctgggccccctcttaatgataagcctaagactattgttcttaccctgcgtagttaatcttattcaaatatttttaactgacaggatcatggccatttcacagacaactaccaaaaacatccaccgacagcattaccccttcttctttcttcagcacttaaaatcttacctcttgtccacagtatactttgtttctttcatgtcaggaaggtcaaatctgggtgccaaagatctaaaaattaagagttgaatgtaaaactcaaataaaattgaaatcaaatataacttatttagtgttaatgttaacctttttctttctttttttttcttcagaggcaaggtctcaccccatctcccagcctggagtgcagtggtgtgatcatagctcactacaactttgaaattctgggctcagaggagatcctcccacctcagcctcccaggtagctgggattacaggcatgtgccaccatacctggctaattctttttatttttagtagagacagggtctcttcatgttacccagtctggtctcgaactcctggacccaagccatcctcccaccttggcctcccaaagtgctggggatcacaggcgcaagccacagcacccagccaacttttttctttataaaactatatacttaccgttctcctctggcctctaatactttttcatccctcctctggttcctttttccaccttagagtgctcattgttgatgcgtcactaacctctccttttcctcctccagactcaaaacctcaggaagtacatctccttacaccctcatcctagctgttattccttactgatgataagccacctgcaaatggaagtttaaataccacctaaaactaaacatatccaaactgctgtcttctctctaagcccttaactccttaacttccttaacaccattagtgccatggttcttgactgcatcctgttcaaagtgaagcaatcttcaaatcctttctcctttacctctccttcatgctttcactcagctacggggaacctattccctcaagtcatgtccactcttcctttacagtctttctcacacattctcctcatccctcctgactgccacagtaatcgtggctgagggcacctcatgtgcagaactctcttctctccatccaagcatccacatcaagaaccatgtttcttcaatacatctatctactgctcagaatatactggtggctcataatggctcctactgccatcttactgtcatttctgactatatttacatctttgcctttctcttcagttaattgacatagcatttgacctttttttaatccaagtttttatgctattttaaccttacttgtctgcaaaataatacacttctcttgaaaacacttctacagtgaaaacagcccaattccttgccagtcttgtacaaaataatgcccttaacctaattactctagcgatacccccaaagtgctttatgtttacagtgtagcatgtgcacatagtcaaagatttctcgacacatctaaaattatttgtttatagatttcaagctttctgcttctgaaactctgctcaaataagggtgtacaatactctacaagtattaagaacaataaataagtctgaaataaaacttcagatcaaaatatgttcaatgcataatgatactcacctttttgccttcctttgattatttctgagaccattctataacaaaagaaaatgagaaatagtttcagatgactaaatcagtcatcttcctttcccgttttccttcctcctgtatatctagatggctctctgaccaatttcttagtccatcaatgtctgtactctcatcaagccctgtatcaacacttagtattgtaagacttaactttttgccaatctaatgagtttaaaatagtatctaattgttttgatttaaattttcctgattcctagtaaagcagcttttaatatttgttgcccatttgggtatctcttctctgaatatctgtttatacattttgtacacttttctactgagctgcttgccattttcttattgatttgtagttctttataacagaatactcttgtaacactaatcaccaaaagcatggattttgctctaagttcaacattgcctgcttatgtgcacaaaaaaattgtctggtttttgtttgtttgtttgtttttgcgatgagggtctcactatgttgcctaggctggtctcaaactcctgggctaaagcgatcctcctaccttggcctctcaagtgctgcaggctacaggcatgtgccactgcaccagcctaaaaaattatctgatttcaagtttacttttaagtttaattctaatttttaaaaacagaaacgaactatattagtgaatctttaaatattatcccattggtaggagagaaaagcaaaatcataggaatatactaaaatataaggatgagtgaggaaagacagaagtgacgtgtggaagggtaaggaatggaacttaattttaaaaaaagtcaaaaagctgccgagccgggcgcggtggctcatgcctgtaatcccagcacttggggaggccgaggtgggcagaacacgaggtcaggagttcgagaccagcctgaacaacatggtgaaaccccgtctctactaaaagtacaaaaattagccaggtgtggtacacgcgcatgtaatcccagctactcaggaggctgaggcaggagaatcgcttgaaccaggaggtggaggtggtaattagccaagatctcaccactgcactccagcctgggcaacagagggagactccatctcaaaaaaaaaaaaaaaaaaagtctactgaggtattatcatttagtaagagtgcataagataaaaaatataaaaattatggtggaatactggaagttatttttaaatgaggaaacgcacagaaaaataagattaagtaggaagcttcgagactaatacgataccataagcaacgaagaactgtttaaactgtcactgttagaatttatctctgatgtatctgctgagaagtcaccttcagatgatgattcagaagcgctagaagaaaagggtgtaactattagtttattaattctgtttttatcacttatttctttccctaaattctccttaaacataaaaatctgtctttcagacagaaatatgaatatgttaagtatctcaattgtttgtctacacttacagtgtgctggtcactaaagagttgctttgggactcacacgtagtagcaaaagaaccagaggacaggtagtcagatttctgaaagaaaaagtatcccttagtaggcttaaatacaactaattatttctctacagaggctcagtttctatgtactatcacatttatttcaacacatttaccaaatccacaaccataaacaattacaagattaataacattttttggatgtttggtctggattttattttattttttattttacttttctggatcacagggcagatattttgtttgtttctttcttttcagacaggatctggctctgttgtctaggttgaagtgcagtggcacaatcttggctcactgcaacctccatctcccaggctcaggcaatcctcccgcctcagcctcctgagtagctaggactacaggtacatgccaccacacccgtctaatttttttttttttttgtagcgacatggttttgctgtgttgccccggccaggtggtctgaaactcctgagttcggccaggtgcagtggctcaagcctgtaaaccccagcactttaggaggctgaggtgggtggatcatgaggtcaggagttcaagaccagcctggccaacatagtgaaaccccatctctactaaaaataaaaaattagccgggcacggtagcaggcgcttgtagtcccagctactcagtaggctgaggcaggagaattgcttgaacatgggaggcggaggttgcagtgagccgagatcgtgccactgcactctagcctgggcaacagagcgagattccatctcaaaaaaaaaaaaaaaaaaactcctgaactcaggagatccacctgccttggcctcccaaagtgctgggattacaggtgtgagccaccacacccagcccagcctggagtttaaaaactaccctgagttgccaccagaaattttatccctctgaggcctcatggccccatggtgcatggctcatcggtacgacacagaatggaggaatcattttgctaaatcactggctgtcttggcataatgttaacacagtctaacctcaagtcaacttcagagggaattttaaaacataaaaatttaatccaaaggcaatacgtaccactgaggtttcttctgataatatctgaagatatgcaagtttagcggccaattgttttgcttcctgtttagtagaacctgtaccaatactatattctttctgtcccattttgcatttataatgaaatctaggagaaatcatagaaggtacttatccaaacatgaaaaatatagcaaatccaacttaggattcaaaaaaaataacatattaacagagatcttaagataacaccaatttattagatagatttatagttcatatcttgcataatttaaaccctcagtaacatgcctgaccaatttctctgaatacccaggatcagctgacatctgagcttgcattttccaggcaatttctaattttttgttgctttgctgaaagatctggcacaaaggcactaagtggtgattttttttttttaattccccaaaggtcaaaagatacggaggtagaaaagaaagaaagagatccagtgaattttttcagaggtgctcaaatgggaaggaaaaagccagcagagaaagtaggcttccacaggagaagctatgaggttatagtgtaggggaagagcaaagcatggattctgctctaacttcaccattgtctgccatctgctcatgtgcacaaaaatttgagaaaatccccacagtgcagattccctatactaaagtccacactctcctcctattagatgtaaggacatttgtggttaggcaaggatacttggacaattatataataactatttttaagggataaaacaatggacatggcaatttatatcacagggttactatctattactgaaaaatgattccagtatttgaactccttttgctttatgtttctgttggaagccatcgagagaaacacatccaaacagggtgagtcttccccgctagaccctgaattaaatagctgggttgagtgactggatcatttctatagctcctatttttttcagatactgcccccccccgcaaacagatttcttctttcttttaggtatctaatgttagcataatttaaagaaaccaaaaaagtgagctacagaaaataaaatcatctcttaattattgagattgactcacagattcacttttgactatttcattccaatgaatactataacatttttctcttcctggttttggctcaaaagccatgactgtaaatagctgagtcaattcatagaagtgtatcctaaagtgatgatttaaactatttgccatgtagatattttttttcttctttctctttaactggttggttgtagttgaaaaacaattgcctcatactcatttgatttctgcttttttcagttccaatccattctttatcctatttccacacatcttagctcactggtgatgttctcagtaactttgaaactctagttcatctgtctcatcagatccctcaaatcccggtctcctcatagtctagggctaaagctcattccttctgatacatggtatttgttcatttaatcaaatttgaaggacaaatacctggacaaagagctccctgatctgacaagggtgaagagtgattctatacatgtggcagagaggttttcagacagttaccaccatcatgtcctcaatgatgaaaagatttctgtattcttcgagcagtggcaccctgtactctcttgggtgttccacagactaaaccatccagctacttctctgaaataaaggattaccctaatttgatcaattatggtaaatgggttccatggcttcagcaattaagcattttaattacaaattataaatccaattacttatcaatcatgtaaaaccttgcatacagaatgcttaaaaggacacatatttctggaaaattagacacgaaaataaaccaactttattgcttaaatacaatgaaacagaaagaaaagccaaattatgtcttacccttctggcccatgcacccccgatgcacactgttcataatttacagttagtcttttcttctgggcaattctattgataaggcctatgtaattccccatggataatccttctgaagaattcgttgttgtcaataataaaggactaactgcctacaaagaaaaaaaattcctgtttaatataaatgacaacaaagatttaaccttttaaaaatcattcttctaataaaattactaaatgagcaatttgaaagacaacttggatgttatatattttcctattatattaccttgagcaaaagtgtgactacgtatctccctctaccagaaaaaaatcgacgaagatagattttaacaataggaaagaagtcactttttcttgtttgtccttggaaagtactataacactttctagcttgttataccctttctaatctcaaaaaacaaggcaagagatattacagtaaagctgtatactggatcataacttaatgaaaaagatgaatataatagcatcatttctactattattatctctacctttttttcttagtccgacaaaaatcttgtccaaagttttgatatttttttaatttttttcagacagggtgtcactttgtcacccaggctagagtgcagtggtgcaacctcagctcactgcagccttgacctcctgggttcaaaccatcttcctgtctcagcctcacaagcacctggaactacaggcacacaccaccatgcctgggtaatttttttgtattttttgtagagacagcgtttggccatattgcccaggctgttctcgaactcctaagctcaagttatctgcccgcctcagccttccaaaatgctaggattagaggtgtgagccaccacacccggctgagttttgctattttattaatcttgtcaaaaaactagcttttggttttattgatcttttttttttattttttatttcttttatagtaatttcaaccattgttattttctttcttctgctttttgggggtaaaacattctgttttttgttttttctaacttcttgactcaattttctacctcattaataattatactttgcacttttgcttgagttaaaaaaaaattggttagaagggtatctttaagtagatttttcaagaaagaaccttgaaacctaaattttcccaacattttccaaatctgagaatggccctctggtgtctaaaatgtaaatgacttcatgtttcattttataagcattgctacactatctcctggtttataatgttgctgtgcacagcatgaaattttaaaaatttttacattttacatagttttcctcttctctctagatgcttataaaattctttcctcatctctggagcacagtactttcataagaatcaatgttggggccgggcgcggtggctcacacctgtaatcccagcactttgggagaccaaagcgagtggatcacgaggtcaggagttaaacaccagcctggccaacatagtgaaaccctgtctctactaaaaatatcaaaaaattagctggccgtggtggtgggtgcctgtaatctcagctactcaggaggctgaggcagagaattgcttgaacatgggaggcggaggttgcagtgagattgtgccactgcactccagcctggacaacagagcgagactctgtctcaaaaaaaaaaaaaaaaaagaatcaatgttggtctgggtggttctaaattttcctgtatctattaagttgttttaatctgcagtcaagtctttctttatttcataaacattgtctgctgaaatctcttcagatcattttcttctgcactatttactctgttcttattttccgggataccagtcacatgtatattggttctccattacctgctctctgtaaacacttggctcgctatatccacgggtttcaaatccctggattcaaccaatcatggatcaaaaatatttggaaaaaaaatgatggttgcatctgtactaaatatatgcagattttttttcttgtattattccctaaacaatacagcataacaactacttatagctgggtgtggtggctcatgcctgcaatcctagcactttgggaggctgaggtgggcagattgcttgagtccaggagttcaagaccagcctgggcaacatagtgagactccatcgctacaaaaaatgcaaaaattggccaggtgtggtggctcgtgcctgtagtcccagccagttgggatgctaaggtgggaggatcacctgagcctggggagattgaggctgcagtgacccttgatcatgccactgcactccagcctgggtgacagagtacgaccctgtctcaaaaaacgacaacaacaacaacaaaaaaactatttacatagcatttacattgtattagagatattataagtaatctagagatgatctaaaggataatcatgtactacataatcacattttggtcaacaatggactgcatatatgacagtggtcccataagattataatggagctaaaaaattactgtcatctaatgaggtcatagccactgtaatggctaaatttcatatttttagtacagacagcatttcgccatattgcccaggataattttaaactcctgggttacagcacaatgcattactcacacatttgtggtgacactactgtaaacaaatctactgttctacagtcttataaaaaagtctagcacacacaattatgtatagtacataatactggataatgataagtaacttactggtttatatatttactatactttttttatcattattttagaagttactccttctacttaaaaaaaaaaaagtaaactgtaaaacagcctcaggcaggtccttcggtaggtaatccaaaagaaggaattgctacaataggagatgacacctccatgtatgttattgctcctgaacactttccagagggacaaaatctggaggtggaagatggtgatgtagatgatcctgacgctgtgtaggcctaggctgatgtgtgtgtttgtgttgtaattttttttctttcttttttttttttgagacagggtcttgctctgttgcccaggctggagtgcagtcagaagatcacagctcactgcagccctgacctctcaggcacgtgatcctcccgcctagcctcctgagtagctggaactacaggcacatgccaccaagcccggctaatgttttgtgtttttagtacagacagggtttcaccatgttgcctaggctaatctcaaactcccaaattcaagtgatccacctaccttgacctaccaaagtgctgggactacaggcatgaaccaccacacccagcctttgttttgttttgttttgttttgagacagggtctcactctgtcacccaggctggagtacagtggcacaatcatggctcctcgacatcccaggcatgaaccgctatgcccaaccatgatttaattttttacaacaaagtttaaaagttaaaaaaaaaagtttaaaattttaaaaatagaaaaaagcttatagaataaacatgtaaagaaacaaaatatttttgtacagccatactatgtgtttgtttgtggttttgtgggtttttttttttttttttttgagacagagtcttgccttgtcgcccaggctggaatgtagtggcacgatctcggctcactgcaacctccgcttcctgagttcaagcaattctcctgcctcagcctcccaagtagccggaattataggtgcccaccaccatgcccggctaatttttgtattttcagtagagacagggtttcaccgtgttggccaggctgatcttaaactcctgacctcaggtgatctgcctgccttggcctcccaaagtgccaggattacaggcatgagccaccgcgcctggccgcgtttgtgttttaggctaagtgttatttggaaagagtgaaaatgttaaaaataagaagtttataaagtaaaagagttatagtaagctaaggttaatttattattgaagaaaaaaaatttaaataaaatgaatgttgcttatgtatacagtgtttataaagtctacagtggtaaacaataatgccctaggccttcacattcattcaccacccacttgctgacaaactcagggcaacttccagtcctgcaagctctatttatgcatggtatgtgccttatatgggtgtacttttgcttgtctttttttttttttttttttttttttttttttttttttttgagataggatccccaggctggagtgcagtggcacaacctcagctcactgcaacctccttctcccgggttcaagcaattctcctacctcagcctcccaagtagctgggattacaggcgtccaccaccacgcccagctaattttttgtatttttagtagagacagggtttcaccatgttggccaggctggttttcaactcctgacctcaggtgatccacccgcctcagcttcccaaagtgctaggattacaggtgtgagccaccaagcccagccttttgtcttttatactgtatttttaccgtactttttctgtgtttagatatgtttagatacatgaatactaaacattgtgttacaattggctacagtattcagtacaataatatgctgtataggttcgtagtctaggagcaataagctatactacacagcctaggtgtgtactggttgtaccattcaggattgtgtaagtacctctatgatgtttgcccaatgaggaaattgcccaaaggtgcatttctcacaatgtattctccttgttaagcaatgcataactgtatatgggaagatgtaaataggttatatgtaaatactatgccattttatataaaggacttgagcatcagtgaattttggcatccacagggagtcctggtaccaattccccacagagagtgagtgaccactgtacattattctccctacaatcactttcatctctttttccttttttactgtacttcctcatttaggtggaggggactcctcccagaacctgtcagctcatttcccactgaacacttctcacctttccatatttgttcaactttagagtatttaactgctgctgacactctaaataactattatccagctttgcccatggtgtcctaggtgtggctctcactcagggtttcatagaaatgaagatagggtgaatgacttaaccaaactcttgaatgtaagggaacgtgtgaatggctttactctgtatgaaagtattttctcacagagagaaacagaaaatgtatttgcaagttcccatttattaggaaaaaaggcaatcactcaccttcttttccttattaagtatctcaacagctaatttggctgcggcattttttgcttccttctttgatctaccttcaccttctggaaattctcttccatctattataacttgaaatgtaaacctgattacaaagagaatattcataaaatattatacaactcatgcactatctaaaaacaagtactctagtcatcactacctcctatgactacctttgagggtttgaacctacattcaatatagcatttaagcagtcacctcaaacagtaaagcagcatgtcttgttgaagcatggaaaggtttctaccctcttttctctctggagtcaactgtggctccaccatggttcccactttatgccaagagcactctcacaaaactaaagtgttgacctcaaagttgtgccagagttgccattcccccagcttacatttataaggtcatatcttttttcttttttttttaattttattattattatactttaagttttagggtacatgtgcacaacgtgcaggttacatatgtatacatgtgccatgttggtgtgctgcacccattaactcgtcatttagcattaggtatatctcctaatgctatccctcccccctccccccaccccacaacagtccctggtgtgtgatgttccccttcctgtgtccatgtgttctcattgctcagttctcacctatgagtgagaacatgcggtgtttggtttttttgtccttgcgatagtttgctgagaataatggtttccagcttcatccatgtccctacaaaggacatgaactcatcattttttatggctgccatatcattttttatagcaacctacctcctatcatgtggaggtcctgaattaggcagttcttgatatttaagtactactccctgcttctgacggtatgtattaagttcctccatgaagaaacctgctgaaagatcaccagccatttcttcttcccgtatcctacaatggaagagacatttgaatgagtgatgctcacagaacatatttaatctgagtttcccaatgcagtttaggagacagaggggttggggagactcccctttataggactcatctcagtctcacataaatgcagagactttctttcaaaaccgttctttctttctcattcactgcacaataaagttaatttctccaaaattttctactttaaaaactcaacttggccaggtgtggtggctcacgcctataatcccagccaaggtgggcggatcacctgagctcaggagttcgagaccagcctgggcaacatggcgaaaccccatctcaattttgaaattgttttaaaaaataaaggaaagaaaaaaaactcaactggtcagtgaaagggggtccttctctttaactctgctctgtgcttccactgagtatcaactacatgtttgcctacctgcttaaaaaagtaaaaaggctgcaggattgtagaatgttttatgttgagaagaaaaagatttagagtatatataataagtgaagtggagtggtagcatggggacaggctgggaaatgaacgggcaggcaagtgtgcctgtgtggacgtggatcctgccggaagccaggcggaggagagctcaagctaagggtgatcagcccgtgacctagatctctagacaaaataaaacaaggaaaatatgctagaatcaacaatgatggatcgatagttgcagtccagcttcgtactacaaatgagtgccataaaacctactatacttgtcacacaggttttaagatgttgcaagaattgtcatcaaatgacatgcttttacttcaacttagaactggaaggacactttctaggaacaatacaatttgctttcatcacataaaaatttatattgacagatttgaggatttacagaagtcgtgttgtgacccatttaacatacacaaaaaactagccccccagaatttgcatgtaattgacttagatgatgccacttttctgagtgcaaaattcggaagaccgcttgtacctggttggaagctttgtccaaaatgcacgcagataatcacggaagtgtggatgttgattctgaagaccgccagagaagcaaacctgagtcagatggaagaactgctaaagttttgaggtcattacaatttacaaatccaggaaggcaaactgaatttgctccagaaactggtaaaagagaaaaaagaaggcttaaaaaaatgcaaccgctggttcagacagacgagtgataccagcgaagactaaggtctatgatagccagggtctcctgatttttattgggatggacctcgatgcctcgatgaagattgtttaggatgtttctatgcttgtcgtgcctgtggttctaccaagtgtggagctgaatgccactgtgaccgcaagtcacaaagtatgagcaaactgaaattgaaggaggagaaataattcattataaacatgctggataatctgtggtatcaaactatggggcctttaaaggtctttatttctaaaattcggttactctaagatacattttaagcttgattgtcaaatgacaaagattttaaaagcacctcaatgtgcacgaatttttcatcttgggtgctttaagattcactatttgatataaattcagatagcctatttctcagtagtcagcattaagcctgcctggaccaatataaacatgtagggtgtaggcaggtcctcaatgtgcacggttcccatggcacaaatttcagtgacctagatttagtttaaataccagtttccttaccaggaaggaaaggaaactggtaaggaaactggtgttgtttaaacctaggttaaaattttaggtagcacagtataactctgagtaattacaggaagtacaaacttctctgctagttcttcagtctacaaatcacgatgtaaataacagatatgcttcatgatcagtgaccagtcgtgttacttgtttcaaattcttccagtggttggtccctgtgcatctgttaatcagttcactcacagcagagcacgtagttacactgtctctttgtcctccacctgacattttatagaagtgaacaatcgaaagaactggccaacaaagatgaaagtccaacaaagcaacgaaaaatgataacactggaagtgaaatttgaatcaaacataaatggatttgtagaagaagtcactgatcatgggaatgttcttcctgctgtgcattcataggagcttagtgaaggcaaacttatcaacacaaataagaaaagtgattgcaataaagataaatatgtcccagaggaagtgacggtaaaaaaaaaaaaaaaacaaacttcacactaaagagcatttaatgtgaatacagaaatacttcacaacattgaaagcacaagcaataaaaggctggaagctcacccaaacttaaaaggagtatgacagtttgccatgaatagaaaagatgcttactcagtatcataagtcacttggcagaaaaaaaaggcaatccctattcaaactacttagttttcacaatgaaataaaacactttaattctatttttaatgttttaaattacagtgtactaaatatttttaaattttttttgcatttttttctacatttataactgaccttaagagttttaatattttagcagaattttaaaggtcatggaacaatcatcattttccccattgattattaagattgctttgcatggccatttttatggtcccacagtaccatgcaaaatgaggaccgcttgtagccgggaacaacacaatgcttgcttcagggaaaactgatttacacagaagtgactagttgagtggtaaactattttggaaataatctacatatctaagtgctgaaatatatttctcttctccccacgtattcttcaaataaaaaagttttaatactttaaaaaagtgaagtgtatgaaatcatgaaggatttaactgtatggatatagatttctctatgaaatcccaaaaatctcccctctgaattttgcagaaatcaattttaggacaatttaaccactgagtaaattaagacctctgtttataggtctcactggaccaagtctatagcaatgatttaaattataaacaaaatttagaggatataaaatataaatgtacaagcgaaaactataaaactcttagaagaaaatatgggggagatcttcatgactttggatttggtgataaaattttagctatgacagcaagagcacaagcaacaaaagaaaacagagataaattgggcttcatcaaaatttaaaacgtttgtgtatcaaaggacactatgaagaaaataaaatgacaatctacagaatagaatatttacaaatcatatatctgatgagggtctagtaaccagatatataaagaattcttacagctcaacaacaaaaagacaaaccacccaattaaaaaaataggcaaaggggcttgaacagacatctctccaaagaaaatatgtaaatcgccaataagcacatgaaaagatactcaacatcatgagtcattaaagaaatggaattcaaaaccacaactaaatacaatttcacacccactagtatggcaataataataataatcaggaaataataaaaaataagtgttggtgaggacatggagaaactggacccctcaaacactgctgataagaatgtaaaacaatacggttgctggggttcctctagaaggtaaactttgaattatcataaaactcagcaattccattcctagatatttcaaagaattggaaaacaggtttccaaacaaagacttagacaggaatgtacatagcagcactgttaacaatagccaaaaggtggaaacaaaccaagtgtccatcaacggataaatggtgaacaaaatgtgaaatatatctacacagcggaatattattcagtcacaaaaaaaatgaagtactgatacatgctacaacatggataggccaggcgccgtggctcatgcctgtactcccaacactctgggaggccgaggcgggcggatcacgaggtcaggagatcgagaccacggtgaaacctcgtctccactaaaaatacaaaaaattagccgggcgcggtggcgcgcgcctgtagtcccagctactcgcgaggctgaggcaggagaatggcgtgaacccggcaggcggagcttgcagtgagctgagatcgcgccactgcactccagcctgcgcgacagagcgaagactccatctcaaaaaacaacaaccacaacaacaaaaacatggataaacctcaaaaacattatgcaaaatgaaaaatccagacataaaatttcacacatattgtatgattcccatttatatgaaacttccagaatcggtaaatccataaaggcagaaatcagatcctgtaaacctcttaattcttcttggaaagctcttttgatcttctttcttccagggccactctttctgttttttgtttttgagacagggcctcactctgttgcccaggctggagtgcagtaacatgatctcagctcactgcagcatctgcctcccaggttcaagcaattttcctgccacagcctctcaagtagctgggactatgggactacaggtgcccaccaccacgcccagctaatttttgtatttttgaggtttcccggtgttggccaggctggtctccaactcctgaactccagtgatccaccagcctcagcctcccaaagtgctgggattacaggtgtgggccaccacgcctggccgggccactctttttaacacaccttaatctttgtagctctaaatgctggcatggcccaacaatcctcttctcttcactctatactttctccttaaggtgatttctttcacgtccatgatttcagtgatcatctatacgccattacctctaaagtttacatattccttatgaaccgctctgagtttcagatctctctatccaaattctccacttgaacatcttgaacgaactttaaactcaaaatatcctgtactgcatgtatgatcttctcccaagctggtttgaagtttcctttcacaggaaatgagtccaccatctatccaagtctgaaagccatcaatctgggaggcatccttgacatttcctctccctgccttctaatctataactaagtcctgtcaccaaaatctttctacttctcaaagatgtctacacttaccatcctagttcaagccaacaccacctcattcctggattgctgtgagaatctcagaaccagttccgacagctacttcaattccttctctaccctgcaaccattgtgatttttttttttatgttttaaaattgtgataaaatacacataacatgaaatgtactatttttcaatgtattaattccctgcctttaagtacattcacaatgttgtgtagccgccaccacatccacatccacaactcttaatctttccaaacagaaagtgtgtacccattaaacagtaactccccatttcccagtcctttcagtctctgctaatctttttttttttttttttttttgagacagggtctcgctctgttgcccaggctggagtgcagtggtgtgatcacagcttactgcagccttgaactctgggctcaagcgatcctcccacctcagcctcccgagtagctgggaccataggcgtgggcatgcctggttaattttttatattttctaatctctcttctgtctctgtaaatttgcctgttctaggtacctcatataagtggaatcaaacagtatttgtccttttgtgtctggttatttcacttagcaaaatgtcttcaaggttcatctatgttgtagcatatgtcagaattcctttcctttttaaggctgaataatattccgttgtgtatatataccatattttgttcatgcattcatttatgaatggacactggttatttcaaccttttggccatcttgaatcatgctgctgtgaacactggtatacatatatctgtttaagtccctacttctgaatatttgtggtatataagtggaattgaatcacatgataattctgtttaactttgtgatgaatcaccaaattgttttccacagtggttacacccatgttacatttccaccagcaatgcacgagggttctaatttctccacatcctcaccatcacttgttattatctgttttcttttttaatacagccacatcatgatctttttaaaacatcaattcagtggccaggcgcggtggctcacacctgtaatcccagcactttgggaggccaaggcgggcagatcacctgaggtcgggacttcaagaccagcctgaccaacatggagaaaccccatctctactaaaaatacaaaattagccggggtggtggcacatgcctgtaatcccagctactcgggatgctgaggaaggagaatcgcttgaacccaggaggtggaggttgcggtgagctgagatcgtgccattgcactccagcctgggcaacaagagcgaaactccgtctcaaaaaaaaaaacaaaaacaaaacaaacaaacaaaaaaacatcaattcaatcatgcagtctccacaagccactgaaattgtttttgtcgaggttaccaatggcttccctatcactaaatccagtagtcagttcttagtccttctctacttgacttacaaccagcatttgatggggttgcgcatcctcttcgccctcctctccctgtcttagcttggacttttaagacacccactctcctagttttcttcttttgagacagagtttcgctcttgttgcccaggctggagtgtgatggtggcatctcggctcgctgcaacctctgcctcccgggttcaagcgattctcctgcctcagcattccgagtagctgggattacaggcgcccaccaccacgcccggctaattttttatatttttagtagagacggggtttccccatgttggccaggctggtctcaaactcctgacctcaggtgatccacccaccttggcctcccaaagtgctgcgattacaggcatgagccatggcacctgggcctggttttcttctgttctgacaagctactccttttctgtctcctttcctggttcatcttcaacttcttttcttctatttttttttttttaaccttttctatggttctaacttcctcttttctagatattctagcatcactgggcccggtccttagacttgctcttttctacttggactcactcccctggtgatcacctccaggtttgtggctttaaattccacggacacaatgatggttctcaaaagcacgcttccaccatggactctctcctgaactcccaactgcctctgtccaacctgctccctcctaaaatgcccttgactctattccttctgctgtcttggcctggtcaatttctacttcctacagatttcagctcaaaatcccagacactccttcacaggctcttccacagtgctcatcccctttattaaaattgcttatttaactattttccaaaatagagcatgaattactacaggtaagggaccaggctcaataatgaatgagtgagtaccaaaatatctccagataccccatccaggacttgtcacctgcttttctctacatttatagtgcaatatctgcattctctctgtacccaccaatatccactcatctatcaggatcaacacagccttctttgatgctggagggtcagctagtatgggcttgccactccaccttgcccaaccttcaacacagccctgactgctttttaaactaattagtgagctctttggggagcagattctacatcttattcactcatctggaagaaacctccatcataatcactaaaaaataatatttgtccatcttactaatgcccagaaattattttggctatgcctccacttcctttccagcagactacatacagcctggccaacacggtgaaaccctgtctctactaaaaataaaaaaattagttggctgtgctggcgggcacctgtagtcccagctacctgggaggctgaggaaggaaaatcgcttgaacctgagaggcagaggttgcagtgagcccagatcgtgccactgcattccagcctggcgacagagtgagaatctgtctcaaaaaaaaaaaaaaagaaaagaaaagaaagaaaatgtcaccaggtgataactactatgttgacaaccgaagtagtggaagggggaacagcaagggcagagcggggtttcttgtataggcaggttgtttgaggaaggctgctctgataagctggcatgggaagcagtgcaggataagggagggatttccccatgcagttatctggggaagaagctttccagaaagaagaaacaagcagtgcaaaggcctagaggctggaggatgcttggctgtgcaccaggaacagcaaggaagccagcgtggccggagtagggggtgcgaggggccttgcctgtgagccttaataaatgtttataggattctgatgagacaggaaagctacggggaaggtcggagcaggggagagtctggttcttacttaaaggaacattccagatgctgaggtgtggagaagaggtagggggtggaggttcaggggtgaggatacggagtgggaacaggaactgcggccaggcaattgggaaactactgcaactctccacggaagagatttttagccaaagattgttcagccagtctatgagtatttcaggcctccgtattttccatgtgtcaagccactaggcctattcgtcttccactagaccccgccccacaactgctgcctgggaaatatttgttacttgcactgataaaaattcttcacgggaaggaaatggctttcagtccccaccccgctccacgatcctttccctggatttggggagggccccacacccgggctgcggacctgggcctgctctcccagtgctgacccagccggggccaggggcttcggatcagcgtccgcgtcctgagctggggacgcaggattggcgagtcccgccccggctgggcctgcagcccctcgtacgtggccccccggcccccgctccccgcgctccctcggctgccccctgccctgctcacctgcgccgccgccgccgccgccgccgccgccggccggagacccgcggcttcgggagagctggttctcagtttcgttttccccttggactccgccttccctgcagccgcccggccccctctcgcacaagccctcgtctgctacgggattggggtaaattggcgctggatccagagtgcgcgcgagaggcactggcgggcgggcttggcaccggcgggcgggcttggcaccggcaggcgggcttggcacccacgtgctgcccctgcacggccaggaccctgcacccccatcccccgcccccggggctcctagggttctccgctggcctagtccgctggccgcactaggttctcgaatcaagggttccacttactctcaacacaaatatttggggtggggttgggaagatggatcttaccagctccattctacaatagaggaaactgagtaaatgaactcacccaggggtcctgccgctcgtaagtggcaaagccaggattcagttcaagtcggggcctgtaaacaccaaagcactctttccctcttgccacaccgcggccccctcacctttacaagcctggggatcagaggcctgggggcgtaatctccttcactccgctcccacccatccattcattcatgagcagacacttgccagccgctgtaaaagcacctgtgggccagtcctgctgctaaatagagacacctgcttcctacagtaccccagggagcttcctaccatagtccaacaccagtagtcctcgatttatagaaattctactcacctgatggactgcgacacactcccagagtcacacagagttccagagttcattggcacagtgactaatgagtattgaggcacagagaatttggattaacacaggtagtaagcagcggagttagaattataaccaggagtttgtactctcagtatcttagctgggataagagaggaaggtggtccaaagacagacctcaaatatacattaaatattatgcctaggccggcgcggtggctcatgcctgtaatcccagaaatttgggaggctgagacgggcggatcacctgaggtcaggagttcaggaccagcctggccaacatggcaaaaccccgtctctactaaaaaacacaaaaattagctgggcgtggtggcaggcacctgtaatcccagctactccagaggctgaggcagggagaattgcttgaacctgggaggcagagattgtagtgagctgagatcatgccactacactccagcctgggtgacagagtgggactccaattcaaaaaaaaaaaaaaaaaattacacctaggcaggcatcctctccagcctcccttctccatcccccaacaaccccacattgcagggtatcaacaactaaaatctacactttccttgtagctctggtcctgggcatagcttaagtcccctatatgtaaagcactggcgggaggtttagaaggtagacatgaggcagagccatctttttgtggcatttccaggtgacaagaaaactctgacagtgctgtgtgtccatttgtcagctttgtgggtgtgggatggctgtggcagcagcaatggcagtagcaaggacaagtttttctgactttttgagcccctgaactgcccaagagagcttaaagaatgaaaaatggcaagcttaagcatgatcagaggacacacgcttttatgactgtaccagaaaaccctcctatttcagggagcctcaggggtgatgtaaaaatctgccttctctgctggggaaagatttggaaggaatgatatcagagggttggtgatgaggtccaggggaatgatatgatatgggtgaacctcttggaatgggtaaagtgtgagcatattggactccctgaggagcccaattccctactgtctgggctctcagctgcaaagcttggtgctgcaggcaccagaattacaatataattgttttgagacagagtcttgctgtgttgccgaggctggagtgcagtggcacaatcttggctcactacaacctctggctcccgggctcaagcaatttccctgcctcagcctgccaagtaactgggattacaggcgtgtgccaccgcacctagctaatttttgtatttttagtagagaaggggtttcaccatattggccagcctggtttggaactcctaacctcaagtgattcccccacctcggccttccaaagtactgagattacaggcgtgatccaccgcgcccagcctagaattacaacaaaaattttcatttgcagcctcatcaggtctcttctgtgaacactgagggcattgattgtgaaagaaagaagccctgggaatttgggtggatttgaatgaatccaagtgccactgccctcctaaattctgctgtgtctccacaggcttcccaccattgtctgataaggctggtacagcctacattaaaaagcatgaaacagtcaccctgcaaggaggtgctgattctccaaatatcctatctctacctgtgccttcactcctagaactagaatcagatgctaatgcgccccaagaggatatggacaagatctgatggaggggtgatgctttacacaacaaaagagcaacagaaagcaagaaatagacatggcaatgagtctaaagatgacgtgaagaaagctgaaagttgaggctgagcgcggtggctcatgcttgtaatcccagcactttgggaggccgaggtgggcggatcatgaggtcaggagattgagaccatcctggccaacatggtgaaaccacgtctctactaaaaatacaaaaattagctgggcgtggtggcatgtgcctgtaatcccagctacttgggaggctgaggcaggagaatcgcttgaaccagggagtcggggttgcaatgagccaagatcgtgccactgcactccagcctggcaacagagcaagaaaaaaaaaaaaaaaagaaagaaagttgatgtactgcctctagcagtgggagcgctaagccagtttgcccagttggtttactataatatcagctcagtggcagctcacactaaatgtaaatgtaatgccaagtaatgcagatgaagaaatcaaaaatacttagggagtcaggaatattggagtagattcatcttatgcaacctagtcacttacttcctaaccatggaccccaagaagatccaaagtcccctccttcagtggcttatacagagccagtggctggcaatgcagctgatgttcagagagttggaaggaatgatatcagagggctgatgatgaggtctagggaaatgatgtgcttgaaccacttcgaatgggcagagtgtgcatattgggctcccttttgaatgttcaccaaaggcaaccacttctaaagaggcttttgagaagcagttgagcaagaagacttctgttagccttttccccagctatccctgtgcttgtttcaacaaataaagaggctgtgacagcaggaatggaggatatgtgtgagtttatccacatgggcttctcaggccttactacgtaactctttgtgaatatcagtatggttattgacctatagtcaatcccataagtctatctcttttaatacagtgacttttagatcaaaatgtgtaatgctaaagcaacgaatcagacacagatagaagaatcgtatgtatcaattattcttaattctctttttactagcagaggaaaaataataactgttattcctgcttttggaaattgtagagtggtccatatttatgttgtaccatatctcttgtggctcttttcctcagatgtttctgctttagtaatttgtcttgcttacttataaactcttcttgtcaatagtccccacatgcacattattataaaatcatcgctatggtctgaatgtttgtgtcctccctaaaactcataagttaaaagcgaatcaccaatgtgatggtattaggaggtgtggcctttgggtggtggaactggtgctcttataaaagaggccccagagatctgccttgtccctttcatcatgcagaatacagaaagaaggccgggcgtggtggctcacggctgtaattccaccactttgggaggccgaggtgggtggatcactggacgccaggagttcgagaccagcctagccaacatggcaaaaccttgtctctactgaaaatacaaaaattagctgggcatggtggtgcatgcctatagttccagctactccagaggctgaggcaggagaattgcttgaacctgggaggcataggttgcagtgagctgagatcatgccactgcactccagcctgggcgacagagagagactgtctcaaaaaaaaaaaaaaaaaaaaagaaagaaagagaaagaaaagaaagaaagaaagaaagaaagaaagaaagaaagaaagaaagaaagaaagaaagaaagaaagaaaaaagtcaagcccagaatcatcaagggcttacaagacactatatttcctgcaccctggttgccactttaacctcgtctcttgtttctctgcccctctttcattctcctctagttacattgtcctccttgtggtttttcaagaatgccaggtatactactgtctcagtgcctctgtacttgctcttccttttgcctggaacctcatccttcagatatctgcaaaactcacagatcttgttgaaacgtcacttgctcacgaagccccctgactacactatttaagttccaatcactactgtcaccctgttgtcactccctatccccctcattctattctatttcccctccatggcacttacagccttctattatacaatacaacttattgatttattgtctttgttttctccttcctctgacatgtaaagtcacatggacagggatttttgactgttttattcgctaattatttcattgtctagaatagatctgggccaaaactgggctgctgcctgtttttgtaaataatgctttattagtgcacaaccacattcattcatctatatattgtctatggctgctttgacactaagatgagttgtgttgagtcactgtgacagaaactgcatgaccagtaaaattgaaaatatttactatctgacccttcacaaaaaatgtttgctgatccttgttctagaataatgactggccgtggaggaggagtggaactagcaaggacactgggaggcagcagctaatagggaaaacaagagacatggactcctacaagccaagtgaaaaaaaattttttctgggaggaaagcgtaatccactatgtcaaatgctgcttaacaaatccttgttgaatgaatactgggagacagatgaaggccccagtgttcctctccctgatgctattcctcttcctcttctcagcagagataatcactcatttaagttattcacattcatgacttaaagggtattacctctgtatgcattcatttttaaaaataaaatcttcatatgttttaaacttgctttttgtattcatttttttttctgaaagtggtgaaatacacataacataaaattcaccattttaacctttttttttttttctttttgagacagagtttcgctcttgtcacccaggctggagtgcggtggcacgatctcggctcactccaacctccacttcctggattcaagcgattctcctgcctcagcctcccgagtagctgggattacaggcgcccaccaccacacctggctaatttttcgtatttttagtagagacggggtttcaccatattgggcaggctggtctcgaactcctgacctcaggtgatccgctcacctcagcctcccaaagtgctgggattacaggcgtgagccaccacagccagcctaacccttttaaagcatatgattcagggggacttagtacattcacaatattttgcaaccatcaccactgtctagtttcaaaacatttcaccaccccagaaagaaacctcatattgattaagtaattcttatgtgttttaagagttatttactttaccatggtcagcctggtgatcaaaaataatcataataaataaaatttaaatttaaaaagatatttacttaatatacatagctctaattcatttaactgctgaatatttatttctattaatatttcaaaattttcttatccattcttctcagttttgtttttaaatttctcactatttacaaataatgctgcaatgaagattttccttcatgttgccttatacaaataaggaagagtttctcttagatatacgcccaggaatgtaattgctggattgtgaagtatatgcacaaataactaccaaatttctttccaaaatgtacaagagtatacttctatttcttctctcttatcctttgtctcattgttgtcatagatttacttctatatataagccccaaaatacattgttattacttttgctttgaatagatagataattatcttttaaagagattataaagacagattttttagatagagtttcactctgttacccaggctggagtgtggagtgcactggcgtggcaatctcagcccattgcaaactctgcctcctgggctcaagcaattctcttgcctcagcctcctgagtagctgggattacaggtgcccaccaccacacctggctaatttttgtatttttagtagagatggggtttcaccatggtagtcagcctggtctcaaactcctgatctcaggtgatccacctgccttggcctcccagagtgctgggattacaggcatgagccaccacacctggccatggggaaatatagtttatatatacccacacattcgccatttttggtgctcttcattcctctgtgtagacccaaatttccatctggcatcattttccttcatctaaagaacttctagtatttctatagtacatatctgttggaaattatttttttcaggctttatttgacagaaaaagtatttatctgtttttttttgagacggagtctcgctctgtcgcccaggctggagtacagtggcacgatctcggctcactgcaagctctgcctcccaggttcacgctattctcctgcctcagcctcccgagtagctgggactacaggtgcccaccacaatgcctggctaaatttttttttgtattttcagtagagacggggtttcaccgtgttagctaggatggtctcgatctcctgaccttgtgattcgccctcctcagccgcccaaagtgctgggattacaggtgtaagccaccgcacctagccagaaaaagtatttatcttcttttctgaaagatatttttgactgatatcaaattctaggtggaccgagattttctttcagtctttcaaagatattactctattgccttctatcttgcatagtttctgatgagaagtctgttgtatttcttatgtgtttcttcatatgtaacatcttttttcttttttttttttttttttttttttttgagacggagtctcgctctgttgcccaggctggagtgcggtggcgggatctcggctcactgcaagctccgcctcccgggttcacgccattcccctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgtgcccggccaacatcttttttctttagctgcctcaaagaattctctttgtcactggtgttcagcaattgcattaggatgtgttttggtgccatttcattatgtttattcagcttggggtttgttgaacttcttgaatctgcagatttatagttatttgaatttgaacaatttcagtcatcaatttttcaatttttttctgtacctctttccttttcctgatattccaattacatgcaaatttgcttgatattgtcccataagtcactgaagctccgtttatgtttttctgtagtcttttttttttcctgtcttcatttagaatagaatagtttctattgctatgccttcaagttccctggtgttttcttcctctccatctaatctactgtttattcatccagtgtattttttatttcagatattgtgtttttcatctctaaaacttccatttgggtctgtttacattatccatttctcttctcatcattttttttttacccatttgagcatatttataaaatgtataatagctcttttaagatatttatctgctaattccaccatttcagccatttgtctgtttctattaattgattttactcctggatatgggtcatgttttcctatttctttttatgcttgaaaaatatttattggatggcagacatagtgttggggctttatttttttaaattcattttttaaatgttggacattttatctagcatttttttttttcaaactggtaagcaattaagttacttgagttcatttcaatgcattctaggcttgcttttgttacagcagggctagggctaatttagccctacttctaaggtctgaacattctgggaaatctacccaatgccctgggtattagtctctccactttgactgatgggaacacaaactatttccacctctgaatgaggtccaggaaaattctttggctcactgctttccagtaatcctttccttgtcttgatgggactttacactgtctttgtaaagttttattccatgcatacacatatctgcactcagttaaagattagaaagattccctctgcagatctctgaggttcttgctatgttaaatttttaacatacagtgctcttttccccagcaatgtgctctgaaaatctagcctcctcagcctgcctgactcccaatatccaactccaattttatgagacttttgtatgatgttccttttccctgtactgcagcttggaaactgcctatagatagcacgttcaggaaggtgtagggatcaactcacttgtttactccttctcagagatcccagtattcctctgactgttgttcaattttcctaattagtacatttttctcattatctatttatttaccatttggatgtcctcttctataaattacctgtctatatcctttacacttttttttaagagacaaggtctttgttgcccaggctagagtgcagtgatacaatcatggctcactgcagcctcaacctcctgggcacatgcaatcctcctgcctcagtctcctgagtagctggtactatgggcacacaccgccatgcctggttaattttttttttttttttttttggtagagatgaggtcttcctatgttgctccagctggtcttgaactcctggccttaagtgattctccctcctcagcctcccaaagcactgagattacaggcatgagccacagcacctgtctacattttttttttcctattaggctatattttatttcatctattgatattagttgttctttatatactctagatattaaccttttatttagcattttctctccttccttccttccttcctctctctctttccctctttctctctctttctcccttcctccctcccttccttcctccctccctccctcccttccttcctccctccctccctcccttccttccttcctctctctctctctttctttctttcttttttctcccctccttccttcctccctttttttttttgacaaagtcttgctctgttgcccaggctggagtgcagtggcatgatctcagctcactgcaacctctgcctcctgagtttaaacgattctcctgtctcagtctccccagtagctgggattacaggtgcacaccaccacatccagctagtttttgtatttttagtagagatgggatttccccatatttgccaggctggtcttgaactcctgatgtcaagtgatctgcccgcctcagcctcccaaagtgctgggatacaggcatgagccacctcgcccagccaggattctttctttttagaacattttctgtcttg

SEQ ID NO: 1073 - DNA, 64721 bp, Homo sapiens
agctgtatttaggtaaaatttggaaatgaaattgaaatgagaatgttaaataaattatgacattttgacccagatgtacagttaaaaaaagaagaaaacaacccaatccccaagtctcccagaatgaaaactgatcttttttttaaatgtaagaaaaactgcagaagacttaaagaagtaggaataaactagtccatatatggcagataacctaaaactatgatacatgggatctcccagaggtgcaagatggctctcttaaggaaaattctaagtaaaaaatgcctgaagagctcccagtactcaccatataatgagtagcttttttttttctttttgagataattaaatgagattagaaactattcaataacattaagaaacagtccaagggaagcaattgcgtcaatgggaacacagaagatgacttccttgattaagaataaataagctattcttattttacttcttccctctatatttaggtccactaaagagaaggctcaaaatttttaatttgagatttcagtgaacgtaaaatccctaagagcaaatactcctagtatgtaaacactctcctgtttacacatgcatttgtttcccacagtgagctctatgctcagcaaaaatcaactgtgttagttttgaaacctcttcacgccagttatacttattactgtaattgcacaatttaattacacattgctcaaactatgaaatgatggtaaggagttacttcttttttggggggtagagacagtgtcttgctatgttgcccaggctgctctcaaactcctggcctcaagcaatcctgctgcttcagcctcccaaagtgctaggatcataggcgtgagccaccgtgcctggtaggggatacttaattccgtgaacacaaaagctgaatacttggaagattcaaaggcaaggtgctaaaaaaagatatcaaattacgtaaggctaccactgaataaattttttttttaaatttccaaaacctagattctacattcagaatagctttaagtgtgtaatctcttgttcaattttagagaaaccaaaattggaaatcatagatgaagcagcatggctgataaagaaaaaaagaaacgatacagaatacggaactccaacttgaagaaaatcctggtcaatatcaagtgaccagaatatgagtgtacagatgtattaggttagactaaaatgttgagatatgaacacatcacttttcttttctttttttttttttattttttgagacagagtctcactattgcccaggctggagtgcagtggtataatctcagctcactgcagcatccgcctcccaagttcaaacaattcttgtgcctcagcctcccaagtagctgagattacaggcatgcgccatctcacctgattaatttttgtatttgtagtacagatggggtttcaccatgttggccaggctggtctcgaactcctggccttaagtgatctgcctgccttggcctcccaaagtgctgggattacaggcatgaaccaccccacctgacccacatcatttttaagagtctcctgacagtcttctgaatgacttgcctgatcacatcaaataaaaagtggcaaattaccataggcgactcaaaagggttttttttggccagaaagaaagagcctattgtttgacttcataccatttctgatccaatttgcaaagggcaagtctgtaaaagtcacataccctttaaaagaaaacagaacatttagctactgggtgactggaaattaatgacattagttaatcgtaactactaataaatattgatagtgtatccatgtatacacgatgcttctggtcttcaaggccctgctggtaccttgtctggtcacttatacagatgttcatccttgcttttcttatcctgtcatgagtttcaaaagaatagcaaagacagaaaacttcagagctattaagatatagaaatgctcctcataaatatctctgggaccaaaaagtacttcaagggtactgaactccctctcaaataaagctcatacaacctgggcatgctattctaacaatctagttagagtactactataaataaatatctgaagcatagtaagtactcggtatactttttcttacctttttcttcttatctttaaattgtttgatcaatgtgaggacatgttcaacaagaaacatgaaatacaggcctcctagagctgttagacccttccacgtggaatcaaaataggcactttcttctatgttttgagaagacagatgactgaaaagtggtcctcttttcatttccattgctggttcttcatggctatgactatggtggtgacttgcatgagactgaaggcaaaataatttgttatttataaattcatcagtttcacacaccgagtcagaaagttggctaggtaaggtcaaaattgaaatcattcagttatgcaattattcagatacttcagagatgaggtgaagtttaggacattaaaaataaaatgaccaatgagcagctagctatctagaacttaatgcatgtcatgtacttcagatacattcccagtgacccccataatatataaatagtgagcattttcaatgcttgacgaattaccatggccacaaataacaggaatactagacttaatgtgcacagtttctactgcttattttcccaactgaaaagcccataccaatgtcatcacactagcattgtaagaagcctagtgtgtgtgtgtgttgggtcctggcatgtacccgagatccaggtgcactgccctagcagcctgtaactgagtggagtagtaactactgctattgcacattagggaatcgggtgtggaacacactaagatactgggggatcacagagtacaccccatacacacgccactttctatcagtaggtattcccgaatgtctgccatctggtggtccgagagcttgtcagagcaacatagttttctttaactactgaatggaacatgagatttgtagtgctctaggtatggtgtgatttccttttcccacatacttgaaaacctttaatgggaatttaaagaatgaaacacgcatattttttaactgagcatctattccaaatatctgatggaaaagtaaattcactttaccaaacttgttttatgtgtcatgaagtgtaaatctttaaatacatacataaacattcaactctgaagaaaacctccaagtttcttgggtacataaagggtcacatattttatttcttggcaattacactaacagataaagcagataactcacattgctgcagtctatcacagtactaatagccaggcagaatttgtctctttttattaagtgggtttcaaaaagttaaattagtctgtgttttgtaaaaggaaagcaaaattcacaaatgtattaagatcgagcagaaaaatacagctttcacttaccaaatatattttaaaataagcttttctaaaccaaatttctaacattttatacaaaaaattctagcataaaccaaaacatttttttttcaatgttgaataatcaaacactaacaggacaaattactatacttacatgtggaagaaggtgtaaaaaagcatcaccactcaaagtcccaacggccagtgccacaaggaaactcaggagaaatttgaaaaacacccgattcatgagaggcactaagataacccccagcagagacaggaaactgatgatggaaatggctataaaaccaccaacccaggctgtcaaacaaaacaaaacagagcaaagaaaaattatacaactaataaactctacaagaaagacttttggagagtagcataaagcaacacgtaaaaggagagaagctaaaaacacacaaattcaatgcaaataggacctactgtggcaatagcacaataaccaagaaatctgttgttggctcaaatgaacaacctgactggtacttaagaactctccaggtaaggagcatagctctaatgggaaattcttcaggtcggggtgaaagaggaaaaaaaaatggttaccaaggatgaactgtagctcacttaggaactgagctttcagactcccataagagctaaatgataaaagaattttttttttttaagaaaaaaggaaaagaaagaaaagaagaggaagaaaccaggaattcaataatgtcctcagaaaacaaagcagtgattccttcctcattacttttgagcaatgagaccctacgctatagcagagcctatcctagcttcacttatcaataagaatgcatcagtattaggtttctaagcagcataaatgaacccaagacctcttcccaagcagtgtgacatgatataaaaatcccaaatttcaggtgatcctgacaccttcttgtaggatgaacccagagaagtcataattgaaattttattttctgggatttttttttaaagggcagggctaacacccttccttgctttcttcacattcaaggcaaagaacaactaagatgacatattcagaattgtactggaaaacaaataggctgatgcaaatctaaggaaaagcacaatataaatgaatctactgaaattgtttttacataaaaaaggcaattttacctatttgtaatgaataggtctttggagggatttcagccttcttttcacttgtatgaatcagacaagatctagcatcaatttggttgatgatggctggacagagatagttgaactctgttgcattcagcggaacctggatgcccatgccatgagatgtcagtagctttgatgcattgaaacactgaaagaaacaaagcagtgaaaatcaccaaaagccatccccattagagtagtctgatgacacaatacccttttttactaatgctacttcgttttctcgagttaatgaaaattaaaatcaacttctgttttgagcactttggaacttgcctccagctacctggcgatactatgtcaccacagtggtatcccacctcttctacctcatcagagaagcagtacatcacgagtcacctagggagaaagcctcaggtggaacaagcatgaggataaatggagattcacaagcctgttaactcactgtataaacgtattaaggaaatgagctttaatttcaaaatggggctcatcagagattgagaaatatgttgcttcagtactaacgctatcctacttggcctaaacaagtccaagacatgcctctcttctagtaatgactctacttgcaaaaactcagttctgtctacatacctggcaaagtaatgctctgcaatgagaggatattaaattatgcagattattcttgtggagggcaaggctggttaataaaacaaacctgtaccggcaggcagatgttttcaactatttaattagatgacaaacttagtttgaagatactcctctgtgcaatctctcccccagccaaaaaagaaaaaaaaaaaaaaacaacaaaaaaaccccaaactggctttagtaccagtttctcatcttctgtaaagacattttcaactcccaccacaattctcagttggtacaactcagagcaaactttatcaccagggctgctatggctatggccactactaggattagtccagaattagtacagtcacatgctggtttgaatgaagtactaaagttttgcttattaaactgtatcaactaattccttgttccttttttttttgacataattccctgttcttgacatctctcagccaaggtgaattacgtacagtctggaagtctactctagaaaaaccacatgaactcagaacctcactgtcccaacttttcccttgtccagcatgacattcatggaaactgctccaatttcaatcattcctcaagtcatggtggaccttctgtcaaggaggcagcagtggtattctcagtagtcttcagccccttcagtcacacctttccctacaatatggattctaactcctgctttcaacccctcattttctattttttattaataatgttcacctttatagactttctctaaagatagccttgatatctttctctacatattttatattctgtattagaaaaaattgtaggaggcagcactacgctcaccaaaagaactgttccctaagttctgaattgggaatgtttacaacatagcaggcatgctttgtggcaagtgccttgctgagaaggtggaaattcccttttcaataacttcaacattttacttttactttaaactcctcataactagagatagagtagcagagacaggacagacacacaggtatattaaaataatgaacagcactcatcttacctcctgaggattttcatttgtgtttctggaatacataaagccttttcggggctcactcacagattcatttgttttcctaccagccagccggctcacccggctctttgatgtgacactgggtggagtggagctgcttacatctttggggaagagttttccaggtcttggagtctctattgtctctagaaagtgagttccttcagagacagtgttgtacacagttgaggtcacttcactagcactaacactgtccttgacattccttctaccactggcatgttctggtcggtgagctcctttcccctggctgtttctaggatctttacctgaactatctgagtcatggtctgggcaaagagcttttcgcttatttttaccagaagcagcatgattatggtgagagtgatgatcatggtcagagtgatgctcgtgctctgagtgatgctcatggtctgagtgacgctcatggtctgagtgatgctcgtggtctgagtgatggtcgtggtcatggtgtatatggattcttttaatcttatctatgcctatattttgaagtaattttctgaacccttcaactgacaaagaattattttctccatagcggtagaaaagctgttgtagatgatattgccgtgtggaaattgccaagtcaacattaatgccagattcccaattcggactaattttctcagtggtctgggggaaagcagctgcttttagttcatgaaggggatttgtgacagagagggcaaaggtcaggatcaagattacagataacttcctcgccattgcgccttcctagaaaagacaggaaaaaaaaattcttgactcacttctaaaacaaattgaattaagaaacctcatactgaaaattaatgtgtaatcaaataatcaaagttgccagagcatcatgtggtgtgaccagtgtgacgctaggtactgtgaagatggaaagaactagagtcctaggctctacccttgcattcctaaaacacatgaaacaactggagaagagctgagtgctaagagactgccattagcactgtaaaagcaatagtaattcagagacaagggagatccatgtggccacagccatcaactgcttactgaagttgagaatttatttgaacgattatttgaatcattgaggccaatgattcataattaaatctaggctgggtgtggtggctcatgcctataatcccagcactttgggaggctgaggcaggcagatcacctgaggccaggagtttgtgaccagcctgggcaacattgtgaaaccctgtctcaaaaaaaaaaaagaacgaaatgaaatctagctaccttgatcatcaccatcatttcataaaataaccttcaaacaccaaaaaatagaaataataatctcagaattcacatatttaaaaaattttaaactaatacactctccttacatacaagcccatttaagacccctttccccaatcacaatcctcaaaggtgctcaattttgccagtgtatccctcaggatattttctatgcatactcaaatacatgtatacttaattttttttttaaagttttttttttttttttctagagacgaggtctcactatgttgtccgggttggtcttgaactcctggcctcaagagatcctccacctccaattcccaaagtgctgggattacaggcgtgaccactacgcccagcctcaaataagtgtatactttaaatacacattgaatcttttttccgacttgacaatgaatcagacacattatgtccatacatagaattcttaaagtaaactgaacttcatgaaaaactcactgtagcatccttgtgttactacaaaccagtcaacatttaatcacaggctgttaatcatccacagtagtgtttggaaccaaaggcctgtgccccaaagaggaggaagcaattgagttggagcttgaaaagcagaattcagttaagcagagccagaattcagttaattcagatccagcaggatgtccagcaccaacggtggaggtgatggtggtcaaactcacatctccagcaaaagacgcagacgtcaagtttacaactaagcaagagcatggggctatccagctctaccacggtcagctgttctttggacagggctctcgcattcattaccttatctaaaataccggtaaaacctattttgcaaggcgaaggaggaaaacacatgaaggaatgtatattacaagtactcgttaaactcatgtgttgcacaagtgcgaggtatcatacagggaacagtgggaaatggaggtacggcgtagaacgaggctcctgaaagaggaatctttggggcttgaagtttcgggaattcttttactaggtaaaagataaacatttagaaatcattcccaggagagaggcgaggagcggggtgggaggggactagcacaggggacagctccgagcctttctccagggaggatgctgagcgcggtcgtggacccgttgaaggatctcctttcctgcaagttggtgtgtgctggaggaaaaaggaaagcagaagggaagggccttagagaaaaaggcgagtacagaaaacggaaaagagggcacaaagctctcttctaaaagctttttatttctaaacacgtcagtcccttcttcgaatatgggatgaaaagtacggatcttttcctcaaaaaatcctccgttgcaccccgaagcccatctgagcaccttaagaagtccggctctctagggtgagtgggcgcctgcggcgggctccccccagcatcctctttctgtagcccccctgcccggtccgcaggatccggttctccgcagaaccacccctaccccgccacgcctgtctggcctgaggagctcccctcccagccgccctgctcccggacctgaaagactcacgtctccgcggcctcgttgtcccacggcccggccacgcgcgcaggtttggttccacacgggcggtccagagggctcggaacgggcccactggtgtcttcgagaaatctctaccaggcgcgaacacgcggtggtttcattgggttggctgcccctcggtccgggggcagcgccgcgcagccacccggcagccgcgcccctagccttcgcgaagctggaagacaatcactaattaccgccgcgcgcagcgccgcggggaaccaccgcccccttcgcccaggactgcagggcatgcgcagtgcgaccccggaacccggctccgcagacggatccgcttttccgtgtgttcgccgacgccgcgggggcgtggcgcggccctagcgcattgtaagcagttgggggtcatttcctcgaggccctactcgctagccagcgcccccggggccagccctggctgctgctgggagccgggtcgtaaggggcagcgagatgtttctgacgctgccccaggcacatgagccccgggtccttcgggagggtcccgagccactcgggtcggatttcgctcttgagacaaaggcctggctcgttcgcggagcggggccacggtccaagagcagagctagcaaagcggcggccttgcacaggggttccagcctgcggtgggaacggagagtctcaggggggcggggctgcctccgtctggccctcggctggctgcgaaacgtggactgggtgatgcctcaggagaaaccaccctagtagttccgctccgagggcggaagtgcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctggtaagagaggtcgctggacggccgacccttgtgcttttcgggttgaacctgtggacgtgctccgggcgcgctgttagttgccgccccagacctaggaggcgagtcgggtcggctcaggggagcggggtttgggctcggagtctccagtggacctgccggactcgctcctcacccctcaccctttgccgtctcacgcgtggcgtcatcctagggtcattgctgcccatgagctgctagtaacctgttagtcccacgcagaaacccgaatgataagcatcttacctgaagccttccttgggaactgtagtaccgttaatcaatttgggttttaaaacaattgaaatttatatgtagattaaaaccatcatcccacaggtgcaatctcatttcagtatttccttcagttttggttaatgaacttttgttgtattgaatttcaaggaaatgttacctgtgttttagctacgggaatggacattttagagaaagtgtcagtttgggggaaaggtcataggggatggggatcctaagcactgattataaggcgggacttccctcgacttcacccagtcagttggttattttcttggtgctttcctcaccatatttctcaagtgaatagtttttgcatgctccccggaattcattataactccattcccaatggctaagttggtctatacagttagtcttgcatctcaaaaggaggctcagtgtaaaaagtaaaatgttgaaaattcaaatacaacgcaggagatggctatatgtatttctgttcatacggctttattaatttggttaaaaatttcattattggccaggagcgtgtctcatgtctgtaatcccggcactttgggaggcagaggtgggagcatcgcttgagtccaggagttggagaccagtttaggcaacagagcgagaccccagtctctacaaaaagtttaaaaaaaaaaatagctggttgtggtggcgtgcgcctgtagtcccagctactcgggaggtagaggtgggaggatcgcttgagctcagaagtttgaggctgcagtggacgggggtcgcaccactggactccagcctgggcaacagagccagaccctatctcaaaaaaacattattctcacaccctttggagattcaaatatatatatgaaatatttgtaaccacattaccccatcttgagcttgcttgcctcttcctggtttttgtttcttgttatttgcattcttgaatggcaagagaaagtgcaaaaaacaagggtaaactttaaagggaccatgaggcaaggaccgactgtagaatgggagagaccacagcaggctctccatcatctcccacagcgtctcctcatccagcgccgtgagcgcggagccttgcggcattgcggcaccgttccgccatggctgggcactgggaggaccctaagaggggcggccataggggtggagttgtcagggaagcaggagcccgggagagccagggtgacacccttttaaaatcaactccgtcgtaaaattagcaaggcacactctttgccagtcaacccacggtcctgagatgtttacggcagaggaagcatcttggtaaagtctgcaaggacaaacttgccgctatatcacaggacaagatctgcttttaagatgattatactcatgctttgatgtacttaacacactgaaatgaaattctgattcagctgtagaatcccatctttttgcagcagttgaatggatttgtttccatgtattccatcagattttaaatgataacctggtggctgagctagtgaattttagcatattgacaaagaagtgttgagcctaaaaagtactttgtcctgttaaatatttgctggtcgggctttttttttttttttttttttttggagtgtagtgacagtaactgctcagtgcaacctgcaacctccacctcccgaaatcaagtgattctcgtgcctcagcctccctagtagcagggattacaggtgtgcacccccacacctggccaatttttgtgtttttagtagagacaggttttaccacattggccaggctggtctccaactcctggcctcctgaagtgctgggattaaaggcatgagccaccacacctggcctcgattgggcttttaagtaaatatgggaataaaagcatttcaaatgctaaaataaagttttgggaatgatgctcattcagcaaatcttcgacgaccatctgtgggctagccctgggctgagtgatgatgacacaaggtaatgagtgataacgcgcgtggccaccaaggaattctcagtctagtgggagagacagtgaagtacagtaaattgttttccagcctcaaataacctatatgtgaaatatattagtttatgcacatttgcctcttcctttttcttagccatgagaattctagttggcgtataagcagatacaaagccattgccgttgacaacagatagagaaaggggctgtaaagaggaaggtgcagtagtcacagttaaaatctttaatggtgtgtgaagtatgagacctccaagtgtggggtgaagttggtgaaagcagtctgttgaggatctgtggagaacctggcaataggccctgcaggaatctgatgtgtgaggaccttagtagttgtggccttgtgacattgtgccactgggtctgaaaaacccaccgtctcattggccattggcatgcaaagtgaactgtgcttgtacccattaatcacagattcttctattggagggcttttttttttttcttttggtcagagaaaccctcagattggtgcaagcatagtaggcctacttccacaaggaagcagctgcttgtctagtttggtgtgtcaggacaggctgcctaggtgaaaaggatgtgggcactgtaggagagtgagcagaagcaggtgggtggatgcagacgcgagagctcagtgtaatgggaggacaggatgctgggaatgtggagtctcaagaaaggcaggactgatttagaggaatggatgacttaagccatggttaaaagtttatagattgaagaaggcaaatctgtttgatgtaaacctgatctttttactagcatcgaaaacactgaaatctgtttttacttatttattaatttttctgtaggataaattccagtttactaactgtattttcttctctaaagaaaagggttgttgttaccaacttgaatggtcacaccgcccgagtcaattgcatacagtggatttgtaaacaggatggctgtaagtattaaccagattttaaagttgatctcaattgttttctgataaaataaggttagccatttttttctcatcacttctcttaatttagcattaccttatatgatgttatgcaattggagaaacaagaaaaatggtattcccagtgaaatatctgaactgtatttttacttcgtagcagttgaagcttggattatacagcagtgcttaggatgagggtagtgcagccctagactttggcaggatcctgtcccacctccccagttgcctgtaacctttattaaaagaacttgtaagcagggcctagactgaggctgtgttttagagacttggtttcttggtctgtttctgccataaacaagctattggtttttctttttattcttttttcttttatttacttatttatttatttatttattttttttttgccaactagttggagactagaatgtttatttttttaagagacaggatctctcacttgttgcccaagctggaatgcagcggctccatcagagttctctgcaatagctgggaccacaagtgtgtggcaccacgcctttctagttttttaggggttttttttttttttttttttttttttttttgagatggagtctcgctttgtcacccaggctggagtgcagtggcaagatctcggctcactgcgagctccgcctcccgggttcacaccattctcctgccttgctctgtagcccaggcttgtctcgtactcctaacctcaagcagtcttccctctttagcctcccaaagtgctgggattacaggattagctactgtacccggccagctattgcttttttaggcaagacattgcatctctattgaccctagtttgcaccttaataacatgtgagaagtaagagattggactagatcaagggtgtcttagaggtttgtaagacctatgagatcaaattattttcataatgatatcaagaagttattcacagtattcattctcattgtcatgaatgtacagtgttttccagcagccacatgatgtatgatactgcagcagattaaatacagaagcagatatgaaaatccagctatattctaataaaatcatatgttaaagagatttgtaggaatgtaaaatagttcctctctttcattaagtttttgttttggaaaccattggggtttttccccatcaaaatgttatatatgttcacacatcatagaacccattgttatttttaagtaaatggttaaacacatatttttcatatttctcagttttaatttctaatgtggttaatattggtacatatggttcatataatcaaaagctttttggggtcctcaaaaattgtaagactgtaaaggaattctaagaccaaaagttatgaaaatttctggacaagattatctccaggtctcttcatctctaagattctgactccagaattttcagttaaaatattagttgcctttagatggtgctcccaaaatcctatgatatttctttagttatcttaaatatatctactgtagttttgatatgggttctgaattagttttatttttcattacacactcatttgagggcattttgagccaggcacaaatgcaaaattttctgaattattaagactttgctatgattttataaatgatgtttaaaaaagttttaataagctacttatttgcttctgtaggattagtcacatgttaggtcaataaaaatcattaaatggtacaagggatgcctgttagtatggataataaaacataattgcaattatattaattgccaccagataacatcaaagactgactttcagtataggagtttgttataaaatgttaatttaggcttgtatgttttatcttccgtttaaaagtgaggttacataaaatggattgcttgtgtattactgtaatctataactattatgattgatttcctttcattgaactgccagataatgcagatagcctttccaaccctttatcggtgatatataaaattttaatatcattttgtatttttaatatgtctgaattttaacattacttttatgtatagacattcttaaaatcatatagttagttaagtggctcaattgctgtgacacatgaagttgaagcccatgatcacagttggctggcagcagagttaggacatgaacctgggccttctgagttcaaatctaatgctctttagtccagctgcttccctgaaacaaataaaaagaaaatccaaacccaaattaggttatttgccccttttttggtactactttttcttttgttatcactgagaagttgcaagtatttaaaagatctattttgaagtgtgtctctaatttcaacaataagtcatattcttggtagtagcacctgactacaatgtttcatataatgttcctgccaagagtgtttagcctgcatctaatcatgaggaaacaatcaaacagattgagggacattctgcagaacaagtgctgggtactgtcattgtcacaaaaatgagggggactaggaaactattctacattaaaggagactaaaaagatttgatatccaaatgttgagtgtatttccttagattctgaatcccaaacaaaaaaagttttaaaaggcattactgagagaattgggacattttaatatggactgtatattatataataatacttatcaatgttagaatttttgaatgtgataattgtattgaggtaatataggagaacgtttttgtccttaggagatatatggtctttgaggatcagagatcacagtgtctgccacttatttttaagtagtttgcctcctaaaaggtgtgtgtgtatgtatatagaggaagagtgagatattaagcaaatatggcaaaatgttaccagtttgtgaatctaggtagagggtacaggggtattgttttttggtgtagcttggaaatttttaaaaattgcagaaaaaatgaataaagatatttactgagatataatttttttcagccccttctactgaattagtttctggaggatctgataatcaagtgattcactgggaaatagaggataatcaggtgagtggacatgtttataatcaagaaatgactttttttgttcatttgttttttaagaggtagagtttcactctgtcacccaggctgacgtgcagtggtgcgatcgtggctcacctcagcctcctaagtagctgggactacaggtgcctgacaccatgcctggctgatttctgtttgtttgtttgtttgtttttgtagagatggggtcttactttgttgcccaggctggtctcagaaatgacttttatatatacttttattttaagtttttttcttcaactatgttgttcttttatgaagttaatcttgctcatcagcaacacaaatgctgtatcttttatactacacaggccctgtaccctttgctctgatttctactcccatatttgtatgctgttaactgtctctgtgaatttcctgtcattttggaataattttcaaactattcttacttgggctgatctgttttcaatgcttttggcatacgaatatagatttacaagactcttctcagtgctaccccacacttctgtcatgttatgtttttaaaaattctctgattgagctataactgcttaaagatgtgaaatgagtattttcaatagatttagttttttcagggggtaatgacagacttgttaaaaaaaaaaaggttataaatacaaaaagtataaagaaggaaaaacctatgcaaaatctgagcagagttaactttctggtgaatgtcattccccgtctctagttatgtgtgtataattatgcataatagagattctattgtatccaaggattttttaaacctttttgaggtgagatctggctgtgttgcccaggctggagtgcagtggctgttcataggtaagatgatggtgcactatagccaaggactcctggactcaggtgatactcctaccgcagcctcccaagtaactgggactgctggcacacaccactgcacctggcttaagtgttttttccaagaagtcaaaggctaatgattctaaagaaagttagtgtacagacccttatacatgagtattatgtgcatcttctttagtggcagaattctgttttaagtattataattggaaaaacaactgaagagacatttaaggaacaccactatttcagcagacagttgatagaagataccttttaaaagaagtggtggaatgtcacacatttgaaacttaaaaaaagataaacccaaaacatcagtagaagggatgccagagggaataatcttgatggcaagcagatagatttgataagccaatgggatttcccacttctctttgctatttttctattttgcagccctacttgatttaggcaagtatcatgagtggatgctaaaagtacttagtaaaagtttgatgaggaatagaatgtttattcaatcccaaagtatactcatattatcaccaaaaaaaaaaaaaaaaaaaaaaaattaacatcacggtgaaaaaacctggcagacaatacttctactaaatataaaggttagcttcactaaaacctggacaaactgaaatgatgtgcctcctgatgggatgtgcttatgtagtaatgctgtcaaaatgtatattctgaatctcttcataatgaaaatcacactaatccaaaaagaggaacattccacaaagttgacctatattcttcagaatacctattgtctcctcagagtagattcctagatatgagattgctgtgtcacagggcatgcacattttgtgtgttgttaacatggtcagacagacttcttgaaaaattcttttcaacttagaggacctatttctggctcagccattttattggcacatttatccaattaaataaaggtaaaaaaaatcctttttttcacaatgcttctgtcattctttctgattcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaaggtaggtttggagacatgataatccagacaaatgaaataatatttaacaaatgaatgacgagtagaagagcatatatataattctttacaactttggagcaactttaaaaatactataattctaatctaaatttttcttttgcacttatttaaaattctctataccaagactttttcatgtaagtcattttgctgtctgtaacatcattaaaatttggccatttaacttcacatggtcagtgggggctcaggattgacttctctcatctcccttctgctacctggggctgtgatgatgctatccaacctgtctagttggataagctctgaggtagttagttgttcattgtgttttttattatttcttagtaatgtgccttcagactttaaactttggaaatggatttgctttggctctctgcttatcttttttgccaaatactgatggtgagtatcctgttaagtatatgttaaaagggcagtatatttgcatactgtcatatgattagaacctaaaagaaatgtattgggtcttaattttgtatctgaatgtttctatgaaacaagatgtgaataacatactttccttataatattcaaatgatctgagtatagaacataaagttaaggggggcttattaggattttgatagccattgataatttaaatgacttactgtgtacccaagattgatactgttatcaaatatactgtggatgtatataggtctaatttgaggaaagaatctaattctttagaaggtgaaggtctggggtaagttgaaaaagtgttgaatgaagatggcatatgagcatttctctcaaaatgatagctccttcacatcccgaataatgacattttgcccaagaccacttaaaatctgcaaacagaaaaatttcccttttgctgtgaaacccatctgtatttatctttgagtatcttctacaaagataatagccagtgtgagtgagtcagcctctttgcctccacagttacctggaagactggccaggtggaacgaggcagggcctggaagccaccagcctctctcgccctctgtagcaggagctgcgactctatggtttcatgttacgcttccattctgtgcaaggctctgtggaaggagaagctgcacacattctggcatcataacagaatttcatttcttccatctgcattcaggccaagtgactggagttttgtttttattgtttttatttttcttttttctgtagttgatctaaagtaagaaaatctttgaaaaacacattggtggcaaggcatgtccttagaaaaagtctcttatctagcagagtcatcagggctgccctttggtaatgcaaattattaatgattttttatcttattaaaataattttacagtcacatctttcatagctttttaaaattttaaaatttaaaatttatttatttattttttagagacaaagtctcattctgtcactcaggctggagtgcagtggtgatcatagctcactgcagcctcaaactcctgggctcaggtgattttcccacctcagccaagtggctgggactacaagcatgctccaccacgcccagctaatttttttattcttgtagagacaaggtctgtttatgttgcccaggctggtcttggactcctggcttcaagtggttctcctgtctcggcctcccaaagtgctgggatcacagatgtgagccactgcgtctggatccccttgcgtagctttgtaaattttttattttatttttttgacacagggtctcattctgttgcccaggctggagtgcagtggcgccatcacagctcacctcagcctcctgagtagctgggactccaagcacatgccaccatgcctggctaattgccttgtatagctttttagccacatgcttaattatatgctcttttatttatttttatttttattttgggggatggagtctcgctccgtcgcccaggctggagtgcagtggtgcaatctcggctcactgcaatctctgcctcctgggtttaagtgattttcctgcttcagcctcctgagtaactgggattataggcatatgccaccacgcccagataatttttgtatttttagtagagacaaggttttgtcatgttggccaggctggtctcaaattcctgacctcaggtgatctgcccacctcagcctcccaaaggataacgccctaggattacaggcatgagccaccacacccagccttttattttgttttaaacaaaataaaacataaggttttcaaacaaaacataaagtcctcaaattaacaaacatacccttaaatctgtgtgcattagccatgttggtagggctcatagtagctgttcattatttagttgtcttaacaacttttcatcttggtctttgggctgacatggtgaaaatgctctctagttgctcttgagcttatttttcacttctatcataaatgtcatagaatggagagaaggactggattctcatttaatagtcattatatttaccaagtaaccactgaatagaacgttttagagtgttcattgtattcctgcagacatttattgagcattttcaattattcgtgtagtggtgtgggaaattgaagtcaggattctttacttagagcttacaatccagtacagttgataaatcataacgtggtggaatagagaactcacagtgaagcctgttttttcttcccccagtaccaatattagcatgtggcaatgatgattgcagaattcacatatttgctcaacaaaatgatcaggtaataatgtttatattaagaggctggaattatattctgcttagttatatctcaatacagactatatccagattatagaattttagggaatgttctaatctaaaccaaaataatccaatagaatctttttttgacagtcctctgttaagatggttgtctactctgaacaccaagtaaccgctgccttgaccatcaggctcagagttgttagggggaaacaggtcattaggtgggggaggagagatggaagatgctgtggtagttgtttttctcttaaagatttaaacgagatataacatacctacagtgaagcattcctagtagtgtttatttgcccttctgagctttacttagattttgagtggttaaactaaaggagagaaatttagaaaggggttggttaactctaaactcatttatttaataggatactcatttctttgcattctataagaaggttaaaaatggttgtgaaagtccagctattcaacttttttttttttttttttgagacagagtcttgttctgtctcctaggctggtgcagtggtgagaacatgcgtcactgtagtcttgacttcctggggtgaagcaatcctcctgcctcagcctcctgtgtagttgagaccacaggcgtgtatcaccatgcctgactactttttaaattttttgtagacacagggtctcactttattgccccggctggtctcagtttcctggcctcaagtgatagtcccacctcctcagcctcgcaaggtattaggattataggtgtgagccactgcccaacccacctttttttctatattatatgtatagtatgtatcattttatatcttaaacatttaaaatatttgagattacaaatattatattatctactcagaggtgctccagttagtgatttagatattacgtgatgggtttttcattcccaaaggaatgctttttcttgtctaatcaaatagtgttctcagtaaaagagcaacgcagtaggactgtctgagaccaaatgatgtcactggtatacatgaagatgttaaattcttacatcaagcccaatgatttttatcttactagtttcagaaagtgctttctctctgtggacatgaggattggattagaggagtggaatgggcagcctttggtcagtatgaaattttgctaatgcacatacaatgggaacaaatatgtgttacttccaagaaagcagccttttttgttttaatttttaagttttctttgtatgttatgtttttctattgtcccaattagaaaggaggatgcttatctcttctgttgttagttggatggtagatgattaaataaattggtatttatcagatgacattagctgtcttgttcacatgcagaccttcttgaaaagttctttgtagaacttagtagactatatactacatgttgtaaacatgtattagcattgtatgcatatttgtcaatgttattaaaaatgaatatagatcaaatgaattggagggtaaggaaacaaagtattgttttttttctggaaaatctggaaatatatatattatagacaaaaaagtcttatacataaacttcacaatataatgttttaaaattaatacaacttattttttaattaggtagagatcttttcctagcaagctgttcacaagattgcctgataagaatatggaagctgtatataaagtcaacatctttagaaactcaggatgacgataacataagactgaaagaaaatacttttaccatagaaaatgaaagtgagtaataatgaaaatatccaatataacgatacttaggtctcctagttggttgatttttttttcaccacccacctatgtgaaggatagtttttcacaattgtcagattcctacctgaaatttcttttttctttctttttttttttgagacagagttttgcttcttcacctcggctggagtgcagtggcgtgagcttggctcactgcaacctccgtctcccaggttcaagtgattctcctgcctcaggttcaagtgattctcctgcctcagccttccaagtagctgggattacaggcacgcaccaccacgcctggctaacttttttgtatttttagtagaaatggggtttcaccatgttagccaggctggtctcgaactcctgacctcaggtgatctgcccgcctcggcctcccaaagtgctgggattacaggtgtgagccaccgtgcctggccttttttttttttttttttttgagacttcttacccaggttggagtgcagtggcataatcacagctcactgcagccttgaactccttggctcaagtggcttagcttcctgagtagctaggactacgccatcacacccagctaatttttaaaattttctgtaaagatagggtcttgctatgttgtccaggctgtttttcaactactggcctcaaatgatccttccaccttggtatcctaaagtgttgggattacaggtgtgggccaccatgcttggcctgatactttgtattttcctatttttatgtgagaatgagtcatttttcatatgtgaaatatttttcttctaaaccatattagtaagatttttaaaattgctgaggataatgtttagtgcttctcattaaagtaatttgtaaaatattactaaatttgcagttttagcataggaagacctaaaggaataatgtgaattacttacacattttattggcctatgataaaagacaagctaaatctcaccatttgagtagtatatttaattctgattttcctattgtctagccttagaacagtatccctggatggtagatcctgttgggatgttgtatttgaaagagatatttttggatgtgacagttataaaggtagttcagtgaacattgttcacctaggtgtattctgttttttgttactattcttggtggtaaagtccatcagagttgagattttggtaacagttttatggggagaacgaaaaaatgatataaccagcatattaggagtagctatacccaaatatgaatttttttctattttcattatattgtttgaaaggtcaaaatactgatttcattatctttatttctgcatttatccttttaaaaaatgggatttgtatttgtccattcttacgcttctataaagaacttcccaagactgggtaatttgtaagagaaagaggtttagttgactcacagttctgcaaagctgaggaggcctcaggaaacttaaattaatagcagaaggggaagcagacaccttcttcacagggcatctcccaccagatccttcccttgacaggtgggacttagggggattacaattcaagatgagatttaggtgaggacacagagccaaaccatatcagtattttaggctattatattcttataatgagtgaggataataaagaggctggcatgactgtttttccttcctcattgtggtttaacaaaagtagctgtctcagaaaattgtaaaaatataagatattccttcatatttatttatgaccagctagaacagaatataaggaaaaatgtataactttttctcctataattttgaacagcagttgaggttgaagaaatttagaatgcatgttctttttttgaatcccaactatcatattttgtcctaatttttttttcttacataattgcccaactgtcttggttatggaaatattctttttagaagagctttgaggaaataataccttcattgcttttgttataggtgttaaaatagcatttgctgttactctggagacagtgctagccggtcatgaaaactgggtaaatgcagttcactggcaacctgtgttttacaaaggtaggaagaaaaccatacacatatcccttactccagttaaatcttatggcacagtaagctgaccaaatcaagtggagaatttttttactgtgattagaaatctcaaatacatgacattttcaagttgacaaagtataatactgcattcctggtctgctggacactcagttccattgaacattgaactcctaagtgggaaaagtgtaattcctgccatgatgctgaaactaccacacccccagtaactttttatcttaaaagtttccacttgattattatgggattgaagaaaaactgactttcaagccaacttcactggatcctttaccctcagtaataacaaagttggtaccactgaaatacattatttatgagaaagtaagactgttactccttctttcttttgccatttatctccatttatagagtgacagttctgtgcatgttcaggctggtgctgggtgtatagctaggtaaggcatagcctcacattcttccctggcctcttccccaaggcaataacagtaataattaattcttaggcaaactaccattcacctcttccttacattatgctatgtttgctgtaatttaaaaaacaaaaaaaattggaattatagatattacagcttgcctttttagcttaccgtgttttggagctgtatccacattgatttgtgaagctctagttatttgtttttattgcacggtagtagtctgttgtctgaatataccacaacccatttatctcttcttctaatggtagacatttgtggtgtttgcaattttttgctattacaaataatgtgcagtgaacatccttgcagtacccatgttgtttgttgtttttttctggtcatctacaaacatgatgattgttgatcacctaaagggattaggttttattttttagatggtgtcctacagcagccagtgagattattatctgcttccatggataaaaccatgattctctgggctccagatgaagagtcaggagtttggctagaacaggtaaaaatgttggatatttaaggaacagaaaattaagttttgaactctgtatttaaatcccaagtctatattgatagacctgcaaattttcactgtgtacattaaaatagtgggaatttaacagtctctggaatcagcgatttctgttgtgagaaacatagactattgattaagaattgttttctgtctgttattgtacaggttcgagtaggtgaagtaggtgggaatactttgggattttatgattgccagttcaatgaagatggctccatgatcattgctcatgctttccacggagcgttgcacctttggaaacagaatacagttaacccagtaagaaaagagtgtttaaataaagcatttctaatcaaatagagtacattctaggtaaatagtattttgcttataacactctacagaaacatagtagaggcacttgaagttcaagtgacataacttttttctgtagacattgttaaggtattgaaatttgcatgtaggtaaatttgctacgtaagtgcactgtattcctttaagctatagaattttttaatgataatttttctgaaatgtgtagctttcctgtcttcttaaaaagttaacataattggatatcttgttggactgctagatccctattattgaatgaatgtcagtcatttattgtgactgacgttcaacacctgggcatggtggctcttctcagcaacttgaaaggctgagatggaggattgcttgaagctaggagtttgagaacagccttggtgaaagaataagacccgtctccaaaaaaaaagaggtagtcttctccctttagtcatgtaactgtctctctacagcattccttctcttactttgtaatctgatttgcttctaatctgcttctagcttgggaaaattagatagcaagaacggagtggccaagagcacaggcccttggagctagacagcctgggttcacttactagctatgtgtccttgaggacattagttaatccctgtctcaggttcctcatttgtaaaacatgggtagtttttttttttttttttttttcttttaacaggatcttactctgtcatccaggtgtgatcatagctcactgcaacctcattctcctggggttaagccatcctcacgcttcaacttcctgagtagctgggactacaggtgcacctcaccacacccagctaatatctaaaattttttttatagacacagggtcttgctttgttgccctgcctagtcctgaactcctggcttcaagtgatcctcccgcctcagtctcccaaagtgctgggattacaggtgtgagccactgcatttggcatgtggattgttaatattacctactgacagtttttgtttgtttgtttgtttgttttgagaccgagttttgctcttttggcccaggttggagtgcagtggtgtgatctcggctcactgcaacctccaccttccgggttcaagtgattcttctgcctcagcctcctgagtggctgggattacaggtgcctaccaccatatctggctaattttgtatttttattagagacggggtttcaccatgttggccagcctggtctcgaactcctgacctcaggtgattctgcccctccccccgcctcagcctcccaaagtgctgggattacaggcgtgagccaccgcacctggtctactggcagggtttttatgaggcttaaatgagttaacatttatatgatatgcaaaacaaggcctggcacatactggatgctatgtaagtgtattttattttattattattgttgtgttttttattaacacttacttttttttataaagtatattgcaaaggaaacagaagcagagacgtgtagggtgaggtatgggagaaggggtgccaagctcccatgccctccctggctgtgccgccctccaggaacctccatgtgcttagctattcggaagctccgaagctccctgaactgtgtcgtctttggtttttatggcagcttcatgacgtcagcattttttcccccagggtggaaccctctcatggtcaggtttttgtttttttttttttgagatggagtctcactctgtcacccaggctggagtgcagtggcgctatctcggctcactgcaagctccgcctcccgagttcacaccattctcctgcctcagcctcctgagtagctgggactacaggtgcctgccaccacacctggctaattttttgtatttttagtagagacggggcttcatggttttagcacctcgtgatctgcccacctcggcctcccagagtgctgagattacaggtgtgacccactgcgcccagctggtcgggtttaagacacacagtcaaacaggtggggaagattagaggcctgaccctgaagcctaatatacccaattttgtaggtgaagactgtaacaagggctatgggagttttgagccaggaagttttgtcagagaaaaccagtgtacttaacacctcaggccatggatccctcaggccagggatcctttacatcaaaaaatataggctgggtgtgatggctcatgctggtaatcccagcactttgggaggccaaggcgggaggattatttgagcccaggagcttgaggccagcctgggcaacatagggagaccctgtctgtaccaataattttaaaaattagccatgggcttgcagccctgggtatcgttgcaggcgcctgtggtcgcagctacttgggaagctgacgcaggaggattgtgtgagcctgggaagttgaggctgcagtgagccatggttacaccactgcattccagcctgggtgatagaccaagaccctgtctcaaaaaaaaaatgtgtatgcacacacagtcaataattagtccagtccatcatactgtatgaatgtctcccaggctgaggccactcaggtttgcagatttccttcaatcttgtcaggtttcagaaggagtagcctcagtcaatattatatacaacttcactttttcaggcatctgggataattaagctaagagacaatgtcatctcttgctcttgagactcttatgagttgttaatgtgatattgaattttcctcaatgacccatttattcatttctttactctcagctgctatttctccttctctccattaatacccaaagcttttcatctttgaaaggcacattagaattgccattgtgttgatctagattgctggcagtaatacaagtcaagcaagtagctcctcagtctactacgttcagacaggataaggttaggtaggtgcagaactagtgagctatttttaccaccaggcaatgtagctgttttcaccattagccctaattttgctagatggggtgaaggtacaaccgtacaacccattcccgtcatgccttaggaattttgatacaagacttagaaacatagttgcagggttttttgttttgttttgttttttttttttttgcttagaaatcatccctgctgttccagtacttgttgttgcaggcctggtcctggaccactgcatcaggtagaggagaaaaaataaattaaaaaaaaaatttttttgaggcgatttggggaagaaagaaaaaaaatatagtcattttaccagtgtattcctcctttggtaagaaccgcatagtcataccagcatcctccccaacccccttccccatatcaacaagaaaaacaaaaaatctagcagggacactcaagttccactcatgttgagtgtgagtacacactcatgaaggtgtgtaagccagcccttcatgcttttatctccccttattttagacaaccgatgtttcaatcgtccatttctacttctctgtcaaactgtgactctaaggaggagatatctctacccattgttggacattatgagctgtacagtgtatctttggtctgaagaaatgatggtcggccatccagatctatttaatatcttctgttctggtttttttatggcatgttgagcattttcatctttcatttgataagcaaaacctactacacagtcagtttcagttcctgtcaagacccatttatagctccccaggtctactagcatcagtcttacttgccagccatgttcagggccttcccaccagagtctgccctgtagccatcagcagtctctgttgctgacaaacagagcagttctttctggcattatgtgccttggaattgccatctactaacccagcagctcttgagagctgttcatctgacactgcagaatccagcagtttttcacacagttccagtgtcagttctaggggaaaagaaactccttgctcaagggtatctcctccttccattctccaggtagtataaagcatttccgttttattatggaactcttccggacactgccatccccattagaatgtttctctgacatcactggagacagtatgggtgtttcaggtgtcatagggatagcttcagctaatgtttcatagcaagacagtaaatgcccctcaagtggaaatactctagtccaaaccccagtagttgttgctgggagctactcagaagctttagccataagctcgaggagctgtttcacagagggtgatgaagtggagaatttatccttcccagcactctagcttctaccctgcattgtgtggttcaggcaattctgctggttcccatttagcatatccagttaatattgcttgaaggtcagatttacatgctttctgttttacagtaccaggtaggggaaacattccccaatcagacacaatgttcagccccatgatacaatcaggtaaaagagatgcaaccacttcatatgaagtgtgttcaaatatgccaactttcataatcctattaacccttagatttttatgttctgttttcaggaacttcacccccagaccattttaccctttcttgtacaaaaagctttgggtcccttgctgccaagggttgagccaaaggactccagcccttttgtcagtagtttccccccctattgccccacgccagatcagatttttcactgtagtctctgccttccagcttttttttttttttctctttttttgagacagtgtctcactctgttgctcaggctggggtacagttgtgcagtcatggctgactgcagtcttgacctcctgggctcaatcgatcctcccacctccacctcccgagtagctgagactacaggcaggcaccgccatgcccggctaatttctattttttgtagagacggggtttcaccatgttgcccaggctggtctcagactcctgggctcaagcagtctacccgcttctgcctcccaaagtgctgagattataggtgtgagccaccctgacctgccctgccttccagcttttaccatttctccaaactgggagaagtgcagtaaactggtttggcatcctttaatgttgggagaccaggcgggactccctttggtccacccagcctttgatagtgttgtattactacttcgttttaggccaggcatggcgtctcacacctggaatcctaacacttaggaaagctgaggtggatggatggatctcttgagcccaggagtttgagacaagcctgggcaacatggcaaaaccccatctctacaaaaaagacaaaaattagccaggcatggttaattctttgggctgaagaaatgatggttgggcatccagatccatttagtatcttctgttctgttctgtttttttttttttttttttttttgaggtggagtttcgctcttgttgcccaggctggagtgcaatggcatgatcttggctcactgcactctcgcctccctggttcaattgattctcctgtctcagccgcctgagtagctgggattacatgcacccaccaccatgcccggctaatttttttttttgtatttttaggagagacggagtttcaccatgttagccaggctggtcaactcctgaccgcaagtgacccaccttcctcagcctcccaaagtgctgggattacaggcctgagccaccatgcccagccagttctggttttttaatggtttttttccagctactcagaggctgaggtgggaagatcacttgggcctgggagggagggtgaggctgcagttagccgtgattgcatcactgcactctaacctgggtgacagagtgagaccctatctcaaaaaaaaaaaaacaacaaagatctttgttttaacaccatcagtttccattttattctttgtttcttaataaccatctaaagatttccaccctgcctttgaatctctcccttttacctttcctgttttcttgtcaacctaatgtttttattagcatctgtaagactcatgagaagctgagacagcaagtttaataaggcttcttgaacggtttattgattctgcaggagtaccatcacatggggtgcccatgtagaaggaacccccttaaccatagcatttactgtgatctgggtaacaggcatattcagcaggtgaatatccctgtcatcacatagccagtctcacaaggcttgcatacaaagcatattagctgccccatctggggtgttacacttggcatttatagatgatgttaggcagtccccatttttgggggtaaacagaccttacagtggcatttatccagtccacctggctggccgttccctcaggaataatctcccgtgtgtctggattatatatccccacccacgattgttcactagtgagctgtgggtcctgcatcaacccaaacatgctcttccactctgtagcatttaaaaccaaagatactgcccctaaattaatcactttcatagtccactttagcaaaggttccccaggaaactgatgataccagtctataagatggaacaattccttagcactacaccctttggtttcagtagttacttggttttgcccttcccccacattgactaccttcttggtaaccacaggacttagaaatattttctgttgtccctgcataattctctgctttgtgggtgactttgaggctggtggcctgagctcgcacccacattttgagctgggtccagcctcaagtccttatccagcaccctcttgtactttcattttagccattatagataacagtgaccaagggattgaattttggattgaatatttcacttttttctttttagtttgcatttccttatgtatccaatgaaccaactcttggagttggatctatccgtaaattccactggtaactttaacctttagtaactgatctcaacacagctgcagcttcataccattggtgagcacatgatcaaagattcctcattccccacccttttatcctttttcttcccaaaccacacgattccgtgagtcagggcctttccagcaaatcctgcttcactaagtatgtagggaaaactctctctcttacaccacagcaatcattaacttctgtgagcaaatgtgtgggggtttcttccccgacaccaagcagcagacaccagctgggtgttctctaattcagttccaacactctctacccagagatagtgtcagatcccagaggttgagggctcagtccccaagactgcccctaccccagcagtcacagtccaggcctcaggaacttctgactgaccagcttcaagttaggattccctcgaccccctctttaggttcagttaatttggggtgactcacagaactcagggaaacacttaacatttattggtttatggtattgaaagtgacttgttttttatatagacttttttttttttatagagcagttttaggttaacagcaaaattgatctgaaggtacagagtttccacgtccctctacccccacacatcaacttgtagcctcccccactacattgttacagtcaaggacgattttttaaaagccaaacactgcccttcaggactgttactgtgggaaactgttagtccaaaagtgctgtccattgctcaaaactttttgtaaactcccattagtgctaactttagaatcagtttttgttcacagagggagtaacattttttgtcacaggcttttttttttttttttttggccagacataatatagtttagtcacagacttatccatcagattaggttttgaatgacctattagctatttatacacatttaattttcctctaaaggttaagttttagtcccacttgaggttgttcaaaaaggtgctctgtggaccaggcatatgacattttctatattttgttgtcattatttgtttatatggttgttgttgcaggcttcttagtaggtgaaccaactaggtttgattcagttgtctgtcctctacacctgtaactctttttacttaataaagccatcaggtccacatgcagaacccactgactcgttttacacaatatttttacattttatacaatttttatttagtttaataaatacatagaacctagtgtatactagaattgtcctgtgtactttacaaaagtaactcatttaatcctcataataaccctagaaggtaggtgctgttataactgttttattctataattgagacacagaaaggttaagtagtatctggctgctcaataaatgatgaatggagggaaatttcccacagttactgatttaaaggatacaacacatatttgaatgcttaagctcttacatgattgattggaaaatggatcctattattctgtgatccgatcttgtatacttagcttttcaccttgccagagggctttagtcttctctgttatcagacgtgagtgctttactttggtggtagtctttgagtattttgatatgtgatatgagcacttccattgcagagagagtggactccagagattgtcatttcaggacactttgatggtgtccaagacctagtctgggatccagaaggagaatttattatcactgttggtactgatcagacaactagactttttgctccatggaagagaaaagaccaatcacaggtaaaatgtcttatttatttatttattttttcttgggacagagtttcacatcacccaggctgaagtgcaatggcacgatctcagctcactgcagcctccgccacccaggttcaagcgattctcctgtctcagcctcccgagtagctgggattataggtgcccaccaccacacccatcttctttttgtatttttagtagagatggggtttcaccatgttggccagactggtctcgaactcctgacctcaggtgatgcaccgcccctcccccccccccgcctcccaaagtgctgggttataggcatgagccactgcagccggcctcttcttattttactaatgtgtttaaaagaaaacatccatgaacacaagaaaagtagggcagccacgctagccattaggaaaatgcaaattagaaccatgatgagataccaccacacaccctcttgaatagctaaagtaaaaaatatattaacaagtgctggtaaggatgcagagcaactggaactttcatacattgctattggggatgcagaatgatacagccactctggaaaacagttggacattttattttttgttttttgtagagacaggatcttgctatgttgctcaggctggccttgaactcctggcctcaagtgatcctcctgcctcagcctcccaagtaactaagactacaggtgtgagccaccatgcccagctaatttttagattttttgtagagacagggtcttgctctgttgcctagtttcgttatgtcttgtaattttaggtttaattcattaggaagcattatcaagtgtacaataaaagcctgaagtcatatagtattagataatagtagtgagggcagtttttgtttaaggaaattttcactgtgttaggcacctagaataaaacaaaatgtaaaagatagatcctgttttcaaggagtttaccatctagctgtagggtagggctataggtagggggcagtggaactaatgtttctgtaattattagataagaccagttaattgctaagtgttggccctgagctcaaacagttgtaaaacttcactactggtaaactttgaactgctatgtggtagagaaaatcaggatcctctgcttcagtttctgatagaaattcacggaactgactgtgggtcagtccgtaagagctagtgaagtttgccactaacactactgcttgagtaacacgtggtagattcaaataaatagagttgagaacattgggaacagcatctatagtcaactgaaaaacaagtcaaatgattttgagtgatttttctgtggctcttggtaatttttaccaatactgcccagttgtggtttattcatggatgaatatttgccccatggttatatttccattgtatagtaaataattttcatctaataatttgcttattgaaaattcagcttttgaatgatcatttttgtttatcccgttttacccaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatgtgagtatttctctaaatattttacctaaatctagtcacttcattttaaatttaaaaggatttttgccttaggctttaaatggaatatatgggtagaaagaaagtaatattgtttcttaatgtaagatgtgacaaagtttttgtgcactgtggggtgtaataatttaaatactaaaactagaaattttgtgtagcaaatgagctcaaaatactacaaagctgcattagtgttcaattgagacatgaatatgatgttttatcactgtgttaggtacctagaatagaacaaaataaaagatggatactgttttcaaggagattaccatctagctgtatggtaggggtagaggtagggggcagtggaactaatgtatctgcagttgttagatgagaccagttaattgctaaatcttatggtactaaagtaaatttcatagaaggaagaggtcattgtattggaataacgagaacatgtttaatgggacttgatttgggttttgtaagggtaactttcttttttatgtttatacgcccttctaagaaagatttgagctacttataaaagtacatggattataaaaattatgaagtaattttgaaagaaggaaaattaagtaggaagataggttacacagaagtgcatattatacagtccttcacttagagttgagtcacgaatttggttctgagctcaaaaaggataagtacccttttgataggcaaaaagaaggggagagagagggagagagcaaagggaagagagagagagcaaaggggaggccagagctattgtggtacctgttggactgaagactggatagaagtggggagaatggggaaagtccatggtggaagacttgggaggcaggcacagtctgactgtggggtgctgttggaggctcctacacaaagagtgatgaaaaggattttggaagagagttatctggaagccaagagactctgaaagcagtgaaactagcaccagtgtgagtaagactggagaagaaaatggaattcattagaaatgaagtagccaactaaatttcctggaatgtatactcagcacctcatgctacaggctttcttgattatgtgaagaggatttaagattctgttatgcttgtttctaataataatggacaataggaacaagatcaaaagggaagccttaattgtggttattatgtagagctaagcgtatggaggtggagggacagctagtttcaggatctcttcagttctaggaattgaaatggggttttacgattccatgagaggcttagtcccagttgtacacttagttctgtgtcctaagatacagggatcctgtagagtagcgagctgcttgctctcgtttgggttttgctcccatactaagtgttgggataggtatgtaggaatgcctcttactgttcttttccatgttagtttttctttgtttctgagataaagcatactgtttcttgtgtcccaggtagccatttttgatggttttaaattcttactattcatgtttgtgtctagtttcagcttctgtgttaaagtctaagttgtacagaacactcttagcaaatgagcatgtgccagttttgatggttagcatatattttcacatgtaataatttgattgatataaattgcaaaatctaagcagatattgccttttcaaatgacactcatacgaagttttaaaatactcagttagttaggtatgtttaatgaaaatactatgactaatgctgtaactgttcccttctgggaagcatctgtgtttatatgagcatcatcaggggatgtgcctgtgagattatcttggaagtagagctctgggccttccattttcagctcactgcatttcctgtcagaccctgaaacccattgaaatgttatggttcgatgaggtccctttatggatgagaggatgcccgactttatggattgcatgggagttggaggcctggtagggcttgtctgttggagagtgattgcttagcattgcattgttggttcaggaagtgaaagtacgggtagacatccacacaagatggtctttaaactgtttctcagcatttatgagcgtgacttttttgtagtgcctgaagtaacagtaacttttagttttaaaattagcaaataaaactttagcatttataacttagatattatattttctattctagcaagatagtgatcttccagaaggagccactgtccctgcattgggattatcaaataaagctgtctttcagggtaaggcttttgtcttcaaaattattaaacccatagtggtacttaaaccccagtcatacacttgtgtaatgtctacctaatgtttgttacagctgattttttttttaaatcacagtatatcttttctatcacctatttcgtgataagtactctttgtacacactcagaccactgaagtagatgcagttttcacaaagcatgttttttcccttttttttttttttttgagacagagtcttgctctgtcacccaggctggagtgcagtggcgcgatctcagctcactgcaacctctgcctcctggcttcaagcaattctcctgcctcagcctcccaaatagctgggactacaggcatgtgctaccatgcccagctaatttttgtatttttagtagagacagggtttcaccatgttggccagagtggtctggaactcctgacctcaggtgatccacctgccttggcctcccaaactgctgttattacaggtgtgagccaccacgccctgccacaaagtatgtgttttggtgttagaactacagatgagaatgtgggtaacctgaagagttggttgtgtagttttaaaagtttggagactgttagatcaaagaaaatggaaagaacctttatggagttgattaatgctgccaggagcatgtttggaaaatactggagtaatggaaatactcttgcctttggaatcacatggacacagctgtgaattgcaccactttgaattaccactgctttctatgtggtggccttaatattgagacaagtgaaggagatataaaaatagtgactatattcttgatgtgtttcttcaaactaggagatatagcttctcagccttctgatgaagaggagctgttaactagtactggttttgagtatcagcaggtggcctttcagccctccatacttactggtaagatgtgacaaagacaatttaataaatcgctagaacacacagtatgttatctattgctgctgacctaaataagtgctatagaattcacttttacatagaaaaaaatagcttcaatttattctagagcctcccactgaggatcatcttctgcagaatactttgtggcctgaagttcaaaaactgtaagttaaactgtatttagctctttggtctgattctgtcgtaacttctgacttttcctccccaccccacaatctgatgtctcctttttcttccttctacctacctttttcctcctcttctatatatctcttagtggctcttcataaggaatgagaattaaaccttaacgtttatttttatattactgtttattatgttcattagttttgtttattcatcttatttttaaagtagagaagcataacaatatatattttttctttattaagaagacttggctgggtacagtggctcacacctgtaatcatagcactttgggaggccgtagcaggaggatcacttgaggccaggagtttgagaccagccttgacaacatagcgagaccccatctctacaaaaaattttaaaaaattagccaggcatgatgatgcatgcctgtagtcccaagctacttgagagactgaggctggaggattgcttctgcccaggaattggaggctgcagtgagccatgattgcaccactgcaccccagcctgggtgacagaatgagaccttgccttgaaaaaaaaaaaaaagacttaagttttgttgttagtcatggtctttttgtctttgatggttcctgatgaagacttttccatgttttattgtttagatactggctggttgaaagtaggaggtgaaaacttgtatgttaattgtttgaatgagttatattacttataggaagctgacatttttctcccatctccctgtctttctctcaaatgtttgcctagacaaacatacaatgttccttaaaagaattgtatattagctagagaggttgatgttattctttttactttcaaaaattgtgtggcatgagaatagattcatttgctaatagtactttttttctttttaaattttagatatgggcacggttatgaaatattttgtgttacttgtaacagttcaaagactctgcttgcctcagcttgtaaggtagggaagtttacttttgattctgcttggtcacaggttatttgggtcatcaggctcctgcaagtttggtaatgatttaggcagaactctacgtgaaaggccactagtgcttggttttttgaatcttactttctcaatttctcttacccttctgtctcttcaaaagcttatggtttcattttaagtctgtttcagctgcacattttgagtttatctgtgcctccctgctaaaagtgatttaatcaggtatctcaaaatgacacctgcaatcccggctactcaggaggctgagacatgagaatcacttgaaccccagaggtggaagttgcagtgagtcaagatcgcgccactgcactccagcctgggtgacagagtgagactctgtatataaaacagcgatatctcaaaatgacacctaaaaatttgatgaattttaaataattggagtcatagagacacagggaaatgagaagaggaaacctggagtgaaatccatcagactgttttttgaggacactcttggcactgacctaaggtagatgacttttgcatttacctggaaggatggtcttgaattcatcattcagtatttatccatatcctgtggaatgatatagcaattgtggaggattatccgaagggtctgaaacccacacattcgtcttaaattttctgaaatttatttacttgttttaaatatgatgataagagccgcccacctgcatgggcttgtgtccctgcttttaatgtggatttatgccactgatctgcattttggacatcataagaaatactgctgtgcttcccctacacccacccctaccccacttgtttattctttgaaatggtactgagaggacttccttctcttataggagcctttgggaaaaatggaattcagtagttcaaatgtctgggcttctactgagcagataatttgtttctaacttagggcactgtcaatcctgtaattgattttttttccccctttttaagttgattcacaacaatatgtgtatcctctaaacattttttaacagctttatttagggttattaacatactataaatggtatgtttaatgtgaacaatttgataagttttgacatgtttatccctgtataaatcatcactacaatcaagatactgtgtatatccatcaacccccaacattgtctgtgctctttggcaattcctcttttctacctctccctttcccctcctgcctccatccctaggaaaccacttgtctgctttttgtcatgatagagtagtttacattttctaaaattgtatataaataggatcatgtaagtatgtacttttttggttttgcttctttctttcatcataattgtttgagatttatccatgtttttgcatgcatcagtagttcatgccttcttaatgctgagtagttttactttgtacagatgtaccaccatttgttgatccattcacttattaatggacatttgggttgttttccagttttgggcttttactcatggtacagttatgaaaatttatgtacaaatctttgcatggatatatgctttcattctcttgagtacatatctgtgagtggaattgccggatggtatggtagatatatatttaaaattttaagacaattgacatgctgtgttccgcagtggttatacatttttgcagcagtgtattagatttccagttgctgtgcaccctcaccagcacttagtatcagtctttttaactttaaccgttctagtaagtgtgtagcagctcattatggctgtgatttatatttctctaatgatattaagcatcttttcatgtgctaatttttatccatatgaaaatatggtgaaactattcaaatcttttgcccatttatttattagattgttttcttactgagttttgaaaagtttttaaagttttttttatagatttaggggtacaagtgcaactgtgttacatggatatattgtgtcttgttgaactctggattttagcatacccatcagctgaatagtataccttgtaccttgagtatttcattcctcaacccctcccacctttttgattctccagtgtctactattatttcatgccatatgtccatgtatacccattgtttagctcctgcttgtaagcaaagatgtctggtttttggctttttgcttctgagtcatttcccacttaggagaatggcttctaattcaatccattttgctgcagaagacatgatttcattgttttttatggccgagtagtagttcatggggggtgtgtgtgtgtgtgtgtgtgtgtatacaccacattttaaaaatccaattatccattgatggacactgaacagttttttatataccctggatacaactttatcacatgtgcttatgtagatattttttctcagtggcttgtcattctcctaacagtgtctttcaactagcagatgttttatgttttggtgaagtccagtttatcaatttttttttttaattaggctgtgtctttcttatatctagtctttgattcaaggtcacaaggatttttctgctgtgttttgttctaggagttttatggatttttagcttttgcctttagacctatgatactttcaaattaactcttgtatttgtcatggagtataggttaaaactgattttcttttattgtagataccagtttcagcatcatttttttaaaagactatccccttcatcactgtgctttgtccctttgtctaaagtcggttgttcatatatgtgggtctgttccgtagactttattcagttctattgatcttttttgatatgatgccagtaccatactctgttagtaacgatagtgttttaataatacatcttgaaattaggaagtatagagttattttgcctatagtagatcctttattttgcattttagaatcagcttaagagtttctgcaaaaatacctgcaggaattttgatggagattgcattgattctctagatcaatttggggagaattttaacaatattgagtattttgacatatgaatgcaatatgcctgtcattcattcaggtctttaatttctctcaggattgatctttttaaaagtaaaccctttattttgggataattttcatttttttcccccttcatgtcacagtttttcattttatttttccccctccatgtcacagttttgatcatggaataatttttcaagatctgagagctacagtgaaaaggaaaaaaagaaagaaagaaaacatgatactatagtccctgatgattgattttttttaatcccaatcatctgtaattcttcccagagataagaaatggttgtagtatgttatctcctaggaattttttttggaattcaaacagataaataaaatatactcatagaaacaatgtgttgtttttaaaatgttttctcttcagtttatttttacttactagcttcattgtttcatctctgtcctataggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcggtaaaacagcttctgattgggaaagttattagtgaaacagttatgttcattttatctacattaagcagctttagttaagagaaagataacagagtgaagggtagagcctcatgtctttgaagcctttcaaagttcttggataactgaggaagacttgaccttccttgtaagatttaaatggagatgatctttatttgggttgacctacttgtgattatgtagtcaagatggcatgcattcagatatctcagttcaagaaacataaacatctgtatgtaggaagttaggttttgcaaatggtgatagaatgctaccacaaagcctaatggataacttatcctaagctaggattttatgggacaggaataatgaagatacaactaagaaaactcatggttgagtggtttcttctctctgaactattttattaatatagtactattttaaattatgaaatgtagaggaaaccattatccttagctttttcctaccctctccagtcacctccttcattgagaagggcatattaggcatccatctggataaatgacccctgagcaaggtgttagcccacctacccacattctactctgaacctggcataaactgaaaaaaaaaaaaagaggactaaaaacctttgtgtagttgggtcagtggcctattcctgttcccccagattcttttggtggataagttctagagagtgtttaaagtatatttgcattgtttaatcctgttttaaatttttccattgataagactcgcatacagtttggttttgtgatatttctggtctctttgtttcttgtgttttagagaacacccagggactgtaaagtatactcagcaatatgttttagaacagactgttttcttttgcatcactaatcttttcctaacatgcagcatttactgtttaaaaagctaaagtccaccaggcacagtggctcatgcgtgtgatcccagcactttgggaggccgaggtgggcggatcacctgaggtcaggagttcaacaccagtctggccaacatggtgaaaccccatctctactaaaaatacaaaaattggctgggcgtggtggtgcacgcctgtaatcccagctacttgggaggctgaggcaggagaagcatttcaacctgggaggcagaggttgcagtgagccaagatgatgccattgcactccagcctaggcgacagagcaagaccccatcttaacaaaataaaaaataagttaaagttggacgggtgcggtggctcacacctgtaatcctaccactttgggaggctgaggcaggtggatcatttgaagtcagaagtttgagaccagcctggccaatatggtgaaaccccatctctactaaaaaaaatgtaaagattagccaggcatggtggtgcatgcctgtaatccccgctactcaggaggctgagacaggaggattgcatgaacccaggagataaaggttgcagtgagtggagatcccaccacggcactccagccagggcattagagtgagacttcgtccccctgcaaaaaaaaattgtattaataacatatttattaatttgttatatctttatggattatggagtaataatagatacgctcttattccctcctcataaacagttatgtggtttttgttttttagggttttttttttttttttttttttttttttcagacggagtttccctcttgttccccaggctggagtgcagtggtatgatctcagctcactgcagcctccgcctcctgggttcaagtgattctcctgcctcagcctcctgagtagctgggattaaaggcacctgctaccacacctggctaattttttgtatttttagtagagacggggtttcatcatgttgggcaggctggtcttgaactcctgacctcaggtgatccacccgcctctgcctcccaaaagtgtggggattacaggcgtgagccaccatgccttgccaacagttaggtgtgttaggtttagtccatataagggctagaacttcccttacacttaaatcttaaaaggaaaatattttcttaagatttctttttttaaacattaagtggtgcattaatcttttttctatagcctaatatgcaaatctgcctactttgagtaaggctaaatagcttcaggcttcttctgtaggcgtgagttgaacttcagttgagtgtttggaagatgtttgtcatcagtcactagagagtgaccagtcagtacaaaagcattccctactagaaaaatagctgtgtccacagccttctggtgaggggttggttgcctggcttcagtctatttcaaaagtcagtgcatataaattgaatattaagtcatatggtgtatatggcacttaaacatcacttcctaacaggtaaaaacccagctttctctgctttgtgaatagtgtatacatatttctttcagagccagtttttagtctttttgccttcaccaacaaaattacttctgtgcacagtagaattatttggtcttgtgattggagtcctgacagcaagtatttcttcactgggagtcgagacaaaaaggtaattatttaaaaatttaatattttttcaaatgtaaaaataatatttttataggtatgtttgaataaaaaatgcataatcctgcctttctgttacagcttttaaaaatcagctatgtattcctttctgtttttcgtatatgtacatataaaaaaagacttttcttgttaaattctataagtaaatttctctgaaatgtcaaaaatatgaggagaagacctttcagacatatgaccttcatcaaatggtcccagtggaagaagagtaataaatgaaattaatcaagaccaagaaactaggagggcagcgggaggtaggggaataagggaaaaactattttctagttttcttacttttatgaatttaacatttttctgtaataaatgattgttaccttttcatttggtgctagaagtgggtggagtatgactgacccaagctttaaaaaaagtcaaaacaaagtagctaggaatttttttttttttttgagacagggtctcgggtgcagtggtacagtcacggctcactgcagcctggacctcctgggcccaagcaattttcccacctcagccttggcctcccaagtaggtgggactacaggtgctcaccaccatgcccagccaatgtttttattgtgtagagatggggtcttgccatgttgccaggctggtcccaaactcctgggcgcaagcagtcctcccactttggcctcccaaagtgttggaattacaggcatgagccaccacacccagcctcagagtatgttctccaacatgaccttcacctttgttttctgggaaatgtccacctcacctctggtctttcctttgttttcatactctttaaaatatccttttgttcctacagactagaggtggtgaagcagtttagtgttggccattcctctccctgccttctttagtcacagacaaggtacagatcactgaagtggagtgctagcacagacagggtgtcactcaggctaaacacttacatgtcaacctctatggcagactttacatctcagaccctcccttctgttcatttgcctgttctttctttcttggcattggtgtgcctgtgctgtgcttgatgctgaggaagaaggactgcttttgtcccccacagtcatactgtattaatctgttttcatgctgctatgaggaactgcctgagactgggtaatttataaaggaaagaggtttaattgactcacagttcctcagggctggggaggcctcaggaaactcagtcatggcagaaggtgaaacaaacacatccttcttcacgtggtggcaggagaaagaagtgctgagcaaaagggggaagcctcttataaaaccatcagatctcgtgagaactcactcactatcatgagaagagcatggaggtaaccgcccccatgatcctattacctcctactgtgtccctcccacaacatacagggattatgggaactacaattcaagatgagatttgggtggggacacagccaaaccatatcacatgcctatagaacatggtccagctgctactctcagggataggtcagggatccagcagacaaagcagcattcgctggacattctctgaaatgtacttcttcttgcttagacaaagccttctgctcagtatcttgctttggttctgcattttgctactgttgtccacttcacttctctctccatttcttttttttttttttttttttttttttttgagatggagtttcgctcttgttgcctaggctggagtgcagtggcgtgatcttggctcactgcaacccccgcctcccaggttcaggcgattctcctgcctcagcctcctgagtagctgggattacaggcacccaccaccatgcccggctaattttttgtatttttagtagaaacggggtttcaccatgtgggccaggctggttttgaactcctggcctcaagcagtccacccatctcgacctcccaaactgctaggattataggtgtgagccaccacgctcagcctgctctccatttctttgtgaccattcacacatccttgaggcatgagcttccagggaagcctcatttcatgaggggtatcatctaggtcaggttttcctcatagctgagtagattccctgagcaatggacagtgtagaggaagagctagaaagctgataagttctttttttttttttttgagacggagtttcactcttgttgctcaggctggagtgcagtggcacgatctcggctcactgcaacctctgcctgctaggttcaagcgattctcctgccttagcctccctagcagctgggattacaggcacccgccaccacgcccagcttattttttgtatttttagtagagacggggtttcactatgttggccaggctggtcttgaactcctgacctcaggtgatccacccacctcggcctcccagaatgctgggattacaggcatgagccaccgcgcccagcccaaaagctgattagttcttaagcattttgtggtagcttcttggggaagtgcatgagcctactgatgggactccactggatcagaaccaatttgtgagtatagaaggcatgttagacacctctctgtggtctctgggcaggaacgctttgtctttggaccaaggtgagctctcggagacgcatgtctgctgtaccgtgccttctttctgatgcttgaaatgctctcaagtcctggcacaccatacacgaatgtaatgatgcattttttaaaataccagagcaaatactttgttttatctttgccgatgaaactgtagtacatggctagaaaccttgcaaagagaaggctttacagtgtgtgatctgtctgtattaggtggttgtctggggtgagtgcgactccactgatgactgtattgagcacaacattggcccctgctcctcagtcctggacgtgggtggggctgtgacagctgtcagcgtctgcccagtgctccacccttctcaacggtcagtctctgtgtggggcttagttttaagaggaccacttggtttcttaatatgtagccctcatgtcatttcatttgtgaattctcctagcctctgagttactgtcttttttttctttttttttttttgttttgagatggagtctcactctgtcgcccaggctggaatgcagtggcgtgatctctgctcactgcaacctctgccttctgagtttaagcgattctcctgcctcagcctcccaagtaggtgggattacaggcatgcgccgtcacgcctggctcctttttttatatttttaatagagatggggtttcaccatgttggtcaggcaggtcttaatctcctgacctcaagtgatccatctgcctcgtcctcccaaagtgctgggattacaggcgtatgccaccgtgcctggcctgagttactgtcttttgcaaaatgcttatgtttctcataataatttttaaattgatagaacctaatgattcagaatgtaaaatacaggttaggaatggggctcaaagattcttacttcaccaaatctaggactataatactttctctgtaacaagcatcttcagtggaacaagggtccctacagccagctggggaaacactggctcatgggccttgccagcagaggacacagataaatctgtgtgcagcccctgtaaagaggaggctccttgaggacacaggagagcagtgcagcatgtcctgggctgatgcctgcagagtcttttgtaaggcagggacagttgggacactgtgaagaactactttagagcaatgacgaagataacaatttcatgctaagttaatcactgttgtccccctcccttaaaaacagatacgtggttgcagtaggattggagtgtggaaagatttgcttatatacctggaaaaagactgatcaagttccagaaataaatgactggacccactgtgtagaaacaagtcaaaggtatttctttcctatttttgtttccatcagattaactagaaattgtggggtctttcatggcaaattttatgccacattttcatggagagggacatatatctgtattcgtcgtgtctaccactttgttttgtggtaatctgaaattgatacatgtggtaatctgaaattgatatattgcacttgatttttaaaagtttgcttgaccaaattgcttgcatgcataatattatttttataaacaaccatttgagatgaaagtgatttccataatggtgtgttgtagaatttgactacagtagattcttaatttgattcaaaatgtttgtgatttttaaaaatattctggattgcactttggtagtcgtatccttatgattgagccctttacctcaaaagatcctatagtggagctttcaggcatagcaaggctcatgccctgggcctcatgcatttgccacctgagctggcatagagcacctgctgtttacaacctcctccccatcccacccacctagacagtagggatcacttttaatctacccttttacaggttttattctttttgtgtgtgtgtgagacagggtctcactctgtcacctaggctagagtgcagtggcaagatcccagctcactgcaacctccgcctcccaggctcaatcagtcttcctacctcagcctcccaaatagctgggactacagacacgcaccaccatgccaggctaattttttttgtatttttagtagagacggggtttcattgtgttggccaggctggtctccatatcctgggctcaagcaatcctcctgtcttggcctcccaaagtgctggagttacaggcatgggccactgtgcctggcccacattttattctttaaaaatgcctaaatgtggctgggtgtgttggctcatggtctctaccagtgagacccctggtctctaccaaaaataaaagaaattagccaggtgtgatggtgcatgactgtgggtcccagctacttgggagggtgaagtgggaggatcacttgagcccaggaggttgaggctgcagcaagccataatcacaccattgcactccagcctgggtgagtgagagcctgtcccccccaaaaaagtataaacgttcagaaagctactaatatcattctgtgttatattttcttaggctttttcaaccttcgtatatctgtactgttgaaaatacaatttcaaatagcaatttcaaatgacaatatgatgagggtgagtgcttaatggagagagatttgtgagcaatgtcttaagatatttcatccagcagatcttgtctccatgtcagccaagcatgttagtgctcattataattatatttattaaaatgagatattgccatgcccccatggcttctctcctgcctctctgggctgggtttagcagttgaactagtttgtgctgttggcttgctgaagagggaagaagtctgttgaaattccatgcttcaggcatttgaaattttctctcttcctgggcaccctttccttccactttgcctgcccacagtgctcccttcacctctaacctggtgtgaagacctcttcaatggccaccatgtgggacactggtgggaagccccttagaaagtgcaggaagggaacacgtatagaatttgagttttttgtctgaaggggttgtttttttctttggtcattatggtgacttaggatttgcaagatggaactaatgcgtgacttaacatatattatttggattgctaatatttcagttaccaagttccaagtacctttcaaatgaaagcttttgctagtaataagatttacagaggtaatataagcaaacactaccctttaggttggtttgccaaactccctatcttcttaaatatgacatgttaatattctggatttaaaggacattaccaaaaaaagaaacccactatctcaaagcttacatagccaaacaagtatgttcctcaaagtagctcccttggaaagagttataccacatatgtttatttccgtgatttcactacttcaaatccttcttttaatgaaatgagataactctaatccataataattgagattccagtgatgttgctatcacttaaaatgttcttggaacttctctgtaggaattgtgttcagaactagcttactaatgatgcaagaaaacaaattataatgccttttataatattacctgtttcaatcatttcctctttttaaagcttgccatttatatctattaagcttgccatttatatttattataaagcttacttccaggtgctttcaacagtcagattcatcctcaaaggaacatgagctatcactgagagtactcaaatcatagtctgcataatatggaagcattttctctagaataatttcagaaaacagttgaggcacagcagtcagagtgactatttgtaagggcacgcagtcatcttgttgcataggttcaggaggactgatttttaaaatgggtttcgtgacttcattcttcccttttaatcatgagaatgcatctggtgacagggactgtcagcaaatgaaagtgtaatgtgtgtgctctggtattgttttcagtgtttattgccctaaaacctacttaggtttttcactttattcctttttggtttgggaagctaatttgcaggttaaatttatagaagatgttgtattttcatagagatttattcctaacatacgttggtaacactctgggtctgcctttttaaagggctggggaggtagggggtagggagcattaatacgatggtcttgcccaaggtcacgcagttagaggtcacactggagaccaagactctttcattgtgcagtacattaaatctgtcattgtctttctttacccagtagtaaaaatgcaattccatccacctcacagggatgtcaaaatagtaaaataatctagaatatattgtaaagttaaaattgttataaatttagtaatgttatctaaaagactaacttgaatatccatttcatgaaattccattgatcattaaaacaacattcatttaaaaaaattttattttttgtttttttttaaacaacatttgacagagattcattgtctgtgtcttgctcattttggtgatgttattgccagtgagtaagattaaaatttagtcttgcagttttaagtaaatatagtaaaatattttccaggttaaaataaaatggctaaaatgttaatgatgcgattttaaaacctgtacatttcaattttcaggttttaacttccattcatgtttacaccattaattggaaaaacatttcatgatttctctatctttgttttagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttttttttttttttgagatggagtcttgctttgtcacaacctccacctcccaggttcaagcgattctctttcttcagcctcctgagtagctgggactagaggcacaccaccaattccggctaatttttgtatttttagtagagactgggtttcaccgttggccaggcgggtctcaaactcctcgtctcaggtgatctgcttgcctcggcctcccaaagtgctgggattacaggcgtgagccactgcgcccagcctgagtttcattttttaagtcacatagcagtagtccttatttcagtgctagaccctttgaaatgcgatgaaagctatatggacccttcgctttgttatataacatatgcacacatacccagaattttgcacatatgttcagagattcctagacctgcagacctgcctctgtgtgtcccaatttaagaacctctgttctttcttcatgactggatttgcccaattttgtgttattttgggacttaatttgtccctctttgggacatttccttatttattgccctcttcagagagtagatgtagaaaataaagagaggaaacctagattacttaattttattttaacattttctatagatagcataccacgccaagtgtgctctgtcttgatccccttctttctagcatctgccagacattgtagagtttcgcaagcagttgtaggtttgagctgcagccagtcatttcttttattctttaaaagtacatagatttgtctttttagggctttactgaaagtaaaatatcctgacatttaaactgacagatgtaggaggtaaaaaatagagttctgaaacatttgaatttatgtgacagctgaagtcacgagatgagggatatatgtcccccagggaggatgcagaaagaagaaaagggtactggaaacagcatgtcagtggtgccagctgagggctggaggcagccaggagagttgggagcctgggtgctgggtggagagaggttaacagggaagacatgggaagtattgtgaaggctggtgtgagcaggggactactccagccctgttggaacatagagccatttggcagattgacaatgcagtgacagctgtatataataaatgtgttgaaaggaggaaggtgaggattttcttggtgggagtttatgctgttatttaacatattttgcttccaaaggggttaagatgttttacctaaatggaggtttctaggtcagtgctatacaatatttctaatctgtgttttatagtgtgagctacatatgtaattttaaaattttcaagtagccacataataaaggaaacaggtgaaatttaatgacatatttcctttaatacggtatatccaaaatattattatgtcaacctataatcagtataaaaacctgttactgaaatattttatagggcccatctcagttcagactagccacatttaagtgcttcatagccacatgtggctcatggccatccatatttggacaatgtactttagactattgcatctgtatactcttgtgccgtcagctggggggtggggtgtgtgtgcgtgtataccaaggcagtgagcatctgagctttgaacctcaaagaccaaaatgccctgcccattttcctgcttatcagctgaggaatctttacccacattgacacatgggcttgttctgacccaagtgcatgcaggcttccagagcagattcagaggcctaacttagtcctttagctttcctcccagcacagaactcccaaggttatctgcaagtaggccttgcctagagagactgagttttcaagttgtcagttttcccaaattgtcctcaagcatcttcctctggaatcaccttactgtttagtaaacattcagaggacttgctacacatctgggcagtctgcattgtaattcatatgtgtttacacatttgtgtcttcatctgctaaagcacctttgaaccatattgtaattcataatatctgaagcaattattatgaattgtagtaattcataatattgaagcgattcataatatctgaagcaatccccagatacgggttaggcatggccctgctctgagcaggatggcaaaagtggcagtccgtgacgcagcccttgttaccccaggctattactaaatggtggtggtggttttatcttaattaaaatgacatcaccaacaatgggccctttcctgtctgccaggaaaagttttctgtagtgacgcacgtgttgtgtgtgtatgtgtgcgtttgaggctatattactcattgctacggcagttcaaaatgacttggaaaaaaacaatgaacgctggtcattgatatgtatactgacatgtttgagggaagttactgtggtctgtaacttatgaaatacataaaaaatatgatgggtggagtgacggacacatggacagatatgaagcaagcactgtaaaatattagtggtagtttttgtatgcccatactcacggcaccattattcacagtagctaagagatggaagcaatatgtgcccatcagtgggtgaatgatcaacaaaatgtggtatattcatacagtggaatattattcagcctctaaaaggaagatacgctgacatgtgctgcaacatggatgaatcttgaggacatgatgctaagtgaagtaagccagtcactggaagacaaatactctatgcttccatttatgtgaagtatctagagcagtcaaatgcatagaaacaagtagaatggtagttgccaaggactgggggaggaggaaatgaggagttgtttaatgggtatagtgtttcagttttgcaagataaaaagtcctgtggattggttgcacagttaagttatgtgaatgctgtatgccaactcaactgtacactctaaaatggttaagatggtaaatcttatctttattttaccacagttttttttaaagcatggtaaacaccatttcccaggatgtaaatcggtactaaaaaaaaagtgctccaaagtaagatatatttgggaaacacagggataactaaggttagataggtgttctttattgcaggaattctaagagcatttaacaaattaatttacactgggaattttcagtgtggagggtctggctcatagcatttcacaaacattatacttcagagtcccaaagcctttaaataaaatgttaatggtagaaactccttaaggggtgttcactgtacaattctttcaacttttctgcatgctgggagtttttttggtaacaacgtgttggggaaaatggccttggaatatttcattcaaattggagccaagctaacacaaagctgttgctgctagtgggaacagccctgatgtccatgtaacaagctgccctccccaactccctccttcctgtttctccctcctcggcacccacttctaggattaacaggcagggagacgggagagcccagctctgggtacagttgggccacagcagaaggagggccagggtagaggtttgggccttggctctgatgcttgaacataaacacacctagtcagaagtacatcagtacaaagtgggccctacaaaattatagggtcagaaaacaggtaagtggttaccaggggctgggaatggggagaggagtgactacagagggacctagattcttcaacaaatacattacaagaggaaaagggaagggaagggaagcctggagattgaaagatacttgagacgtgtgaatccagtgcaatgtatgaaccttgtttgcctcttgatctgaactagccaatcaatcttgtaaaaatgtgcttaagggacaaagcaaatttgaactctggctggatatttgatgatattaaggaaacaacatttaaacatatgacagtggggctatggttatgattggttttgttttttttttctctagagactgggttttgcagtgttacctaagctggtcttgaactcctgggctcaagcagttctcccacctcagccttggtttaagaaaaaaaaaaaaaaagttctcttgaatcataatttcagtatttatggatgaaatcaatttatgtcttgggttgtttcataatgattgtgtgtgtgtcaaggactagatgggttttagatgtgtggattattaatgaagctgggcagtgttggggtggtcatactattctaattttttaatatacttaaaatttccttataagaattgtttagaaagaatgagcatatccataagttaaatacaaaaattgttacattgtgaggagttcttccccttctagcatgtagtggatggtccagtattaaggctctgccatgcttaaacaagagactggcactccaaggacaatgaggctgaggccagaagagagacagcgtgttggatggctgcatgtggttggtggatagaggactctgagccccactctggtggactcagagatctgggacccgggccgggcgtggtggctcatgcctgtaatcccagcaatttgggaggctgaggcgggtggatcacttgaggtcaggagttcgagaccagcctggccaacatggtgaaaccccatctctactaaaaatacaaaaaaaaaaaaaaaattagtcgggcatggtggtgggcgcctgtaatcccagatgttccagaggctgaggcaggagaaccgcttgaacccaggaggaggaggaggttgcagtgggccgagatcgagccactgcactccagcctgggcaacagagtgagactccatctcaaaaaaaaaaaaaaaaaaaaaaaaaatctgggacccagtactgagtgaagacaccagagtgaaggagagaggccatgctgtgtccgagaagctcctactggggtggaagggacagctccacaaaggctgctcttgcaggggctctcctgcagcaaggtgcctgctgactgtccccagactgtctcccgacacagagggatgcaaaggcagcctcttcctgctcagtggaatagggaaattatatcacctttcacttcccactctcacttctgcccctgctacccttagtctttggcttttgctgacattttcccctcttatcttttctcctgaccaagttctaggtatttcatagggcagtctaggtgagggttggaaccccaatgagttgggcaacagaaacccagctcacactggctgtcactgtgggcaagctgttcccctcatctctaaaagtggagatgagattagtgtatgagtctggcttccattcaactgtgtgtgaaaaaaaattgtaaaattttctttctggtttacgcaagttaaaagtttatttctctcatatgaaaggagtcaaggcagacagaccaggatggggagggagatgtctacagggtcaaggacccaggctcttatttcgctgtctgacgtccttagtatgaggctttcaccttccaggatggctgcttggcctcctgccatggtctttgcgttccagccagcaaagaggaagaaggcatgaagaaaggcctgcccctgactttaaaaacatttcttggaagtcccatactattttgcttaatctcctcgggcagaatttagtgttgtggccataccgagcttcaggagaagctgggaaattaaatctttattgcagatgcccatgtgctcagcagagaactggggtgcttcattctggaagaaagggagaacaacagtaaccagtgtgtaggattgttctgagaattaaatgagccaatatatgaaaaacactagtttggtccctgggatataaataagacagcagtaatttgtatctggtactattatgattaaataaagctctgctcgtgtcaactccatagagcctttggtaaacccctcaagtattcttttttgtttttcctctgaattccggagtattttattccagttttgttttatggcacttgtcaccttatatcttctatttttgtgtatgttttatgctgtgtcaggtagatgccttctattgtaaggaagttcatctcaaacacaaaggaattactggctcatatgactgagaaaaattcagtggtgggataggcttcaggtgcagtttgatatgggctctgccttcctttctctagtttgcttagctctgccctttccatggcagccttcttcttttgttattatttgagactgagtttcactcttgttgcccaggctggagtgcagtggcgtgatctcggctcactgcaacctccaactcctgggttcaagtgattctcctgcctcagccccctgaatagctgggattacaggcacatgccaacactcctggctaatttttgtatttttagtagagacggggtttcaccatgttggccaggctagtcctgaactcctgacctcaggtgatccacccacctcagcttcccaaagtgctgggattacaggcatgagccactgggcctggcccgttattatttttaatagaggcagggccttactatgttgcccaagctggtctcaaactcctgggctcaagccatcctcctgtcttggcctcccgaagtgctgggattacaggcatgagccactgggcctggcccgttattatttttaatagagacagggccttactatgttgcccaagctggtctcaaactcctgggctcaagccatcctcctgtcttggcctcccgaagtgctgggattataggggtgggccaccatgcctggccacatggcagctttcccctgaggccgttctccctcattgccgtaagaggaatgcaaacagcccctacattacttttttccttgttagtatcaaaggaaataactcttagcattaagtctctaactttactctgactggaccattcctcagctaatcacagtgggcaggggaaagccgcatgttaagtggcttgggcctgcccatctgatgtaacaagctgtgagatcacctgtgctggcctagaggcagagtaggtcccagtgagatcacatagctgctctaacgtggggtggttctccaaagcaaaatcagaggggccaatggatacaggatgggcaaccaatgcaagccccctatacgaacctgctaaagcctaaacacctgcgcatcagatggttttcctgttgtccacagcatccctgaattcagcaaatatgtattgccacatatttgctgaattcagggatgaatgagtttgataatgctgatggctggtggaggaagtattctcaaatgtaatctgccagtcggtaaatagaatatctgagattcctgtcttggtggttaaaggggtagggggcaaagagtaggagggaggtgctagcacagaagggaccaagaaggggctggcctggcccagtggacctgctcatgaatgaacatgggagaagccgagcccccaggaagacagcgccaggaagattgctgctctgggccctttgccctctcagtcctgtggtctacctagtattggtgggtttggttgtttcaaacattagatataatggagccttgttcccaatcatttcatgatgttgaactgcccttttcatttctattcacaggaaaggtcttgtgtcactctaggggagggagcttcctggggtttctgatctttctttccactgctctcagtttctaccagggcactctgccagtctttggagataaacttgctccaatgctatgtctgtctcactgcttcctttgccagccctcttctgacttcctaggtaccaggatatccaggtctgtgagctctcatttttggaaaagtgtgcatttcactctagtaggaaacacttaagttaatttcattatccaaaccaaattcagccttcttggacatacctatccctatcctgatatttgttgggaaatttgattcctcgtaattgcagcccccaactgtaggttggtgcaaaagtaattgcagtttttgccattttgatgcaaaagccgcaattacttttgcagcaacctaatatcttccagactaggaggccaaggttttcagggggctcaccagtgggaaaacctctacccttactcaccatttaggacttgaccactatagtggagctgccatccccacctggataatagagctgttcctgcttaggccactgcataccacctacccaacaagtttaacaatctgtcctaattgtttaacccttgtcctaataggccttatggccttagatattgccaaggtgctctcttctggctctgtccccacttctctaactgaactttcccacctgtggcatgagacagagaccctttaagtgccactgtccccagggttctggcctctttccctaaacacttcagagctcctgagatgacctgtccacaagcccctcacatgactcaagtctccaaccccagacactctgtcccttttgagccctgaatctccaccgagatgtcctgaccgagttccatattgtctccctatgcctgagactccctctgtccactcagtctcccaatctgacagcaccaagtcaccttgggccagtccttcgtcccattcatccctgaatttcatcacttctgcacgatctgggcctcagaccaggccctcactgctcttcgccaggacttttgcccagcctctgacagcagggctgcctgcaacctccccactcccacctcccccactgctgcctggggtctaagcacaccccgatccagccactctcaggaggagactctagggtgttcatgtcccttttagaccaaggccagctttctcctctgtaccagaaagtctgacccctcttacttctctcactccccatcacacttatccccacagagctgcagtctgtgctccagcttcattaaaagtcctgcatctggaattctctgagcctttttgcagctctagacctttgagtatggaatgctgccttccttcccccacctcctcctccaggaccctctgggcaggtctcccagcagccccaggtctgggaggctctttaccccaagcctggacctttgtgggaaggacttttctctagcgctctgcagcctggaggggtgacctgactatgaacctatctccttcctcatcccaggagcctctcaggcacagagactgccttgctgactgttgtcttctcagtgcctaccatgtttgcagcagggcacagctgcccagtgaacactgaataaatgcccctgccaaaagcactagtaattttcaagtgaatcttctagtgtttcaagcctggacagttgcaagaggttatagctggttttcctgctcccaattctcacaggctcatccagtctggtcatggccattggatagttctacctaaatcactcatagggcactttctagttccaaagcctgcctttcctttgtttgtctaccaccaactccaagcctaactctgacaagcactcattcatcttctgctgagtgagtgaatgaatgaatgaatgaatgaatacatgaatgaatgctttgtatatagtagagattcttgcaagtggagcccattgctaggagacactgggggtgggagttgttaacctgggagcaaggggatttcgggaagcatcatcaggaggtaaggaatcaggctcagtgaggtgcaccagggactaagattcacacggggagagatttaaagtacaaaattgagggcatctcacctgtctgcccaactggctcatagacacataatttttcaagttcttaggtgagaaagggttgcaagtgggagttggaagagctgttttcctacctagctgtaaactttaggtgcagaagctggcctctggggaactcagcatggaccagctcaggttgcttggaagctccaaggccagcagctggaccaggtgagaagtggccatggcagcctatagcacagggcccaggagatcactcctcctcccaggtcagacattccttg

SEQ ID NO: 1074 - DNA, 29379 bp, Homo sapiens
tttagacactggagggggcgaatgctgtcaaccccctcctggtataattgtcagttcatcccaacgccgccgaggtgtaggctcaggacagggagggactacggggagctggggatgccctagggacagggaccataacgaggtggagagaactatcagatgggctcagcagcttgtgctgtggttatcagcccacagctttgaatggcgcaaagagcagtggacctaaggcagacaccaaggtctttgaccttgaacaagtcacaactgttgaggccgtttcccatctctaaaggaagtgcccaaggagcacacagcaggctgaacttcttgttctctatcctaaggtgttccttctaatgggcccagctcaggcatctaatctcagtgtcccaaacctttaaggcaggaaacagtgctacagtggatcgggatatcatcgagactggccttgaggatcctgaagcagcaggctgtacacatacacccagaggtgctagggtggttcagtggtagaattctcgtctgccaaatacaccacacagctaggtgaggggatcctcctataaccccaccaccacccccaagggggtatacatgttaccctggctgctagcaacttccagaattccttaaacaaaagggagaggggagtaagaggtgggaaacagaggaagaaacacccccattcccctttcctatggaggccaccagtcatccagaaagctcatctcaactcctttgaatgaatctgggccaagatggttcttgagctccagcaccactgggagctggggagcagtttgggtcccacaagaagcctagctggagcaagccgcctgggtccaggctgcctatctcataaagctgttcccagggcaagaaccatctgtacctcctttgttgtcctttgtcctttattttccctctcaaagacacccccaacacacacacaacacacacccatggcaaagaacagctgagccaggagaagctgaagaaaacagctttttatttgttactataagaaccaattacagaatccgaggttaaaaaaacggacaaaagatctttatttctgagaactggcgtacaaaaggcagagggggaggggagggaaggaaagagcgagcgtggcctggggttgatgccagcttaggggcctcaaactccaattaggaaagtccggacaccggacagaaagagaaacccccaattaggaaaaaaaaaaaaaaaaaaaaaaaaaaagacatggcagtgcacgcccccctcccccaaccaggtaccaccacctgttatctgtttactcttcccctccccatcccctttcacaaagggaggcaaaatttttaaaaaattaaaaaaccctccccccaaaactgtccaagacatctgtgggtcctaccccccaaaacaggctaggttcccacatgggccaagttcctgcagtctgtcctccatcggcaagcatggaggcatgagacaagtctcgaggtggtaacaccagagggcgcccaacccctccagggacacacactcacttgctctcttccttaattcactcctcactcccttcgacacgaaagggaagggaggtttgggtgccctgggcatccaccctctacctctcagcccacctcccttccccacaggtgctcagtcctccaggacaataggctcattggtgctggcaggatgtgagggtgcaggtagagggacagggggccgcactgcaatcagcgttggcttcaccttcaggggcaagttgggtcggcgagcagctcgccgcatttccagatgggtcagagccttccgtagggccctggccagaaagagcaagtgggaaacagaaaaggcttagagaacattaagacctccaggtgaagccccacactgcaattatgccttctggcccattcttttctggcatccccaccctgcatccacaactttcctggagctcttgctctgatactcctactccccacactcaccagcctggactgtccctctcagcccctcccatggtagacgccttacctggtatcctttgtggccacaaacaccacaggattgggggcatcagctgggtttagtttctgacgcttggctgctggctgtgagcttgaacgaatccctgaagccagaggccttccattggcagagaaaggaacccctgcccctgccatctggaaaaggggtaggatggcacaatgagggaagggaccctctcagactcctatgagagacaaaagcccacccaactcaatctggcccacccctttctgtcaactcacagtctcataggcccgtttcaccataatgccccccagtccccggttctgggacagctggtttctgttgatcggtgtcttggtaccccgaggtgtttttggtttcaggggtgcctgggccactggaaaaaaacagaaaactttcgcaccttttcttcccacgcagttcccctttgttacttccatctctcttccctggaccagcagtttacctgggcatccccaaaagtagcaatgggggaatgttctggcaagctatcactagtatttcaaatatcagtatgaccttatcaaatcagtacagtaatactgaatagtttacaaaaaaaattattaaacaacaaaagtacagtttgttagactaaatctctgaggacactatgaggaagaaaaaaagcaaggggagagatgtcagacagggaaaggactgggagcctgatgccaacctcactggtccccatcccatacccagatctttgacgatagttgccaggggcagccgcaccagagggtgaatcttcaatggagtcttggcggccttaggaagtcgaatggagcctggagaacaaagaagaaagcttctgaagggcttcaccattcaggtctcctctaaggccagaagccaactctaatcttaaaaaaattatctgtggcctactatccctcctgttattagacatccagagaaacaacggtctctgggcagagcaatccgaaacccaccaccagtcccaccactccctgcccttacactctgctttgatggcattggcattgataggagcataaggccgtcgggcggccctccttggctgtaataggtccctgcacatgcgtctggcaagacgggtcagctttgtggtctgaagcaggaaagtttgtctgttcttagccagtagcttggccctgttggcgctggttgtgtaaggagagagactttgagcttcaggtctggataaatgaccccttgagtgtggctcctagaagaagagcataggaaagagagagagcagaaatcagcactgaggctcccttctttcttccattccctgcaggggacaatttattcctgtctaatctctttactgacctcttggcctatgtgtctccccaaccagcatcaagcaccccgtccatcaaaccatcaccatataaagagttgaatattctggccttcacctaagctcaccatcaatatgcttactgctctcccctgcttttcttcccactgatccttaccgtggtgccccgagtggccccctcaagctgagttggggtcttcagtcccccatacttcttccagtagatccaacaggaagcacagaggcggcactgcatgttaggtgggccccaggcataccactgagcagactgtgtggctgtagagtacggagaggagggggacagggaagaagcatactacctaagcccctcagattcttgagccacagcaggccttccacccatccccaccatcccagtgcccccgtaactcactgtggcaactctcacaagtcaggcccttctgaaatccagccccattcatgccaggttttgaacccacagaaatgatctggttagggtttggcttagtgctaacggggaaggcgaggagaagggaaaaaaacaagaaactggtcaaggaaaagaatcaatttccactctcagtgtgcccctacctcctgcccacccccaatcactgaggaaggcacaagttaggggaagggaaggaaaacactctggtctcccctacccaccacacttactaggtgggaatgtagacctgtttcagtttgctgtctgcttcagcagctttcaaccttttctgtaagaaggtaaaaagaaagagaaggatcagagcctcatagcagggagaatgtcatcaacttcaaaggcagaggtcagcaggtagcctatggtccaccctccccagcccagataatacctgctgaatataccggtctgtggttttccacatgtaataaaactggactatgctggcaagtgacttccagggtagctaaggggggcagagggaggaagaatgagctggcatctggccccaggtcctggttccctcacctgtcatctctcccacttctcctcctagtgccatccacttacaaaatcctggcgaatatcattgaagtccttcccatacttctctagggcctcctcaaatagcatggcctctgaggctgaccattcctccatctcatcccgacacagcaccgggcctccctggggtaccagggtcgacatggccttagccaggtcgtagccgttcctttgcaaggtatccatggcgtgaaactatggggaagatggagagcaactgaggacctgaaacttttggcaccactcccttcctgctccttaaaacactcccactcccggccgggcgcggtggctcacacccataatcccagcactttgggaagcggaggcgggcagatcacgaggtcaggagatcgagatcatcctggctaaaacggtgaaaccccgtctctactaaaaatacaaaaaattagccaggcgtggtggcgggtgcctgtagtcccagctattcgggaggctgaggcaggagagtggtgtgaacccgggaggcggagcttgcagtgagctgagattgcgccactgcactccagcctgggcgacagagcaagactcctctcaaaacaaaacaaaacaaacaaaaaaaaaacactcccactccctcagagataccctcctcttctgttcccaggctctgcaagtccccagaaaacccagcctgcccaactacccaccaacttctgctcaccagagtgatatctcgggaggcagcagctgcactcatgtgcaagcttggctgccgaatggagctgctacaatctagggctcttgcaaaggttcccacagctctaagggagaaattgagaagtcaaaagcgaaagaaaagtcaaaagcccaagtgggctgggaaattaagccaaaggagaaagaaggaaaacatccatggcaatgaaagaaataaagtccatctctaagaaccatgggactcagaacaatgtccacacctcccccagcccatcttccctatccacccacccctcaccgggccaccacaagaaactggtcgatctgccggtctgtgagagggttgtctgggtcccagaccttcatctccatcttctgctggttccgattatcagattctcctggggaaaagaacaatggcatcaacagggagagggcaggggggaacagttggtgtcttttcattcacaatagcacctcctccttctcttcttctgcttggattctatcaactctccgacttctcttcccaactgttcccattttcccttttcaggttcctacaggcccattctgtcagggtcatggcagagagccctgcagacagtgcactgcacaaccccaggtgacgccattcacagagactataatgttaaagtgccccttggaattagacaacctggtagccgtacagtcttgtcctgttgcttaccctctactaggcgatctgggatctcagcttggtatttgcaaccaactctaatctcgccctgatcagcgagaagtgtcttctgcacggggtcaaacaccagtgagtaaaaaaagcagtcctggaattggggagagacaaggtaagcaaggcagcaatccacataggcggcggggagggaggtgtatctgagtttccatgaccggcagtctggcaaccctgtacctcatcattgtgctcctttccccctctcttttgcgggcaatacccattcccctcgctcttctctcaacatctctttctcacctccttttccaggtactggctcaagatatctgtctcattcaagagggtcacactgcatttccccctataggagagagattggaaaaccccggtgagccccactctccctccccacagcatctctcaataccacctccttctctccatcttctacgtaagtgcacgcaggctatgctggccccagttgtcctgtaccgtatgtgggtggctggtaatgattcaaattgccgagaaagaaaaagttcccggtgcttcagttgatggcgctgctgctcagacacccctggctgctttgattcctcttcaaactcccctgggagattaaagaggaagaaaccaagtcagaaatggatccagcaaaacaccaccctggaaactctaactcagggaaaatatttcctatcttggctgtttttttctcacatttcccaggcgtctgccttctatacccttatcccaccagctttccttcttagctctatgccccatcatagatgctcccaactctatcagtaatgcttttagagaagaactgctgagagtacgaagaatgctctagaaatacatcgctacccagctgccagtactcagacaccaaagtccacaacgggccagcaagaacatcacacttgtctcttgcttgctaaaccagcctgaggtccaggaactcaagatgaaaaaatatcacacaagactgtgtttaccagttcttttcaatttcaggagactctttgctctaaaacatcacatgcagccctaactatccctcattttctacttggctaataatagttcctggggtttccaaggacaacacctctcaagccagtgccaacaccttcctccccaaggagctgcagcttgccctgaaacctagcggaaggggttaacctggctaggcgccaaccaaagtgggagggagcagaagaacctcagccccaggctcattggtgtattgttcccaacctcagggagaaggggggggttgtgcagtaggctccacccctcgcttgtgtgctccggaaaccctgtgctgaggcaagggggaccacacccccaacaccccttctgattggacaaggccaaggtcagcccctgccagatggggctggaaaccctaaagggccaaggaacttggtaagctgggctcctctttaaccccttctcacccagagcagtctgaaaaaggaaaataatttagaaaggtggaacaaaaggaaggaaaaagaaaaccaaagcaggaaaggaaaaagaagctaaggaaaatatgttttttaaaaaaagaagatgagaccttaaagagaatgaagatagggcaaaatgaaaagggaaagatgtaaaatggaggggggcgggcggggaaatgggcgaggtgagaaattaaaaagcgcaagaaaacttccagccatcttctaacttccaggtactctcatcaccttgtgattacaaaataagcctgcttctctgttacgcaggcttctcagtacaatgtcttcctcttcacgttgaccttcagtcatcacctactgtctcaatgtaccccaaactgcccccctttagaaaaccattgtttctctaaagctcgtcctcatactctaaatgttatcatctctctcttactctcatatacaaaccatattatcgctttccttatcacaatctctccaccctgcttccaaccccaacatgtaaaaacaggcctccctcctcaggccaggcatttcccacccccaaactcacacctctgccttgggcatgctaccaggggaaatacctgcagggacatgcccaggcctcagatcatgggtaggagaaaaagaaagggaggaagatactcactggcattactatcagccaggctgttgaggctactagaaatgtccctgcgccggaaaagacagacaacctttgcctccacatttccatttgcagtctaaggggaggaaaaaaacaaaaacaaaacaacgtagcagtggaaattgatcatctgggaacagaaatgcacaaagagacaaataacagtaagtttcagagggacctaaattaaaaagcccaagaaaatatgagtaaagacttacattcaaggatagacttccaaatccctttcctttgcccccaagagacagaatagtaaagttcctgctaacctctcaatagcctttcctgaatacatccaatgaatgaatgaacgaatatgaatgggtacttagtataggatcctctcttccaccagaagttagaaacctcagaagagaccactgcgggagggagggagagggattctgctccactcaccttgttgagctcctcaatccgtctaaccaggtaaggattgctggaagagttctcaaaatagacgtaatctgtaagggaagggaggggggagaaccacgaagatcagaggagatgggagacgcagagcaccagggtaggagagaaagttggcctgagtggatcaaaaggagataaggattcaggtagaaagggcgctgagatgtgaaagtggacagactaagagaaaataaggatgtcccccatccccaccgcacctagttctaaaattagatcctttactcaaaagagagccttaaggaacaggcaagaagcaggggttcccctgcagtccccacaactcagcgatgagttgcaccccagtcgcggcgaagtaattgtccgctctagcgcagggcccctaccttttcgaatcgaggcgcacaataacgcctgggaagaggaaacctccgggcggctcccccgcggtggcaaagccgtcgccccagcccctcgcgttccctccctaccctgtcagctccttcggaaccggttccgaaggccactccgtgccccggggagcccctgacgcagccccgaaagtgccgtcggggctgcccgcagcttctctctgggagtctcggagccctgccgcgtcgcggttccccgcaccctctctcctcgtctcccggttccggttccggtccgcgctccggtccacgctgccccatacgctgcgcctcgcgccacccggtgccgagcccctcaggtccctaccccaacctctcccgccccgggccccgtatccctgcgcccggtactcacctcccacccggtacatgttggccgccatggccgttcccgccgccgcctccggccgcacaaaggggtccgggaggctcgcgggggcagggctcggctcgaggcaaagccccgaacggtgggctgccgcttcgagggagtctcactggggcccgcgcagccggcacctccgctgcctcagccgtcgcggttcatcccggcccgcgctgtcgccgccgcagctatcgcctcactcccgggacgctgaggctggcccccgtccgctcggcttcttccggaacgagctcggctcctgccaggccagagccaggctccagctacccccgcccccgcggagtcccactagtcgttgggctctgccggccgcagggaaggcttgccgggcccgcctcagggttcgcctccttccggaacaccttcggccgatccggagaacaaggcccactgctcggctcaggtcggagagcgagaccccgcagatcggctacttccggaagaagttcggctcctgtcgggcaaccgctcggctatttccgtcgcagctcggccccacccccttttccgagggcgggagaggagtcgggcttaactctgtcctcgctggagccctgcagctcctcctcgcgccccaaagactcgcgcgccttagcgcttcgccaggttatttgcaagcggctttgcctgtcatttgcataaatggtctacgctcccttaccctttccgcacgcctcttttccttcgtccccaccccacagagccccggaggcgcccggcagcgccccacaaaagcaccgggaggcgactttggttctggtttattgcccctcagcaggcagcgggagtcaaggcctaggctggggctgcccggctcagccagcgggtctaaacagtgtgtgcaggggcgccgttcgcgccctccaggaaaatgcgcgatcgggaatgtctcgaagtcagtccaggaaagagtcggcccctagtcgtgggggattgggccagggaagggcagggcggggcggggccacgccgccgggccagtcggtcccgccaggcagcgatcaaacgtcgagggaggaggcgggggacagggagggggttcgagagggcgtggcgggcgccggccccgcgcccccagcgcccagcactcgccactggaagatgctggcgtccttgccgcccagcgagacgaggtgcgagtcgtcgtgcgtgaatcggacgctggtcacgtggctgccgtggcccccgtacatgcggctcggcgcctgggccggagggaagagttgcggtggcggctgagccctcgggcccaccggtcccaccccggcgatccccgcggcctcaccttggcacgagcgcacgggtactggaagagatgcactttgcagaagtcgtcggccaccgccaccacgcgctcgttgtgggagcggcacagggagttgatgtcggtcccatcggagccgtccggccagacgcctagcacagcggccggcctcagcccgacctcctacccaccgccacccacggcccagagctacaccatttcaggcgctccggcagccgcggccacccactgccgcgttccaggcaagccttcccggtcccgaggggcctcctgggctggatcttcaggtttctggactctcacccaacgacacacgcccagcgttccaagcccaaactgggctccaccttgtcccccacccttccagcaggtttccacgcccctgctcaccgtagacgtgaaagcccagcacacaggtgtaggtagcccattcccggtctcggctctcatagcgattcttcagctgcttgcagcctccagccacgtcccctggggagagggagcccgcccagctcagctctcaccctgccctcagtagggaagatgccagggaaagccagactggaaagactggcatgaaacccggcgatggcatgtgatctggtcaccgtagtagcatcacctcctccccctgtgaaacccaccctgtgtgcgtcctgtcctgagctctggctgaagttctaacagcttccacgagttcctcctccctagataagtcaagtgctccacacttgccctgagaaacttttcccaaacaatcttttcttagcgcatttttgaactccctcaagtcaacaagacatggtgtgaaactagttgtttccaaatcacgaaatttctcctacatataattccaactccactttaaccccatctccacttccttatctaacaacacctctaacagccccccctacacaaaacccactccaattaccctctccccatgtcctgctccactgccactcacagtaaagaatctcatagtccccagaattggacatgatgaaattcccatccttggaccagtcaagatgagtgatgaagctggagtgaccctgggagcaaaggtcaagagttttaaagtatcccatccatttcccatccccagagcccccttgatgcatcagacccctgagtttcgcagctgttatcatgccccaccacacaccccaacttcctcaccatacagcggccaaagcggctggatttggcaccatcactggaaacactatagatgtagatcacgttgtcatgggaaccaatggccaggtacaacccatctgcaaatacagtcactcagagagggaagggccagggacgcatgtgagtccagggttggggtggctcccacctgggctgtaccggaccactgagagctgctcattgccatcaatgacatcagacacgatctctctggtctctgtgtccaaaaccaaccacctggaagggagggaagtggaggcagataggaagacgaaaaggcaggatgtaaggagacccccagggaggccaccctgggtaggcttggggatggcaaataagagaagctcagagacacacacagaaaggctctgatgtagaagacaggtcacaactgcattcttcttttttagtttgttgttgttgttgttgttgttttgagacagagtctcactctgtcacccaggctggagtgcagtggcaagatctcaacgcaacctccacctcctgggttcaagtgattctcatgcctcagcctcctgagtagctagaattacaggtgcgtaccaccatgcccgtctaatttttgtatttttagtggagacgaggtttcaccatgttggccaggctggtcttgaactcctgacctcaagtgatccacccgcctcagctcccaaagcgctaggattacaggcgtgagccaccgcacctggccaccactgcattcttatgctgagaaatgggaaggagctaagtgtggataaaggctgaggggcttctgatgtcgtctgaaaaagtaatctgaaactacagaccaggggccgactacaaaggcactgtgcaagctggaagcctgtcacttccctgtgtttgtctatgcccctcccattcccactgtttctctatcctgggctgctgcctcctccactcccaggcttggaggagacactgggttgggggagggggagaaacagttaccacagaagaggaggggagcccgggtggcaggggctgcagggagaggcacagaggagtgccaaggcgcaggtggctcctgggtagaggtggtcactctcgcccactcccccagtaccaggaacccttcccagtcctccctgctttccctcctgggagtcctggctctctctcacctccccgtgttcagtcctacggccacaactgccccactcgggtggaagtcagcacagagaccagtctcctgggagaggggagaaggtgaattcaagatgatgtctttctagtgagggaaccagagtgaaccccttgtcctcctaacttcaaagccacttactcccaaggagaagatgggaagagagggaagggatacccgggtatcactggagcctgaacagggagtgataccaaaatatttaaccacagaactgatgccaatagctgtgctggagattaaccatttaggtgctggatcaagaggaagtctgaggggttctgggggcggcagggagtgcccaggtggtactagaagcatcagcttttaccagtcagtacagaaaaattaatatttgagtagccagtgcagccataccagtacaaactggccacctctgggaggcagaaggcaaggtgctggggaaggcgtggtggccacaggtgtcctggtgggtgtggcatgggggatccaggggcacagggctctaccttgaggtcgatgctccaggccagtgcatggctctccccatcccacaggcagagctgccggtcgtggccgcaggtgaggaagcggttctgggaggggtgtgtgcagagcccccagagctcatcagtgtggccctgcagcacagcatgactgtcactcctgcccctctctcacacccctttgtcccttcctcccctgagcccttaacccccaacctggattacaggggagaagccctgggccaggtctcccctcagcaatgcattcttcgtggttcccaccagcagctcagagccaagcccttcagcaatggctcgcacggccccgaagtgctcgggaatctgcagagtggtagcagaatgtcaagagcccactgactattgctcttctccctcactcccttgaccccagcccagccctcacctcagcctcctggagggccaccaacccgggcccccactgtaccagccggcggtcccgcccgccaccactcagcactgtcccgtccctccggagacacaaggcgaagatagaaccttcatgagcgtgagcctgggccacaatcccataggtctctgttggcaaagccccaggtagatcatgttttgggggtgcaggggagtgagaaacagggccagcttggctgtcgcaatacagtaagaactcccagccattgcatgcactgactactatgtctcatcctcatactgccaacacatctgttattctccccattttacaaacaggacaactgagactcacagaaatgaggtaacttcctaaaggcaaggcaactaatagcaaaactggaatctgaacctgagatctggcaaacacaaagctccagccgtttctcctttgctgtgctgcccacacgcttctagactagcccccaagagaactatcaactctcaaggtaaaaaggtgggaaacctggctgggcgccgtggctcacgcctgtaatcccagcactttgggaggccaaggcgggcggatcacctgaggtcaggaattcgagaccagcctggccaacatggcaaaaccccatctctactaaaaatacaaaaattagctgggcgtggtggcgtgtgcctgtacttccagctacttgggagactgaggaaggaggatcacttgaacctggaaggcagaggttgcagtgaaccaagatcgcgccactgcaatccagcctgggcaacagagtaagacctcatctcaaaaaaaaaaaaaaaaaagatgggaatgggaaaccctctcctctgttcccacagaacctctggagtactacacttcccagatgcccctcccagccacatacctttggcgccacccctgcctggggtcttggaatctgaagggctccgcccccaggtgagaatgttcccctctgagtctccagtgagaatgtctccatccggaaggaacacaaagcaagggataaacttgggtttcttgtatttctagtgggaggggagagcagacagtagaggtcaaagggaagggcaaagattaaaagtcgcagggcaggccaggtgcagtggctcatgcctgtaatcccagcactttgggaggccaaggcgggcgggtcacctgaggccaggagtttgtgaccagcctggccaatatggtgaaatcccgcactgcactccagcctgggtgatagagcaaggcactgtctcaaaaacaaaaaaaacaaaaaaaaaacgggcatgatggccaacatgatgaaaccgtatctctattaaaaatacaaaaatcagccggcgcgcatctgtaatcccagctactccgggaggctgaggcaggagaattgctcgaacccaggaggcagacgttgcagtgagccgagatcttgccattgcactctggcctgggtgacaagagcaagactccgtctcaaaagaaaaaaaaaaaaaggtcacaggggcaggtgggggttagggaacctcagggtccatagtactcagcccagtgcttcctcttccactctgccctccccatcaccttccacttatccatgcctcaccccaaagacaccctgtttccgggtaagggtcccattcccaggaacccctactccaccactccaattccagaagtggacgtgagatttcccactggtgacgatgcagctgctgtcacgagggttgaagccaacggccaggactgagtcatttgtactctgaagggaagacactagattcagccaccccaagccctgggtaccttcattctacttgactctcctcaatttgcatcatgacagctggctggcagaggtccagaaaccccaggacaacccttctttcaaaaccctggtcccctaagagcactatttcctgtcaatcataattaatcaccctaatacctaacacattatgcctcatgaggtcagaacccatgtcacaaatgaagaaactaagggtcagagaagctaggagatttgccccatgtgacccagccaaaaaggaaggaaatgtatgggtgagtctggagctccctgcactccaccactcccacccccaacctcagagcccctccaagccacatggactcctcaccttgatctcagccagcttcattccccggctgcagtcccacaccgacagcatgtgctcattggaatcatccaccacacaaagaaaggcaccctgatcctgaagaagggtgacacataggaggtgcagagtgaaccctggaggtccaggggttcatggtcattaggttaagaggtaccatcacagatggagagggcagaaaaagttgacacacatggccctttctcaagagaaccagctgggtggggttcaggaaggccagaacttccaaggcttcctggtgacatgcaagagtggggttcctaggcaagaatgggggtctagaggcttcagggccagctcaccgcagctgaaaaggccagggccccaacaccccgctcgaaggcccccagtccaatctcctgcagtttcaacagcgtctctgagtcccagatgtgaaccacaggctgcaggggctggtggaggaagagtcacaagtgtgaagcaaaattggagtgcaattccagcatgtctgcctgctccctgactttggccttacctttccatccttatccactccagctgtctgtcccgaggctacccgaacaccatcagggtgaacagcaaggctaaggcagggggaagacactctagggaaagggtctctcaagaccatccaagacaccttctccaagcttgcagagcagcaaggcaactcttttctcctgcttctccatccccccagaccctcttcctgccaagcccaccagccccggactcctcaccatcgaacgcagtctgtgtgcccccggtaatgtctctggccgccacctccaggaccccctgggcctcctccaggccggtacagcaccaccacacaggcgataaagtagaccacctccccagagcgcaacacaaacagattagagcgggagtcacgacccctgtacccataactggggtggagatcacggtcaaggaaagggttagatcaagggcaggaggaggaagaggggagaaagacagagcttctggctggcagggcctagagcagaatgatggtaggagaggatctagaaggctccttgtccccacagacccaggaggaaactgtaaaggtaagaggggtcccaaggtgagaaaggtggttctcatgggactggaaggggcaggatacacccagtcaaggctgagggtctctggcggtgggccactcggcagctcctcaaggctgcggatgccagacgggatgtacatggtaatggggcgccctcgaaggaacatcttcactgagatgccttctacagagaaaaggggtggtgtcaactacccccttccaggaaagacagagcagaaccctacccaccacacctacccaaaatagctcctggggctacagcccaaatcctaaccctgccatccaagttttcctctctgtccctctttacatacccaaattgtaattgctcctccgagatccagggcccccagggctggagagggggtcttttcccccacggctgttgggaagagagaaagcacagggattggggtcaggtcccaagacctaagcggggaggggcaggacacaagaaaagaggtcactgcagaaaccacagtcacttctgcaagcctgtagtttgcttcgtgagtatcagggccctagtagatggagacttctagttccatttaagagataagaagattgaggctgaaggggctgagcgcacagcacaaggccacaaagcttggaagaggcagtgcagggtgccagagccctttctctcctccagaccaccaggcctcagtctcgctctgtcgcccaggctggagtgcagtggtgcgacctcagctcactgcaacctccgcctcctgggttcaagcaattctcctgccttagcctccccagtagctgggattacacgtgcgcgccactaggccccgctattgaccttttcatttccccatccgtaaaatgggaccaaagggagtcgagaatgtacaccagctccgcctctcagggatccgggaggcaagcaagaaagtccacatctctccagagattcctgtcgttagataacagtaaagtgatactgtctcttcagagaataaagcacaggccaaggacagggctagaatgaacatccgggtgtcctggggcccgtacatactctgaggcaactacatccggccactaggatgtcctcttgccctctagaagtaagtattaatagattggtacttggtagatccagcggaaagagggctgaagctctagggacagccgtccatgaaagccatggaagcttctagaaaagcctcttgggatcgcagaaggtgtgctgtgatgtagtggaaagggtaggggaactggagtcaggaagagttaggttcaaatcctgactctagctgtgtgaccccaggcaaatgacttaccctctctgagcctgcttcctcacctgtgcaatgagcagcatgagaccacctaacccccaaggatgttgtggggactgactgagatggaggaggtcgagggtttagcacagtgcccggtacacagcaggcgccccagaagtgtttgtttctttattcctgttgggcaatcaggtccccccaccccaaccagggatgtgaggtgagggatatggaaagtcgagagcctgcgcctggggcggggtgggttgaggggaagcctcacccacctctctgtgctcccggaccgcactaacaggttggcggaggagattgccttcctggagagcttctgccgaggccgctctgagggggatgaggaggaggaagaatttcttcgcggcctggtgggggcatagtgaaggtcattccctccaactgtactctgcaatcctaccacccctcccagcttccgccacagggccacaggacacctacgtgtcagcacgctgtgggggctgcaagggcctgaggatccccggggggccaggggagccagcaccactgctgctgctgccccctccttcagattgggtcccgctaggctcttcgctggccccctgaggggctgggggtccattgctcaggccagggggtccaggggatgacttgagctccacctctgtctccgtctgggtgcctcggctcaccaaggaaggggtgcacgtgggtggcagtcctgggggggctgcaagactgctggagagatgttgaattaacctgaagccccagaggccccaaggaggaggaaaaatggggtgtgatgacatgcatacctgtcccccggaggagctggtgtgccagagccctgcagggaggaagggggcacctgcagccgcagcaggcgaagggcttctgccagggctgcctttaccagttccatctcctgctcctgcacccgaagccgctggctcagagactggagggcctcccgagcagggccgtcacctgggaaaagggcaagaggtactcagaatgtacccatcacctgaagaaagcgtagaggggattctgtctccccacaactttacatgtgtccggtaggactgcccctttcaggcagccccaggcttgaatgctcgtccagaggggaggagacggtggtaaaggatcaagggcctccttctggcagggcaggcgagaaacctggcaaagctcccttcctgctgccgtctcagcctccgcaaagactgggagtaccatggagtaccgggggggaaatatggagtactgccgaggaacgtgggagccacagagagaggcgccgcactggtgagggcagggaccgcagccctccccacgcgcccccagcaagctcaggtctccagcgaaagctgagtaactgagccgggggaacaccaggagagagaacggggtgcgggaatggagtcatactgaggacccagagtacaagaaaagagatccagagtgacaggagagagtgtgagtggtgagcagagtcacagtgaaggtctcagggggcagtggggatcagaaggaaaaagacctgaaataccacgagaagaggcccggagtaacgcagggggcagggaaacatcgaggggcccggagttacgtggggcgtagaatgacgctggggaagcccgaagtgacagcaagacccaagcaactagggagggcgaccggaggaactgtggaggatgctcggagcccctggggcggaggagcacgcggggacgcctccagacagccgtccagctctggcataacccgacgagccgggcgctccgggaaggggcacgccgcccgccccgccccgtactcaccgggccccgcggccccgtccatccggcccccgggttgctccgagcggcggcggcggaggaggcgtctaagccgcgggggccacggccggggagaggggaaggggaagcaccccggggcgcgcgcgaagggcgccgtaccaccaccccgagggggcgctgtcgggcgcggggaaggggcctggagggggcgctgtgggcccggggccgcagtctccagacccccccgggccctcggactctcccggggccgctctcggctcccgggggtggggtggcagggccgtccggtgccacagcgccgcagcacaaacaggcgccggacgcggagccgccaggaagcgcgggagggggggcgggcccgagggggggccgggccgcttggtaacccctccctgtccgggcctcgccgctcagtacgggggcggggctagccggctgaccccctggcctactcccggcctccggctccaggcccttcccggatccccgcccccggattcccaggggacggggaagggagcgcccgccccgatatctccgccccccagcccctaacccctcagggttgagcggaccaaccccaccacttccgcgaggggcaggggcggggtcacaaaacgggccctcggcctaggggcggagtttctcgtaaggggcaaggccaaggcatcttgtattggggctgacaggggggcgggttattagggctgaggatgggaggatgctcagggtattggggtcagggtggcattagcccagctcaagccgggccgggctgactcagcatcctgccccagccagcttccatccctgacacctctgcattcccttgggcagagatgggagatggcgccggtgttgcccctggtgctgcccctgcagccccgcatccgcctggcacaagggctctggctcctctcctggctgctggcgctggctggtggcgtcatcctcctctgtagtgggcacctcctggtccagctaaggcaccttggcaccttcctggctccctcctgtcagttccctgtcctgccccaggctgccctggcagcgggcgcggtggctctgggcacaggactagtgggtgtaggagccagccgggcaagtctgaatgcagctctataccctccctggcgaggggtcctgggcccgctgctggtggctggcacggctggtgggggggggctcctggtcgtcggcctcgggctagccctggctttgcctgggagtctggatgaggcgctggaggagggcctggtgactgccttggctcactacaaggacacagaggtgcctgggcactgtcaggccaaaaggctggtggatgagctgcaactgaggtaccactgctgcgggcgccacgggtacaaggattggtttggggtccagtgggtcagcagccgttacctggatcccggtgaccgggatgtggctgagtgagtgatttgcgtctcccttcctcctcctcctcctccctggacaggctccctcctgctgccttgaatccccacctcgctcagaggggcaataagtagaacatagtggctgagagactggttacagctctgccatttattagctgtgaaacccagggcatgttaccaaaccaccctgggcccattccttcacctgtaaaatggaaataatagtacttatctgatagagttgttgtgaagatgtgaattatgcttggctggcacatagtacagcagtcagtaaatgttttactattctttttcccttctgaacacctgtgcccttcagtccctcccccaggcctctatctccagacatcctaacccctctgtccctccctttgcagccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactgggtagcatgctggctgtcaccttcctactgcaggtgagtcagcaaagcatctgacacctcctcccacccgggactcctccctgcctccaaccctgggcctcttggaaccgctgactctccctgactctttccccttgcttcccccacaggctctggtgctccttggcctgcggtacctgcaaacagcactggaggggcttggaggggtcattgatgcgggaggagagacccagggctatctctttcccagtgggctgaaagatatgctgaaaacagcatggctacagggaggggttgcctgcaggccagcacctgaggaggccccaccaggagaagcacctcccaaggaggatctatctgaggcctagaggcctggagcttggggtgaggaagagggagggatggacaagtctgaaaacctcacaactccttaccaaggctccaggttggggggatcgtaggattagaggggctaaggatagtcagcgagctggactggggtaagaaagaaaaccagatgtcctagggcctagcccttgtagtcagaaccaccagggaacagcaaagaacagagtgatgggaaagtgacatgagaaggcctggaggctgattctgatatagactcaataaagtttttggatggaagcaattgctttttcttgtcaaggggatgggggcctgggagaactgatttctgtctgatggagcagctaggactccaaagtttggaccctggctcgacctgtgcagcaacaggagcccacatctgtaaggatcagaaagcaagaacccaatgtaagaagcaaaggaaaacaagaggcccctccaggttgagattctttattctggaggtaggaagggggtcagcatgctcaggtgggaagggtccagcccagctcctccagccccccagtgcatgcccagccccaataagttacccagttactcagctgccctccctcctgggtccatctgtccttctgttccaccctagacagggccaacctgactcaacacaagggctgcttgtccccagcctgtgggcagtgccacacggcaggctaggggaggggtgaagcagcaggaccatgccctgggcctggaggggcagaggggccacttctggctccaagggtcaggacttggaaaaccacatcctgggcaggcctggggcccagtcccacaaggtctgtgcctgaaaagaggtggtagttggggtggggccgccatcacacctcaattgctgggtctgagccccggccctgccgctgcagctgctcctcctgcttcatcttgggcttctctgtccgagtatgccacaccagtacctgtgccaggagggatgcagtgagagccaggcccagctgcagccaggcctctgggtccccgagcctggaatggattctctaaccctatcgacatatacagtataggcttcaaagtgtaaagggcagggtggaggaagacttagtgcctctaaaaccgggccttggccgggcgcgtggctcacgcctgtaaccccagcactttgggaggccgaggaaggcggatcacgaggtcaggagattgagaccatcctggctaacaccgtgaaaccccgtcactactaaaaacacaaaaaaattagccgggcgtggtagcgggtgcctgtagtcccagctacttgggaggctgaggcaggagaatggtgtgaacccgggaggcggagcttgcgctaagccaagattgcgctactgcactccagcctgggtgacacagcgagactctgtctgaaaaaaaaaaaaaaacaacaaacagggccttattccttcatcctctctgtgccacatgggttcccagaactcggggcagagtggcaggagaccactttcccccgctagttcccagcttccccttcagtagagtcagcaaggctgatcagagatctggagagtccctcctggttaaaccacccattcccagggtctcactgtacctcccccatcacctgtccatccaagagccaggtttctatgcccatctccattcccttacccgagtgcagttggcagcccgtggctccaggtccttgggatccacaaggtggctcagaagactgctctccaggtggccccggggagcggtggaatcaaattgggcattgggcttatctaacagcaagggcagggccacggcaaatccagccatatccacagggaagggcctgctgggctcccatgctgtgtggaagcccactacccggccgtcctgtacctgagggccctcgaatcgcaggccgcccaccagccccacaggccacactgagacaccacgggtccagcgcatctaacggaggtcgggagagaagaaacagaggggtggtccggggaagggagcagcagaaagagccacctggctcactctgccccactgcttccagcccctcacccagcagccaacggcaacactgctaaccaaggtaacgaatgaagctggccgcacctggtctcttgcccatccccatcctggtgctcacctcctcaaacagctcccggctgtaggtgttgtcatcgtcagcaaagtagacgactccttgggtccctggtggtggtgggtccttctccccacccacagcaccccctctgccccggagccagtccagggccttgttccgctgctcgacaccacggggatgaacccagccaggctcgccctcccgaagccgctgggctttgggcgtgaggaccaccaggtgtgtgaagaggaggccagaggcagccagcagccctgagaccagcggggtgggaccctcagcatcctccaccagcagccaatgcagccggggcaccaggctcagtgtctgggacagtcgtaccagctctgccttctgtaccagcctgcaggggagagatgcagcacaaggaaaaggggcaggcaccatttgcctgctccagccagggcagacagcttctcctgggccactgcctgcgtctcctgtggcccttcccaaccaatgcctaaactccctctttcttgcctgtcaacttcatgctaacactcacctgccctgttcttctggtccatgtccatcacccacctcaactccagagctcaggctgtgggagactataaattaagggcacagggccgggcatggtggctcacacctataataacactttgggaggctgaggcaggtgaattacctgaggtctggagttccagaccagcctggccaatatggtgaaaccccatctctactaaaaaaatacaaaaatttgctgggtgtagtggcacatgcctgtaatctcagctacttgggaggctgaggcaggagaatcgcttgaacctggaaggaggaggttggagtgagctgagatcgcaccatttcactccagcctcagtgataacagcaaaactccatctcaaaaaaaaaaaaaaaaggccgggcatgttggctcacgcctataatcccagcactttaggaggccgaggtgggcggatcacctgaggttaggagttcgagaccagcctgcccaacatggcgaagccccgtctctattaaaaatacaaaaaattacccaggcatggtggcagtcacctgtaatcctagctactcgggaggctgaggcagaagaatcgcttgaacccgggaggcgaaggttgcagtgagccgagattgtgccactgcactccagcctgagcgacaagagcgaaactctgtctcaaaaaaaaaaaaaaaaaaaaaaaaaaacaaattaagggcacaggctttgggatcaggtagatctgggtttgaaatccagttttgtaacttattatgtgagacaatttgggaaaatggctcaatctccctaagcctcagtttcctcaactgtaaaatgggaataacagtactttataacaatgttgttttaaagattaaataagagctggggatggtggctcacacctgtaatcccagcactttgggaagctgaggcaggtggatcatgaggtcaggagatcgagaccatcctggctaacacggtgaaaccccatctctactaaaaatataaaaaattagctgggtgtggtggcgggcacctgtagtcccagctacttgggaggctgaggcaggagaatggcgtgaacccgggaggcagagcttgcagtgagccaagatcacgccattgcacccagcctagatgacagagcgagactccatctcaaaaaaaaaaaaaatacaaaagtaaaatacaaaaaattactggccaggcatggtggctcacacctgtaatcccagcactttgagaggccgaagcaggtggaacacgaagtcaggagttccagaccagcctggccaacatggtgaaaccccatctctactaaagatacaaaaaattagccgggtgtggtggcgcatgcttgtaaccccagctactcggggggctgaggcaggagaattgcttcaatccgggaggtggaggttgcagtgagccgagatcgtgccattgcactccagcctgggcgacagagtgagactccatctcgggaaaaaaaaaaaaaaaattagcctggtgtggtggtgcacgcctgtaatcccagctactcgggaggctgaggcaggagaatcgcttgaacccgggaggtggaggttgcagtgagccaagatcacaccactgcactccagcctgggcaacagagcaagactccatctcggtgttgcggggaggcggggggaagaaaaaaaaaaaaggaacaaaccaggaatgtggaacgtggggcttggcctcttctgtacttctttatccttcagatctacctgcctgtcccagggctggttgtgtgtgcatgtcgcaggtggggtctagagcttcctatgcgtgaatgggacagccatctgattcccagaagatgtattaacacccttatggctacagatccaaaaccacattccccaattggttttattagtaaaaccaattacatttgatttaaaacaaaagcaaatgtaaatcactaaatacagtgcctgctagagagtaaacacactgtaagtaacagctggtataactatttctggaccctagtatgactatcaggccaagcactttcaacttttttttttttgaaatgggctctctctgtcgcccaggctgcatgatctccactcactgcaacctccgccgcccaggatcaagcaatcttcccacctcagcctccagagtagctgagattacaggcatgcaccatcacgcctagctaactttttttttttttttttttttttttcagagacaagagtttcaccatgttgcccaggctggtctcaaactcctgagctcaggcgatccgccagcctcgggctcccaaagtgctgggattacaggcgtgagccactgcgcccagacaagccctttcaactttaatcagggggttttaactttcttgccaaacggtccctaaggagagagagttaattcactgccaagctcaaaatttctttgaaatgttattgttctatcttataatttggtagaaattttgtattttccttctagaaaaagaactattttttttcttttttcttttgttttgttttgtttttgagatggagtttcactcttgttgcccaggctggagtgcaatagcgcactctcagctcactgcaacctccgcctctcaggttcaagggattctcctgcctcagcctccccagtagctgggattataggcatgcgccaccacgcctggctaattttgtatttttagtagagacggggttttgccatgttggccaggctggtctcgaactcctgacctcaggtgatccacccgcctcggcctcccaaagtgctgggattacaggcgtgagccaccacacccagcctgaaaaagaactattttcccacaaatatttgagtataaatgtggttcatttatcctgtctttggcatgctctagtttgaggaacaactcctagcccagtgcctccccaaactcctcatcatcaactccaacttcttggacaacgcagacctcttgagtgcaccagagcccatacctggcataggtgggggtaacaacatagatagtaggcagggcctcgggttcagggggctgggcaggggcagggggtggccgtcggagttccgcttgcagctgggaaatcctcagatccttctgccgtagctgctcggctgctgcccgcaggggaggaaggcagtcacatggctggcctggtcccaggaagcattaatggggaaagaaggtggggacagagaaccgcagaatgttcagcatcccaaagggccgtaatcgtctcattaattcctaaccaatgcaggtatcaccttatgacttccctagtagccttttctatacctctcgtgtgggaaactcactgcctcaagcagcagaccctctccaactttaataaattccattgttacaattttatgttggatattgagctgattccatcttttctacctgctggtcctaattttgccttctgggcttctaacaagctcatgtccttaaacaggacagtcttttcagagtccaaggtgccaactaaccattacactatggaaccccttttggacagtctttcaaatacctgaggataacgcagtggcactgtccctaaatctttgcataaggggcagggttcgatccattcccttggctaggtgaccaaagactcattgttaaattcattgattccatcgtaggataaatatttattgaatactcttcctaggaggcactgccttaggtgctggggatacagcagggaacaaaacagacacagtccctgccctcatcgagctttctgtttagtggaggaagcagacactaagcaaagaaacaaattaataacattattacaaactgtgatggggccatgaagaaaataatcaggatagagaataaaagggaatggaattaagaatggtaactttagctatggtggtcagggaaggcctctctgaggaggtgacatttgagctaagacctgaaggatgagaaagaggcagcccgggaaacgctggaagcaaagcaccccaagcagagggaacaagttaagtgcttgagagagtaatgagcgtggggttttcgagaaactgtcagcaagccagtctggctgcagcagagcgag

SEQ ID NO: 1075 - DNA, 21695 bp, Homo sapiens
gaattgaaaaacaatacaaaatatgttctatgtgagagaaaaataaaaaaaaactcgggctttccagaaactatttcctttggaacacagcttaccaaatcacattttaagctgtggccttctccttggcctttgacctcttctctgtgccatctgtgtattcactctcacttacctaaatgtttagctaccatctcatgtctcttcatattccagggctcttttccttgctccagacaggtaatcaggtctggcttagagacagcaatacctgttttattgaaaataaataacataaatcttgcacatattctccaattaccaacttggtaatgtgctcagtaaagagaatgcaatagaatattctagtaaattaatccccaaatgctaatttataacaaaaatttctaaagatttagaaaatattttaaatttgtagtttcttaatttcactacctggtactactgaatcaaaacaattgttgttgggagttagattttaaggtgtgggcaacaatattttatgccaataaatttctaaaattaccactaatcaagactgaatgataaagatcatctcaggaatgtggaaagttatggtaaagatgaaacatcttgaataaactattttctacaatgacaaatctaaaagatttttttgaaaacagggatctgaaactcaatttatgcaaagcataaatcaccaaaaacattctacaaaaaagagaattaaaacctttagggtatattagaaaatgtgtattgaagttaccttcacccaagaaaaccaggtttctgtagttctctcacatcacatgcctatataaattctgctgtgcagtgtccaggcattgccactcctccaaagagaattctatggccacatccataaatgtcaatggtccctgaaaaacacaaaaacacacacatacacaaaatcacatacatttaccaagtggccatgggcataattttaaatttcaaggtaaaataaaacagtaaagaaaactggttctgacttataggagtgaatgaaactatccataaaagaatttttaacacagaaatattttctaatgtattatctaaccctgagaaaagaaagtggtataagaagatccacaacatctgtgtatatatggtacttttctggataataaagtataaattagggcataaacgccaacatgtctatttttaaatgctatatctgcatcatacagaatgagttgtgtgtatttttgagatgaaaaagacatgttgagttaaaaggtacctcgcaagttttaatgtgtatgataaacttcagatctcgttaatgcagattattttttcagaagatctggaacagtctgatattctaaatttctaaaaagctcaccaataatgtcaatgtttttggcccaagaagagtattttgtcaaacatctagtaggtgggtgagcctgtgtttttcccagtttttctggcctgtaaaaagggatgacagctttcattttcctaaggcagatatacgcacagaaaacctaagaaagaaaggcagctgccagattaaatgtgatggtttacatgcacatcagcagcataaagatacttaataatgaagagaaaaataattatagtaaagaaatctgtccaagagctctttaaccaattgaatcattaacatcaactgcactaggacaaatttttgtaatgtgctgatgcacacagaaaaatgcagcttcactgctgcgatattgatctcaaaagtaaattagagtttgaatttaaccataaaaaatcagttttatggaaacttcaagatacagataattcatatgttctgtaatttttaatagtgattttaagtagtttttcttcagcaccctaaagagcaggtatctatctcctaataatttgtttcagaactttctgggtaataaatgccattctgtttgaaaaagcattttattaatcgtgttctgcatagagctaatggagaacagagatggtacctcaacgttacatgttctccttctttactaaagaccctagcttttccccaataggaatcttgagtagtcacaccttcccatgttcaacagccacagagggaacatttttcatgttgcagattataaattcataatgagatttctacgtggcatataaagagccgtgatgtagagatgtagagaagcctctggtatgtaggaaaaaatatttttcagagacccttgactatcataagaattttaaaaagtagttgaaacaaactcattagggagaaacaacacaattagagaagtaaaggtttgcaagaactaaatgcatggcattccaggaggcagagtggacacagctctctatctgagacatattaagcttaaaaaaaggtcatgtcttcctctttctcctgtttctctgggattccttttaagatgagattctatggacaaattacacctgcatgctgagaatatgcttttaaaagtgtcagcaccacctgtttacctgctaccaccacacccacagagatagacagagatagctctaagagctctgtgacagcccacctcattcacagacaccatgggatagtaatggggcctctaaaacagaaaccaaaagcattcaagagaaaaacagctctcactctgagaaaaattgtattgagagaaaaacagttaaaagcatcttttaaaaacacaagctagatataagtttgatcaagtcagccagaaaatattctgctaatcaatttttctaaacacccaaattgcacagctactctcagcatgagaaacgtgagcattatgaagaaaggggtcatattctcagcagaattttataaggattctcttccatctctgctgctctctcttctcctagccattaaatgagagatctataatggaatatatttgacaatttccaaagaacactttttttttttgagacggagtcttgctctgtcatccaggctggagtgtagtggtacaatctcagctcactgcagcctccacctccagggttcaagggattctcatgcctcagcgtccagagtagctgggattacaggcatgtgccatcacgcccaactaatttttgtatttttagtagagacagggtttcaccatgttggccaggttggtcttgaactcctgacctcaagtgacccgcctgcctggacctcccaccaccataactttccgatgaagaattagaatattactttattcatatagtggaatacatttgagtttgcatcatggtgaactgtagagctattatggtttttgggtggccaaatcattcttgtttacttttcccgtaatagcaccattccaatttagtgaaatgatagacactaaaatcatgcttacctataattaactctactggataaattagtaagcatgtcatactaatattactgtaatagtttggtagtaaatttcctttgaatattagatataaatatctaagtataaataatgtactagtcataatgtacataggatttttaaaaattgtctacaaccataattcaattaaaacagtttatatttcaaaagtatgaatataacattattttttgtttgtttttttgttttgaaacagtctcgctctattgcccaggctggagtgcagtggtgcaatctcagcccactgcaacctctgcctcccaggttcaagcgattcacatgcctcagcctcctgagtagctgggattacaggcacgcgccaccacgcccggctaatttttgtattttttagtagagatggagttttgccatgtcggcaaggctggtcttgaactcctgacctcaggtgatccacccaccttggcatcccaaagtgcagggattacaggcatgagccaccacgcccggccgaatataacattattaaaatgactaagggattcaaagtaaatattgtagtgttatattcacactagtatataaaatactgtttatatgaatgcagtttgtctacaaacactacatataactatgctaattgtactcaagtaataaatataaaccaaagcacaactacagactccactgttcagttcatacactgaaccatgcttttgcaataaaagtacttcggcctgcaaatattacctgattaccttggataatctgtattctatcaaaggaacttagtatcttttagtctttagcattttttattgctaaatttaatcctatcttcatgctcaacttttgtgtgctcttaaaacaaactttaatctaaacaaatctgtgtctaccttaaaagacaacaaatggagaaaataaatctttgccaaagcaatgaacctgaggtcctagacaaagacaatcccaagtcaaaaacagtgacaaaaggtttaactgttaatatgatttacatatctttcaaacaacagagaaaaaatatacataaaatttaaatgctttaaggaaaaataaattaagaaaatatactcctggcagggtgcagtggctcacacctgtaatcccagcactttgggaggctgaggctggtgaatcatgaggtcaggagtttgaggccagcctagccaacatggtgaaacctcatctctactgaagatacaaaaaattagccaggtgtggtggtgtgtgcctgtaaccccagctactcgggaggctgagtacacttgaacccaggaggtggaggttgcagtgagccagatcatgccattgcactccagcctgggcaaccaggtgagactccatctcaaaaaaaaaaaaaaaaaaaagaaagaaagaaaatatcctcccttttttcatgtggagaataaggcttcttatttctaatttgtattttccactataacagccaggtctctggacatgtttttgaactactggacatcttaattttgcatgccatgtgcacttgagaaatgtttatgggaaaaaagcagaagaaagaaaggtgttataaaaaaaaaatccatgggtgtatcaatcaagaaaaatgacaagaaaagtctcaatcattttaggagatttatttcccaaagttaagaatgcacagctaggaaaaaggcctatgtctttctcccaagaaaattttgggggctccaaatttaaaggagaaagaatgagatactgagaagtacaaaactgttatgtaagagggaggtagggaaaaacagtcattcatgtcattgtctgtcagtgaatctgcattttttttaacataagatgatgcagacaaatggcacagacaaaaaatgcaggtaatctgcatttttacataagataacatagacaaaaaggggcaggggaacaatcagatatgcatttatgtctggtggaacgtgtaaagataagccatcaatttatatttccatggtataattttaacagaaacaccttagggtaaagatcttgcagctcactagaaattttcttgtgggcaaaatatgagggagtcatgtaacttttcatcttgtagccatcttatttaagaaccaaaaggataggtgggtttgtgtgacccagttcccagcctaacttttctttttggtttaatgagtttgggctctgaagatttcatttcctttcacaggtacacatgaataagaccagttctaagagatttatatttagattctgacagaataattttgggagactacaacaccccacagacactattagacacatttttgaggcagaaaattaacaaagatattaggacctaaactcaatacttgaccaaataatcataatagacatctacaaaagtctccatctaaaagcaatataatatacattcttctcatcaccaagtggcccatactctaaaattgaccacacaatcagaaataaaacaatcctcaccaaattcaaacatccccaaattataccaaccacacactctgaccacaacttgatacaaatataaatcaaaacaaagaaaaccacttgaaaccatacaattatgtggaaattaaacaacctgcatctgaataacttttgggtaaataataaaattaaggcagaaataaaaaagttctttgaaacaaatgagaacaaagtacaacataccagaatctctgcaacacagctaaggcagtgttaaaagaagaatttatagcactaaatgctcacataaaaaagttaaaaagatctcaatttaacaatgtaatatcataaataaaatgagagatgcaagacaaaaccaatccctaactagcagagggcaaaaagtaactaatctgatctgtactgaaggagatttagatgtgaaaaactatacaaaagatcaagaaatccaggagttaaatctttggaaaaaattaataagctaaataaaccacgagccagattcataaagaaagaagattcaaataaagagaattagaaatgacaaaaggaacattaaccctgaccccacaagaatacaaataactgttgaagtctactataaacacttctatgaacacaaactaaaaaatctgaaagaaatagtaaattcagctgggtgcggtggctcacatctgtagtcccagctctcagggaggcaaaaggtgggaggatagcttgagcccaggagtttgagacctgcctgggcaatatagtgagaccccgttctccacaaaaaggaaaaaaaaaaaaaaaagaccaaaaaaatagaaatagtaaagtcgtggacaaatatatcctcccaagactgaacaaaaaagaaatcgaatctctgagtagaccaataacaaactccaaaactgaattagtaatgaatagcctagcaaccaaaaaaagcccaggacgagagagattcacaactgaattctaccagatgtacaaagaagagctggtaccattccttctaaaactattccaaaaaattgagaaaaaaacactccccttcaactcattatataagaatgtcatcattctgacaccaaaacctgacataggtataacaaaaaaagaaaactttaggccaatatccttgatgaccattgatgcaaaaatcttcaacaaaatattggcaaattaaattcaacagcacatcaaaaagcaaatccattatgatcaagtaggctttatccctgggatatgaggctggttcaacatacacaaattaatatatgtgattcattacaaaaacaaaaataaggataaaaaccaccagattatctcaatagatgcagaaaaagctttcaagaaaatttaacatctttcacgttaaaaacctgcaacaaactaggcatagaagatacatacttcaaaataatgaattctgtatgacaaacccacaacaaacatactgagtggacaaaagctggaagcatttctccatgaaaactggcacaagacaaggatgttttctctcaccactcctattcaacatagaattggcagccctcaccagagcaatcagacaagagacaaaataaaaggcatccaaataggaagaaaggaagtcaaacttcccattttttgcagatgtaattctatatatagaaaaccctatagtctccacagaaaagctccttaaactgaaaaactgaaccaaacttcacaatacaaagcaaatgtacaaaaattagtagcatccctgtacattaataacatccaagccgaaagccaaatcaaaaacacaatccccttcacaactgccacaaaaagaataaaacatctagagatacagctaaccagggaggtgaaagacctctacaacaagaattacaaaacactgcttaaataaatcatatatgacacaaataaatggagatttattttatgctcatggataaaaaagatcaatatcattaaaatggccatactgccaaaagaaatttacagatctaatgtaattcctatcaaactaccaaaaacattcttaacagaactaaaaacaactattttaaaattcatatagaactaacaaagagcccgaatacccaaggcaatgtatacacacacacacacacatatatacacatatacacacacacacacatatatataaacgactcatagaacaagaaacagaatagatagccaataaataatgccacaatgccacacacctgcaaccatctgatcttcaacaaagcttacaagagcaatgcaggaagaattccctatttaataaatgaggttggaataactagctagcactatgcagaagattgaaactggatgcctttcttacatgatatataaaaatcaattcaagatgaattaaagacttaaatgtagaacttaaaattatatatatatatatatatatatatatatatatatatatatatatatatatatataaaacctgaaaataatctagaaaataacctagaaaattctaagacataaaaactggcaaagattttatgatgaagataccaaaagcaattgcaacagaagcaaaaattgacaaatgggacctaattaaactaaagagctattttgcagcaatggaaacaatcaactgaataaacagacaacctacagactagaagaaaatatttgcaaactatgcttctgacaaaggtctaaaatctagcatccataagaaacttaaacaaatttattttaaaaaaaaagaagaagaagaataagccaggatctgtggctcatgcttgtaatcccagcactttgggaagctgaggcagatggatcatgaggtcaagagatccagaccatcctggccaacatggtgaaaccccatctctaataaaaatacaaaaattagctgggttttgtgtcacgcacctgtgatcccagctactcaggagactgaagcagaagaatcatctgaacctgggaggtggaggttgcagtgagtcgagatcatgccactgcactccatcctggtgacacagcaagactccatctcagaaaacaacaacaacaacaaaaagaaaaccaaaaacctaattaaaaagtaagcaaaaacatgaacagatacttttcaaaagaagacatacatgtggctgacaagcatatgaaaacaaaattcacgttgttaattattagaaaaatgcagagaaaaaccacagtgagataccatctcatccagtcagaatgcctattgttaaaaagtcaatgacagatgcgggctaggttgcagagaaaaaggaatgcttatatgttgtgggaatcaggaggccggagagatcactgggtgcaacaggaaggttttatttaggtggccactggcccagcggattaacatccaaaggctgagccctgaacaaagacagggcttgacttttatacatgcatcaggcaggggcaagtcgggtttttggcgcaaaacctgcgaggtgagaaagcagtcttacagaagcagaacaaaggcagttaatcataccgtgacaggttttacaacaggatttgcaacatgagcctaccttacttaaacatgtcttgtgaccttgccatgctacagaaagaaaaacaagaacttacaaaatctttacagacttgcagaaatagttacaaaaatagttgtgagagcagaacaaagaataatgttatggggagagaatttcaaacagggaaactgataaggagaacttgtttttctcatccctgctcctggagcccactccttcggagcccctgcctggccttgcagataattatcatagctccagcaggactttggagtgagtcagactggtcaggaaaggacttgttttccctttacttgtttttccttttatatttcctgcttcattcccccctttgatgctttttataagtaaagtttaagagaaagcatcactatcttcatttacttcaagaggaagtagctcttttcttggcaggggttaatacttagttagggccattagtcgtgtggtagtccgtctgtccacaagagcctctatggctgtttggatatttttgacaatgaggggtaagagacaagggagtataaggcaaactcccaatatggctaggactatttgtactaaggttttaaatcctccaagggatgagaaccaacctctgaaaagggaatctggagactatcctttccaagtctgaactgggatgtgagctaacttttggattttagcagttatttctttgatgacctttccttcgtcatcaagttccaggcagcagttagtaaggttgaactttccgcatactccctcttcctgggctaggaggtagtctaaggccagtctattttgataaatgacatttctcatttttgtggcttgctgggcaagcagattcaaggcccctgcagtttcattggtaatgatttctagtactgcctgcaatcttataatgcggttaagcatgtaaactggggtgcggtatccccacattccatcttctgcccaggtggctgggccataatattgaattattctttcaggaggccattcattgtccttccaatctcctatagttatgcctcttttgcttttccttttagtttcatcatagatggggtatcctaaggcttctccctgttttaggggcattaggaagaaggacggcctaattgtccccagtacacaggcccctgaccatttagctggcagttgtcgatatgcttgtggcccacagatccagtagaggccagagggtgcctgccaggtatttggagcttcaagttggtaccaagaatggtttaaagatgggaaacgagagaatgggcttgggtgtggtgattcagaattattgcttttgcccctccataaagtctttcctagtgtctcgttgtaatattgttgtcctaggcaagttaactctcctactgggtctgtaaaggcctttccccagcgagcaatacagaattttccaataatggaggtttttaagaaccagatgctctgacttgatggtgcaggttcgagggaagaggcggttagtgtgaaattatcttggggcattagttcccttgcttcccatggccattggtctcccatgttcattcccccacagacataacatgaagcaacgtgcaggctgctggctatgttttcagccagttgggcgaataaattactggccaagggagggggctcaggcaatttctggttaacatgctcatagaatgactcaaaaactcggaactgttgggttgagcgggtccgagttttctttatgatatatagatagacataggctcctgggccaatttcttcaccgctgactcgtgcccctagcggtgcttttaaacctgttgtccatatgggctgatctggctctaagatggtaagatttacagaattgcaagtgcttgttttacaatctggttctaatggtattttggtaagcataattggccctagtgattgttggttagtggaccacgttgtgcagtcccagcaagttgttactggggaatcggtggaacaagcagggtgtgcatacctatttttatggcagctactatagtactccatggaactgaagattacgggaaagagtgagcccatggatactatctggcaaacatcaaagtataaggatacgacatccttgccagagggaaataccttggtttggtttagaagatccccttcctttgacccgacatgaatttcaaaccaggtcccaggtgaagacttagggtcataacacacataaggctggccccttcctgggtcacagactgagtaggttgtctggttgtgagtacaagttcctaggcaggtcccagcacactcataataagtgtgatacaacagggttttagtcatgatgttccccgaccacgtagtgtgggtgcagtggaggcatccctcccagggttctccttttaacatggataaggggagtagcaagaacaaagtgatgagtagcatgttcatacccagcatggacagaaaaggctttttcctggggggagaaggctaagcaaagtgacagcttaatagcaaagtaattaatatgacaaggaaaattactggacttcagatttctaaccacatttacttccctgatgatgactcaagcttcggccgtgcatagactagtcagcttctggggtgactagagcagggctgttgtctcctcaagcttcagccgtgtgtggactggtcagcttccggagtgaccagagcagggctgttgtcatctcactggcaccttggttccatcgtaggatcagctgggttgcatggtctaggtcctgttggctggtccacttgtcctgggctgctggtttcagctgactggatggatggatccaaggcacaattcctgcaactttaacaacagtgggaatagacaagattacagtatggagcccatcccatatgggtcccagagtggttgggttttattttttgacccaaagagagtccctgggtttaaaggggtgtattggatctatcaggcttatgggcattctttcctgtacccagccatggacacttcacatggctatccctaaagcctgcatttgcctccttaaagttaattcccctagttcacggagattacccttaatttgacttatgattggggatggcttgccgaacagtatttcatagggcgaatacccagtttgtttggtgggggtgcacctaacttgaaggaggaccatgggcaggacttgatcccatctcagaggggtttcttggcaatatttcttcagtagctgtttgagtgtccagttcatgcactctacttttcctaagctctgcagccggtaggctgtgtgtaatttccattttatttttaacactcgtgttagttcctgaattatttcagctagaaatgccagcctgttgtctgaccctagagtcacagacagtccaaatctggggataatgtttcttaatagtattttagtcacttctcatgagttcttgcttctggtagggaaagccttggcccatcctgaaaaggtgtagacaagtactaacatgtaccgatagctccctgcctgaggcaactctgtaagtccataagcaggttttcacagggcatggttcctatttcctgaattcctgggggccgagtgggccattgtcatgggttgttctgggcacaggttaaatattgttcacaaacagcttgggtgatggcagtgagtcgcggcacatagaaatggcgtcctagtagcgtttctagtgctgtttttcccacgagttccatgatgcaattacttcacaaatttgggggccaccattttgggaatggccgacctcccatcagaaaatttccaccatcctccttcaatatattttccagttttttgggcaaaacaggccttctcattcggagagtaacttgagacctcctggaggggaggctctgggaggaggggcatagctaaggcttcctttttaaaatgaggtgtaaccattgctgcccattttgcctccctgtctgcctttctgtttccttttgcctctgacgtccctgccctctggtgtcccctgcagtgcatagctgctactttctctgggatccatacagcatctaagagctgtagaattcattctttccattttatttctttgcctgtggcagttaagagtcctctttctttatatatagctccatgaacatgcagtgtggcaaaagcatatttggaatccgtgtaaacactgatctttttgtcttctgccagctggagaaccctcgttagggctgctagctctgccttctgggctgatgttccagcaggctgaggctacgcctccaccactgagtctaaggtcaccactgcctacccagcccagcagaccccttccagcacaaaactgcttccatctatgaagtattctacatctgggtccttgaaaggctggtctgtaaggtctcctcgactggagaatacctcgtccactgttgccacagtcacggaaggtgattcccggtttgactgggagcagggtagctgggttaagggtgttcactgtttctaaagttatgcgtggattttcacataggagcccttggtatcaagtcatcgttgggtttgataaccaatgctgctctctctgatccattaaagttataaccgcatgtggtacctggatggtcaattgttgccccagggtcagtttgtcagcttcttgtgtcaatagggtggtagtggctagtgctttacagcaaggaggccaccctagcaccacagagtcaactgtttggataagtacaccactgggcgatgccatgatcctatgatttgagtcaggacccctatagccattccctttaattcatggacatatagaaagaaaggcttagtagtatctggcagtcctaaggctggagcctgagttagggcttctttgatttgtttaaacaccttcttctggtcagcctttcagaggaggggttccttttcaccctcccttgtggcttcatataagggcctggctataagtgagaaatttgggatccagatatggcagaaccctgctgcccctaagaattcccctatttggcgccaggtggttggagttggaagtgcacaaatggcttgctttcatccatggccaagccagcgttccccttggcttactatgaagcctaaatatttaaccttttcatggcaaatttgggccttctttttggatactctataccctgctttccataagagatggaggaggtcctgggttccccagtaacagtcctcttgggttggggctgccaaaagaaggttgtctatgtactgcaacaaggcgcagttgtcatttggtggggtgtatgccttgaggtctgaggccagtgcttccccaaagattgtgggagaattcttgaacccttgtgggagactagtccaggcgagctgtccccctgtgcctgtgactgaattgtcccattaaaatgcaaagatgggctgactaactggtgccaggtagagacagaagaaagcatcctttaagtccaggactgtaaaccaggtggcacttgctagaataagtcccattaaagtatacaggtttggtactactggatgtatggtcaccgtggcttggtttacagcatgcaagccctgcaccggtatatactcatcagatcctggtccaggcaatggtttttgtaccagcaaaagtggagtgttccagggtgactggcattggattatgatcccatggtcacagagccactttaaatgcttataaatgccccaaatatcctcttgggaaagtgggtactgacaaacctgaactggagttgctcctggttttaattctactaccagtgcctgatttacagccagcccaggtggcttgtcttcagcccatactccaggaattttatcaattggcctaaataataatttctcttcctcctgcgtacaaggctgcattggtgcctgtacttcatgtatagtctccattcctcagcctgcgggatggtgagggttaacaccatggcctttggttgagttaggcttaaagtaatatctccttgtgacccaaaggtaatctgtgcatgcaatttttggagtaggtctcttcctagtagaggcactggataattggggagatacaggaatttatgttggacctctcatcctccaaagacacacctccttggctgacaaaatggcctcttctctgggacccctgtagccccaacaatagttgtatgatctttggatgatggccctatgggctgggtcactaccaagtgttcagccccagtgtctaccataaagttcattagctggcctcctacttctaatgtgaccatgggctcctggggggctaaagagaaggagcccagtctggcctaatcttcatattctccagttcctgccagcctgatcaagtaggtatctgactcccttgggacacaatagcccttggctggcagttttccagttttatagtctctgtcattttcttcattgccctctggacattcacctttccagtgtcccctctttttgcattgcgcacattgattcctacatagtcttggttgactttcaggtctctgcctggcctgaacccctccatgtccatggctatgtccacacccactcgcgatgctagtttcccttcctgtgaggactgccactagcagatcggcctttttcttaagtctgatcagcctctctttgtctcctggttacggttaacatacaccttggtggccacttctaaaagctgagtggcattcatgcccgtgaaacactctagcttttgcagctttcgcctgatgtctccctgggcctgtcctacaaactctgcgttcaccatgcactggttctcagtagcctcagtgtcaaacggggtgtaaagctagaatgctttacagagtctctcataaaactgaccaggactttaattagtctcctgcagcacttccaagattttccccgtgttgactgcctttttcccaccttcctttagcccttgcaggagtgcctcccagtacctctgtaggtactgtaattgggctgcatcatttgggtcccagtgtaggctggcttctgggaattggccctgagcatatatgcctggacattaagtgtgccttctggtgcattgtgttccagccagtggagggctgcctgggtcacccttcggcattcctcggtgttaaacagtgtcaggaggagctgtttgcaatctggccacgttggattttgtgtctgaaaaatggactgcatcagatctgtgagggcttggggcttctctgtgtaggagggagtagggagtatggtgtttccagtttaggagatcagtggttgaaaaaggctggtaaataaaagtcggttgcccccccttgaacctgcccctgttcatcataatagataggtccccgtgtttcacggaggggcatctgccacactctggtgtggccaggtcgaaggcggcctgcttgatcatcctgactttccttcttgacctcctgaggtgggggctcagatttccccctttgaggtgtagcctggagtgtgtcaccatctgagtctggctgctcaggggccgtccttggtaaagggggatagattggcacatagggaggaggggtttctatctcctctgctggttcctgcaaaactggtttttcttgtggctttccttttgtctctgtagctgacagtgaagctgatttttcttttactttaggcttggctcgagctatgagcgttttgcaataagaagccaggcaaggctgcagccatgcaggttgagtttgaactatatttagccatgagtcaatataaggaaattggtctggatgccctggctgtcctccgaccccagtcaccaccttaaatacacggccaattttttccctatctatagttccttcggccagccatccaacattgaaagagggccattctatttcacagagagttctcaacctctggggggtcaacttgatctcataatcccctgtataatcttacttaaagttccttaacatacattctaatgggatgggttttgatgacttccctcccatttcctcccagttatggcagaacccactcactcttcctttcatttcagactgattagaccgtgtcccttgcaggagtatttcagacacttcttagatttaatggagggttcatatgagtcctgaacccggaccaccacaatctataagttgtggggcacctccctaagccatatgccgtagccccaaaggatgtttgccactagtctcggtcggttccacacttcactcagatggtacagtctatgctaagagacctgtggctccacacacgtcactcagcatgttggttccttttggaaccatctctttcacatttattcacacacctccccacttccagtttcctttcttaaccaacttagtgagccactctcacgtcctgggtcagttggggtgtaggtttcttccaactttgcgagcccctctcatgtcctgagtcggattactaggtacaccccaggaggtgatcaggctccccttccatccttatgggacgggtcctgccttgggcccaaaccttactgcagtcctgtagcgtgaagtcctggaatcgtcctgtagccccttaggttccaatgcactgtcagggaggggcgccgggtcatgggagagccaatctcccctccgggttgaaggtctcccaatggtgccttgggtcacgggtctcccccagcccggggctccagtcccacagccaaaggagacagtaaacctgtagtctcccctcctggctggctcgccaaaatgttgtgggaatcaggaggctggagagaccacttggtggaacaggaggattttatttaggtgaccaccagcccagccgatgaacatccaaaggctgagccctgaacaatgacagggcttgacttttatacatgcaaccaacaggggcgggtcaggtttttggcatgaaacctgtgagacaggaaagcagtcttacagaagcagaacaaagacagttaatcataccgtgacaggttttacaacaggatttgcaacatgaccctatcttacttaagcatgtcttgtgaccttgccgtgctacagaaagaaaaacaggaacttatgaaatctttgcaaacttgcagaaatagttacaaaaatagttgtgagagcagaacaaagaataatggtatggggaaagaatttcaaggcggaaactgataaggagaacttgtttttctcatctctgctcctggagcccattcttttggggtccctgcctggccttgcagataatgttatcatagctccagcaggactttggagtgagtcagactgatcagggaaggacttgttttccctttacttgtttttccttttatatttcctgcctcatatacactgcctgtaggagtataacttaattcaaccattgtgaaaagaattgtggcaatgacagaactaaaaacagaattaccatttgacccaggcacctcataattgggtttataccccaaaaaatataaattattctatcataaagatacaaagacatgcatgttcactgcagcactactcacaatagaaaagacatggaatcaccataaacacctatcaatggcagactggataaagaaagtatggtatggcacggtggctcatgcctgtaatcaaagcactttcttttttgtttttttttgagatggagtctcacgctgttgcccagggtggagtgcagtggctcaatctctgctcactgcaagctccgcctcctgggttcacgccattctcctgcctcagcctcccaagtagctgggactacaggtgcccaccaccacgcctggctaattttttgtatttttagtagagacgggggtgtcatcgtgttagccaggatggtcttgatctcctgaccttgtgatctgcccacctcggcctcccaaagtgctgtgattacaggcatgagccactgcatctggccaatcacagcactttcataggccaaggcatgtagattgcctgaggtcataagtttgaaaccagcctgggcaacgtggcaaaaccacatctctacaaaaagtacaaaaagaaaaattagccaggcataatggtatgcacctgcagtcccagcaacttggggggctgaggtagaaggattgtttgcaccagggagattgaggctgcagtgagccaagatcacatcactgtacttcagcctgggtgacacagtgagaccctgtctccaaaactgaataaaataaaataaaatatttaataaaaacaaaatatggtacataaatacaatgaataccgtgtggccataaaaaagaagattgtgtcctttgcagaaacatggacagagttggagaccattatccttagaaaactaatgcagaaacagaagaccaaatgcatgttctcatttctaagtaagagctaaataataagaacacatggacacaaagagagaaacaacggtcactgaggcctagtttagggtggagggtgaaaggacaaaaaggatcaaagaatacctgtttggtgctatgcttagtacctcagtgacaaaataatctgcatgccaaaccccccgtgacacaatttcacccacataacaaatctgcatgtgtacccctgaaccaaaaataaaaaattcgtgggtgggggatagcataatgtacgtgtaaggaatggtttgtgctacagatagtggtccaggtgggattgtcctctgatttatttctgtgtccatgcaggcagatgagattatgaacaggtggtccagaatcctagattggtggagagaacaggttgctgctgcagattcagtgtctgggaataggaatatgtcaggagactcgtagacacttttgtgggtttttggcaagaaacaccaggatgaaaaatgctgtggtgaaattcctaaggtggtgcctagtcctgggaggtgtgaacacatcaatgtctagtgggtatgtttgtgagtgggtggaaatcctgaggtggcagtggtgggaaaaggaggtctgctataagagctcctttcctctaagttttcagtcctctctcacagtgggagtgggaggagacctcaaatcccaggacaatgggcagtgtgacagcctgtgtacaggagagcagagtctctcattcccagacacccagagttccattccaggccaggcctctgagatgtctttcttctggcaccaaaactgtaatgtttgctgaacaccaagcaattcttcaaaaccaacacattgtctaaaatttgaattatgaccccacttaagagtcagcacagaccctgatccagggctcaatctcacaacactgtcttcactgcagacaccagtcacaaaccctataggtccatctatgcttttgagctactgtttaaaaattcaggactcccataaatctctcaagttcaataattttatagagctgctcacagaactcagcaaaatactgtagttatgtttacccatttattatacaaaatacaacccagaaaactcaagtggaaaaaatgtataggacaaagaaaagacgtggggaaagatgaagcacatagataatcctggtaaatagcgttaataaaattctctatcctttgtgttctccaggaacagtttatggaaagaaacatcctttcattatgacttagatggtgctctcttgtctgacttatcacataaccagacactgactctgcacattttcttcttttttgtattaaaaaattagctaaatttgtcttcagtggtcaaaataaaatgcttttttgtttgttttttgagatggagtctcactctgtcgcccagactagagtgtagtggcacgatcttgggtcactgaaacctctgcctccaaggttcaagcaattctcctgcctcaacctccagagtaggtgggataacaggcacatgcaaccatgcctggctaatttttatatttttttttagtagagatggggtttcgtcatgttggccaggctggtctcgaactcccgacctcaagtgatcccccggccttggcctcccaaagtgctgggattacaggcatgagccattgtgcccagcctaaaatacttcttaatcaaactttacttaagtttatctcctttccacaggctcctgaactttgagctactctcagtctgagccaacatacagccccattttatgttcctcctaaaaacttgctgacttcatggtaaaacaatttctgatctaaaatctgattttttttcatcctccatttgctattcccctctgaccttctaatcttttttgctcctccctaagaaagaaagcctttatctgtttaaactttgcaatccttaaagctcttatagttggt

SEQ ID NO: 1076 - DNA, 61514 bp, Homo sapiens
gtgtgtgtagaaaagaaatacatctcctaaacaactcttgatagttaatgagctcaaattttcattttggaagagtaattggatttatcagcagtagtagtggacaaaggtcctaccaacaaggatactggacatcataaaggtactcataaaacagtagtggaggccagacatggtggctcaggtctgtaatcccagcattttgggaggctgagatgggaggatcacttgaggccaggagttcgatactagcctggtcaacatagccagtaccccatctctttgaatttttcacttaaaaaaaaaataaaagaacactgagcatctcttagatggaaaagggagattccagaaagtaggggagggaacagcaaggaagactagagggcaccagtgtgagaacaagtcagctacccatcctagtcttgtgataaaacttgatcataaaaaatagtagaataaatgagatttgcttctagtttcattttaaaaaagaaaaaaaaacaatagaatagaaattaaaaatacatatcactttattatagactgagacacaaagatttatgaaaacctatatatttcataaaattatatattttttagtttatgaacacaaagcagagtaaaagtgagctctattacaacctggtaagattttttgaaagctaaatgaaacaaatgtttagaaaacaaatttttattaatatagggagatgattcataatgaaacagctcaaaaaagcagaagaatgttgctcaaagttcagaggaaaagacagtgggaactttagagctatgagtccctctgtttgcaaatgtggagcaaaaactctggcgcaaaatggcacccttggatgtcatgactgcccacaaagctggaggcccaggacctgtaaagcaagatcacgtccagtgacattcagttttgtcgagtaagacctacttcatccttgtgatcactcactctataactgtctaataaacactttccatgaagcgggccctttgcaaggtttaacaagatcaccgtttcccagtgctctgatgttggaatttgccacaagtgtaagaaaggtgtttttggggtgtgaaaaaagccttttccaatgcccgcttccatactgggtctcccttcctgccgaagcagatttaattgttttcatagtactatgttcccatttctgttgtgatacccttttatttcatagtaagctgtttggtgcttcgggtctatctcccctctaagctgagctcctcgggcaaaaggacaacgttcatccttgtatctgtagatcttagggggtgtcttgcacattgtaagcactctgtaaccatttggcaatattcagctctgcctataggcctgtggctcttcaagcctcagtttcctgatgagtgaagtggatctgacaatacctcctgcttcacagagttataatgagaatcaagcaagagtcctgtggcagcccttggcacaggcaggtacttgtggcgacacaggtcttctgggcattcagcccttcctctcctggtaaaagcactttgttttcttttgggaaatcccctttttgctattcttatgccatgtggtttcagtgtgctgaagtctacctgccccttccccagccctgttttccagggttgagtatgtgcaaagccaggtcaattacagccggtgaacatttgctcagggccttctcctgaaacaactgggaaaaggttctctggagtcatagggtaacttagatattaagctttgagctgcaaatttgcccacataaatagcctgcctgtgaacactctaaggtttcctaagatgccattaattacaagatataccattattttctacacttctaacgataaagaaatgtaataagaaattgtacattgcattttgatttcagacatgtgaaaaagaaaaacatgcattttaaaattgacgagatatggtaaaaccagcacagaagaaaaagagatgaagagacgccagtcctaatgatattgtttgatccctcaagtccatctgagcctaaattcttgagttattcccgcactttccaggaacaagagagtgtatttgtttgttagggctgctgtaacaaccataaactgattggcttaaacaactggaatgtattgcttcacagttctggaggctagaagtcccaggtcaaggtgcagggtttgtttctcccgagggctgtgaggaaaggatctgttcaacgcttctctccctggcttgtaaatggttgtcttctccctacgttatttcacagcttccctccatgtgtatctttgcccaaatttttccttctcataaaaacatcagtcaaattggattagctcctcacccccaaccctccagtaatgaccttattttaacttgattacctctgcaaagaccctatctccaaataaggtcacattctgaggtattggggtcgttatagaacctgtaacagaaggaatgcattcccttcatacaaaaaccaagttgaggtgggtttctgtcatttaccaccaagacttctgctcagtaaaatttaatttcctttccttaggtaactaaaagttctttaaaatcccagcaagttttcagaaatgaatgataatatgcatgagcaaaattttaatttaatcagttccgttccttctgagtcattcttgagggagaccagaggttcaggacgagataccgtaggatgagacccgggctctaattttgattcttccgttacaaatgaagttggccaaatcaattaaaaaaagaacagcaatttcattttaaaggaaagtagcatgagactgtgaagaggacattaatctaaggatgaaaatatctcctttagataaaagattctgactccaccacttgttctgtgatattaggtgagccactgaatgatccaggcctcgtcttctgaagaccaaatggaaatgcatgtgaaagctcttgacaaactatacatcgtgtccatgactacgttttgggggctttttctcacttcactgttgagtgtcgcagtccagacactagactctatacaatttaaatggattatctcatgtaatcttcacgatcttatgaagcagttcaattagctctattgttcctcccagttttcaaataaggaaaatggaaaattatttatttattttcattttattctgttgatcaaattattgggtcaatgtgcaatggctcacttagactagtgcagtcttggtttaagtcatttcagaggttacattatgctccgcggtcaccccaatcaaataaagagatggggaactttttctaaagtcagcaaattaacagctaatacattacacagcccagatttgaattcaagcaaggtaggctagacattaagctcttaactgagctggtataaaagggataatggaagctatctatggagatatactgatagatgtatatatagatatacaaaagaccaatggaaaaactggccacagatgtttgttaaaaatacttattagattttaaatgacggaattaaagcatgtgtttatcctctgcttctgaaaatagaactgctggctgagtaagtcccctggaggctgaaagaccaataagtggacagaaattcattactcttttattctgagaccagctgcttcatgcggaatctggcacttaccatacaaggaccactcttagctttataatcaatgtgacgcctttgtttagctgagcctctccatcttgtatttctcctcactaagcattctgttgctggctgtaattctcactgtgttgatgtattgatgtctatttcattgttccaggttatatttcactgagttttcaatagaaatgtccctttttgctacctagtgagtgggtgtccttcagcagcttaccactttggaactattattctgatatcccattgcaagtcacactttgtcattaaagtcaaaagagcaatatccatttcactcctatgactaagtcccaagttcaccaagaaagtgggtagcattctctgaactttttgtatttttaatttttttaaaaaaacaaaagcaaaaagttgaagcatggagataagcaaaaagttgaagcatggagataagcaaattcacttgggccatgagaaagtcgtggtaacactgaaaatcatgagagaagcaagtgctgctccaacggtaagaagagaagcttcctcagtctgaaccactgggcccaggatgtatgacttattaaagatctcatacaagaatgaagagttagcctggctgtgattgcagaggccctctcccactcattcaccttgagctcacctgggagtagctttgaaggccaaggtcagaaaaatgtatctttggatccaaacattctcaggattgtgcctattgtctttttgattccacaactccatgacagcctgctaccagctggaactatgtattcctcctcctctctggatctttgctattcactgggtacattcttcccactatgtgtcatagtgaagaatatagccatttggagtcagacagatactagcttgaatcacatcacataacagctttaggtctatgacactattacctgcttctctctgcttccgcttttttcttctgtaaatgagggtagcaatagttatcttccagagctattacgaggattacatgaggtagcacatgcaaaacatggtagattataaaaaaagttgttccttttctttctttttcccaaatcatccaaaggggatttagtcaattggtaactctgaaaatgttaacataatatctatctctccacagataaatacatatgctagctatccaaaggtaagttaaaagcagattccacagccaaactacacagggttcaaatccctttgtacttcagctgtcgcacttgtaaaatggggataacaaatgtgccatcctcatagcatcgttaggagtggtaaacaaattaaggatgtaaatatatacaactaacctgaaaaatactaattgttccctaagtattataattcaagactctaatagtaacacttattatttagatagataggtactgtcgatgctaatatatcaatcacctccaagaaagctttgccaaagacctatgccagtttccctaaaatgtatattttggagccagagataatattttttagaagtgtcattctgcaaaaatgcatttcatagttttttttttttttggtgaaggacaaaaacagaggctatttaaaatcgttttccctctgcagtagggaatgaggacagcatttactctttctgcattctctgtcctagattattcaaataatactcatcctgataactttggagttgtttaatttcactgtaaaacagctttgaaaacagctatattgcccaaacatctaagttctaaaaacatcagtgtctcttttagatccaggctgttagctaatttcaatattcatttgtctattcaaccagaagtttactggagtttactatgtgccagacaatgttataggagataggtaaaaatccctgctcttatagagctttcattatagtgaggtgagagatgctcaattaacaaatagataactagaatatgtaatttgtccaattgtatgtatcatggagaaaaataaatcagggaaaggaaaattaggtatcccaaagtagggctaggaattgcaattttaaatagcataattggagaatatctcactgagaagaaacctatgtgtattactgagcgaagtaaaggaccaagctacggggctatctgttggaagagcattctgggaagaaggaacagcgtatgcaaagccctagaggtgggagtgtacctggcatattcaaagaatggcacggaggctagatggctaaagtagagtgggcaagagcaagaagagtgggagttgaagtcacatgcacatgaagttacaagaatgttcacagaagcagtagtaatagaatcttgaaaccactcagatatctatcaatagtggaatgaataaattataatgtacttacataatggaattctacattgaaatacaaacaaaaaacaaactataggtgctctcgataatacagatgaatctcacaaacatgatgttgagtaaaagaggccaaatgctaaaggataaaaactgcatcatttcttttatatacatttcacaaacgaggcaacacttgcagtaaaaaggcagattagtagttaggacagagatatctgattggaaacgagctacgaagtgtcttctgggagggaccaagtagaagcaatatatgttcattttgtgataatttgcttaggatttatgctttctgtatgtatgttttacatatataatataatgtaatagtaatacaatattactatttataatagtaaatggaggaatttgagacaggaagtacaggattttttttttcaaaaagttttacgataacaggagcagagaaatgaggggaatactgaagggttattttaaagatggaagaaatgactgttacggaaagctcacttactcatatttaccattgctgcaaaacacctgttctattgtttacttaatcgattttcaacttaaatttacttaaaaagcaagtttcatgttaacactgtgtcacttgccataatagaaataaccgtaaaaatacaatggacacaaagtcattcgattaaaataatttaaaaatgtaaaaataattgaatgcaatcaaaatcaatcaaattgagctgcaaaaatgagcgcctaaaaataagttacttaaacagaaaaccagagccgttgatgatcagtcagaagaaaaaggatattctgttccatatatatgtaatagtcaccagcactgtgcacaattccttcatcttcacctttacactgcatacatactgttttgaacacctatccacattcattttaacagaggagcaaaataaaaacctagtcccatatgaggtgacaagacgatgctgacttgcccaacacttgaggttgtcccttgttcccatgtctctgatttggagggaagttgagctttagaaaaagcttcctaatgctgctgactaaaaagaacccccactcctatgtctcttcttagaaattactggtgtatgcatcagtgtgtgtgtgtgtgtgtgtgtgtgtgtgtgtgtgcatgtgtgtgtgtggtggggaaggtgctgctcagctgtggttctagcaaccctgcctgaaaccaggcaaaggcaggaggccatctagagggcacccacaactctcactaggccccaagtcattggctaagttccacactgtagaaaacactgccctataacaatggagacagtatcttccaaattaaaaatcaggcaacctgatatttcaacaagatacagtatttaaagataagagctggccgggcacggtggctcacgcctgtaatcccagcactctgggaggctgaggcgggcggatcacctgaggttgggagttcgagaccagcctgaccaacatggagaaaccccgtctctacttaaaatacaaaattagccaggcgtggtggcgcatgcctgtaatcccagctacttgggaggctgaggcaggagaatcgcttgaacccaggaggcagaggttgcagtgagccgagatcgcaccattgcactccagcctgggcaacaggagcgaaactctgtcttaaaaaaaaataaaaataaaaataaaaaataaaaaaataaagataagagcagcccagaaaacccataataatagtgccatacctaggacattcatgtattagtccacacatttgaaatgtttaaaatcaacactagtgctactgggatgtgaaaattcatagacataatccctgccctcaaagtaaggttgccagataaaattacagaatgccaagataaatttaaatttcagataaacagggatttcttttagtatatgtctcaaatattgcattagatatattaaaaatttatctgttgttcatctgaaattcaaatttctgggtgtcctacgttattatttgctaaatctggcaaccctacctcaaaaggttttcagtctattgaagggcaaagacaattcaaacacaatgagaatatgagaagtgtcaggaccaaagagccatcacagaatgcttgtgcatatcaaacaaatatctaacttagggaagacatttggaaactggtaacattggaactgagtcttaagctggaaacatatgggatataccatttatttcagcatttaataacatgccatcatgatttgtgacttaactgtctcataaacatgtgttttgtctacagaactagatcttaagttccttgaagacacaggacatctctttatgcctccatgccacctggaactgacaggcacacttaaggcagtagtaaattactgcacacattgatgcaaatggttttgtcctcccaaagagtaaaaatattctgttagtgaaatgtattgtaactagtgttttcttttccaattttagtctttgaacactgcagccaagaatacagtttgaaaccttgggagtcaaattcacagtaaatacatgagccgttcacagtgcagcaaactctcatgttagttttatgacagatccagtgacactggaatggacacctttttgattttggggttccttcctaagacccccatgtgtgatatattcatggttggattctaggtactgaagcagttactacagctggatagtccaatgagtgtaagaaggcttctctacaaacacatgctgcccacatcgaagttcctctttaatctactgcagtttgaaattgtcccccactttctccaagagtccactccaagctagtttagggttaggtctaccatagcctttggaagagggagggaagataacttttctcatctctcctagtcccagctctaaagaccagaaccagggagaaagcaacacagcttttccaaacacattccccaaatgtggcaccttttcaacaattttagtaacaaatttaaggcatcatagatgcctttaaaattggcatgatagatgttagagtgatcataaaaagactttaaaagaggaaaagatgtaaagaacgtaatcaaatggggagcatgtttaacaatgtgctcacttcttccccttcaattccttgaattgagtctgcattatcattcctattgatctttgagcccagaacattactttgtggtctggcctaaggtttcttccaattttttaaattacaatatccctaagaggacagcgacgaggtctggggtgttatgaggattggaaacctagccacaagtgaccatgaaagtccaaaatgcctctaaagtctttgtctctaaggcccattttcaaggtcttgttatatagctaatttttccccgacttatgtcaaaaataaacgaagctgggttctaggtaaaatggtaggggcagattttaatcactactactactgcaatggggaaaagaacccagcgtgaactgaattcaatttcgatttgtagaggcaaccgggcgttttaaagagaatgaaggaattaggatgggactgatgacgccgagggggactgagcaactttttcaggtttgaaaagcctcaacatcaacgcgcgacggcgctctttcaacatcagcctccagaactggggctgcagccaggagggaactacaacgcccagcagccccggcgggtgtaaacactcccaacttccgaggcggtgctcaccatcggccatcagcgccagtgccactcgcgccctcaagaagccgcacggagttcgggccggcagcagcggctgcagtcgtatggcagtgagccgctgtctacccagcgagacggagagctcaggacgcaaccctatgagttggaagccgcaggaggcggaaccgggttgcgggatacgcgttgacgtcacatcctctgggcggggccgcaaggaacccgcgcaaattgaaaggtcagcctttcgcgcgctgtgtaggcaagttacccgtgttctgcgttgccggccgtgggtgctctggccacagtgagttaggggcgtcggagcgggtttctccaaccgcaatcggctccgctcaaggggaggaggagagtcccttctcggaaggtgagaggagcgggctgtgcggaggctaatgggtgggttcccttgggggtcgacctgcgcgtcacctccgaccctcctctcgggattcgggtcttccaggaagggaaggagagggtctggcgtgatcttcccaacccaacagcggagcccttagcctgagtggagtatgtgttttgttccgaggggacgtctggcaaccagaggtctgcagttcagtgaacggagggagataagagagcagacgattccgggctggagcaggcgccagggttgccagacttacctcatttttccgcagaagctggcagtccaggttttacatgcaatctctccacctttaaatgttgacaagtacattttcccataatattttgcaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtaagagactgtttttctgaaactgtggcttgaggaccacctgcatccagattaactgctttgtttaaaattcattcacagcagaactagtgaatcccagtcactgagtggagttgagagtctaagaacctctgaaatttgagaactgctggaccagagcctttagagctctgataaggtgtcaacagggtaaagctgcctcctgatcctgtactttctttcttcctttccttccaaacttaacgtttgataggagagatttgtattatgaaatgctaagcaactgctcagtgcccattactgactttttattgtagagtggggggaggtcgtttcatcagaaagggttgtgacagttccagaatctctgtatagaaagggcttagggggctgcaaccggaatggaagggggtggaaagttaaagcatttgtcttgaagctgtatttgcatagcagacgcagtttcacagttctttagggtagctttcagagaggctgatggagttgcccctgggcgccaccactgtttattaccagaatgttcgtgcttagaataatgcgttctaatagcagtgaatttcagtcctaaaaaagtacaggatcatttctgtaattctttttgaatttttcctttgttttttaattgaaatacttaccttcctacaaactgttttgagtttctactcctatttgaatttgcacgttgacccttatgattaatgccctttgtagaggcaatgcgatgccatcgcatgcatggttttgtttgtgcctggctccttgaagcatgtgtcaggagtgaaagtgcaaaagcactttggaaagactaaacaaacaataagcaacagtcaagtggcattagaggtagtattagtgattaatgtaaattctaccctatggaaattgtttgatagggaggagcccagctaaaatattaaagagcagtgattcttgaatatctgaacaatttctggccgggcgcggtggctcacgcctgtaatcccagcactttgggaggccgaggcgggcggatcacgagttcaggagatcgagaccatcctggctaacatggtgaaaccccgtctctactaaaaatacaaaaaattagccgggcgcggtggcgggcgcctgtagtcccagctactgggaaggctgaggcaggagaatggcgtgaacccgggaggcggagcttgcagtgagccgatataggccactgcagtccctcctgggcgaaagagcgagactccgtctcaaaaaaaaaaaaaaacaacaaaccaatttctgcattggactccaagctttctcttcatttgtctaagatgttttaataaatgtatttttctttaaatattactgttctccctgtctcttttcatatcaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtaagtctggaccttatgttaattctttgacaattaagaatgagacctacagtgcctttttttctcccccagaaacggattgttttcactcaatgccagaacttatcaggaagtaaaagttgtatgttttagaatattcccaaatcagggatgacttccttctgtgataataggcctagttttctttctttataataagccagagtatcaagacactgatggacaaagactattaatatctcctttattctttttttttttttttttttttttagatggaatctctagctcaggctggagtgcagtggcacaatcttggctcactgcaacctccgcctcccaggttcaagcaattctcctgtctcagcctcccaagtagctgggattacaggtgcacaccaccatacccggctaatttttgtatatttattagagacagggtttcaccatgttggccaggcaggtctcaaactcctcaagtgatccgcctgctttggcctcccaaagtgctgagattacaggcgtgagccaccatgcctggcccaattcttaacctaagataaattttttaacaaatgctttgaaaatccgtgatgatttctgactcccacattcttgggtacagaaaacatactgctaatcctggttagcaaaaaaacaaatgtgttgtaaaattcattataatttcatatttgctttctcctgaattttgctttatgatcagcaggtcccaatcattgttccataccaatgcaagttcactgtcactgatctacaacacatagaaaaaataaggataacaatgtagtgagtctttcatcaagatgacatatttaaaaggtcatcttttttttctttattttagctgctaagtttgcgttatgcaaaaagattaaagattgttttcccattcctgtttttgagctaaaatgtccttttctttataaaatgatagaagttgtaaatgcagttgtttttgtcacaatacctaatgtaatacctgacccttgattggatcctggatttggaaaaaatagtagcagtggtgtcctggagccaattcatatgagctctttatacaccatgtcttctcagctcagcattcatttgagttcaagtaggtagctcatctgccattgagaaatatttatctcagggaaatcaggcacctcttcccgcagaactggttgttaaacatttaccaggacaccactgaatataagaaacattgttgagacaagtgtaccaattataatataaactgagtattagataatattatgttactattaaattacttagctgtgatatggtgtcgttggaagaatccagtgtttattgtactattctttcaacttttcaatagatttgaaattttttaacataaaatgggggggaaagaccagatttgaaaccaaagatgtcagaattagaagggatatcaaagctctttaattcacagataaggaaaccaaggcttggagggtcaagtagttcaccagacatcacatggctcgtaagtatccaaggcaggatttgaatccaagtctagtaagttagagttccaattcctatgaaaacatctgcttaaaataacaaaataaaaaaccttctctttccatagttttctcatctggcctaaaatagagcagaagtattaccttaagaaaggtgaagcactgaatgtttttctttttttccataggtatgtaggattttgtatgaaatttgtaaatatgttactatctcatgggatcaagcctattctcgtatttgatggatgtactttaccttctaaaaaggaagtagagagatctagaagagagtaagttaattctctacttaatctctaacttcattgcactaaggtcagacactgtagtctatatgataccaatttttaaaattttaagccaggctcagtggcttgcacctgttgtcctaggtactcgggaggttgaggcaagaggatcacttgagcccaggagttcagcaccttagtaccctatgatcatcgctgtgaagagccactgtactccagcctgggcaacatagtgagaccccgtcactaacaattttatctttattttttgacagtctcactctgtcgcccagtctagagtgcagtggtataatcttggctcgctggaaactccacctcccggattcaagcaattcttgtgcctcagcctcccgagtagctgggactacaggcacgtgccaccacacccggctaatttttgtgtttttagtagagatggggttttgccctgttggccaggctggtctcaaactcctggcctcaagtgatctgcccgcctcagcctcctaaagtgctggaattacaggcatgagccactgtgcctggcctaaaaaaaaattaataaataaaattttaatttgttgaggcttattttatagcctagtatgtgaacagatttccttaaatgttatgtatctgctacattatcacttttgtttaaaagtatcttcgttactacattttctttgacaaaaagaattgctgtggaaaagcctaatggtaatcttgtgtgtgtgtgtgtgcatataatcattctaagtcacttgttctttttgccttagaagcctaaagcatctgggttaatgttctcaagggcctggtgtgtactttctaatgagtcaaaaacttttttcagttctaggaaagcttcttgaattacagttctgttacagtttcttgagtcagcctcttaaatgttttatatttaaaaaatgttcttcccttgcagaagacgacaagccaatcttcttaagggaaagcaacttcttcgtgaggggaaagtctcggaagctcgagagtgtttcacccggtctatcaatatcacacatgccatggcccacaaagtaattaaagtaagacaaaggggcagatgggcaagttcaccaaagctagttacaacttgtttattgatgggagaggaagaaaatcaagggtggaaaattgttctaggcctaacctcaagtaaagggcagatgtcagaaggagaagggaacagcatcactagatagagaagacttcagcaatttccaaggagaaatcctaaggcataagtaaggctctctcttttaagtcatgttattccatagcaatggaaggaacagggccaggcacggtggctcacaccagtaatcccagcagtttgggacgctgaggcaggagggtcatttgagctcaggaatttgagaccatcccgggtaacataatgagaccctgtctctattaaaacttaaaaaaatgaagagatggaaggaacaaattcctggaggcatcggtctcacccaactctcctacagtcttcaacacttactgtaaccggcactcttgaatgacagatctgtgatgtagcttcgttgccccaggcaccctacagacttctgttccctttcacctcctccttgcagcagcttctttccttattcctgtaaatcttagtgtcaaggtgcccacattcccagccctcactttcccctttttagagcctgcttggttaaggtgttgtggtttttttgttcgtttgtttgttttgaggcggagtttcactcttgttgcccaggctggagtgcaatggcacgatgtgggctcactgcaacctctgcctcccgggttaaagcgattctcctgcctcagcctcccaagtagctgggattacaggcatgtgccaccacgcccggctacttttgtatttttagtagagatggggtttctccatattggtcacgctgggctcgaactcccaatctcaggtgatctgcccaccttggcctcccaaagtgctcggattacaggtgtgagccaccgtacctggcctgttaaaggtatgatggtaaaggtgaagtcagctttttctagcttacagttctgtcatccagttcctgagctaaaataggcgctacacttctgattttggctttgtcatttgagtctctggctcttttctgtatgggtcaagctagaaggaaacgatgcgatgcaggacagagcgtgaagtataaagaaatgtgtgctctgtgtagtcaggagaagagaggctgcattgtgtgcggaagtagaggagaaaccctgattggacacaaatagtggtgtaaaagtgtgtccagaattggtgggttcttggcctcactgacttcaagaatgaagccgcagaccctcgcggtgagtgttacagctcttaaggtggcgtgtctggagtttattccttctgatgttaggatgtgttcggagtttcttccttctggtgggttcatggtctcgctggctcagaagtgaagctgcagacctttgcggtgagtgttacagctcttaaggcagcgcgtctggagttgttcgttcctccctgggggctcgcggtcttgctggctttaggagtgaagctgcagacctttgcggtgagtgttacagctcataaaagcagcgtggacccaaagagtgagcagtagcaagatgtattgcaaagagcgaaagaacaaagcttccatggtgtggaaggggacctaagtgggttgccactgctggctggggcagccagcttttattctcttatctggccccacccacatcctgctgattggtagaaccgagtggtctgttttgacagggtgctgattggtgcgtttacaatccctgagctggacacaaagattctccactgtccccatcagattagttagatacagtgtctacacaaaggttctccaaggccccaccagagcagctagatacagagtgtctattggtgcattcacaaaccctgagctagacacagggtgctgattggtgtgtttacaaaccttgagctagatacagagtgccgattggtgtatttacaatccctgagctagacgtaaagattctccaaggccccaccagactcaggagcccagctggcttcacccagtggatcccgcacggggctgcaggtgaagctgcctgtcagtcctgcgccgtctgcccgcactcctcagcccttgggtggtggatgagactgggcgccgtggagcagggggtggtgctcgttggggaggctcgggcggcacaggagcccacggagggggtgggaggctcaggcatggcgggctgcagtcccgagtcctgccccgcaggaaggcagctaaggccccgcgagaaatagagcgcagcgccggtgggccggcactgctgggggacccagtacatcctccgcagccgctggcccgggtgctaagccctcattgcctggggccgacagggccggccggctgctctgagtgcggggccgccaagcccacgcccacccggaactccagctggcccgcaagcaccgcgcgcagccccagttctcgctggcgcctctccctccacacctccctgtaagctgagggagtgggctccggccttggccagcccagaaaggggctcccacagagcagcggtgggctgaagggctcaagtgccgccaaagtgggagcccaggcagaggaggcgccgagagcgagggagggctatgagtactgccagcacgctgtcacttctcaaaaggatgagagtaggactattgctggaccaaaaaaggaaaaaaaatgagaaaaatagcaaattgttaccaaaattgatagcagcaggatcttgatacctctttcctctttttttctttttttctttttttttttttaacttcccaaagcctgtcttcaggccttgggaaccattttcccatagtttagaacatggaagttccagttccagctgcctagattttgacacagcggctatgataggggctgtttttcttggcaagtttattttaaaagtattttctcataatgcattggtttaaatatagtgctatagcctataatatatatgtaagatacattattagaggagagttatgtatgtgtgtatatatacgtgtgtgtgtatatgtatacacacatatacctacgtatatattttccccccaagacattgctggatatggtctataattttatcaatactgtgtcagtacattgactttcgtagcttgacaggacaacctgttatttttatggggaagatatattcaaaactccaaacaaatgtatattttcggaacatagccattcttaagatggaagttttctataatttaaaataagtgggccaggcacaatggctgaacgcttacaatgccaacactttgggaagctgaagcgagtggatcacttgagtccaggagtttgagaccagcctagacaacatggcaaaaccttgtctctacaaaaaatacaaaaaaattagttgggcatggtggcatgcacctgtagtcccacctactcgggaggctgaggtgggaagatcacctgagcccatagcccaggaggtcgaagctgcagtgtgccctgccggctggcaccactgccactccagcctgggtgacagagccagaccctgtctccaaaaaataaaatgattacttttgtaacttgtaggattcttttttcctctggctgtgtagcagtatttcttttctccaaattttataagttgattttttaaaaatgtcttaatggctatataattagttcaacatatactaaaacttacagtagaaaaactctacttcaaaggaaatgatttctcaaagtaatattagcatgtgcctgctgaggctagtaataaagtgggtttgaaacaggaagttgtttagtactttccagatgccgtgctagagattcactgtgattctctcttctaggctgcccggtctcagggggtagattgcctcgtggctccctatgaagctgatgcgcagttggcctatcttaacaaagcgggaattgtgcaagccataattacagaggactcggatctcctagcttttggctgtaaaaaggtactcacctctgactactatatattacttttctatgtagatagtagtgtaaatcaaggagctgaaatttttcctgtccaggaaattatgataatttataatatttataaaatttataatatttataaaatattacaaggtaaattattgtatttaatagatatttgcaactgacatctatttttataatgttaataattatttaaaatgaaaagaagggttttgctgcttgatgtttgtgtaatgtggatactttttcaaagtaagcccttaaggttggaggggtttgttattgttttatgcagattctttagtagaatgtggacgtaccagttttattttttaataatgacaacatatgctttatatttcttgattaggttaggtatactaacttatgtactaaagggttgccatgcagttatttagaattatgtataaaactatttcatggaaaactttatttaggggagaattaagatacaaaactacaggatgttctcatttttgttaatgcctatatttatgactagaagggtctctatcaaaaggttaatactaggttacagtgataaatgagggaatagggatgacttgttttcttcctgaatttctatattttccaaattttctacaataaacatgaattgcttcaataataaggaaaaagattacttaaaaggtacaagtgacagagaaagagaaaatgtttttcgtatgcattactgtttgattatcatgacaaccctgtaacacaagtaggaaataaagagatgcaaaaagagcttgctttataccagaattgtgacagttgagtcctagctgtatagccttgtctagtcatatcctatgcttcagcatactttatttgtaaacttagtaatcatcagcctgtctatctatgtctcctgtctttcagtgttatggtgaagaacaagaaagatttcttaaaattattgcagtggattagataatgacaaaagtggcccttctaggtattaacaatttcccttccttttgaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggtaagagtgatttgctaagtgtcatattcaatttctgaagcatttccttaataaaataataaatcataatatggatttaaatattctgttatgcgaataacctatattatattattaaaaggagcaaatgactgaggcactagaactttgccttagcaactaacatatattgggaaaatcatgttttctgcaattggcaaaaaagtagtgatttttaaaacaaagactagtataaagaggctcaaggagaaaatattctagggtaaaattaaactcggagtcttttgacttctgtgctataactctatagtagtggttctcaaactgtttggtcgcaggatccctttacactcctcaagctcctttatggtaatattttttgtttatgtaggcgatagctattgatatttactgaattaaaaattaaaacaaaaatttaaatgtttatcaattcacttaaactttataataaactcattacatgttagcataaatagcatgcttttatgaaaaataatcattttttaaaacaaaaattatgagagagaggaatcatacatttatgcaaatctctttaatgtggcctaatagaagacagctgtgttcgtatacaagttgaacatccctaatccaaaaatctgaaatgttcaaaaatccaaaactttttgagtcccggcaggcaagtgaaaaattccacacctgatctcatgtgaagagtacacaaaataattaaaaatactgtataaaattaccttcagtctatgtgtgtaaggcttatatgaaacataaattgagttttttttcttcttcaccctcttgctgtcagtgtgtggaaacgtaaatggattttatgtttagacttgggccccatccctaagttatctcataacgtgtatatgcaaatattccaaaatctgaaaaaattcaaaatctgaaacacttctggtgccaagcattttggataatgtgtacccaacctgtatctgctgccttattaagcctcatttgataccatgtatcatatatcatctggaaaattctgagactctggacattgctactttgtagtttgtcttaaaaaataaacatcaaagaagctcattttcccccttggatattctctaaacccttaacagtttgcagagcagaaatttcatttttctatttccaggagtataaggcctgagtcctcaggactaagagtgatgtcatgtaatggaaagatctctaggttggaagatagtgtcccaggtgggaataggaccacgtgccttaactagcctgtgactccaggatccgtttggttctctgggccttccctttttcatctatgaatttactatgcaatgtttaggatcctttccagctttaagcatccatgactctcacagaaatcagaatgtcaacttggtttaaaaatatgatctagaaatatttgcatttttttaattctcagattttggatgttctttttttttcctttcttgataaaaaggactttgaagatgaatggataatgtatctcaaagttacacctagaagcacaaacttgatgtactatataactgtatttttttatccttcaaattagtaatagaaaaaccaaagaaaatactagttatgagacttagaattttaagtgatgtaacatggttgtgttagctggtagaattttttaatgtagatgaaagcagttaatgtttcaatccctctttatgaatgtaaatcaatcagccttgaggataatatgttccctgttctttagttgcagataaaatatttttgcatgcattgttaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcagtatcctttctgaaacagaatggtagaatttgtgcatttttcttcaatatttttatggtgatttttttgtgaggcatttagtaaaaagcttgcacattattttttgctctcttttttatagtgaaatctgtatattgttcatttaaattaccatgctagtgaaaattgagaacaactttttgtttataaacccgaggctcatccactatgcatcctgattacttagattgactgacagtagcatgcacagggtccgtcacttacggtacacattccaaaggtggctcttgagaggacctcctcgtggcaagcaagctcgacttatcaggaagagcattctgggcatttgagtgcatcaggagaggatgcccttcccatagccactggccatgtacatgcaggctgatgcagagccctgagtcacttaggtggtggctaggactttcccctctgtttcccttaaaggcagggagtcagtgatggcctgggccctcgtcagaagacaccaactcctgcagagacagatagagactagcaaactgtgtctgctttcagtaatgctgatgtataaagtaaggagactccatttaagtcataaacctatggattttcgtgacaatagaaaacatttttccatcttagtataatatcatttggttggttgttaataaatacatttttccttaatcttgctaatctagatatgttgatgattccatagctcttcaaatagcacttggaaataaagatataaatacttttgaacagatcgatgactacaatccagacactgctatggtaacgttttgatgaccaccctatgaaaacacgttttagttatgtcccgagctgtgattaaaggcaaatcttcatacactaagcttcttttaagcgtttctatatccaggctctgtgcagaatgtacattaaaaacaacttgatcctagagaaattacatgtattagagcataggtatattggttaattttttaaaattaagaagtgactgttatttattatcaaacccttatccttgagcatttcatttgaatataccaagcatttgatgcctttttttctcatctcactccgttcggcttctgtggcatttggcatcattgaagacccaagcctaggaatgctacgggagttaaagctgttttttcactcatgcacaatttaacaaatatttaatgcacgcccctgctgtttctttaaacaatttgctgttttcttttatttttcttttttgagacagagtttcattcttgttgcccaggctggagtgcaatggtgcgatctcagctcaccacaacctccgcctcccaggttcgagcaattctcctgcctcagcctcctgggtagctaggattacaggcatgcaccaccacgcccggctaattttgtatttttagtagagacaggatttctgcatgttggccaggctggtctggaactcccaacctcgggtgatctgcccacctcggcctcccaaagcgctgggattacaggcgtgagccaccactcctagccgcgatttgctgttttcttctgcttcttcagtattgtatgtattccttaagatactgtctcccatcattgtctttctctttgtatttctgtttatcctctgttctcttttctgtttacatttcttccttaggtaagtccttagggctttaatcccatttacgtaaagaactcacatctccatctttactccagtctctcgcctgtgcaccaaccacagaattctcactgtctcttgcgtctctgatttcctgtagcctccaagtctatttataggcaaaactaaactcttcatgtttttaatcaacttttaatcacatttctcttttatttcctacttagcacttattactgtataacatgcttctattcttttctgattctttccaatagaatgtggtcttcataaaggcagaacttggtgatcctcactgctgtatgatatttactatgtttatatgttgagtgaatgagtgttagccacaggtctcttttgttctcacactggaaaacttggaaataaactttggcttccatttcgttgctacatcctcttgcctctttgagttgtccttctggttaacattttcttcttttcccaagcttccagtttaattcttgctcactaatttattcctttactaaacatttatcaagcactgaaacaatgtaattaggttagctagggttctggaatataaagaaaaataagaaatacaggaaaagtaagatccttgcctgtcaaatgcccattgcctaaataggaaggagaagggattctatagaaagaaatgcggtaagtgctacgctaaagaggtattccaggctctgtggaaataaaaagcatgtccctcactccacctaagagaatgcttcctaataataatggcaaacattttctgagcatttgctactttccaggtgctcttttaagcaccttagacatagtaagtcatttactcttcagaaagcctctgaagtcagcaccattctcattttacagatgaggaaacaattagaggacacttaagtaacttttccagctgaccattttcgtaaataggggagctgtgattccaagccaagttctctactgtctgctgaaagagaaactgatgtgtatcctcagtttgcaaggattagtagagtttttcaagatgggtgattccaggctaaaaaaaaaaaaaacaaaaaaagcgtatgtagaaaaaagtgatatattaagggaactcttagattgttcattatggatgggctaagaatatcttagtgtttaccatgtaaaggaaccagatcttgagaaaaaaagaagtgagcctggaaaagatgaccactaacaaactggtgatccattcagcatggaaaagtaaccattactgtaagctgaaataagccaagcctaccaagagagcacaaatctataacgaccctaaaaatgaactttatcagcttcagtgatgtaaaccttacactcaggttgctattcccctattttctaaccttgctccatgtaatacggtagccactagccatgtgtggctatttaaatttgttaaaattaaatacaattgctattttacttccttagttatagtagccagctttcaagtgcttagtggttagtggctaacatagtggacagcacagagcttttctatcagtgcaggaaattctgctgaattctttacttctactatcatatttttatatctagggactctttaattgtacttttttttgaagatttagatgtcatctcttatctttctcagaatatgataattttttgaacgttttcttccgctctctgtaactgctgtgtacctttttcctgtgttgatattttctccctcatggtggtaacttctggccagtcatatttgaaggggccccgaaaagctcatggggaacattgtgtgaatgagtggggcttatgatgttggacttcattcttggatgatgtggttggtaacacattggatttgatttgtgaattctccaatgttggaatgttctctgcacagttacatttttccaaaaagagatgtctgcttagggtatctaaactttggctgtctgtattttgaaagcaggatagggaaagtgagttggggcaggccaggaaagggtagcatggttccttgccattcaatatttagccttttgtttcatctctgttttcagacaaatgaatctatcttcagaaatgcctgctatgtctgttactctttgtgggtttcaaaagttcaattgttctggttctgaaggcaggtagatgtttgttgactgtatagtcaggttggagatggggacacagggtcaaataattctctctttcgttagtcattcccccaccaggggcttctgtaattccaagactttaattcttgagcctttctccaggtttctgtaggtggaattggcttctctttgatattctcttctgcagacaaagtcttttaatttcttccatctatgttctatcttcaccgtggtttagaagtcacagattatctcctaatttttttgcaggttaattttgtgtttcttattgttttgaggaatgattatggaaagaaggagactgaaaagtgctatctttacacagctgaactattgacagtatttatcatttctttctttctttttttttttttttaaatttgagacagggtctctttctctgtcctccaggctggagtgcagtggcaccatcagagctcctgggctcaagcgatcttcagtaactggcatcaagcctcttgagtagctggaactacaggcacatgccaccatgcctggctaattttgtgtgtgtggggggggggtctcactatgttgcccaggctagtcttgaactcctggcctgaagcagtcattctgccttggcctccaaaacttctgaggttacacatgtggagccaccacacctggccacagcattatatatatatatatatattttttgacttgaatatctctttttttttttttttgaacagaatctctctctcttgcccaggctggcacgcggtggcatgattttagctcactgcaacgtctgcctccgagtttcaagtggttctcctgcctcaggctcccaactagctggaattacatgcatgtgccaccacgcccggctgatttttgtattttagtagagatggggtttcatcatattggtcaggctggtctcaaactcctgacctcaggtgatccacctgcctcagcctcccaaagtgctgggattacaggtgtgagccaccatgcctggcctataatttcattaagaatgattcttaagcttttcctttgtctcagaaactcaaaaatagttgacagtgttgagtatgtcccattaccaattgtaatgttatggaatgctaagatggccatccttcatcagctcaaattcctgtcagaattttgtccttctcatagagaaatttctataggaaccataattgtacaccaaatgagttatttttatttatctaaaatttatttagtctggttttctacttgtctatttctctttcttatttagtaaaaccatcagtgggatctaatgccatgagccatactgataaagctatctttttatattcgttccctcaattaaattaccttccttattaattctcaaagggtattctgaataatgtcaccggttttatttatttttatttttgtcctttctttaagtgaaaggctttgattagattctgagttcatgtgggatttttgtcaggtgggattgtaatgattttttttgtgtctttgctaattttttccctttggctgtccttctctgttagaatatcattgacatcctcttagcagatcattgtcttccaaaatttgtagtaattgtgaataacttatattagcattaaaagtgattgctttccttttttgtttgtttgtttttgagacggagtctccctcggctcactgcaacctctgcctcctgggttcaagtgattctcctgcctcaacctcccaagtagctgggattacaggcacacgccaccacacctggctaatttttgtacttttagtagtggcagggtttcaccatgttggcaaggctggtctcgagctcctgacctcaagtgatccgcctgcctcagcctcccaaattgctgggattataggcgtgagccaccgtgcctggctgctttccatttaaaagacaccgttttcctgaccacatttcttcagttgtggtcttatttcttgcaccatttgtattacgaagatttttatttatttatttatttatttacttttaatcttttttttctacagctgctagcaactcttgattttttttttttttttttttagaaatgagctaacaaagttgcttgactctcatcagaagaaaaacaggcctaggaatataagacacatttaatggaaaagtataggaccagcaaagtaggaaatgttattcaaggacagctgtttcatcaacagctattgtttttaagggtaacttaagatgtttatttataatttatgttgatacagaaggaaataaattgattattttctttctgcaaataatctttttccttttccttttctagcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtggtacgtatttcagttttgcaaaatgctggtgaatattggtcatatttaaagaaatcattgcccaacgcaaagtcgcgaagattttctcctgttttctcctagaagttttatagttgtattagtccattttcaccctgctgataaacacatacctgagactgggcaatttacaaaagaaagaggtttaatggacgcacagttccatgtagctggggaggcctcacaattatggtggaaggtgaaaggcacttctcacatggtagcaaacgagaagaatgagagccaagtgaaagggttttcccttataaaaccatcagatctcatgagacttattcactactataagaacagtatgggggaaacggccaccatgattcagttatctcccaccaggtccctcccacaacacataggaattatgggagatacaattcaagatgagatttgggtggggacacagccaaacattatcattagttttagctcttacattttacagttttagcctgtgagccattttgagttagtttttttaatacgatgtgatgtaaggattatggcttttttttttaatcttgtatatatggctgtccaattgttccagcaccctttgttaaaaagttttcctttccccatttaattgccttggcacagctgtttaaaatcagctgaccacatatatgtggatctttttctgaactctgttattctataccattgctctccttacttatctttacatcagacacattcttgattactgtggctttatagaaaatcttgaagcggggcagtgtaagtctcaagttagttttcttttgaaaagttgttttggctattctgtgtttttcacgtttccatgtacattttagaatttagctttttaatttctaaaaaaaaaaaggtcaggcatggtggtttgcacctacaactgcaacgttttgggaggccaaggcaggtggattgcttgagcctaggagttcaagaccaggcttggcaacacactgagaccctgtctccacaaaaaaaatttttaaggccgggtgcggtggctcacacctataatcccagcactttgggaggccgaggcaggcagatcacttgaggtcaggtgctccagaccagcctggccaacatggcaaaaccccatctctattaaaaatacaaaaaattagccaggcatggtggcacacatttgtaatcccagctacttgtgaggctgagacaggggaatcacttgaacctggaaggcagaggttgcagtgagcggagatcacgcagtgcactccagcctgggcgccagagaaagaatccatctcaaaaaaaaaaaaaaaaaaaaaaaattaagaaagctgtcagctggttattctccaaagctgcagcttctctgctcaaagggtcttactagttcagaatacattatcgtaaaacaaaaaataaatacaaaagaaattttttaaacattagtcaaatgtggtgacgtgtgtctgtagtcccatctattcaggaggctgaggtgggaggatcgctcgagcctcagagttggaggctgcagtgagccatggccacatcactgcgccccagcctgagtgacagaacaataccctgtctcaaataaaaagtaaaaagtctattgagagttagttaaatccatacatcaatttggagaaagtggacattttaacaatactgagttttctgattcattcatttaagtctttaatgctttgtagctttcattgtacagatcttaacatatctgttgtcaaattatctttatatttcgatttttgatgctgctgtaaatagtattttcagttttgttttctagttgttcattgatggtatatagaaataccattgatttttgtacattaatcatatatttgcaaccttgctcacgtcacgtattagttctagtatctcttttgtggactatgtaggattttctatataaatgactgtgtcacctatgaataaagacaatcttgcttctccttttccagtttaaataccttttatttctttttcttagtataagaatctaagcttgttttcttttgaactgcctgatttcaagattatactgcctgacttcaagatttcctatgagccacagtgtgtgatgtaacagtgtatctgatgtaaagataggtaaggagagcaatggtgcagaataatagagttcagaaaaagatccacatatatgtggtcagctgattttgaacagatgtgccaagacaattaaatggggaaggaaactagaatctgtagtacaatattgaacagaagtgctgagaggaatatactaggtattggggaaacgtgggaattttttcaccatagaggatgtttaaaatgaaaagaatgattataattgcttccttctctcttaacttccttccctcagacatctacatcggtgaatgaaatagcaacaataaaaataaaacaaagacttgcaaattttagttcatgcttttatttttcaaatttaagcatagattatacatattcggccgaaatatcctgattccttatgaacctaaatgattttcatgataattatctctgaacctttgtttcttcatatgaaataaaaggtttttgtgtatgttatataagataatatatacttgttatataagaagtacagtgtacattcatcttccttccttccttccctccctccctccttccttccttccttccctccctccctccttccttccttccttccttccctccctccctccctccttccttccttccttttttgagactgtgtcactgtgtcacccaggctggagggcagtggcgtgttcttggctcactgcagcctccatctcctgggtttgaggaattctctgcctcagcctcccgagtagctgggatacaggcgtccactaccacacctggctaatttttgtatttttagtagagacggggtttcaccatgttggccaggctggtcttgaactcctgacctcgtgatccacccgtctgggcctcccaaagtgctgggaatacaggtgtgagccactgcgcctggcctgtacatgttctttcattttcttctgctacaatcaagacacgctgtccattttatgtagctagctcactgtcagcaagtttgcgagttctttatgtcagactaagtctacttttctataactacaacttatcaataggttttgtcccctttctatacacacaaacacaaaaacaaaacaaaagaactagagtaagtttaattcctatttcatgtaccagcccttcagatgatttaaagatagccattgtgacactcctaaatttctcttccaggctattatgttccttggccattcaggttgtgctctggatgtaatataggtttttaagaattgtctagttgttacagtgagtatgattattgaaatgtgatctgcttaccacagaagaaatatttagaattgtggcactgtttcagtcctgtgcttttattattgcaaactaagattgcattcacattcttgcaatctggcattttgctggaatttgctgagttgataattgatatttgccagttgctgttaagccaggtatagttacattttaaacttaaatgtgggttaactcattcctcttacaataatcttaattcattttagttcattgttctgcctgttaatttttttgttcgaatctttgtattttctaataaatgcatattatgtatgtcatctggaaattgatgagtcttaaagttttggttacagtacgtttgcttatataatgtttaactgaatcagagcaagtacagaaatctggagtatatgagacagacttccttttgactaacagttgccagtagtagtcttttaggcctgcgcaattgctgcaaatccccataactaatatacagtagatatggctttgcattgttggctaggatgatatgagagacactcaaatgtcttgccaaattctagatatgcttaatttatggagtccccaaataactatgctaataaccttattgagaaaaaaaaaatgaggttaatctggtgtggcttctgaaagccttgttggggaccctggaacacttgtttttcttcttctgcaaggactcacaattccctgcataataaacagatttaacttttgctggggatcaacatctaatttgctgatacagctttttaaaaatctgtgccttttaaaaatttgagacatctcgtttctggtattttggtaaccccaacctatcttaccaacttcacaaagattatagtagtgtgcacttacacctctgtggagaaggagctgttcagactcagaattagtcaaagtaattcaaagaaccttagtgctgtctctatgtacttacctgtctcagattttaaacttttgttattatttagtcttatgatttattttaataccacagaatacatttgacacacagcaatcttcttgggcctcatagtgaagtaataacgatcagagctacagcacaaattacttacgactatatgacattcacaatatacatcaaaacccagaacacataaaccatgtgtatcaatagctgctggttttattggaacattttaacgattgatcattaaccatatatttacatataaattttcctggagatttttttatattcaaaattagacccttagtataatgaatacatcgccacacaggattgattgtgctctgaaattttgatttgggtaattttaacatgaaattgtataaacaactgatattaaatcttaaactaatgtgtgaaattataaaatagacctaagggagtttttttgaatcatccttatccttatgttttcttttctgaggcatagttttttttttttttttttaaagtccttatttttaggacaatgggatataaactgaagttaaggccaaatctctaagtacaggtgaaacaaagatttacagataattttgtttttatttagcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtatagttatgtctccagaatgttgattgtctgttgtattatgtactctgttggtatttattttgtctttttttagaattaatttatttattatactttaagttctggggtacatgtgcagaacgtgcagttttgttacatgggtatacatgtgccatggtgatttgctgcacccatcaacccgtcacctccattaggtatttctcctaatgttatccctcccctagccccctaccctgccacaggccggggtgtgtgatgttcccctccttgtgtccatgtactctcattgttcaactcccatttatgagcgagaacatgtggtgtttggttttctgttcgtgtattagtttgctgagaatgatggtttccagcctcatccatgtccctgcaaaggacatgaactcatcgttttttatgactgcatagtattacatggtgtatatgtgccacattttctatacccagcctatcattgatgggcatttgggttggttccaagtctttgctattgtgaatagtgctgcaataaacatacgtatgcatgtgtctttatagtagaatgatttataatcctttgggtatatacccagtaatgggattgctgggtcaaatggtatttctggttctagatccttgaggagtcgccacactgtcttccacaatggttgaattaattcacactcccaccaacagtgtaaaagcattcctatttctccacatcctctccagcatctgttgtttcctgactttttaatgattgccattctaactgacgtgagatggtaactcattgtgggtttttttttttatactttaagttctagggtacatgtgtacaacgtgcaggtttgtcacatatgtatacatgtgccatgttggtgtgctgcacccattaactcatcatttaacattaggtatatctcctaatgctatccctcctccctccccccaattgtggttttgatttgcatttctctaatggccagtgatgatgagccttgaataaacattgagtctagagggaagcaggtgtagaacctgccttaatctgattactgtcttatcatgtattgtcttagttctgacataaacccctttaacttctagtactttcgtaatctctccgtacagaatcagaataaaagaggattgtagcccctattattaattttgctttacagaaattgtttttttggggagttcccttccccctcttttttttctacttttttgttttctttgagggcttcatacaattttgcaaagtattttcagaaatatattctaatgtagatgactgtggagctgtaatattaattgagaacctgatgccatgctaggtgctatagttcaaaaatgagaaagacagtttttgtttttcagaagcttgtagtccagttggaaaaataaatacataaaaatctttccatacagtatggtgagtacagagataaaggcatgaatacggtgttttgagggcgttcaaggggcatctaatgctggggcaatggttggaaagggtaagaaggaagggatgagtgttgggtgtccctgcctaggtttaaatgacaggtgaagcaggcaaagaccggcaccaagtaccttcccagtacagtcagacagcttgaggaaaggtgtaaagatggggggcagcatggggctcaggacaactccttgctgtctgtcagtgctgtgatgacctctgtcagaattcaagctggggaaagatgggtggtgaggggagcagaaataggcaggagaccattcactgaaggcttgtatgccaacgtgggaacttttagtcttctttagaggcgatagaaacattgagagggtcgccgggcacgatggctcatgcctataatcccagcactttgggaggccaagtgggtggatcacctgaggtcaggagtttgagactagcctggatgaaatggggaaaccccgtccttcctaaaagtacaaaacctagctggacatggtggtgtgcacctgtagtcccagctacttgggaggctgagacacgagaattgcttgaacccgggaggaggttgcagtgaaccatcatgccactgcagtccagccagggtgagacagtgcaagactccgcctccaggaaaaatagaaaagaaaagaaactttgagagggttttaatcaggggaggtggtgtatgatttgatctctgttttagatcaaccattctgagcgccctgtgaagagtgggctgaagagggccacagatggggcacaaggaccagttgggctgttgccatagtccctgggagcaatcatgagattgtgaagagtcagtttaatttgtggattaggaatttagaacctggagtcaggcttcctggaatcttgttgtgttcattgtgagatgtgtgacttgacaagttaacttctggatacttcagttctctccttttaaaaattgggactaacaattataacagccttagggccgatgaaaggattaaatgagttactatcagtaatgcacctaaagcagtgccttatagatagatgataaacatacagtaagtaactcgtattatgttgactttagatggtggtgccacaacatgaaaaaggaaatgtaagtgtcagaagtgatctaggcatgatagagtaacactaagagagaaaagttaccagctcctgtattccactagaagacttcgaatgaatagtctttgtttttcaagttttttatttttttatttttatttttacttgagacagaattccactcttgttgcccaggctggagtacagtggcgccatctcggctcactgccacctccgcctcccgggttcaagtgattctcctgcctcagcctcccgagtagctgggactacaggcacccgccaccatgcccagctaatttttatgtttttagaagaaatggggtttcaccattttggccaggctggtgtcgaactcctgacctcaagtggtccatacaccttgtcctcccaaagtgctgggattacaggcgtgagtcaccacactctgccctgtttttcaagtttaataaatcaggcagcagtcagctttgtctaaccatgatgatgggagaagagcatgaaagaatgaaccactggtagtttcttagtctcacctcgggtgatgtttcaaacccttctcccatggagtcttctcaaggaaacagttgcaatacaatatgattaaatgatagttttgattcgtcttttgctagtcacccttgttaaaggtgcttgttaacagtggaatgatgaaaaattggccacaaaactggaacagtgttctagataatatacactgattgggccggccgtggtggttcatgcctttaatcccagcactttgggaggccaaggcggtcggatcatgaggtcaggagatcgagaccatcctggctaacatggtgaaaccccatctctactaaaagtacaaaaaattagccgggcgtggtggcgggcgctagtagtcccagctgtttgggaggctgaggcaggagaatcgcttgaacccgggaggcggaggttgcagtgagccaagatcacgccactgcactccagcctgggtgacaaagcgagacttcgtctcaaaaaaagaaaaaaatacactgattaaaaagttctagaaagttgacttctctcacttggaacagtttttctagcttggttttgtttttccgctggggtgagagtagagtgtccctgtgctgctgcttcatgttgagctcttctttggagacaacaaatgagaatgtttgtgtgtctctacagggctcgcctatttagtcattatagaagcttaaggaagtcttcaagtttgagactgtacatcgctgctttatgtagtttagatgtttcactagtaacttgttcagagggtgcattaagagatacctagagaaataatttgttttctctgtcagctttctgtgagaaataattatcaggagtaagtcagtctttgatgtgtcattttatggcttacattatacagcaacatctgataatgactagacagggtataggctcacacctataatctcagcactctgggaggccgaggagggtggatcacctgaggtcaggagtttgagaccagcctggccaacatagtgaaaccccgtctctactaagtattcaaaaattagctgggcgtagtggcagatgcctgtaatcccagcttctcggggggccgagggaggagaatagcttgaacccaggaggaggaggttgcagagagttgagatcgcacccctgcactccagcctgggtgacagagcgagactccatctcaaaaaaaatttctttttaaattaactggatattattaaattagttttcaaagttaattttcaaggtaattttacatgtttttctatttctcacaacaatattatgagatacataggattgctgctatcttctctatttgaggttaagagattgaggctctgagaggttaagcattctcaaagttgtacagttagtactggtgataggaagattcctagtcacagttgatataatggattggaagcggcatacaatccaataggcctggatttgaattctcactctgtcatctttttagttgagtcgtctttcacacactgttcacctccctgagcctatttgtttataaaaaatggatgattatatacataaggctgttgtgaaggtaaatagaaactgcgtgtcaagcacctgccataatgcctagtcattaatatatgtgcaagcattcattaccactcctctccttttaattgaatgcaactaaaaggagatactaaacatgtaaaacgttgtcaccaatttgcctgcattttggaagcctgttttaagtcttaattatttttattatgtaggtagttatcacagaaacgtgccagttttatctttcgagatctggaaatacaagtcaattaagtaacagtatgggccagttgggaggaagtagccatgaactgggaagggttctgagttttacttctgtttgttgctagccaagtaattttataaccctgggcattgtcactatctcttctcttgcctgtgaaatgatatgtaggagaatacttgggcatcataggaattgccgttgatttaaaaatgaatttgccgtcctatctaggagctcatgttttctgcttactgaaaagcctagtaagagcttttcttccacgtactgcttcctgccccctccccatacaactaatctagggatttggtgaaaggatagaaaggatttttactctctagcatttagtaaatattctgttcattatcttggatttgaactaatgcctattaaggaggtaaattctctttaagttttttatttatctgatcatgtataataggatatttgttaaacctaaaaactctctttgcctcctcaataatgatactgatctttcattttcattggaatttttttttaaagctgctatactgaataagtaatacctctttagtaatatggaatttatgattgatttgaaagaaagtcttaacctgtatatttaaaagagtatagaagtttatagggtatataacaagctggtagattagtatactactgcaagttcctagatgatataatgctaggaacaaagctaagatgaagggtaaatagctaatttctttaattttgcttcctacaaaatatgagagaatagttgtcaattgtccttttggttgcatatttctatatcttttcatgcgtttgaccatgttttagccccatcctaggtactgtggaagatacaaagacatgggaagtacctgccctcacagagtttatcttctatttgagagtttaaaagtttagggaaagaacacctatatgatgattaggtataaataaagtacagaagttccaaatacatgtgtatatagaagactgcttttagaaagtcctctctaggccgggcgctgtggctcacgcctgtaatcccaacactttgtgaggccaaggcgggcggatcacctgagatcaggagtttgagaccagcctgaccaacatggagaaaccccgtctctactaaaaatacaaaattagccagcatggtggcgcatgcctgtaatcccacctactcaggaggctgaggcaggagaattgcttgaacccggggggcggaggttgcagtgagccaagatcccgccactgcactccagcctggtgacagagagagactctgtctcaaaaaaaaaaaaaagaaggaaaatcctgtctaaaaattcatcgtataaatagaattctaaatgtgtgaatgttggcataatcaaaatttgaattttgactaaaatttaagattttttatgcctttatgaaattatatatttatgagacttttttcaaaaagaaactgattattccattttgaatcttgacaccccttgagaaaactctaaaatactcatacttacttattgtttctattgctttttttattaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggtaagtcaaatcctgaaggctttgttttcaaatttatatgtaagaaaaaatagattgttgctcaaactgaggaaatttttcctacatgtgaatgacgagctatattattttttcattctaaactctactgtgcagaaagttcacattttattcatttgaaggacttctctgtatctttcacattttaaactgcaatacatttaaattaactctgtatatttcctgaatcactgtatgttcgattggtgagtatctcaaggggtgccacagttaaaaccgaggcagagtgataatctgtgaaatgaaaaattattatcaatttactgtttaaatccttaatatgctcttgaattcagataacatttaagaccttgtaaggggccaggtgcgatggctcatgcctgtaatcccagcactttgggaggccgaggcgagcggatcacttgaggtcaggagtttgagaccagcctggccagcatggtgaaaccctgtctctcctaaaaatacaaaaatcttaggcaggcatggtggtgggcacctgtgatcccagctattcgggaggctgaggcagggtaattatttgaacctgggaggcggaggttgcagtgagccgagattgagccactgtactccagcctgggggacagagcaagactgtctcaaaaaaaaaaaaagaaaaaaaaagagaccttataaggaaataaccctgttaatgcaatggtattcatcttaagttttagtacttcagaaatatattttcatttactcttcttattccttctaaatttctccttatgacaaaacaaaacagtaacacaggtgtgcatactggtctagaagactgtctgtttctcttcctatgaacgtctttatctcgtctttttcatttctgcttcatactgcatcttctcttactgccacttgggtaccacggcagtggctatcttgaacatctttcataaaaacatcactgtcaatttgtgaggatattaagtctgctgagctcctttggggttatcttttttatatttccagcatgcatcttactatttcatttactttggaagcgtttagccatgttttcctgagaagccttatcagttcacactgtaggctggtagaactccacattttgtcttctgggctaacctttttttatgtactaatggttatagaaatgtgaatcctcctcccctagccatgccccactgaaaataaacgaactgaacaaaactaggaataattcattaagtcctctctcttgctgccagatgtagtaaactcctactagaatagttaattctcaaagaatctgatgctgacagttgacatgaaaatcatataatctttctttgatggagaaaatgtttcagaaagctgtgaaacattggggcatcattttgaatatcagtttttatcctatagttcagaagaaaatgcttcaatatttgagccttctgtcggtagttcactgtgaaaaacaacaaccatagattctgtgttgagttcattgaccatatttgaggttgaagtcttcttaggaccttccttgtgatcttcaggaagtgatttagcccagagtcaccaatactgttagctatgagcaaagaatgttagagtttctgtaaggtataatacaagttaatggagtgcttttcactattgggttttttattgctcttttgttttgttttgtttttttgttttttaagtctgctctgttgcctaggctggattgcagtggtacaatctcggctcactgcaacctccacctcccgggttcaagcgattctcccacctcagcctcccaagtagctgggacaacaggcatgtgccaccatgcccggctaatttttgtatttttagtagagacaggatttcaccatgttggccaggctggtcttgaactcctgacctcaagtgatctacccacccaccttggcctcccaaagtgctgggattacaggcatgagccaccgcccctggccttactgtcctcttttatttgactttcatgggaatgcagattataagggaactctccatctatagagaagtcttatctgatagaattgggggcagaaaggtctgaaagtcattgctaaaggtgaagtgcatttaatacaatgctactccacttgaaagtggatgcgtttttttctttttaaagttgaacgtgttacatgattaaaagaagggatggagctgcaccagttcaacttattttagctagtaagatgaaaacttaaccacacgtgcgtaacgcagcgtttttacattaggagactcttgttttatctgactcagcattttaacatcctcttctaacagttcagaaaagactttaattttaaatagatattttatataatttacctctccagctgaaacatcttgttagcttcttcaatgaaattggcaaatatcatcctttccatattattcattttcttttattaattctatcccatgttcttatttatcttccattttgttgaatattagtttgttgtcataaaaattctacagtaaaaatctaattttattttattttttgatctggggactctaggaatctgattgcaatattaagttacttgacagtcaaagtgaccagacctccaagctacgtttatctcatttctcaaaaaaagacacacctctaaggaacaaggtaaaacatttatttaattttttttttaatttcagaagcggtgtatgcttacaactagaaaatgagaaatacaagcagaattaaaaatcaaaatacctgtagtctcatttatataaaaatgtctactttaaaactttatgcttgactgtaggtgtttaagttgtgaaacttattttctcttgcagtgtatatgaaagatcactttccaagtacttttagtcattaatgtaatgactttataatatgcagttgtataggtttggtcaatccccttatttttgtcatttaccctaaatttttttgctctagcaaataatactgcaaccaagatcttgtggataaatatttgaggacatgttcttgattagtttgtaaggatgaattgcatggagtggtattactggtcccaaggcatgtatgatttaacattgatacatactgccaaaaggccttctagaaactgtgtacccatgataaactaggtttgttgaatcaaaatatataaatatttgtgttactacatagtaaagcatattttatatattaagcacgaattaaagcatattttatatattaaatgttcttgttcatcagtataaaaacaccatttcctaacttaaaagatggataaaggtcataaacaggtcacaaaaggaaaagtaccaatggttgattaatatgtgtttaacctcatttgtttaaccgtatgtttaacctcattagtaatcaagtagtgcaaattaaaataataaaatagtttcttgcctcttcatatttcaaaaaaatgtttttaattatactcattttttatgagagtatagtgagataatcacatgttttaaaaagtaagtattggtctgccatttctagaaaaaaatttgaaagagttcaaataatttaaaccagtaagtgcattctagaactttagcctaaggaaacattgagaatttaaatacaagaatacttaatactgcattggttataatagtgaaaaattggaaataacctaaataacaataagggagtgagttattaaataatcattggttttagctcttactggtagaaatataggtgaatttttttctgttctttttcttgtgtttttctaccatgagcatatattatgtttctagtagcataaaaacttcttactttttaaaattttaataaatggccctggctatccatttgaaagaagatgtagtctcacacaatataaatgtaaattctactgtagtcaatatgggttgctataacagaataccagaaactggatttgcttaaatgataaatatttatttctcacagttctagaggctgggaagtccaaggtctgagtgagagcccacttcctggtttgcagacagatgccttctcgctgtgtccttacatggtagagggagagaatatctcttttgtacctcttcttaagggcactaatctcattcatgagggctctactctcatgatctaatcacctctcaaaaatcccaccatcacattaggagttaaggggttaggacttcaatatgaatgtgagggagacacaacattcagtccacagcaaattccagtacattaaagatacaaatatgaaatatgtaaatatgagattattttttaaatttttgagcaagaagttttttgcaatcatatctactaacttgaaaagacattcattattagtgaaaaggaaaaatatgttattaacaatatgtatagtgtttttgtttaaatactttaaaatattcatgtacacatttgcatgtttgtggcatcctattaagaagtctggaaagatacatgcagaattatttacaatgatggatagaactggagatgtagaaagtacttttcctgaaggagttatgtctagatagtaaaccatcatattattattattattctcagacatttgcattgtcagggatttaactaccacttctgttttggtgacccttcaggtgagctctccctgatacccatctttaatacctaaaatcaaactcgtgtcttttacctctatttcttctcggaacgttttttgttttatctattaaataaaattatattatctgccacttagtttcaaaatcctaaggttgtcctttttcttgataactgtcagtttgatccttctacagcagttagagaaaaacaaccaaacatcgatacctctccaaattctaacgtttatttctttgccttcttttttctccctcactttttccccatcacaacacatatttaaggatttcatctttactgtgtgaacctttattttgttttaactttttcattcttcctacacacactgccagattcatattgtaaaccttttttaatatacctcattcttactatcttaagaaacaataacaaaacttcattgtctccattctgtccacagggtaaaaatcaacccttagtagaaacagcctaaatgtcaatagaggtttgtttaagtaagttatggcatatatatacaatgcaagaacaggcaacctattcaaaataaaattctatttcctgtgaactgaaaaaaatctctaagttacatcattaagaggaatcaagatatattaagtgagaaaaatgaagtgcacaacaatgtgtactatgctgcctgtgtgtgtgtgtgtgtgtgtgtgtgtgtgcacgtgcacgtaagtcagtggatgcataggaagctgggagcagcaattgcctctggaaagggaggcagcgagagacattcattttgctctctgttcctttacaaaagagagaacttttaaattttatgccaggtttacatattacctgttaaaataatttatgatgacttctgtaatagacttttataaatagcacatttttaccattgctcatgggttattttgttcttatgtataaagaatagtttggccgtgtgtggtggctcatgcctgtaatcccagcgctttgggaggctgaggcgagcagatcacaaggtcaggagatcgagaccatcctggctaaaacggtgaaacgccgtctctactaaaaatataaaaaattagcgaggcgtggtggcgggtgcctgtagtcccagctactcgggaggctgaggcaggagaatggcgtcaacccgggaggtggagcttgcagtgagccgagatcgcaccactgcactccagactgggcgacagagtgagagtccatctcaaaaagtaaataaataaataaataaataagtaaagaataaagaatagcttgaaattaaagttagttgctttaacagaatggtcttaaaatgggtgtttaatcttcaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaagtgagttgccttgtttcttattctgaaacaagataaactgttattttctgtaatttccatccctttctcccaactcttcctagtttcgtatgagtttttgtttctctcactataaaataattatttttctctcttccctttagctaactctttatacttaatatcaatttctataccttcttttcataaaaagatggcaaactaaaaaccagttttcagtctggttttggagtctctctgatgtgaagcaaattgctttcctaggccttaagtctcctgccttccttttcttatctctcaggattgtaaagagaataaaattttatttggttttttgttttttgttttttgttttttgtttttttgagagagttttgctcttgttacccaggctggaatgcaatggtgcgatctccactcaccgcaacctccgccacctgggctcaagcaattcttctgcctcagcctcccgagtagctgggattacaggcatgcaccaccacgcctggctaattttgtatctttaatagacacgaggtttctccatgttggtcaggctagtctcgaactcccaacctcaggtgatccacccgccacggcctcccaagtgctgggattacaggcgtaagccaccacgcccagacaagaataaaattttaaagaaggggtagaaacacagtgcaatatcgtacttctctaatttatcacatctaaaatggggagactcattgagtttatatgatgaatttgccagatttgcagtgtatgtggccagcactgttttaaaagaattcatcttctatatagttaaatttttgttaaccataatacttccttctgttagaccacaaaattagccacagagtagcattaccttatagctattttcttgttctcaataaaagaaatgtgctgtttaataaaagttttttttaattatatggaatgataggattaaaccttacctagtagaaatattgtcatagatgaggcggtatgagtgggaaacactttgtaaataagtaagtgctggacaatcgtttcttattttacattgtgtaaagtctaggattaaaccatatgacagcagttttcaaactttttcttttcaggaatgctttatactcttagaaattattaaaggccccaaaatactttggtttatttaggttatatttgtcaacacttaaccatcatagaaattgaaatagacattttaaaatatctattttaaaataatgataagcctattacatgaatgtagatagtacatttaaaaaataaatagctatattttccaaatccccccaaaaggtaagaaaagtggcatggctttacatttcattttgcaaatctttactatctagtttgcaaatctttactgtctggcttaatagagctcagccggattcttgtatctgcttctacatttgatctgttatgatttggtgttttggttgagtatatgaaggaaatagacatatttgtagttagaaaatatatactttgatagcctttttagatagtggtaaattttcttctttgctgttatgtctaaatccaacaacttgtagtttctttaggtcagtgatagtgtagaatatgaaaccatatcaactgactttttgtactctgtgttttattgcagtccactggtgtcccttttttctgttgcctaggctggaatggcacaatcatggctcactgtaccctcgagctcctgagctcaggcagtcctcctgcctcagcctcttgagtagctgggactacaggcttgtgccaccagccccagttaattatttaagttgttatgtgaggtgtgagccaccttgcctggcctacactggtgcacttttaatgcatcttttacatgtaacatcatgagttggtcttttggaaaatattggttaattgagatgtacttccaaatattgatatattttattatacaatataagaaaaaagtcacaatcaacaaagcctttaatattggaaaactgttgtgtggcagatacgttttccaaaattttaattttcatttgaaagcttgaattttatcattagcaacaaatactcttagttgtttttctttaaagtaacaggctctctttgctcattttatttgtttgtttatttatttatttattttgagacagagtctctctttgtcacccaggctggagtgcagtggcacaatctcagctcactgcagcctccgcctcctgggttcaagtgattcacctgtctcagcctcctaagtaggtgggattacaggcgcctgccaccatgccttactaatttttatattttttgtagagatcgggtttcgctgtgttggccaggctggttttgaactcctgacctcaagtgatccacctgcttcaacctcccaaagtgctgggattacagacatgagccaccacgcctggcccctttttgttccaaattttagagaagtcctgaatgaccttagtgtcacacatgcttttacttgaggtaaactatcatacttccatacacaatagaagtgttttgtttgtgctttccattttgtcacagaatattaaaaagtataccaaagaattagctgagcgtggtggcatgtggccgtagtcccagcttctcaggaggctgaagtggcagaattgcttgagcccgggaggtggcggttgcagtgaactgagattgcggcactgcactccagccagagtgcaacagaacgagaccttgtctcaaaaaaatttaaaaaaaaatgtaaagtataccaaagggttgagatttaataaaattaatgatttgtactgcttccatcaagaacatttttgagacttttttttaactgcaagtgcgcagaggtggagaatacaaatagtcctggtatgactcgtacggtgtgatgccactgtcttgattcacactgagttgtcagcagtttcactctgttctgctttagcaacatccatgcaagggtcagcacagtggaaaggatgaacaaagtctgaatattgtaagaatagttttggtcttggaaaccgttcaaaggatcttgggactctccaggggttgtggaacatgctttgaaaactgttgctagacagaaattaagggtgcaacagtattcttaaatacctttgagaaaaaaagatgtactggtatttaatttttgttgacaggagatagaattacctgtaatatcttcataacaggattaatttttatagatagcttccttccagaaaagaaaaaagagaaaacaaccgagaggggaataaaagacagggcttaggccaggcacagtggctcacgcctgtaatcccagcactttgggaggctgaggcaggcagatcacttgaggtcaggagtttgagaccagcctggccagcatggtgaaaccccatctgtagtaaaaatacaaaaattagccaggtgtggtggtgcacgcctgtagttccagctactcgggctgaggcaagataatcgcttgaacccaggaggtggaggttgcagtgagccaagatcgtgccactgcactccagcctgggtgacagagcgagaccatctcaaaaaagaaaaaaaataataataagatttaaccagggcttaaccatttgttcctgcttcacttatattagttcttaaccagacttgagaagggcactaaggagaaaagaattaaagtattggaatcattctgccttagctaatatatctagtggtggcccagcacctacactgaatagtgattttgaaagcaagaagaggcactaagaagtgagactcagaatgtattgggagtgctcacaggagaacctgattgtgttatataatgaattgaaagagatcgtacagtaaagggtcttatcctcttcatgtccctctattttgtccaggtagaatatttcttctctaataatcagtaccttaaaaataccaaatgtattttattgtattttgcagagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttataattgggttgtggtttttttgctcagctttttatatttttataagaagctaaatagaagaataattgtatctctgacaggtttttggaggttttagtgttaattgggaaaatcctctggagtttataaaagtctactctaaatatttctgtaatgttgtcaagtagaaagatagtaaatggagaaactacaatcctagaggaaatcactgtgtttctccaggctttaaagttttccacttgcctttcccatctgtccttcagggttgaattgaaaataaagttgttgagatgggaggggtaattggaagggttaaagatcattacacaaatgagacagtgctctcttatccctgaagggtttggttggattataggttgacactgaaggaaaattttcagcctcatatgaaaggaaatacttcttatatcattaatatttttaaacttcaaaatagcctcagttttaatatatatattttgaagtataggctaaagctttcttaacatgtatttaaaactagtcccctaaacactacataagatactaaagctgcaaggtctgtgacacgtacactctgcaaataaatgggcagatacctggaaagagaaccagctgcacaagtgaggatctgaagtgacaggaattaaaggaattataaaagtatttgtgatatagaggataaaggaaagagagccaaagtatttatatttttgagtgagacttggtagaggactctaggaaaatgagatcagaatggaataaaagctaactaaagctattacaaaattaaaacccaaaaaggcccaatctggaaaagacctaatccaaagaacaaaagcagatttgaattctccatgcatgtttcctgttataaaataaattaggaatgtgagtcaaacgttgtcttcaaatatttatcccctcactcactaaaaatgctacttaaatgacagaaaaggaataagacaaatccacaaggttaatagaatggaagaagagacatcaggcaaggaaactgatggatgagtggtaagtgatttcacaaagaaatgataattgtcagtggcagaagactagaagaggtaaaaatctaataagcttgacaaatggagatatccagattcctctaaagccagaggtgcagaataaggctggaaataggattggttttggaaatctttaaaactagtgtgggagaaagggcagatggcagcagtgccatagttttcaatctccaaatcaccatataatagcaactggatagcaaaataaaaatccatgagcaacgtaagtgggtgaagatagccacaagaccacaagctggcattggcatcaattcaggtgaagcagagtgaggaaacggcatctaatggcctgagaacagaacctcagggtcatcacagaaacagcaggccaggttgaaaacagcactcaagtgggagaggctttgcccatttcaaaggtgggtgagtccaagaggcttgtattaaggtctgaaggactgaagcaagctagcccctagaaagtgttagaactgattcgctgagttcaccaaggttctcttccaggacagcgttccccacagaagagaaactgctggggtgaagccaaattgaagaagagaaagatgaagagaaggtccaaatacaagtagaataggggatagtcaaccaaaatctctcagcagaatactggttttgaacacttagaaagaaacagggaagttcccgtgaatcatgcttccttctcaaagtttaggaaatggaatttacttaagaaactaaggaaagtttttagatgaatctcatacaaagttattttaatgaaaagaaagagcaaagataagatttctgggcaatgaagatctatcagaaaggtctacagagcagagcaaaactagttcgtttaaaatgtgctaaaagatattagaaaaatgatataaaatatgacaaatttaggattacaagaatcagaaataagataaactcaggaaaacactggaaataaaaagataccagagatgcaatataaacactatggataattcctttaaaaagaggtaaaaataaaaaggaatttaaaaaacccaatttttgtttaattagaaaatgacaaggcccaacatacagataataggaatttgaaacaacaacaaaaccctataatcttagaaaatgttttatttaaatatataaaacaatattttaaaagtgaactgtggtacctaagcagcagctaacaccaggacataaataatataatactttaaagggagaaaactttttggctaggcaaaaccaggtgaaatgaaagatggtgatcagactttcttcacaattatactttatgcctgaagaaaatggattgaccattttcgagatacccaaagaaaaatgtgagctgaggttttcatatctaataaagttataagcataaaaggctggtacaaacttatcctacatagacaaatttgggaaatgggaaatgttgttcccttaagctcttcatcaggaacatcagaaaatgagctccagataaccacaatgactaaagaaatagtgacagactggtggtgaatattaagcatgtgttgcttatataatttaagagttaaagtatagtatgtaaaagcatatgcaaaaacatttggtttagctggtggtagtctgatattttgggactgtgtgtagactggaatagaataattactatttataggatatttgaaatcctgttttcttgagaatcagggtcccttttttttttttttcaagatggagtctcgctgtgtcacaatctcagctcactgcaacctctgcctcccaggttcaagcaattctgcctcagcctcccaaggagctgagattacaggtgtgtgccaccatgcccagcttcatttttgtatttttagtagagatggagtttcaacatgttggccaggctggtctcttaatctcaggtgatccacccaccttggcctcccagagtgctgggattgcaggcataagccactgcacccagcctagaaccagggattttaatgtgaggaaaaggagatagagaatacagaacatgtaattttttgaaaaaaataaaaaaaaacaaaaaaaaaaaacctatggctatgaatttgaattggacgtagtggtataaactcatgaatgtatatgaatacatgtagatatgtgtgaatatacacattcatgagtttgtaccagtatgttcaatacaaattcataactatcaggatgcttaacacgtcagcttgtggtttcaaagtacctttttgtttttttcattaaaacgagaatttggggaaaatagtctggcaggaagtgtaaaagataagcctaggacatcttgtcacaacaaatagaggggctgggtgcagtgtctcatgcctgtaatcccaggactttgggaggctaaggtgggcggatcacctgaggtcaggagttcaagaccagcctggacaacatggtgaaactccatctctactaaaaatacaaaattagccgggcgtggtggcgcatgcctgtaatcccagctacttgggaggctgaagcaggagacttacttgaaaccaggaggcagaggtttcagtgagccgagatcccgccactgcactccagcctgggcaacaagagcgaagctccatctcaaaaacaaaacaaaacaaaacaaaataaaaatagaggttaacaaaggctgctaggtaatttccaaaagattcaagagccagcttaaaggggcccccactgtgcaaatgtgggaaactttggtcttcaaagaagataattgcaatttactaaaacccatcataaacattaagaataattggtcaccttggaggatgatggagtattcattgtcttgaaaacttgaagcaaaaaagcattttcctgtctttcctctatgaacagtacaactgggtaactaaatggcagatgaaggacatatctctttctagtgttctaataattaagatcatatatttttcaatacccagtggatcaataaatttgaattttgtgcatcaattgctctaacatcacaaaaagaccaggcacagtggctcacgcctctaatcctaccactttgtgaggtcaaggagggaggattgcttgagctcaggagttcgagagcagcctgggtagcatactgagatctcatctctacaaaaaaaaaaaaaaattgtttcaattagccagatgctgtggcatgtgcctgtattcccagctacccccatggctgagatgggaggatcacttaagcccaacagattgaggctgcagtgagctgtgattgtgccactgcactccaccctggatgacagagcaagaccttgtctcaaaaaaaaagaaagacaaccagacattttatgcctgctaatgaaagggctcaacatcacctatagttttgccacagagattagaaatgagtctgattatgcctctgggttcagctgcctgctacattgcaggagattcagaggacagtggaacatgttgaactgaatgaagcatgagtgtacaactagcaaaattcagactcgggaggctcaggtgggaggatcgcttgagcccaggtggtcaaggctgcagtaagccatgattacatcactcaactccagccccggtgacagaatgagacctgtcaaaaacaaaacaaaacaaaacaaaaacaccaaacaaaaactagcaaagaaaaaactttagttgaattcttactctgttatacagaggccccatcatccttccatgctgtgtcccagataagccagtgctagcattgtggctgtccttgggccatcccatctatccttagagttcaggctacttttgccctgcaatcttagccctctaatgattttattttattttttattttttatttttttgagacgaagtctcactctgtcacccgagctggagtgcagtggcatgatcttggctcactgcaacctctgactcccaggctcaaactattcttctgcctcagcctcccaagtagctgggattacaggcacctgccaccacgcctggctaatttttgtatttttagtttcaccatgttggccaggctggtctcgaactcctgacctcaagtgatctgcccgcctcagactcccaaagtgttgggattacaggccaccgcacccagcccagccctctaatgatttaaaggaaagttatgattttgtagattatccagtttttcttgttactaatgtgagaatgaatcttttttccagcttcctccatcctaggcagaaataaagtcccaaatctttgttttttaacgggtcatagaggacccatcatcaccctttattcattccttgatcatctcaggctagagaagtctagggatacagctatatataacatgaccagaagaattaactgggccgtagcataatcacatatttgaaacaggtaagtgagtcatctgtggctagagacaagtcctggtcacttccctattctgccccaatactcaacttattacattcagatgttgcttaatggctagatgcagctttgagggtaatgcttctattaaatatgtcagttcagttttacaatggaaaattctgaagatggatggtggtgatggttgcacaatatgaaggtacttaatgccacttaatcatccccttacaattgttaagatgataaaaattatgtatattttaccccaataacaagatcttttaaggccgagcatggtgactcctgcctgtaatctcagcactttgggaggctgaggcaggcggatcacctgaggtcaggagttcaagaccagcctggccaacatggtgaaactccatctctactaaaaatacaaaattagccagacgtggtggcacgcacctgtaatcccagctacttgggaggctgagataggagaatcgcttgaacccaagagacaggcagagtttacagtgagccaagatcacaccactgcactccagcctgggctacaagagtgaaactctgtctcaaaaaaaaaaaaaaaaaaaaaaaaacaagatttttaaaattaaattttacaatccagtacaaaataaaagcattgtccatccttgtttctcaaaaacccagaaagaccttggtgatctggtcacccttccacattcttattattcagtgacttctcataccaggtactgtatgttgtatagcacctgaagtctttctaaacacatttcagtgtgttttatttatttatttatttgagacggagtcttgctctgttgccagactggagtgcagtggcatgatctcagctcactgcaatctccacctcccgggttcaagtgagtcccctgtctcagcctcccgagtagctgggactacaggagagtgccatcatgcctggctaaattttgtattttagtagagatggcgtttcaccatgttgaccaggatggtctcgatctcctgacctcgtgatccactcgcctcagtctcccaaagtgctgggattacagggatgagccaccacgcccggccacagtgggttttatttaacagttaactggctcatgctttaggggaggcagaatagttgaaagaaccagctaggaatcagaagacttggtctgtaattatgacttgcctgaaactctaagtgacctttggaaagccacgaaacctttactgtcttttttcttacaggacaatcatgagagattgatctctaagtctgaaattggcactccagtgttttctgaatgaaaacacacagtaaattctttgattcgggagtaaaaactactccaaaactccacaagagggcagctcctccacacctgaatggcctcagagaccttccaggcacctttgaggttattgtaaaaccacttttttatacaatgttttatttttatttatcttaattatacaagtagcacacaaatatattcccacataaaaagtccaacattacagatcaatttcaagtcacttttgattagtatgctaatcctagtttcctcccctgttatcaggttgttttctgagactttgaaaacacaacttctgcaactaattttttcaatctgcatataatttgaacatcattaatatctatgtatgtataagaaatttgtggatattaatatacttctcttaactctttaaaatgcatgtgtcataatttacttgtttcttaatgacatttagattatttatcttttttcagtattcaaagaatgctgcattgaatatttcagtactgtactttcaaaaaagtgaagagcctcacaagacttcatggtaattaatattttaattaattaattagtttttaattttattattattttttgagactccacccagactggaaagcagcggcgtgatttcagctcactgcaacctccgcctcccaggttcaagagattctcctgcctcagcctcctgagtagctaggagtacagacgcatgccaccatgcccggctaattttttgtatttttagtagagacggggttttgctatgtcgaccaggctggtctggagctcctgacctcaagtcatccacccaccttggcctcccaaagtgctgggattacaagcatgacccactgtgcccagcggcaattaagattttaaagctaatttattaagccaaaggaggaatgttttaataattttactagccagaaaaaaatatataaagtcaattcatagaaaggggactgaaagagggggaaatgcctggcagtcttccttggaagcattaggttactccattccatgatgtaaatcattctgggatacaatttcctgctagggcattttatcaggtatgcttttgacttagatcaaattagacacaagtagcaaatggctcagcgaatgcagataactgaaacgagaaaagaacgatccagtgttgcacccaggaatgttaggtgctgtgtcctggttactttttttttttttttttttttgagacagagtctcactcttgttgcccaggctgctggagtgcaatggcgtgatctcggctcactgcaacctccacctcccgggttcaaacgattctcctgcctcagcttcccaagtagctaggattacaggcacccgccatcacgcctggctaattttgtatttttagtagggatggggtttctccatgttggtcaggctggtctcgaactcccaacctcaggtgatctgcctgctcagcctcccaaagtgctgggattacaggcgtgagccacggcgcccagcctcctggttacttctgtgtgccccacagtggaaaggaaatgttcgcaggtaatgagtcagagcaattcagatttcatgtgtagaagaaaagttcaacataaacatattggacaatattaatgtaaaatatggtcagccttccacattcttattattcagaataaaacttttatctatagcgaatattcctgaagaacgtttggaattcttcagaatccaaacgttgaatgtcccattcaagctgtcaggttccaaatcctatgtttcctgaagagacatggctgggatccggctgggaaaattccgaaggtgccaaccttcaggtcacggtacctgactggtgctgcattctccttccagccttgaagattctgaaagtggaggtttcttaagcagatacagagctaatggccaggtttcttgggagtacattacaataaatgcaagaggtgcagaaagcaagaaattgctctggatcttagaaaaatgggcttggagctccattagtgtctgctaccttctgcaacccagattccaaattgttttccagacttgtgttagagttattggtgtcagaacatcttttttcatccccagggataagacacaaacacctgcaaagctgactcatgaaaggagacaaggcactactatgacagtggattgtgggagctgtgaggtaggaccttaaatttttttggttttttttgagtctctctctgctgcccaggctgaagtgtagtggagcgatctcgcttcgctgcaacctccgcctatggggttcaagcgattctcctgcctcaacctttcaaggagctgggattacaggcacacgccaccacacctggctaatttttgtatttttagtggagacaaggtttcgccatgttggccaggctggtctcgaactcccgaccacaagtgatccacctgcctcagcctcccaaagtgctaggattacaggcgtgagccactgcacccagccagtaggaccttaaattatctcccctgatagcccagaggagctggaggcagcctgtttgccttcactccaggatgccatggcgtgacttctaaaaggaccgtctgtgatagcatttggtgagcaggaaagaagtagtctgacgtttggaggggtagagtgtgcattctccattttgatctgtgacaatccatacagtggaggcaacaggggggtctggacatgtaagagcttctgggaggaggagactgtttagagggatgtctcagaaaatattttccctaagactgcaagatttcccaccagcaagttttttatttaaaattcaagaaggagcacatgattttgtaatgaaatgagcatggttaaatccagcagctatgcatgttattttgcttctctgagtttcggttctcttttttagaaggaataattgagaaaatatatgtgactagcacagggtcaagcatacttaataagtacacttcctccctattcctgagaaagtttataatgctgaagaagctgatgttgatgggccaagtctgttgtctcgcccagcgttgtcttgttcatggattcgtggagctgctctgattcttcggcccttcatcaacaaaatggtgaaaacagtaactcacacttgttgagtggtaggtgccaggcactgttctaagtcttttttacatagatcaactaacacatttgatgctcatagccccacttcatagccccatctacataggtagatattattattttacacacaa

SEQ ID NO: 1077 - DNA, 196585 bp, Homo sapiens
gaaaagccccaagaaaatgaaataggactcaatacatattcatggacagcttcttcagccaaggaagaagaacaatatgaaacaaattaaaaaaaatttgtatagccagaccctgtggctttatcttggcaattctaagaataattttcttctgttactgttattgaagcataactaagatggtccccaatgatccctgcctcctaatatccatgtccttgtatagttcccaacctttgactgtgggctggactcactgactcacttttagtacatggaatacaacaaaaatgatgggctgtcacttctgagattaggctacaaaaagattttggcttctctcttgcctgccctatcttgctctcttgatttctcaccatgatgaagccaaatgtcaagttgtgagttgccctggagagatactcgcatgacaaaaaactaagagtgacctcccaccagcagctagcaaagaaccaaggccctcagtctaccagtctgtgtggaacctgtgaacaagcttgaaagcagatcatgtcccactcaatccttcagataagactacatctctggctagctgatggcagcctggtgagcaaacatgagccagaggacccagctaagtcatgcctggattcctgacctacaaaattatgagctataaatattgtttcaagcagctaagttttggggtaatatgtcacaagagcaataaataatgaatataataataaatgtgtatttcttttcctttttctttgagatggagtctcactctgttgcccaggctggagtgcagtggcacgatatcagctcactgcaacctctgcctcgtgggttcaggcaattctcctgcctcagtttcttgagcagctgggattacaggcacatactaccacgcctggccaatttttgtatttttagtagagacggggttgcactgtgttggccaggctggtctagaactcctgacctcaggtaatccccccgacttggcctcccaacatgctgagattatgggcgtgagccaccgcacccagcctaaatgtctatttcaatgaagttttacaacacccagatcaagaaatggaatacttctggtttcccagaagctctcttgtgtcccttgagtccctcttccaagggtaaccaccatcctgacttctaacctatagatgagttttgcctatttttgaattctaaataaatagaatcatgttatgacatgtactatttagtgtctggtttctttatttcaacgttaggctgcagttctttcatcttgtaatattttatatagtattgtattttatggagctatttatcttattatatatttttagtattctcattgctgtgttacaattaattgtaaatatgccacggtttatttgtccattctattttagcatatttctattggaaatatgcctgggagtaagattactgggtcatagcatttgttcagatttagcagataatgctaaatagattgccaaaggggttgcaccaatttacactttaccagcagtgtctgagaccaacttttatttcactatgtcagcaggcttctttgctgcctctcagtttagcacaagacaaattatcccatggtattttaaaagcatactttattggtaatactactactaataataagaagaataacagtgatcataatcttttggatatctaattgcctgatatgttaattttcaaaaagcaagatacagtcagtacttcattatattttatattttatctgtatttagaatgcatggataccatggttatctttaaattagacttttaggagatacccaggattaaagaaaagaaatggtagaagtagaatgcttttatatttagatgatttaaacgaacttgggcttttctctttttttaagcttaactttcccagttaatagccttcattttctggttagtattgctagttgaagatatcactgaagcctattgtttttcatcagagagacaggttttattgtattatatctatttttcaattttgcatcagtaataatattttgttgatctatatgagtttttagcattgtgtactcaataaagataattggaatattactgaagatacccagcatttcgttttaatgataagcataaaaggcagattcctttatttgagccataatttttgaattcatggttatagccaagacgacagaatcatatgagcttagcctgtgtctataataaaagtaatgtatataaaagcaaatttggaagtagcaggccaatacatgggtgcttcagcctcgataggcttggtttggatagggagatgcttaatggttgtgtttacttgtcacctgaaagtccctggaaaatagagatgttcaaatttgaggtgtgggtaacattagccatatgggcctaccacctgaaactgtaaagaaacagtgaataataaaatgtcatcaaaagtaggagaataagaatgtcattgtggcaggaaaacattcaaaaaccacattaaatgctatggttcacaatagaaggacatcctctatgaagtttaggaatctttcttctgaggaaaaagaaatggaatggcaaatcagatgcccttccccttcctgagggctgtgtcataccgattgatgggaaagaacaatgaagatttaccagagagaagcactcccagtgtattctgtcagggacctcaggagaccacctagacttgggccttccgtgggtcttgggcagtgcgtgctctgatgaaagggtttacacaaaaacatggggtctcagctgtggcataaattgtccttgtagaaagagtctgggcaggagaatggctggtcattgtgacctccggtgagggctgaggacaaattgctagaaggcaagatggatctcgggtcacttctgtcagtcatgccaaagtgcaactgacttcctacacccatggctggtttctgactcgcctttatcagaaacacttggttccaggccattattatgtttactaattccaggggctgcagattttggatttaggtataaccaatataaaagtaaattactttattctattttgtttcacatagtttgagctatatcagtataaatctatgtgcacatcaagacatttttaaatatccaagaagaaaaaaatagaacgggagcttatgaccagactggccattcctgagtacttcagttcccaggtaggctgggttcgtggggctgctagtgaatctggtatctcttcaagattctccacaggaaggcctcatttcctaggtttttgtgaaaaagaaatgtcatctttcatcactgtgctctctctctcatcttcaagttattcctaatggcatctaaccaaatcttggtggagataaggatggtgaaaggcccataaaaccacaatttagcaggaagagttaaaggaaatggcaatgtttaaactattatgcttgggagtacacattaggtctcctgacatatgtggaggcttctgagaggcagcatgctgcatatctgtacatagtcttcagaaagaacagataaagttcaaaaacactaagcatttcctcgaagcaaaaaatagcattaaccagtaaatttctctctctctcctgagattgttaagcttagcgttctggtaatgttttactgcattaccaatgacctcaaacttagtggcttaaaataacagttaacaacaacggattgcacattttaaaatagcttgaagtggggacttgaaatattcccatcacatgaaaatgatgaatgctcatggtgatggataccctaaacttcttgacttgatcattatacattctatgcatataaccccataaatatatatgtatattatatatcaatcaaaaattaaaaaccaactatttaatcctatctcatcatttggtggaacaggaatttgggcaaggctgggcagggtgattcttaagtgacattgactgaggtcacttggtggtgttcaggtggtggatgggctgatctggagcgcccaggatggcctcattatcaggtctggtgccttggcggaggtcgctggaaggctgagctcagagcagggttgaagtgtgtatacccgtggcttctccagcatgggagtctcagagtagttgagcctttaggcagaagctcagggcttctacgaagaggatttcaagagaaaataagtggaaactgccagttttccaaggcttggagctgagaactggcagcattgcttttatcacattctttcaaagcagtcacggcccacctaaaatcaagggcaggagagggaatgtggtccccatttctcaatggaaagagtgacaatcattttatggtcatttaaaatctgccacctttataacaaatcctaaatctggtggtaacatatttttcatattgtaccttcccactgtctaaacttgctcaaatcagaaaagagaggaaagaatcctcttcgtttataggtacatgctgtttactaataggaaatgctcattaggaccccttatgttagttttgggactattgaaacgttacttaggtaattatgtaagtcctagaacaatgattagtgtgaaaatgaatgggagttcatgagtagtatcaacagctagtttaccaagtatcttttaaaaatgttcattgtctttagagctagaaaatgctgtgtataattcctggcaattgaggtgaacacagtttccctgtcccttttcccgatgcaactgaggcgctttgtttctcatttatttgtttgtttcgacaaagtaatttcttacagacacactaaaaggctttttgtttgtttcattcttatgtagaaaggaaggtgcttgggaaggcaaacttgagtctgaatgagttggggtggtgagaacagaaggacgaacttgccttaaggtgtgaaggaatgtctctagaagcagttcatttcttttcgatactgggttggagagaattttgcctcaaagacagacataagcatgacctgaggggcaagattctgggtcttcagcgctacctgctcatggtgattttacttggctgccctagaaggaacttgtctgtctacacttctatagtttctgacatagacagctctctgtctctacatgctatctctcccactttatccacttgagcctcgtatgtctcatttcccttccttgaatccaactgtggccacacccccattctgacaccttcttcactggcctgagttagggcattccaccccctactttcttggccctgtcactccttgagccacgcataacttttagttttgtatctagtttgttcctagcagcctctcttagttctactctacaatacagacgagaataaacaaattctcatttcgggaagtgctccaactctgacccattcctgcgttttcggccccacctcttctcactggacacttaccatctctccatctcaagccagttgggggccatgttcatggtcttctctctatgttgttacacgagctcctctttgttaaatggtctccaacttacctattattttttcaagattcaatctgaacctttcctccttgattcctgggcacattgaggaaggcttctttagacatctttctgtcttcattcctatggcaccctgggcatagctctattatttggttgtggattatctgtttaaatatcttgctactcctctgctttatgaactctttctgggcaggaaccatggaatttttatctttgcatccctgttctctaaagtgatacctgatgtgtgcacgggtggattgttggaaaaaaaggatggatagatggcttggaaggctagatggttgtctggatgtcaggggatggctggattgtcgaaaaggtgaattaattgatggttgggttcgctgacgattaactttgtaataacattggacgaatgttcataggcagtgactttccccctgggattttgtgacttttgattgccaatgagtctagcacaaactcaatttcccatgacatttctaatacaaatttatacatatttttatttgttgttctactgcagctcttcaaagcatcctgaagttggtcttaagccagcattcttaaaactctaaggaggcaacaaaagatttaaacagtgtacagcaaatggtgactctgaaaccagagttgtttcactgctcactgccaccccgagattgatttgccatgatagatggcttcctaggctcaattaggttcttaattatggagatagttatatttacttctgtcacagggctgatgaggtgaaatatttgcaaaacaatctatctatatctatctatatctatctgtctatctatctatctatctatctatctatctatctatctatctatcatcttatatgtgttgttgttgaggttgtttgagatatcccccaggagaaacagaaatatttatgtttcttatgtttcccctcttttgtctttgaagtcccaaacaccaataaggatttgtttaaaaacactgaggactagcacaggtagagactcagggagagttagaactcacagtcctgctgctacctgagacacattgcttgttatcattgctaaatcataactcttagagccatagcattaatatgtatgaaatcctagctatcaaagggaatgggctggctctaagggtaagcatgacaaacaggttccatcttgcgtgccagtttctttttttctttcttttattttgcaaatttttattttttaaaattttagttctatagatttgcaagagcagtgcaataagtactcacatatccttcacttacattcaccagttgttaatgtttttttttctcagtttttattattattatttataagttttagggtacatgtgtgcattgtgcaggttagttacacatgtatacatgtgccatgctggtgcgctgcgcccactaactcgtcatctagcattaggtatatctcccaatgctatccctcccccatccccccaccccacaacagtccccggagtgtgatgttccccttcctgtgtccatgtgccctcattgttcaattcccacctatgagtgagaatatgcagtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatataccaagtaatgggatggctgggtcaaatggtatttctggttctagatccctgaggaatcgccacactgacttccacaatggttgaactagtttacagtcccaccaatagtgtaaaagtgttcctatttctccacatcctctccagcacctgttgtttcctgactttttaatgatcgccattctaactggtgtgagatggcatctcattgtggttttgatttgcatttctctgatggccagtgatggtgagcattttttcatgtgttttttggctgcataaatgtcttcttttgagaagtgcctgttcatgtcctttgcccacttttcgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttgagtttcattagatcccatttgtcaattttggcttttgttgccattgcttttggtgttttagacatgaagtccttgcccatgcctatgtcctgaatggtattgcctaggttttcttctagggtttttatggttttaggtctaatgtttaagtctttaatccatcttgaattgatttttgtataagctgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagagctctgttttgttccattgatctatatctctgttttggtaccagtaccatgctgttttggttactgtagccttgtagtatagtttgaagtcaggtagtgtgatgcctccagctttgttcttttggcttaggattgacttggcgatgcaggctctcttttggttccatatgaactttaaagtagttttttccaattctgtgaagaaagtcactggtagcttgatggggatggcattgaatctgtaaattaccttgggcagtatggccattttcacgatattgattcttgctacccatgcgcatggaatgttcttccatttgtttgtatcctcttttatttccttgagcagtggtttgtagttctccctgaagaggtccttcacatcccttgtaagttggattcctaggtattttattctctttttagcaattgtgaataggagttcactcatgatttggctctctgtctgttgttggtgtataagaatgtttgtgatttttgtacattgattttgtatcctgagactttgctgaagttgcttatcagcttaaggagcttttgggctgagacagtggggttttctagatatacaatcatgtcgtctgcaaacagggacaatttgacttcctcttttcctaattgaataccctttatttccttctcctgcctaattgccctggccagaacttccaaccctatgttgaataggagtggtgagagagggcatccctgtctgtgccagttttcaaagggaatgcttccagttttggcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttcattggtaagctattgattgtgtgccagtttaaaatcaattgctagttgctacctggaaatgagaaagattctgaggtcttatctgagctacaattgttcagtgatgtctgccatgaatataggatctcctatacgtgattatcataagaccataacatgtgttcgttatgctaggtctccatgctggctatccactgattcaccataatggttcataagattatttatgagaaaatatctacagagattttatagtttctggaagctggtttttgaactaatatgcaacttgatccttcagtgaatatagttaataaaatgtagaaagagagaggtgaagaaaactgtgacattaacacctgttagagtcattttctttagaggataaatgcttgttgttttcctatccagggtgggttgtctactgcggaggaaggatggtttctcaagaagttgtgattagtagtgtgttatattgaaaattaaaagcattcacttctgcacagatgcaaatataatcagtttaactttattttaagcttctattacattgtaattaataataatatactaagttaagccagtttaactgtctagcaaaatgcatttcattttaaaattggatattgggagacttggcaaatgctgtgagattacttagtaaagttaagtatgatgtatatatagaggggaccagctcaccctcataggttagtgctgaaggctcaggaacagtctcaaaggcttagaaatgtggttatatagaccagagcattccattctgattttgcccccagtatacttatcactgttcattttttgctaagaatcacagtctactgacctaaatcacaccctagacatatcagagggaaattctgaccataaatcagccttgcaaatacatagcaggcagccttctctgtagtagccttggaacataatacaaatgatgtcagcatcctctgtggttgggtcagaactagcactggctatttgcaaggctgagtccatattacccttcagcacctgagtgccaagctgaggtctcaacatgggtgatgtgaaggacaagagagaatcagtggctgcagtccttctatatatctggtcactagatccgccagcttcttcaacttgttgggcttattatatctctgaaaggggacctgaacctgcatcattctgcaaaggagatgattcctgagagatgggtgaaatataatcactaactaaagagataaattcttcactttacttcctagtattgcatcccagaaagggttaaagtaagggatattggctcctgctgatcaggccacagtgtgacacattctataaaatgcatcacaaaactacattattcaatagacttgagtgttgcacctgctttcttatctccttgtaggtggttaagtttcccacaaatgcaatttgttaatatggggccacctcttctaacaaggtaaatctaaaatttggcaggcatttgcttggctgcaggtgcaaaatgaaagatctttttctggctttgccaaaaataaaaattatgttgtgctctagtcctgggaaaaatattctcacatggagggtagaacctgaccccgagaaaggggactggaattctagagcccaaatcatgtgctattattcccaaaaggctgagtggggaatctgaagtcttgttttaaatgaggccaggtattgagcaaatctccctggtaagagagcccactgatatttggagatgtagccatttgtgatgataaatgatgactgttactcttatgagctatgagagcttaattaaagctaatgcttagcactctttggaaggtggagagattaaaaactaacttccttgccgaatagcctgggtttggaaaagcatgtttttgaaatatgtgggatctccactctggagccctctgcagtcctgtctgggtcttcacacctaagtcaaagcaagagctatttttgcgttagaatttccttagccaagactacaagaggccaaatgccagggttcatctcagcttcctgtgcattcacatggaaggtcgtctttgaatctgcacgtccagctcgccatacacatgtctcagggagtcactgctcatgctggctatcagcttccgatgcccagagacccagggccggcacacttcttcccactgcacggtggagttgggccggatttcactgaaaggatggaaaagagaggagaggttggaagatccagctttccactttgatcaggaagcaatgaaaactcttgcctaagtcacttgctttctttctctcagttggtgcttaggacactgaagactctcactggctgattcagcaagttatgccccaaatgaggcccccacataaagctctgcagaacctgtcactgacagtcttattgggtcatggttccttccactgggatgcatccgccagcctcccagtggccatcaggagctgggctgattcccatccaaccattaatcaactgaactctagcttgtctccaagccctccatagtagccttatctatgtgactgatcttctgagcctcagctcagtttttgccactagtttcctcctggaattacagtcctatatgaatcccccagctgcctttgctgaggccctgacactcgaattagcttttgccaactcccttgggatagaccttgttcccaggctcagcatctggaatatagccctgcctgctgccatttgactttgagaatcttcatgttctgtaattcaaattcctatttcaaccaccaaattgggcccctccacctatgcaactttctgctaccatttgttgccaatgccctaatgtatgcggctaatgacatagcctttcatggttctagtgttctcctcttcctcccagcctttgccctgaagtcttcctgagtgtcacgaacaagcccacatcagtgcagactgagactaatcagggttggtgagatttagtgttctctggggtgcttcacatatagcctcccctataaaccttgggagattatattcaggttttatatgtatgacagttctttgaggcagatactattcagcagattttatgatcaagaaaaatggaaggtaaccagtgaagtccctttttcaagatcacataattggtaaatgggcagagatgaaatttgaacccgggtttttctgagtcccatattcatactctttctgctcctcttcactgcacttcataaaagtgtacaccatatgttctataagaaaaggctttttctaagatatttgcacacacatatttatagcagcacagtgtgcaattgcaaaaatatggaaccagcccaaatgcccatcaatgagtgaataaagaaattgtggtatgcatataccatggaatactactcagccataaaaaggaatgaaacaatggaattcacagtgacctagatgaaactggagaccagtattctaagtgaagtaactcaggaatggaaaaccaaacatcctatgttctcactcataagctggagctaagctatgaggatgcaaaggcataacaatgaacaatgacgcaatggtctttggggactcaggggaaaggtgggagggataaaagactacaaaatggttacagtatatactgcttaggtgatgggtgaccaaatgtctcagaaaccaccaccaaagaacttattcatgtaaccaaacaccaactgttccccaaaaacctatagaaataaaaaaagaaaagaagaaaaggctttttctgaccattgtgcttactttttcataggttttatttctcaagcaggaaagatactttttgacttagtaataagagtgtcctggaagtgttcatggaggattcattgaactctttgcaagataatttaggaaagtttctcctgcctgtatgcagagagaaaattctcagtgctcaattcaataccaatataagtttgggatatttatttctcaacagctgtgctattgttacctgtatccattcattctctctcctctggttcccccaagtgatcaatcagaagcactttgtgaaacagtggccctggttaaggacccgacctgagaccatgtactgtagataaccacctcaaatagaagctaagtatttagccccctcttatcattttctcttactcataaaaccatccggcataatgatgtgtacatacgaaaaaactcatacatgaaaatactcatacatgaagatacgtatgcatgctattttacatacagataaattcataacagagaaaaaagtattttgataagtggagcaatgttggagtaatcctattttctggggatggatgttgtgataaacgattctcagtaacgtgctgagccatcaggagataccggccatttatcatcttgaatgcacgcaggcaaataagattattattacaataaactgcaactgcccatggtttgtcctctgtgcttctagaccttagcttctgtcctatttgagaaacttaaagtttaagcccaaatcacaaagtgggggagtttttctcttgaaataacatattgaactggatcattttctaaagagcaaaataaatctggaagataaattatttgacgctctggaagcatcaagtgcagaaagttaagagtctgtggaggtggaacctctgcacatctgagacaggccggaggcagtgggggaagagcaggaagataaaccatttcagagtagagttggctcactgcgagtgaggggtgagacacagcaccgccttctttgttcctggctccaattccctgtttaccagctcctcaccttccaggccctctgctttgggttcaataacccctgccttctagacaccacatctggcagggtgtgggtgaatgagtgggggtggtgattccccaactatttaagagctgtattctagaaagaaatacggtcttgcaaaggattttggttttgtggaattgcactttctaggcgtccaagttgttacatggatctggcgctcctagatcagatcttggcaacatagggcacagtggagtgcttctaattatctgaccatatggaagtgggcacggactggctcaggtcttggttgtgaaggtgtgtgctggagtgaggagtaaacagagaaagtggcacttgctccaagttgtaagcccatcttagataacaaatgttttctatgtcatgatttttagcccaagttttgactgtctctgagaaataaagcttctcttgtctgggagatattccaccctgaagctgggtttctgtaactattcagccataaaaagaataaaatcctgccatttgtaacaacatgaattagacttggaggaagggcatcatggtaagtgaaataaaccagacatggaaagacaaatactacatgatttcactcacatgtagacactaaaaaaaaaaaaattattataccatagaagcaaagagcagaacagtggttaccagagactgaggaggagaacatgaaggggaagatgggaagaggttggccaatgagaacaaagtgacaattaaataggaggaataagttctggtgttctattgcatgataaggtaactatgattaacagtaggtattgtatattacaaaagagctagaagacaggcttttgaatgttctcaccacaaagaaatgataaatgcatggggtgatggatacactaaatactccgatttgatcattatacaacatatatatgtatcgaaacatcaaattgccccacataaatatgtagaattacaatgtgtcagtaaaaaaaacttaaaaagagagattgaggactgttacggactaaatgtttgtggtcctcacacattcatttgttgaaacccaaactccagtgtgataccatttagcgatggagctttggggaggtaactaaattagaataggtcatgagggtggggctcatgatgggattagtgcccttcgaagaagaggtgccagagaacttgccctccctctctctgccccatgtgaggacacagtgaaaagacagccatctgcaagctgggaagggagccctcatcaggaaccgaattggtcggcaccttgtcctcagacttcccagactccagaagtgtgagatataaatgtttgttgtataagccacccagtctatggcatttctgttacagcagctcaaactgactaagagcagctagctctctgtctatctacttgtctgcctagacttacgtgttgcagtaactactaacagtaccttaagccagtgtgtgggcaggacatctgtgtccaagaagggactggccttatccatcctttctcccgattcactccactttgctccactccaatgtcagacattaacaataaacaaaccatctggagatttaacctattttgagcctgaggcctcccaaatagtgggtcattgcactgtgtaataattcactgtgtaataattcatcttttgtctaagacacacagtgtcttttttcatgtgttggccttgaccaaggtggaattctagggggatagccaaggtgtaaagatagagaagtttccggtacactcagataaagcttgtgggtttactgtctgggaaggaaaaagttggatacagcagggggctgtatggaagaggaaacgtgtttcactttgcctgaacgattcttgcatctgatttgagtgggaaggtgcgagaatgggtgagtgagactgtcgtttctgacgaaagcaggggtatggctgctgacctctctatgtagctggggttgattactaatttacttatttttttttcctgtaactttcctgttagcacaggaaggttgctatgttttgtgcttgcgttgtttcaaaagcactaagattattttctctgttgtttattgcatctgcaataaggcatctcttaaatgatgagatgcagaagctacgagcattgtaatttgaaagaaatgcggagagccctttatgggcaataaagttgccccagagggtataagtgaggccttgcatttatcccacagattccagagtggggtcgcttccataaagggtgtcgggaaaattcttgacatatctggtcatgaggcagtttccaaagtcctctacctccctttctatgccttagaaggtcactccacaggaaatgtgctagattgattgatgctgacaaggacttatttgtggtagaaatgaaagtaataaacctcaaagattgggatccattctgggtgtcacactttaagaggagtagtgacaaattggaatgtgtgggagagagagagagagagctgaaaccatgttagaggagagggaaataaagtcaggacagatatttgtccccaggtagaaaagattcaaggaagatgagacagctgtttgcaaacatttgcaaaccatcagatggaaaagagatgggccttactttctgtcagtccagatggcagaattaggatcattggcaggatcaaatggtagaaaaacctgtttccttactgttagagctacctgaccatggaatgggttatcttgttgggtcacactctttgttagtagaagtcacagaaactgagacctgtcaagcacaatttgaagtggcctgtgtgtggaagaggctgagtttcattcatatcattacagaacctggggttgtctttggtcccctgaatggggaaccatctagagctctttaggctcaactaaaaaaaaacctgaatccaacagttgtagacactgattgggatggtaaaatctgtgaggtgaggctggagacaaagcacccatgaaaagggggtatctctcagcataatatctgacacgtggtaggagctcaataaagatgagaagagaccatacgtgagtaggtagtacagcaaagtggttcaaacttgggttctggaattcaccagcctgagtctgaatcttggctctgttttcataaactgtgtaactgaacctgtgtaaccagtcaacctctcaaagcctcaaattcctcagctacagaagggagataatagcagtatctacatcgtagggtgtctttaaggattaaatgatgaaagtgctggtcaaaccaaccctagttttactccacgccctacagaaatggtcggcaaggaggaggcagcttccaagacattttcactggggagcagatctatgtttggaaaagacacacacagagaaagcttcccacagccctgcactgcctgcccggtctccccaacccaaggtttaccggaacatcttcttcattggtcttgttactccaggaccatccaggtgtacccagacatttcgcagggtttcttttaaaggattggtaaactcaactgtcacagtcatgtcagaaccaactacctgagtgccacggacctaagagagagaatgcaggtcattagcaccaaataaaacctcgttctgctctcttgttgtcttaaccatcatcacttttactagagttttatgatacagttatttttttggcaatggaaccagtgtgatgaggatagctgattgctttgactggaggatacctattgagaaagagatggaaatttactaattagaatcgcactcttttcctcattataaaaccagcctaattagagctcaggtcaatagcggtggccactgactgctctttgacagcaggagggggaagttcatttggtgtggcaacacgtttccacggtgagggcggccaagtgaactttgcttctggataggcatcaagtttcctgctgggacaaaggggattcctgagtttaagaagtagaaaatgcttcagggcacatgtgccttcttagttttagacacattcgcaagaaatatgccaaggatggagtccttactgttgaacatgaagaggaacctggatactaaaataagtaaaggagatttttcttctacagccacagtaccagagtccaggaaaataaaaggttatttgttggtgagttgatctattatgactctcagaagtatcaggtatttggaagaacaccacaggagacagccagagctcagtgccaggttcaacacttattaacagtggggactcaggtgatttaggctttctgagactcagttttcttgtctttaaaatgggctgacacttttatggggcgatctatgtagaatgctcttattattactataccttaagctgtgtttactgtatgccacacactttagaaccatatgcttttccaacataaacgcaatgtgccgcaaaatgccaggtggctataagacttgtttgtttgtttaggagctatgtataccaaatgaatggatctgtataagctctaagtaacttgggaataagataagaataatagttcttcccttgcaagaaaggtttggaatgaaaaatgctcataaaacggcaaacatattgcaaggcacatggcaaaggcccaatgcattacagttgatgctttttagggtagcaatgctctgggtagtttgtcttattcaccttatatttcagcccacttttaactccaatacttagtacttcaataccaatgtccagtaaatatttattaaattaagtcaatggctcaaaaatggaatttactggatgtctggatcttccagatgacaacacagccattactattccatgttcctttagccactatataatatgggagaaaatatatggaaatgaggcgtttttaagaatggacgtaaagaggaaggacattgcccagagaagaggacccttgcttacttatgctacagtcaagaataaaatcttcctgatctgatcattacacactgtatgcatgaattgaaaaatcacatgtaccccataaatatgtacaattattatatatcgattaaaagaagaatacactcttatggctttactcatcaagccatgctttgtgactaaatttatggctatgggatttcttaagtctataagaaaaacgaaactttcagccaactccctaaactttgttacatttaaatccgcatctcctggagggcagtggtggagagctggattcaggggaactaggagaggggcagacgatggtcatggtagcaacaacagcaggtgcacctagacagcatggatcgtgtgccaggcagggagtccagcactttaaccagcaatcctcagtctggtaatgggtggatcctgtaattcatttatttgaggcacccctgttgattacaaagaaccagccccagctgacaaccataattcacatatattctcacataagcctcacaacacaagggctatatttgtatcagctcgatcagactataataatagttattcccttaagaagaaggaggttttctagggcaggatcactggtgccaggcatttcattttataaaagagaaaactgtggttcaggaaaataggtaacttgaatgaggatttgaagctgccaaatgaccaaggtgggattgaagttaaagtctgtctaactggagatcttgaactctaagatagagtgctactctgaggtcagaggagctggaaaagccaacaactcagcaataacaagacaaccaaaactgtttcgtactgacgtccaaaaaaaaaaaaaaaaaacggcagtcagaaagtaagggagattttcaaaccggtgggagcaacattggatttgaagccacactgacaagactgagaatggataaggcctaatggggaggagactggttcaatgacaggcaaactagaacatgaaccagaagttacttttaggctggctggcacatggggtgtggagagagaagcctggtttgaaggctgtggcaaaaacagtaatcatgatctagatcagggcttctcagcatcaacactactgacatatcgggctggatgcatctttgttgcagagctgtcctgtgccaggtacgatgttaagcaacatccctggtgtctacccactgcatgccaggagcagccccgcaccccagccatcacaaccaaaagtgtctccagcaattgccaaatattccttagtaagcaaaattgccctccagttggaaaccactggtatagacaaaacatgtggaagacagactgaatttttcactttcttcccagaggccctgcctcaatcaatttagatattgaaggtgtagcaatacatcagaatactttacatggtgtccctgatttcattctcaagtgtgtccaatatattttttcctgcattaagaaacatttcaaaaacatctttggatttaaaaaatacaaaataaagatagcatttacaaaagctctctaaactgaagaagatggagctgccacagagacattattggcaaaagtgtttgctatgatcactatattctttctggaaaaaatattttggagccatctgtcttctccatggtatgctatataaggatgggcataagccccttcaaaagtatatctgatagtagctactgacctttcctctacacagacatacacagtgacaaatacaagatatatacaatatgggcatgtatttttaggggatgcactatagacctatgaagtccatacatggttttctaggggcccatgaaccctagattaagaacccttcccataccagtagactggctctacatgaagcctcctacgctgtggaaagtgaaatacacccttccaggtcactgatgacagtgagaaggaatgcttagtatttgagaaactggcccatgcaattgggccatcatagataggcttcagatctgaatatgttcaggacattaaaccttctcaggtaatttcatatgtcatgcctaatcagtttgcttccagtattgtctctgtaattagatgctggcatgggtgtatcaattctgcccagatttccctgatgctggagtggggagcagggagaaggatggggaggggtgagaggagaagcccttctctggttgtagtgtgtttcttttgcaattaacaaagaccagtgtcccttttctgacacttgtctcctgcaccgagaatgtaaacttcctgtccctgactactgatgataatgagccttagacactcaaaccaaactaaatgtaaaaacctacccaatgctcgacatcactgtgttctgcttgggaaatgtaactggaggtgtctccctctccttgcttcttttgaggaaaatgctgccaacacatagtgttttcacgttatgtgttgatttcagtgatgcaccatgctatggtacctacaaaatgctgagaacaatgactatttggggagaaaatatctgtttgcatcacattattttaggaatctgcaaagctcccttttccttattgctgaaagcataattccatatctgcatagtcatattttcatttcattttcacagtcatatttttcattttcttgctctcataaaaccttaaataaagggagccttcaggcaatttagagaaggttagttcaagaagaaacttttatgtgtatttgctttagagaagagtattcattacttgggccagagaaaagaataaagcatatgtcttacttggtgacgtcaaatgcttttgcatatacttgatggccttaagtttttctcaatattctattgaaaatatctctctctgttttaaaaaaatcaacccgtagtatgctttttcaagttacatatcacttactgatattgacattcctgtcctttatactaattcatgataatgagctgctactctgattctttggtaaacaagaaagttactaacacacacatactctctttctcttatataaactttttggaaagaaattacttttttagaaatcacaagatatcttccactaagcatatgctttaaaaatacataactgtattcaaaattgaaactgaaatgaaggaaaaagtttgagaaagagtaacaataagtgaggttggcaatttgaaatacatgatttattagcacacctaacagctcttatttcaagtactttcaatcatgtattgcacgtatttctggaaactgtatttttccctcccccttggcctgtgatcatttttgataatgggcaatttcttgtttgcaaactctgctcatcaccacaggcactgcccctgcttttagctgacacttagatgaacacttactgaccaatgctaatggttctagggtggttaggaaatgttctcagtctatatttttccaatatagtagccactagccacctagggctatttataattaaattaattaaaattaagtgaaatgtaaaaaattcagttcctcagttgcacgagccatctttcaaggactcaaaagcctcatatggctcgtggctactgcattggatggagcagatttaaaatgttcccattaccctagaaagttctatcaactcacttaatcctcccaacactaagaggtaaatattaggagtcttcattttatagatgaggaaactgaggcacagaggagttaagtaacttgctcaagttcacaccattagtaagtagggtaggagagattcaaatgtagacagtctggggccatagccgttgctcagcaacacgtgatcctgactctggttaatgacaacaataataacaagtaacttacatttatttagttagtgtttacttagtaatgcaggcattctgttcatcagtttacttacactaccttatttaatcttctctacagccctatggtcttgggggtagacatgattattaatcccattctgtttacgtgaaattgaaatttagaagataaataaaaagcctacagagttaggaatctggcggaagttggatataaatccaggtctttctgactctaaaacattcatcttcaaaactacctatactgtgatccctgacagaatacaggtaaaaatagaaacttttttttttgctggaatagcttctttattttctgaaatccagcaaagaatcatttgcagcatcaccttttaagttatcgctaaaccatcagttgaggacgaggattataagttgaccctgaactaaattagaaaacatctataactcacctctctctttttgactttatagagaaggaattagatttctatgccagagtaaaatgtgacaaggtagccttggggccttgatatatattacttgatgataataggagtcactatctaggattttctcttttaaaaatgagagatgccacttttaaaaagagaatcagtagcccaaacatactgggattacaggactggaatgtgagattggttattctcatgtgtgtctctttttaagattcaaaaaaatagcaaacatgaaatgcacagagcaaattatgttttaggtaccgcagttaccagtgactcctcattttcattctaaaatgtgtactgttctgtagctgtcctgaagagagagatggaaatgaacaccttcgatgaggagggctcactcatagacatagtttacgatcatctatcctggctaagggcacccacggtttggtcccacggccacaatcctctgtgaaagtagccacgaggggatggagagtcagctatgggagcagggctgaaggtgtcccctcctagggtcccctggggtaagcaggctttccttgctcagagtccctcaggactcataggtagatacctctgatttactccacaaataacctgaaacagtgtcacggacataactgaggtgactgggatgcacacagtggtgctattccaggccaagctgaagggagagcaagctggatgcaggggctgaagaccggggctgccactttgagtttttagacaagtcgcttgacttctctgggcctcagcttcttatgcagttagtggggtgactcaatgtaatatcatacaacagagcatctgacacatactagcattaatgaaatatgaggtttaaagggagaacatgttgccagggtgaccctgagaacctcctcacctatagggtcttctatggagaatgacgtggattcggtttctcaggggttagagaagagagccacaaaggggagaggtgaagaagcccacctcctggttcccatccccggcctccccatgaagggtgtgggtgtgggcaggggtgaatcttggtgacgagagtgcgatggagccacagagagtgcaggaggctggagagagaacgtgctcggttgtggacatggaggggaaaatggtcagggttcagcaataattagaacacatagtctgttcccattttccaccttaatgaagtttgtgatatttacagcactaaatgaaactacagttaagtctcacagtgtagccagtcactgtcatgtactttgtttggggcactcattatatctcaagtggtttcccctttttttctttctttttttttttttcgagacggagtcttgctctgttgcccaggctggagtgcagtggtgtgatctcagctcactgcaagctctgcctcccaggttcacgccattctcctgcctcagcctcccgagtagcagggactacaggtgcccgccactatgcctgcctaattttttgtacttttagtagagatggggtttcaccgtgttagccaggatggtctcgatctcctgacctcgtgatccacccacctcggcctcccaaagtgctgggattacaggcttgagccaccgtgcccagtggtttccccaattttaatgtgtcctctgggataaagttgtatgaatgggatgtgggaggagtgagatcagcagccaccacagccacccacccttccttggtccatcccggtgggtttccagggtgtgagccgtagggagactgaagaggattctactgttaacctcggtaaaaattgtgggcatctcatgaaaagctccagttagaacacaacattaggatggttgttaagaaaaaacaagctagtgtcccaagttggaagagatctggacatggggctggagccaggatgcaactgtgcaaagtggaaaagggaacccccttttttggggggatgtggctccatgccaggctgcagggcttgatggttggcgagtgggctggactgggtcccctcactgtctccttcccacctgcagatgggcacaatctgcacaggggtgagtgctggcctggagggaagccgcccagaggaaggtccctgcctcctctccggggtcaacagtgatacttcccatggatcttgtgttatctatacaattccccaccaatcagtgctggtcatgcagatattctgcttgttgaagtcgatttctgtgggttaagcatctttcacaggccccatgtacactgtctttgcaagaggagcaccccaggctctgtgtaagtgctggttagctcaggttaaaacagagcaactgcactcctggagctgttccaggtgggccagtgctgaaagaaagtggcgcaacctttccccatttcagaaaaatgcaacaaaaatgttctcactgttggccgggcgcagtggctcacgcctgtaatcccagcactttgggaggccaaggtgggtggatcacctgaggtcaggagttcgagaccagcctggccaacgtggtgaaaccctgtctctactaaaaatgcaaaaattatctgggcgtggtggtgggcgcctgtaatcccagctacttgggagactgaggtaggataattgcttgaacccaggagacgaaggttgcagtgagccgagatcacaccactgcactctagcctgggggacagagtgagactccatctaaaaaaaaaaaaggaaagaaagaaaatgttctcactgttgaatttttctctgataatgttttgcttttgttttgttttgttttttgagtcttgctctgtcacccaggctggagtgcagtggcgggatctcggctcactgcagcttctgcttcctggattcaagtgattctcctgcctcaacttcctgagtagctggggttacaggcacgcaccactacagcctggctaattttttatttttagtagaaacagggtttcaccatgttggtcaggttcatcccaaactcctgacctcaagtgatccagccaccttggccttccaaagtgctgggattacaggtgtgagccactgcacccggcctctctgataatggttttgaaagctctaggcatttgctacaatttatttacagagtgggcaccaaataactatatgaagaatggatgaatgcaagagtgactaaataaagagataaataaaaactagaaagtctttcagctaatggacaaaataaatacagagcaaacgcttacttttaaaaactcttggaaacagtcaattgtcctcattttaaaagctttttttttttttgaaaaatttggagacatctgtttgcttatgcttgtaactttaaaaatcacacacataaaaaatggttatgttttctcctagcaaaattgttcctagttcacatgagaaaattagttctattggtgcttcctgacatcctgcaaaggctgcaggactttttccacatgataataccacacaagtgctggctcctgagctgctttagaatggcaggtactgagtagagatcattggaggaacatgtgagtgtctcctctctcccctaggccttactccaggatctccaaggcgggcctccctgcatgaggaaggccccattccacagggaatgctgcatacactcaacacctggtgaccagagattcaagagattccatgccactaggtgagggccacactcaggccactggcccacttcaggccagtggcccacatgctgccctaagcaacccccatgcattgatgggactacagaggagaaagaacatttaccaacagctactaggtctggacgtgggccatgcattctcacaaacattgctacagatgtcaatccccccagtgcagtgttttatatgtgactgtacttaatagaaggagcagtataatcatagtgtattcactttgcaaaggggatactgaagttcagagagaggatgtgtgtgtgtgtgtgtgtgtgtgtgtgagagagagagagagagagagagagagaacaagcaacacatgggaaggcagagaaaaattctatgtctgattgtaatgaaattttcttttctcatcaaaatattttgatagcatggggaaagagacgtgtgctcattaaagtttaatgactgtctctctctgcctgtttccatgtgaggatcacacactctgactcacacatggtgggtgctgggaatggttgactgggagcactattgagcccaggccccatctttatcaccacagggaccagtaaaatccacgactgggtccactgggatgcacaaacaggaagccactggcctgctttggttgacggtgacttggattcagacatgtgagcccagtattgttccagattggcctagatttgatctaaaggggaatcaggtaagaacagctggaaactagcttttaggaaactccagttccaaggctgagttgggtacttcctggagaagacaatgctttgggcaaaggctttgaagagaagggaggaagaaaaagcggctccgacttgtgggagagcagagttgacaatcatgttacattcccactctagaaactcccttgaagcctctttgttcagagagtcgatgataaagctctcatccaaaattgtagactcccctccacatagcctcaagctatctttttcaggttacccttactcatccctgctcccagcctccaccccagccaaggcacgcttctcactgctctacatactgccgtccacctcccctctagcccttgctaacattttcttcctagtatctgaaggggtctctccatccatctctactggttgaacgttatctgttcattggagaccattcatctttctacagtcttaattcttgatgtcccacaccactcaagtgtgtgtgatctctcctcccttgaatacaaaactctctgcaaagtcaatgaccacctctgctttttgtgatagttccattgtagcccagcggctgccagcacaggcttccaagtcaggaagacctgggccagaagtgtctctccttccctcaacaggcacgtgatcacgggccagttactaataaacagcaataatggcaataatagcagcaaccaacatatgtaggtgtgcactgtgactcgggcatccaatgactcataaaaaactcacaaggaccccaggaggagagttaccattgcttttgacttacagatgagaatgcagaagccaacagaggtgaaatgatctgtccaggtttacacagttatgatgttcagaaaacaagctttaaactcagatgatttggttccagagcccatgttctgaccactgtgctacaaggcactgccttctctggtcctctcagttttctaatcagtaaaatagggttatagtaacgtcctccttgtaggatggtatagagggttaaataagatcatagaagagaggcgtttaataatgtagtgcttaataaatcatagctgctgtcatcataatcaccaggggctggtcccaacccttatcttgactgagctgagcaggaagggctgtggtctcctctctgtctctcacataatttcaccctgtgcctggcacatttgcccacagcaaccttgaggctcagtcagttgtgtgtccatccaggctcaaagaggttgaaaaagggtgtgagcgttttcttagaatttagagaaacatatcctatgtaattctggacctctgagccattgtggtttcgtacttttactgcatttagctccctttccaagtcctcatttttaaaaaaccttttattttaagttcaggggtacatgtgcaggtttgttatataggtaaactcatgtcatgagggttgtacagattattttgtcacaaagatattaaacctagtagccattagttatttttcctgatcctctccctcctcccacgccgcaccctgcaccctccaataggaccctgtgtgtgttgtttccctctatatatccacatgttcccatcttttagctcccacttataagtgagaacgtgcagtattcggttttctcttcctgtgttagtttgctaagataatggtctctggctccattcgtgttcctgcgaaggacatgacctcatccttttttacagctatggctgcattgtgtccagtctaccattgatgggcatttaggttgattccatgtgtgtgctattgtgaatagtgctgcaataaacatatatgtgcatgtatctttatgatagaatgatttatattcctttgggtatctacgcagtaatgggattgctgggtcaaatggtagttctgtgtttagctctttcaggaatggccacactgttttccacaatgattgaactagtttacactcccaccaaccgtatataagtgttcctttttctccacaaccccacgagtaccagttattttttgactttttaattatagctattctgactggtatgagatggtatctcatggtggctttgatttgcatttctctgatgattggtgatgttgccaataaccagcatctataaggaacttgaacatgtttacaggaaaaaaaccaaacaaccccattaaaaagtgggcaagggacatgaacatagatatggccaacaagcatatgaaaaaaaaagcccatggaggctataattcttaagaaactaatgcaggaacagaaaacgtaataccgcatgttctcacttataggtgggagctaaatgaggagaacttacgaacacacagaaggaaacaaacagacactggggtctactggagtggggaggatgggaggagggagaggagcagaaaagataactactgggtaccgggcttagtacctgggtgatgtaacaatatgtacagcaaacccctgtgacacgtgtttatctacataacaaaccttcatatgtaccctcaaatctaaaataaaaatagaaagacaggaaaggaaggaaggaaggaaggagaaaaaataactcttaattgagttgtgttttatacaatttatctgacccctctccctaggcctcctttggaatatttcaacttgaagttttcttattactctcctctccccgtttttctcttctcccccccattctcgctcctttttccctcttgtcccttcctcttctcttctgttctctcctctcccctcctgtgccttcctcttttctttcctctttttctcctctccatcttcccctcccctcccctccctccatccttttctcctctgttctctcctctcccctctgttcttctctcctctccctcccttcccctccctccttccctcccctgctatgactctgcatttcacctctccaggaggctaggcaggtccccagtccacaggccggagcttctgcactcagggcctctcacagctccgtgactcctgggtggtccttagggtgtgagtgctttacccaggagcacttctactccatttggatttaggttatccttggagttagttgggctaatggttaaaggacagtttatgggatgatgccccattccacctttttgaacaaacttggcatggacagaagccagaatctccatctctctcatgctctcttccctatcaaatgtccctacctctaaataagtttcctccaggaacagcatctctggttgctttgtggaaggaaacacaaaacaatataactctccatttaaagtactctctacatgcccaggtctgctaacttgtgggataaggtattctgattgtgccctggggaattaaactgctctttaagtaaacccagaagataactaacaaataatcctgcaaattaatagtgcctaaaagatgaaagttatcagtttccttcatacatccggtttattatcagtggtgcaattaaattctattttctgctgtggtttgagcacttcacagcttgggaagcctctctcctgagaccttcacagggacaggccgtcacttcataattaggtacgcacacaggccttgctgctgtcagggaaggttcagggttgagctcataaatgaaacctgcgcaatagcccagaagggtagcaaaagctgcttccaccaagcagctgggacaggcctgcagcagggggtcccacatgtctataggaagagccagctgtgaagaacagcttcggggttagggcatcctgcaccttaagctattaacttcacgttctcatggatgatggtacctctgcagcaaccctaatccccacctctccattttgcatttgtttctccctttgcctgccaaccctgcacagcctcgttttcattcttttcaggcgtcctgtgcacacaacgccatggtgggcctgtgggccatgacagaggcgaaggaaacaaagagacatgacaatgtaggcctttgtagaaaagaagggcctggtgttctgctccctgatgggcattacatgcccgtgagtttgggtgggacttgccttggggtggctcactgtgtcaattacacaggaccagaccataagaacgttcagttgaaggagctggttcccagccctgcttttgcagccagcctgctggggttggaagcccagctccgccatttgctggctgtatggccttggaggagttatagaacctctctgtgcttcagttttctcatctgtaaagtgatgccagtactctttaccttgtggggttgttggtggttgaaaatgcaaccatgtaaagtgctttaagaacagcgtctggagcccagtagttacccaagaaacactgccattctgaatgctgcacagcagtcattggctttccaaatgactcacagcaaaggattcacgagaagcaaggactacctaccctcaccctgcccacctctaggaccattaaaatgtgatcaactttataaagctttgatttatctaccactttagagcaatgtagtttagcaggatctgtgctaattgctcttaatcacttcaagaagattgttctccagagactagggaagggctctaagacctggataagggctgcatgagatgtcactcctcagggtcactgccagaagcctgggttcctgcttccagggcaggaaggcgtctcatggatgcaaccacagatgcccccagaagctacagctgtgggcctgagaagtaggagcacagaggctcccacatttatcttccactctcatcaaccctcggccttcctctgccaagtctcttgagccatttgggcagagatttctggtgatcactggagaggcatcatgaaaactactggtcaaatgggcaaaacaaacctatggtgataaaagtcagaaaagttactatcttggtgatagtctagggggttattggctgtaaaaggcaagagggaaccttctaggggtgttggaaatcctccatttcttcatctggcttgtggttgcaaggcacacgcacatacaaaatcatcatcaagctgtatattttgatctgtgcaatctactatccacaattatacctccataaacaatattactgtccaaaatgttgcaggcagtttatctacctcttatagcatgcctgacccactttattctggagacactgaaagttctaagtatctgtagccattacacatctttatcttcctccacaagtgtgtttatacccacaggttatatttatatctgcagccacatctatatatttaaatctggagaggagaggaaagtgttatatgtatgtgtctatatatagggcagtttacttctttcaaagaacaagaggatcctagcactggtatttttttttttttttttttttgagcaggacattcattcacacacacacacacatacaagcacgcatatgcacacatgaacactaagtctgcgtgcctttgtctctgttccaggatgagacgctaagactgaccttgatgatgatctcagggatggttagcacggtggacttttgcttggccagaacatccctggtctcattgatgcgagctgtgacaaagaagtgcagggacgcttgttccagcagctgacccatgtactcgccggcttggatcagcaccgcctctttcttgactagtaggagaaaacacacacaggcctggcatcaagacttgagacagggtctgctttacttttctccaagtttccctacccctcccacattagcctggaagccaccaggaacacagcaaaggtaaggggcaagtggaacaaagagtcaattggggataagctgtcctgcttcttaggtaaagaatgtgctggaaatttaatattcattgaagtctcactggagaaaatgtgtcaaaccttccaaacagttcttttgctgttgtaaaagaaatgccatggaaaagatgtgattttcatggcaaagaaggaccaatgggttttaatggtggctttgatttgggccgggatcatcccaaaatggaacatgtggggtgctgaagtccaaggcccccattccacataggatcccttgtcaaataagaagtgtctcacctaggccatgggccacactcagactaaattgtcaactacctacacattttctctgtagcattccacattttctctccaatctgatatgatttttctatttaagagaaggaagctgttgaaaccagtttctaccaaaggcattcaactatctccgaacctctgtttgtgatttagaagacctctgtgccaaacaattgttttctcaatggaaaccagtcactgatgtcagatttctaggtcctggggacaagccaatgagaatggcatttggaagatggagagtggtcctggctcccctccaattaccatctgggctgaggatggtgagttctatcttgtggctctggctcactttctctctaactcccatttcccactgtccaggattctagagagcaatgggcagtttttctgtaggctgagcccaggtgtgcacccactgctacctggttggagccagatgcctgtatgtgccgacagctggcagactccgcaggtgaatgggtgactcattcctccatccccagccacagagaacagactctatgaaccttcacagaactgaatgtctttactgctttccttctcagtttctggcttttgccaaagacttccccttcctgtggaagttattgaaggaaacagcttcatggccaacagtttgagcacagagggtaattcattttagcctgctgtactgaacagcagttttgcagcagggtggggtgcctgtggatgggcatgcaccagagcagagggcagggcccctgactccccactggctcgaaggtgtgggtgcattgagccatgcccatcatctgtggaggaactctcacacctgcgatggatctgcagcagcttgctctggaccttgaagaccaagaggctgggaaagcctctgtcttgggcagcacttctatttggaagtctctttacagatgcgtaagtgctgtgccttgcttccaggacttctgattgaagagttctcagtcatggctctatatcacaatcacctggggacccttaaagacctaccaagctggctctcattccaggccaattaaatcagagccttggaggacctagacatctgtatttttaacagctctgcagctgactctgatgtgcagccagggttgagaagggccactccaacaaccaggggcatccctgtagaatcagccctgcagacagcctgggttccagtggaagggatggctttccagtccaggtctttgctgttcctcctgcggtctgcacaccagcagcaccatcatcacctgggagcttgttacagatgcagattctctgacttcttactgcaccagtgaagtcaggatctgcatttgaataagaccccagacaatgcctattgaagtgtgagatactctgagagacaggaggttctaacagcagaaggggtaagttagggcagagttagggtggactgagaactacctgggttttaaattgaaaggcctgcatcctgagaaccccatcaatccctggaaaactagaaaggttggtcatcctagactagtagttgtcaataggaggcaatgttatccccaggggacatttggcaatgtctggagaactttttgattgtcacaactggggtggagggtgggttactactggaatctggtggataggggccaaaaatgcagttaaacatcctacaatgcacaggatagtcccacaacaaagtatccagcccataatgtcaatggtgctgaaaccaagaaaccccgcatagggcaggtggattattagaatgtattggcctattttgggcaagcgctaaagagctagctttgttggcttgattcctggggcagagctattccatttagagctgactctttaaagctatgaccttgccttgaccttggcccccaggtcctgccttttggaatgacccgctctcgtattgctgtctttggacctaagcctggaccctgcttcctccatggctccccttgcaattaattgtttagatgagtgaggttctggccctctattggttacagcctcagatgagcacaaatggtcagtttatcgtgtctctagatagaatggatgaagtggcaaggtggaaggcctcgaagaagatgccttttgcctctagctgtttccagtaataacaataataaaatgacttcttctgactatttctagaggactatgtttgaccactggatttcttttggctaatgggatatgatttctttacagaggctcttgctacctttataatctcagtatcaggacccctttcttctctgaggtagaacactccctaaatcatagcactaaagaaaccaggctgtgcttcagagcccaagagaacagtgcttctgaaatagtatgttatgtaagtgctgtgttttgccactgcacaagaaattgttctagataaagtttattaaacgtggcaggagaaggaggaataggttttcgctctatgagcggtagggctgggatgctgccaatatcatttacggtgtctggggaaagccaagggagacacagactggagctgcctcatctcttttccaaaaagcaaagaaaactaaatatagccaagtggaaatgatagcacctttgaaggtacggagaggtttaagttattcagatctcccaagctgattccagcacacacattccctttaatcatcaatctggaaagtatgcctcccattctacttggaaagctttctttgcagcagaggcatctaagaatgcttgatcaaggcctgaagttatgtggctttttgcaatacactgcaatttaatttatatttcaatatacaatttattggtcacagttaataccacctgcctgcagggcaaaggaacaaagagtctccagttcccttcaagttattcaggacaacctggggctggccaagcgaatgggagatgtgttcctatggactcaggcataggtttggtcagctgtccctaggtcgatgactgagagaatgatatcattctactcacccatacaagctcattctttaattggattaaagagggaaggggaaggagattatgagacaggacacttgtgaggtgggaaaagggctggcatttggttctttgtctaaggatctgtgctagactccaggtaatgggagcacaaggaagggacctggcccacttggggccaagtttaccctgaactggctcactgtcactgctattatctgtctactctattatctgctttgcctctcattgctgtgtgggggcttgaacacatcgactcatctctcgagcttcagtttccccaaatgtaaacatgttggaagttaccatttactaagattctaccatgtggcacacatttcacattcatcactcatttggcttcctccataccttccttctctcacaccacatatccagtctctcagccaatcaggcgggctccaccttcagcacatgcccagatcggactggttctcgctgcttccatcactgctatcaacccctttcagtggagtgattgcagaagcatcctaccagtctctaaccttccgccctacttcctctttagtctcttctcaacacagcagccagtggtcttttcaaaacctaagttagattatgccacatttctgctcaaaactctctaaaggctcctcagctcactcaaaataaaaaccaaaggccttataaaggcctacaattctttatatggtctgcacccagcactgcccccttgccacctttgttcctgattctggctccttcctgctcattgaacacatcagacatgctctggccccagggcctttgcacatacagtttcttctggctggaatgctcacttctgaccttcactcaggtctctgttaaatgtcaccccattagagagggttttttttctgaccatctccacaggtactccccgttttccttaacctgctttgtatttttctattacccatataactatactatagattcacttgtttgtttggttcccccatgagatcagaaattcagtaagaataggcattgctgtgtctccagcataaaacagaacctggacttgcaagcactaaataaaggttaggggaatgaatcaagaaccccggggtgtgtgtgctgtttttcccctttgcagatgaggagagacagctcagagtgcttaagtaccttgctcaggaaacacagctggtaggtgacacagtcatcgcttacatccagaattgtctatttgcaaaactctctgaaatcaaatgtggctgcctgttttaaacaatccccatgactgttgtcctcttcagtcctttacactgactattcttttccatgaaaattacctttactaccctaggaataggaaaagtgccaaagcttttagtttccaaagaaaacactatagtgttttttttttttgagatgaagtcttgctctgtcccccaggctggagtgcagtggcacgatcttggctcactgcaacctccacctcctgagttcaggtgattctcctgtcttagcctcccaagtagctgggattacaggcacctgccacaacgcctggctaattttttgtatttttagtagagatgagctttcaccatgttggccaggctggtctcgagctcctgacctcagttgatccacccgcctcagcctcccaaactgctgggattacaggcatgagccaccatgcctggccccactatagtgatttcttaattgttagctccattactgaagctggggagatttgcttccttcaaatttgagtaagttccttggaattaggattttaaaaaatagtttctcatttttctgggaatattttccaaaacctcagtaaggggaccatgatctgtgacagccacaaaatccagagagcttgagagcaattcagacttgtggcttgaccatcccaggggagcgtattagttttgcttgcctttgctttgtcaaaattattatttgtacacttttctcttcagtgccccatgtcaggccaacagaaattggtgccccaaagtatcgaggtcctttgcaacctgctctaactcattctctgcctagagaccagtttcttccaatggacttgtgttgcccatcgtgtggtcaactgttgtgcccaccaaatacgaacatcctaggaaatgtgattttttgagattgtaatccccaaggcaagctgtagcacgtggaccctgatctgcttaaaatattctgagtttttacagtgatgaaaatgcttggaaggatgtgcatgcaaggacgagaaagaggccccacaagagatggcagaggcagaaaacctcttcctaggcccctcctagatgacacagctttgtttccagcctccattcttttcttttttttttttttttgagacggagtatcgctcagtcacccaggctggagggcagtggcacgatctcagctcactgcaacctccgcctcccgggttcgagcaattctcctgcctcagcctcctgagtagctgagactacaggtgcctgccaccacgccgggctaatttttgtatttttagtagagatgggttttcaccatgttagtcaggctggtctcgaactcctaacctcaggtgatccgctaacctcagcctcccaaagtgctgagattacaggagacagcgttttaagaagcggcctatgtcagcgcgtgtatctttttgaatgggaaagcaaagcacactattcattctggacagcccccaaaagactttcctaacttgggcgagaggcaccagcagagggcctgtttctgagatggatcatttagatccatgctccacaaactctcctgtacactccagtctgcttgggatcttgtcaaaacatggattttgattcagagggtgtggggtgggacatgagattctacatttttttcaaactcctggggaatgctgatgcagctggctcatggaccacactttgagtagcaagaagttacatttaattctcacaactcatggggctctaggctttgaaattttcaatgttcacttctgtgcatgagacgtgaggatgaaagtggaggcttttgggccgagtgcggtggctgacgcctataattccagcactttggcaggccgaggtgggtggatcacctgaggtcaggagtttgagatcagcctggccaacatagtgaaatcccgtctctactaaaaatacaaaaatttgcctggcgtggtggcatgtgcctgtaatcccagctactcgggaggctgaggcaggaggattgcttgaacccaggaggcaaaggttgcagtgaaccaagatcatcgcattgcactccagcctgggtgtcagagcgagattccatctcaaaaaataaaaataaaaaaaaagaaagtggaggcttttgcagaatgagtgggttctccctgtgaggctcacacttctgagatcttggagggaactttaactttgatataaagctataacgggcattaacacctagcaagacaggggccagacagcgagtctcagaaagaaccacaccattgttagcttacaggacaagggctccagcgtcacgtcgaacgtctccttcttgaattctgccttcgggaccccggtgtagaaggtgatgttggctgagagataagctgtgatggtgtaacggttgtggctgttgttccggaaggtgatggagagcttgaagtcttttcccagcacagcattttccacttcaaagtccatgtcaacgttggaccttgatttcatgacaccttctgtgttgaggggctttttagctccgtacatcagggcagtttctagggccaatctctcttcttcttgacctgggggagatccagagataatgacaggcaaaaatacaatccaccagagagaaagtcacattaatggatgcaccgtgtactgcacttgttggggtgtttctataatacaagcttcagacctccccaggaggagggtgccgtcattattcctatgttataaattctgcaaagtcagattgccagacagtcagtgaccagcctaggctgcaagttaggaggtgacagtgttgggatctatccagaaaggggtttctccggggccactatttcagggggtgggaggtaaaattggcaatgtctatcttttcttaaactgtggtgtcagtttgcttgcttttcttagtcccagccatgtggctagaatttggggacctctaataattggaaataattgcctcttgccattccacctcctgcaatgtaacttttctctctgatttgtgaatacctgccccccaataagacctgtcttcctcatctctccttccacttgggcctgtcccacttgctgtttgctgagctgacccttgagggctcctgccccgttcttccctatctcactcaattgccattgcccccaacacccatgccatggcagaaggttctaccaaaacttgcatcccccagtccccaaggatgctgggctctggcaagacattaaaaaggcgaccctgcccaaggtgctccggtcagatcccttggagatgccctagttgtccagcgcctcctggagatgttctccaccttaattagcaaattagaggttctaagtgaagcccagcagcaaggacacctctttgcctttctttacacaaggtttcccaaactcatctgacacggagggcagttttttgagggacatctgttgacaggcggtggtgcacctaagttctaatgcagttcgaggtgtgtgtgctgcttttaggaaaatgttttgtgcagggtttgcaaagtggttgtggtggagatgaagggaggaaaaagaggagggtaacctccagaagaagaaaaacatagctttgtctaagtgatgaggcagaaaatacagatacaagtcaggcctcagaaggagcttatgcctcagacactgggaaggtgggagaacggtccttacagagccttggacaaaaggctttggcttggaaacagggctcatgcagatgtgagggatggtcatcatcctcttttccatcctaaatacctttgggtttatctttgtgtatccctaaggatagagatgagaagatgaaggcaaattccttggcttgtaaaaactaggcttgagaatggctagtgaaaaaaaaatcactttaaaataagaatcctagcttttataattatgctagtttaaaggtattgtcttctactttatctagttaataataaaatgcaatggtgactgagaggtcaatgaatcatcagaaccctcactgagggctagctctgtgccaagcactggcataagtgcttatgatgcattgtgtcatttaatcctcataacaacactataagacagacactattattaccatcactttccttgtttgtaaaataagggtgtctacatcctaggtttattaggtgaattagaggaagtagatatataataaatggaagctactctgcaaagacagaaaaaatgccagaaggcattgcatacgaatgtgaatgtgtagtgtgtgtgtgtattaacgatttccctgattgtcaagactgcaagaatgtgccaggaacagttggtctaggacaagcatcagctagagcactcggagggaggtaagaaaaagggaaggaggagtgaggacaagggaagtgcagtgaaatcttttagcagaaatcatctggccaatagatccatgagaagagaacattaatgatgatcactttggatgcgggccagagatgcattgaggcaaaatgcaggagggaaattcgagcatcaggaacacatcagagaggagctgagctggccaaggtgaggtgaatgggagaagaagccttgaagccagccacaagcaacttcacagcctgccatgggtgcaggaacctggagcttccttctggggaagcactgtcctctgtgagcggagaccgccaaacagaagcaggctggggctgttccaggaagcgcaggcccagagaggagaaaacaactgcacggctttcccagagcctggcagagtaattcctgtttctctacagttatgctgcgtgctctggcatcttacataattcagggccacaggcaacattttagtgcagtgagagacatatccaaagccagattatattttctgagattcttctgcagcctctgggtgcaaagtcaaaaatatctttccattaactaggatgtaataagagagcccttttatgttggacgaagcctctcattcttctggctttagctccactgtcacctcccctgtcctccccctcttaccttgtgtaatgtgtcctcaaaccctagtgttctcggctctccctaacacatacctggttttatttcctcttccttgtcacagtactagttactgtgtgacattatcttccttgctggaatgcaagctccatgagaacagagacatgttgtccacctctgcatccccaggccctgaaacccagcctggcacagaggatctgaaggattgaggtttggagaagcattttgctttcagccagagacaaaactttcctcttcataatagtccagtttaggacattttatgttcaactaagcctagctgtgaaagtgcctccccagtaaccattcattcaaatcatctcatgctgttggaaaccccataatgttccaaacaccgtgctaggcactaggcacagaggagaaacagtctttccctcactggtgcagaaggaacacgtgaagagcaatggcagcacacaggtgctcaccacagatgctgggacggaggttggcctgcagtgcatggggaaaggaaggggcatgggaggcctctcggagtttttggagcgagggcaagaccagggatgcaggtggggggcttggcttgttggaggaactgctggcaggtccctggcctctgcatacaatacctgtgggggcatgctcaggaggtgcagtgaccaggtgccgaaaagccacttagcaagaggctttgtgagttaggactggatgccctggaggccacagggagaggggggggggggtggggcttttaagcagtgctgggagaggctcaggtttatatttcagatattactttggcagcaaggcaggggctagactgagggaaggagggcctgaggaggtgaggtggaattgggaagctagagcaagtatttttccaggagaaaactaatcatagcccaaactaatagcagtagtatggcaggaataacagaattactagtaataggggaaacttttattggacacttattatgtgtcaggcactatattaagagttgtacacaccagataatatttaatttttaggctacagagctggaggggaggggatgcattcgagaacaatttcagaggggacatttagaggatttgttgcttaactcattcttaagtagctaaatttgagtggatggtggttctcttcaccagagtagggggagtgggagaaacggacctgaggtgagggagagagtgagaggtgtcatttgggaagttccgtgtcaggtttctgtaggacatttaggtaaagtcccggtggagacacagacatggggtgatggtacatatgtgaacattaacaccagctatgtgggaagaacatcaggtgggtgggaatggagcccaaggatagatgcctagaatgaaatggaatttgaaaagggtgaagaaaggggaaaagcttatagtcaaaaagaggtaggaaaagagggtcaggcaggagggggtggaaccaggagaaagtaacattgtagaaacaaagaaaagacagaattgcaagcaaagggagtgaacaacagcaccaggaagtataggaaggtcaagtaagctgaagtctgcaaaatgtttcttccctgtgacaattgggtggtcttggcaaccttgagaacaacttcaaggaagtgctggtagcagaaatcaggacagagtgtgcgcggaaggagtggagaaggaacacagcaggacgcaagtccaggcagcgctccaggacggcaaggaggcgaggaggaagagacagtggtgaaaaagatttttgtaatttttgtttttaacacagcagatatttgagcctgcttaaatgctgattggaaggagaaaatagagagggagaggtggaaataacagtgaccctggaagtaactgaaggagcaaagagggaatggaatcaagacactgttatcaaagaagatatattgccacaggagaagtcttcagaaattctgattttcaaagtcttatcgtttcttaattatatatcttgaaaaaagttataaagttaataataagctttagtaagttgaagtgaacctgatctttccatgatttaattcattaaaatagttaagtcctaaatctagtaataatttgtttcctgtgattctactcatttccatattttggtatctacactcagcatttgtggatcagagaaattataagagattcaacggtgagaatcagggtggtaagtactgagccacggatatgacgagtcctcactgcatgccagtggccaatggcggccatcaatccttctacccgccacattcagatgcagtcttggtgttcttctcaaaacaacattctacttggtcacttccaaagttccagtttgaaatgtgtatgccacccttgattaagaaactatccacttggggtcaaactccagccccgaagcaggatgagtcgtcgcttacaaccatctatgtggatttagggattcttctagttggaccagacctccacactgtccctctccctcagccttgcctccttgctaaactctagaggcctggacctcagatgtcttcctcatgcagtgcggacacattttgttttaatttgttatccacccccagccaagcccctgactcctgtttcgtggactgggttttagtctttcctctcgtggcatctgattctgtcccattcctgagttggccttcactgtcacctccatgctgacagctaatggcagctgtgctcggctccatggtttccaagagacatctgtcatgtggacagctcgcttcctgctgcccctagctgcctgtaggtgcaacttttcttcactactctgtctggtcaggacttcttccaaatacgagagttctcaccacagtccttgccttactgccttttcttggggacctctttccccagcttcatctgccaattcttgtgtgtcctttgggcttagtgagcccatcactaacttcctccacgaggtcttccccaactgccgattcttggctgagagcctttctctgtgcccggcagcacccgtccaccctgtgccagagcaattctcacccagcacagtgagggctgccttctgcttttctccccagctgcatgggaaggcagggctgtacatgtatccagctctacacagcactggaagatggcagatggtaagagccagctgtcgtgtggatgtatgtatgaatgagtggatgttgcagctaacttttctatgaacttgcttttttgtttctccaaacctttttttgcttataactctacagtaagagggcattgcttgtttgttttgttttatttgcacttatattgttttaaattttcctttaaggaaaaatccaaatgacaaaaaaataccacctttgtatctgtgttgtgcaatggatgataaccaacagaagaggaaaatgaagcatttaaaaaatacagtgaaaattcactagttcagataacaaaaattctgactttctgagactatgcacaagtgttctcaattcagcaagcttcttctttgtagtgcaaattacttttgtaaataagagcagggagactgtctaaactatttaaaataaattctgcactccttagcacttcatggattccaatgaatatttaggtatatgctaattacttgtcatttttatccatttactaaaaataaatactcctaagaacctctggcagtgaatcatttgcaaaatatgttgcatgttccccatcaggacactcacggtcctccagttctggccactgctggcctcgggcagctttgtcttcagtcactgggcattctgagcctgcaggatccccctaaacataccgggctgctgcacgccctgtaactttggtcatgttcacactgtctggaaacccctgtccagcttctttaaccgaggtccacgacttctcttctcaagtctttttctgaatcagttggactaaatgcccctacttattgtttccaaagacccctctgcacaataatcctgtcactcggaccaggacaggaactgagtcctgctcactgctggaatcgccagcaccaaaccaattgcaggcatagagcggacactaagcattgattgagatagaattaaactcagtagtgccatttgaaacattctatgcaataaaagttaacaaaaacccaccatgacattattttggaattgaaactggccttcgacctaattgtcctgagttagagagattgcattgtcctattaatattgtattatctacgttgtagtcttccatgataatgtaatagaacaatgtatgtggaaataattggtaaagtactaaacaaatgtgaagtagttattttaatttctattattggactaaaattacattagttatacagtgttttctaataggattatttaaaattaaggttcttgtgagcaagaacatattctatattctgttaaattaggtatgactttaaaccaaatcattttacaagccacgtgaatgagaattctgcccaaagcaagctagcaaagaaaactacaatgaaaaattgcatatgtgacgtgtctttcacacgtgaaagtttatacttctgctgttgctaccaaatgctgcaaatgccagtgcattctctggaactcatctctgagtgacaatgaataagtactcaatggacttgggcaaataaatcttcattcagtggtagtaaattaccttcttggaatttgtaagtatcagtaatatccatcatgccatctcctccaatttgtttggtcacaattaatttcccaatgtgggtggcatccacattttccaccacatgagtgccatctttcttagctgtaatgtaaatgaggtcgctgttgacctggaaacaggagaggagagcattagccatcatcacatgtctgctgttgccaaagtctttaactgtccatagagcagtcgtctagagatctctggagctgacatgcccctttcttcaacaacattggattcgtatcatagggccaaacaggttttgaaaatattctaaaggcgaatctagttgatttagtagtactttaaataaagattatttgaggctgagataataaactgtctaagaagcaaccatttttctccctcctctgtccttgtgataagtcctacctctcacaggagagaagacaatgccatgccaccatgcccatcgcttgcttccctggacttcttttgggctaactgtggctatgtgacctactgccaggaggaagaggaagtctgctaggtggcttctgggaaacatttttcccctttgaaaaaggagagaggtacatggatgagtttgtccttccccttctgctttcagctgttttcaggtgttttcaggtgaagggatgcttgaagctgctgtggccatcgtgagacagtgaacagaaacactgctgacaatgagaaggtggcagagtagaaagctgagaggcgtttggggatttgggggccttaatgatgctgttaaatggctaagcccgcatcaggaccacctatttcaggatttcttatatgagaaaatcagtccccatctgtttcagccacattagttctgctacttgaagccaaaagtatttaaattgaacaataatattagatgatctaggaggaattcaggctattttctattggttcagcaactaaaatgtgctatttgtgggactcagaaatagtgtcttggggccatgctgtctgcccccaagctctcccaaggctctgctttactattctactttctagagacaatgactaatgtgtgcctgaaagctgactgtaccagagtcctttattacatattttataatcactttcttgaaggttccagttattatcatggaagcaggtaggaagcatgaattgtactgctaatagtcattgatgtatttactaaatgtttcccaagctcctctccaagcctcagttacccactctttaaatagggtgataataactccttcttcataggacgattggcagaattaacagaaacaaatgcacacacattacttatcatagtgtctggcatagagtaaatgctcagtaaatgttattgataataatattgaatagtattgccagatattgtttaaggattcagaatcctaatgatgaacaaaatagatttggttgctgccattagagagtttatgctttagtaagcatgattctgtgcatcagagtcacctggagaactttaaacaaaaatagacgcctgattaaggaggtgggacctaaatcacgtgaggccctaaatccattatattttacaaaaagtctcacataattctgttagatagtcaggcttgagaagccctgcaatacagtgcgataagtaccatgaaagaataagtacaagatactttgggagcacatggggcagtggagtcaagggttggctagaaagtaacagccaaggtgaaacctagatggcatttgagaggaatactagatttgctgcaagaaacctgggttccgatagtgggtgtgtccttgtagaaagtgcatgttaatctctatgaacttcagttcctgattctataaaataaaaatgattaaatttgttctgccaattttatgggagcattttaggccagagtgagataagatctatgtgaacatgacttgtaaatttcaaaattgagtaaaaatataatagtcatcattaggtaatggggaaacttgaagatatatccctaggttttaaagttgaggttaaagagagcaattttactttctcacagaatgttctgagtgcacatgaagtcggatttctactaagggggagatagccaacatttgttgcatacctacaatgtttcagggacattttataaaggatttagtttgaacctcacaacaacaagcctgtgaggtatatattgtaaccgtattatggatgagggcaccaagactcagaagggggaggcaaagtgtttgtggtttcatggctaggagctgctggagaagcagctcaagccctgggacagcccataacctggcccttggccttcacggcacaccgcctttcccacaccaccctgcgggagcatgagccccagcttgagtggtgagatggttccacacttgcggctcagatttctgagggtgataaacggtggccctgcccctcagcagagcagccagaactcaggggtgctagccacatgttgtgaaaggctgaaatgtgaagtcaggaatcaggacaggagaggacgcagcagatacctgtggaatatttgtcattttggaagctttaaatgagctgtctgagaattcgggaattccctctggaggaagccatgtaagtacaaacagcgaccccctctactttcaaatcgtagcaacaataatgataaataacttcttaataacaatccttataacagcttgtggttttccagggaaacaagcaaaatatgaaagtggctgattcctgcccccccaccttgaatatggcttcagaaattcctgtaggctgaaatctcaggacagaccaacagcactgtcctttgcggagagaggagacgagaaacacctgtatggggtggcttttgtatatgtgtgttggggtgggatgtggagggaaattattctttccaagcgacattagcaagctttctttttggtttcggcctgtagtggaatggttctctattctggttgtactagggaatcatctaggagcttaaaaaagcatggaatgattggccccacccaaaatcaattgacgctctatggtagaacaatagataagttcagagtgtatggcaaggattattggacttaggctgtgtggctctggatgagttactgaatctctctctttttttttttttattatactttaagttctagggtacatgtgcacattgtgcaggttagttacatatgtatacatgtgccatgctggtgcgctgcacccactaactcgtcatctagcattaggtatatctccctatgctatccctcccccctccccccaccccacaacagtccccaaagtgtgatgatattccccttcctgtgtccatgtgatctcattgttcaattcccacctatgagtgagaatatgcggtgtttggtttttggttcttgagatagtttactgagaatgatgatgtgatctcattgttcaattcccacctatgagtgagaatatgcggtgtttggtttttggttcttgagatagtttactgagaatgatgatttccaatttcatccatgtccctacaaaggacatgaactcatcattttttatggctgcgtagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgggatggctggttcaaatggtatttccagttctagatccctgaggaatcaccacactgacttccacaatggttgaactagtttacagtctcatcaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctcttgagtttcattagatcccatttgtcaattttggcttttgttgccattgcttttggtgttttagacatgaagtccttgcccatgcctatgtcctgaatggtaatgcctaggttttcttctagggtttttatggtataaggtctaacgtttaagtctttaatccatcttgaattgatttttgtataaggtgtaaggaagggatccagtttcagctttccacctatggctagccagttttcccagcaccatttattaaatagggaatcctttccccattgcttgtttttgtcaggtttgtcaaagatcagatagttgtagatatgcggcattatttctgaggactctgttctgttccattgatctatatctctattttggtaccagtaccatgctgttttggtgaccgtagccttgtagtatagtttgaagtcaggtagtgtgatgcctccagctttgttcttttggcttaggattgacttggtgatgcaggctctttttttgcttccatatgaactttaaagtagttttttccaattctgtgaagaaagtcactggtagcttgatggggatggcattgaatctgtaaattaccttgggcagtatggccattttcacgatattgattcttcctacccatgagcatggaatattcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagcttttgggctgagacaatggggttttctagatatacaatcatgtcatctgcaaacagggacaatttcacttcctcttttcctaattgaataccctttatttccttctgcctaattgccctggccagaatttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtgaataagctttttgatgtgctgctggatttggtttgccagtattttattgaggatttttgcatcaatgttcatcaaggatattggtctaaaattctcttttttttgttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctatattttctagtttatttgcatagaggtgtttgtagtactctctgatggtactttgtatttctgtgggatcggtggtgatatcccctttatcattttttattgtgtctatttgattcttctctctttttttctttattggtcttgcttgcggtctatcagttttgttgattctttcaaaaaaccagctcctggattcactaattttttgaagggttttttgtgtctgtattccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccacgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggaatctaagtctctttgtaggtctctaagaacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgaagggtcttgactctttatccaatttgccagtctgtgtcttttaattggagcatttagtccatttacctttaaagttaatattgtcatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctgaatatgaaattctgggttgaaaattcttttctttaagaatgttgaatattggcccccactctcttctggcttgtagagtttctgccgagagatccgctgttagtctgatgggcttccctttcagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccatcactttcaggtacaccagtgagacgtagatttggtcttttcacatagtcccatatttcttggaggcttttctggtttctttttattcttttttctctaaacttcccatcttgcttcatttctttcatttcattttccatcgctgataccctttcttccagttgatcgcatcggctcctgaggcttctgcattcttcacgtaggtcttgagccttgcttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcgttctccgtccagctttgttcctttgctggtgaggaactgcgttcctttggaggaggagaggcgctcttctttctagagtttccagtttttctgctctgttttttccccatccttgtggttttatctacttttggtctttgatgatggtgatgtacagatgggtttttggtgtggatgtcctttctgtttgttagttttccttctaacagacaggaccctcagctgcaggtctgttggaataccctgctgtgtaaggtgtcagtgttcccctgctggggggtgcctcccagttaggctgctcgggggtcaggggtcagggacccacttgaggaggcagtctgccccttctcagatctccagctgcatgctgggagaaccagtgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctgccgccttgcagtttgatctcagactgctgtgctagcaatcagcgagactccgtgggcgtaggaccctccgagccaggtgcgggatataatctcgtggtgcgccgttttttaagcccgtcggaaaagcgcagtatttgggtgtgagtgacccgattttccaggtgccatccgtcacccctttctttgactaggaaagggaactccctgaccccttgtgcttcccgagtgaggcaatgcctcaccctgctttggctcgcgcacggtgcgtgcacccactgacctgtgcccactgtctggcactccctagtgagatgaacccggtacctcagatggaaatgcagaaatcaccagtcttctgcgtcactcatgctgggagctgtagactggagctgttcctattcagccatcttggctcctccctccgagttactgaatctctctgagcctaccttccttgtcgggctggtggatagattggtactacttgtgaaagccctacatttacggctaatttttcttccttcttttgaatgtaatgttagtgatcccctttttctatccctacacttgaagggttatcatcacacaaaatctgggcattggtgcatgaaattggatatttttttcacaacaccacacccttgcctcttaagtacaggcacttcctacatagtagcctctaccattggtcagggccctagcttctcagtaaaggtggggtggaaagcaggcttgggggctgctctctgcaaatgtccacctgggcccatagaatgtgaacatttgtccacaggtggcagaagatatgctcttcaccactgaggctagagacgtgctcttgctttcaggaccctggacagagtttgctttggtttgtttatttgtttccaagtggagataaccttgtctgcaggctctgcagagaaaatgctgcttctcagagggcatatggaggcagtgaatgccttcctggcactggaccctagatcctgctctcagcaatgcggttacaagagcttctaccttcatggagctcatattctagaagggagaaatggagtacacactaaggttggaggatgaaaacaacagggcagatggtgatattttaggtgcagttgggtgagcgaaggcctctttgaagaggtgaccagagcagagacttgaatgcagagagggaacaaagcatgcaaagcattcttcctacacagagtgaaagatagtgaggggagctttcctagcaaaaggagcagtatgtctaaaagtgctgacacaagaggatgtgtggatgctttctgaagagaaaaatctcagtatggctggagggaaataaacaagggatgaagtggaagggaagccatggaatcttgtaggaatttatgttcagttttattgtaagggtggtggaactccaccagaagggttggggcaggagtgtgatgtttgtatttacatttaaagaataattctcttgctctgtggggaatagacagaaaaggagcaagagggggatcagggagatgagttaggaggagttaggaggtaactttatggagctcagtgttgtacagagctcagagggtaacgatagagattgtagaagtggctggatttatgataattttgggaaggtatttttggcaagatgcataagggaggttaagaaggaaagctaaaataattccaaagttttgtatgctatttgaataaatgactggattattttatagccaagtaggagatgccaaaaaaataggctgcatctgataagatagtagcaaaataaataagtttgaattgagaatgaataatctacaggaaaacatctccacacgttgtataagagaactgctggcccacagcagaggagggcttagcttcttgagtgatgagatggttgctgtggtcccagggagccagttattgctcctgtcaaaatcatctcagcgccagtgagggcaggcaggagtgtgtgcatgcatgtgtgtgtgtatgtgagtgagtttggggtggagtggtgtgaaagagggcagcagagttaatgagaagttaggacagaagagagttatctttggcaagaaggagagagttcttcactaagaacccctgagggcttcgtgaacatggaatcttggaatacgactccagacgcttagaacagctctcatctcctctcacctatttggaagccctaggccaccataagctggggagataggcagatggggcttcagatccacaggaacccactgcagcagggaggacatgggaagggaggggtaagagaaataagcttcaagccctggcagaaacccagaaatgtggagggtgaacttccaaagtggaggaggagagaaaaaaggaacagaaggtaagacattttccaggcatacccctcttctttttaggctctgctttcactcatggagactaaggccctgggaacactaaaaaacagtcaatgaacatgatgcttgatcaagcctggaaatgagtaaggaatgaccaagaaagtcagcatgctgggagggaagagaaggcgagctgatgcagcaaggacgagggagagcagagagagccacagactcgaacctgagtcatatcgactcatatgacactccccatggggtcccactgcaggcacccttgagaaaagattcctcatacacttttcatcaactcaaacatctcttaaaaatggctcagcccctggagcgcagcccatgccaaagcaacaaattgtaccctctgtcagacacgcctctgcagtgggtgagaaaggagtaattataatctgcaaatcctgatgacattcataacaccccgatctatatttaataatagcaaaaagtgtttgcatttacagctattaggcagcttgcttgtggagggaggtcctccttctccttctttgcagcaataaagtgtaataaaaagctgaaaacaaggctttgtggatttcagagtgatctcctcattaggggctctcgtagcatcataaactatcaaatgacagctgggaggtttgtggaaatcttcaaatcccaaagtgaaaacgaggggataaaattccaagtccagtaagcttggtctccaaaggcttctgtaaactgccacggcaggtacgatgagatgaacactggtcttttgtgtgtttcaaattcctgatcttgctgtctgaattttgatgttcgttttgctttctaaatattaacatttctcagtcctgcctcctcttttcctcattattgccatttgtctagctcatgccctttccatctctggcttggagggatgaccagccctctagatgttccccacaacttcataacaacccctccaatccgtgttccacaaggctgtcagcaccttgcccaagttcccacccagtgaaaactctccctcacttacaggagggacaaggagcaagtctctcagggaggtcctctgcactgcgttccttcagcctccaccttccaacacccctgatgcatccttggcgttctagtgagtctgcacagctttcaactgcccccacaaagctttcagatgctcaactcatccccctgctttgcactcctcccttcctctggcttctttctaatcattttgcctaatcatccctccttcccatgtggtcccacagttctctgctcttactacctggggacacttccacaggcatcctcactgtctgttcccaggtcgcccttccttcctagatggtgtcttgtggtctttgccatcctgcttcagttcttggcctctacttcccaactcatgcatcatatgaatgcagatctgtgctctctacatggcccacctgacaagtattgttgttatttcatgttcagtgtgtttgtgccctgtcacctggcatctagaaatacgtttcttaaagacttgaaccttagaattccccccagtacaatgcctggtgtacattaataataactatttgttcctcctggagtactagagtgcaatggttaccagtatgcattcaggtatctgcctggcttcaaatcttagcactgctatttattagctagatggttgtgagaaagtcacttaatcactctttgcctcgattttattttctgtaaaatgggaagaattatcaattttagaaggttgctaagagcatccaatggtaggcaaagtgaaagacattatttcagtgtatttactggtgcaaatataccctggggaagtcctgcctctcagtctttcaagtcttcctaggccggcagcccagccttctcgtttacccaacatctcttacatttaatttgattttcagagctctccttgagtatcctttaacagcctgttctgcttccagtccctgcctagttcttctgaaatggcagagcctttgcccaggcattcccatcaaccctgtaggtgggctgtattcctctcttagagtagcctccaggctccccttcctcctttggcaactcaaccctccctccctggccacaggtgatggtgtgggatggcaggacatagattgcaaaggccagggtaagaccatggttgggtgtgtgtatgtggattttgtcttacctggattgctggactagtcccagagggaagtggcatgtcctgaaatttcaattcatgacccatctcttccaatgaggttagttgagagatccattagtcatataatttctctggagcagttgatacttaatgggtgcagagaactaagctaatgttagtaaagcatttacttttgggagtagggaatcccaaaacatcaaggaaagaaaaatgttaaacaagaactgcatttagcattaatagcctggaagttggaataatgcctagttacctttgtcaacacgaagcatacgctatgtacctggaaaacttagaaacaacaacttttagcttactctttcatgtgttaagaggttggggagaaaaacagcactttcctccagcttcctgcttacctctgcaaaaacaaaaggtgcatcaaattggaagcagacatggccgtgcttgatggcttgaaccgaggcggggccacaccgatacatgcctgcattgcacagaggaagggcggtgtgagtttgtcatctccaattctgtccagatactgcaagattcatggcactgagggtgactctgtaaagaccagtgttcccaacttcattgctgatttagcccagatgctttccaaggctgaagagaattccattggctatgccccctcaagccaaaaattgaagccatggaaataaatacaaggcaacactattcctgcatctactctgccacctacagacacatacccagatgtgttgatgccaagcaggtggcttacacagcatttatctcttgttcaggtggtatctgaaatgttggaaatgttgatgtgtgctctgtggttgtgctgctgttgctgtttgttttgctttttgtcttttgtttttggacattatgaacatatgtcaagtttaactggagaatttggacattgcctgtgcattttggccatgcccaccatgcatttaggaagtcagagggcctatgttactcttctaaaatgctttaaattttaaccacctatctatatagttaataagagattagctgctattagtcacctgtaaaatgtccccatgatatatataccagaacaccagaaagtgctaaactttcttccttaaagcctaggattataatatggtttcagtatgaatatccattgaatgtttatgcatgttcctgtgtgtgcccatcgatatatcaacacctgaggaaataaacataatatccacagtctactgattctttatattatcatattaaagagagatggaggcttatgatgtgattttataaaaatctgggggaggtcagagctgcagctgcttagcatagttggcaagttagaagacaaatacccacatactgaagctttggaggaaatcacatgacataaaaggaggccaggttctggaaaaacaatttaaaggatgatctataattatttttcgagttctctattttctctcctgccttatatcttaccagtgcataccacaaagggctgaagtatattttatagcctagtaaaaatgcttacagatattttctctcctgtcttcaaaactgcttagcaaagcaagaatggatgaattatacgttgttttatattctttctctaaaatctgtaaaataatcagggtaaagctgacaatggaaatgaaattaaacctgattggaaggtagctaatactgtacatgtgcccaggaagcacacttcagatgttgcctcccaatgggcgtggttcccacacatcaaatgcaagcataaaagcaaaacaaagatcagcaatgaagcaagttcccagagggaggacacagttttaccatcgctattttcctggggggtgctgtccacagcttgccagcctccaaatccaacaggaaggtcaggccttgtcatccatgcttcattccagcagtggtagttccttagaaaacacaagcccagaaaggttaaacttcccatcacacccaatgctccaagagatcaagaagtgacggccaggcacagtggctcatgcctgtaatcccagcaatttgggaggccaaggcaggtgagtcacaaggtcaagacatcaagaccagccttgccaacatgatgaaaccctgtctctactaaaaatacaaaaattagctgggtgtggtggcgggtgcctgtagttccagctacttgggaggctgaggcaggagaatcgcttgaatctgggatatggaggttacagtgagctgagattgtgccactgcacttcagcctggtgacagagggagactccatctcaaaaaaaaaaaaaagtgaccccaaatcctgtgcatatgctatctacagattattagaatggattaagccaaatctgagggctcctggagatatcctggggctctagacttgggttttctgggcagattcattctcattggcatccctcaggacactcacatggctggatgtctctttccctctgctaagagcagcttcaaggccacccaaagatatttgaatcagtgcattgaacagttttaatcttaaccattttctgctgactaacgaaacaacttactaggtaccgacagggtggggaagaaaagttaaccaaaactgaaatatttattttgaactttttaatatagttcctatttagaaaaagcatattcctttgtagcaattaagcaaaaaatacttgtgtttgtggtcttagactattactgtagaaactacaacaattatgcctgactataattctctacaatttccatctcgtgtccaacaagaagaatacgttgtcagggtgaatctctctttaccctttattaaaagtgctaagggtcatggaaaacttctcagaaatttgaatatgaccctggaagcaagagcatggaataaaatgccatcatgaattgtattattatgtccttgaaaagacctgaaattatatgacagtacagaatcaaatgagagcacattaacccctcagcactatagaaaatgttcatatagtaataaagaaagatttaataatgtggtgaggtagttacagcagtctttgtttatgacactgatgaatttcaggttcaactaccacgggttccgtgcctagacgcccttcaatgtcagctgtttgcccatgctcccatctttctctgagtgcagcccatttttgattggttcaagagatattaatttcactatgtacccactacacaccaggcaccttggtaggtgctggagactcagagatgatcaaaacatagattcttacccataaagggtaatcttctaggagaaatgacaaacctgtaaaccaattatcaaaactgtcataggtttgctgtgagacttaaataagctaatacatgtatttcgaacacagactggcatgtgttaagtgctcaaaaatggtaactctcaggctttgaaaaataattaatttaaatgatccctggtaaaacgggtgttgatttggggtgccatggagtctcagtggagcaaagtctccaggtatttgggaagtgatgtttgagctgaggctcgaaagataaatgggaatttaggaggtcaagaaaaggaggaagaacaaagttacagcggcatgaaatagccatcatggtttgtttgtggaactgtctgctgtgtgttgtggctggagcatagcgtgtttgaacattcaggttcataggagaacggtgatggcaggcaatgcacgaaactaacaaatacatataacacttccttagtgcgaagtggtgttctaaaaccctcatggatgttaacacatctgatgtccctagcaccctataagaacagtactattggtcgggcgcagtggctcacgcctgtaatcccagcactttgggaggccgaggcgggcagatcacgaggtcaggagatcgagaccatcctggttaacacggtgaaaccccgtctctactaaaaatacaaaaaaattagctgggcgtggtggcgggcacctgtagtcccagctactcgggaggctgaggcaggagaatggcgtgaacccgggaggcggagcttgcagtagtgagctgagatcaccccaccgcactccagcctggtcgacagagcgagactccatctcagaaaaaaaaaaaaagaacagtactattataattacccccagtttacaggggaggaagctgaaacccaggaaggttaagaaccttgctgaggtcacagctagttagtgatagagctctgaaatccacactcttcaacactgacctatgatataggtaaggataagattgtgaaatcctttgatatcaaattaaacattcatgctttattcttaggctataaaaagccattggaataatttaagaagaagatctaaatttgcaaatctctgttcgtggaagatggatggagaggcaaggctggagattgagctgagtcctccccggctgtcccccacccctgaagaactgcaatagtggaccagaaaggcattcaggtggccagcaccatggagagggagagaagccattggggatacaacccacaggtttagggagatgtgagggactcggatgagttggggaagacttttgcctgtccaagtagtatgatggttttgtttaccaagactgtgaataaaaaaggaagagaagaaagtctgtgttgggactggtggtgatgggtggatgaccagcccaattctgggcaggatgagcttgagtgcctgtgggaaacccaggaggtgaggcctaagaggcatttttgtctacacttgtgatgctctggattggatgaagcggaggaggaggttgcgggagtattggtgggtggtggaggagggctgggcaaagccagctgacaaatgaatgaggagggaagaaagaggtagcttcttccttaagagtgacttagaggctggctacagtggctcacaccagtaatcccagcattttaggaggccgaggcaggagaactgcttgagcccaggagtttgaggccatcctgggcaacatggcgaaaccctgtctctattaaagttaaagaagttagctgacctgtagtctcagctacttgaggggctgagtgggaggatcacttgagcccgggagatcaaggctgcagtgagccatgattgcaccactgcactccatcctggaagacagagtgagaccctgtctaaaaaaaaaaaaaaaaaagtgatctaggttgtaagacagaagaaaagatagggcaggggctagcatgtaatgcaatgcagggaagtctgtttcggttattttcaaattaaaagagactgaggcatgttcatggaggaatggaggaaggtagagacagtgggaatataaaagggagctgaaataccaaggttgcaagaggatgaggctgagagcaacaccctggacagatgtgggaagcaaggcagggtctgcagggagagaagggtacagatgtggattagggtgaaggtgtggaggtctctgagcaggaacatgaggtcagttcccacctgagagcctccatctttgcttggaagctggaagggaggtcactgtgtatgttagacaatgactctgctagcctctctccagagcagtgaaggttgccccatcaggcagaaggacccagggaaaaacagcaataaaacatttgcaaccctgaatggacgccgtcctgcttcctatacgacccgaagtgtttagtgaccccctggctttcactgctacaccatcaccctagattaataggctccagaatagccttatttaaattcaaatatccttggcaaggttagcctggaacaagataaatatgctttgcacttcagatctcaagtaaagacttttctttgaggataatatttcttttcaaatgaccaggacccggggaaaagtttcttttctctcactctgacatctaattagttacacatgatctcttctagtttcactcatggctgagacgttatctgtgtatttagggtgggagtttcataacagggtcaggaacttgcaggcagtgggtgaggtggggaggaagcaaatgctcccagtagggctgggcctccatcaatgggtggaaagctaatggctcagctcccagacagcccatgaagagaacgagagggtgctacctccacagccatggggatctctttcaccatgcaatcctctctactcaggaatgactaggggaattgtgtcctaagccacccgtgcctcaagagtttccatttggctgacattacacaattctatttaagcatgctcagttttttatatcccaagttcctccatgaaagaggctaatgtttacagacatttattttcctgttttttgttttgttttgttttgttttcttgagacagggtctcatgttgcccaggctggtattgaactcctggcctcaagccatcctcctgccccagtcttttaaagtgctgggattacaggcgtgagcatttttctcagatatttagcatttttgctgcaattcatacgtgtcagaggatctaattttcaatatacagtagtgtcatttccctttgtgttggaaaacttcctttagcatatctttaattttttaaatagacacataataattgtataattgtatatattatagggtacaaagtgatgattttacatatatatataaaatcaaatcacattgcaggataattaagttaataacatatcgattacctcccatatttatttttgtggtgcaaacatttgaaatttactctcctggcaattttgaaatatatagtatagtataattaactatagccaacatgttgtatatttgatctcaaacacttattccttccgtacagacttttcctaatttcatctactgattctccaggttggaaaataccaactgattcctgaaatgctactttttattctaaagcttctttatctagatccataagagtttttctgttttcatcttgcaattccatcatgcatttgtagagtgcataaatctactttgggagctctgttggtcttattcttctacacatctccagcactagagcagggcccagtcattaggaggtgctcagtaagtgttggctaaataaatcatgaggacatctagcaaggaagttcttattaaacctttgcttgtttgtttctctttaagattcatggttttttatgttctcggagccttcatttgaaacttaagttctcactatacagtcaaaaggtaccgtgtccctttaaagtaaaaaaattctaaatctccttgttgcctctttctatagaagcagtatagaaatcaaaataaaggcctcatttcattgagacttgtttaatcaagatgagaacaacctttgggaggataacgatggagatgacaagtgaagaacacatctctgctttatgtttcttcctgtgtgttccgtgcagtgacagctagtaatttttagaactcctttcaaggatgctaataattcagcagtattggtacaaaggactcagagaaccttcaccaaaggcagtacttcactagaacagcagcaccatcccctgctgggggaccctacatgggacgtcatagtttatgttgtgattcagtaaatccatgtgctttgaatttgtacacgggaaataatcatacaaatgcaaagacaagtgtgttatgtaagaatgttcatcatggtgtaagaaagggaaagtggaagcatggaagcagcctaactgtccaacatgtgatcaagtattttgaaacagaatagaatgctattcagccataaaaatgcagatctatattgactaggcaagaaagacatccatggcatattagtgtttcaaaatcacatgcagagcagaattttaaatgactcccactaccttttgcataattttgtataattttctcccctgagtgtaggtgaaatctataaacagaacaggctagtactcctgtgactatgttgctttatgtgtcaaggaggattttgcagaagtaattaagtttactaatctgttgactttgagttaattaaaaggtagattatcaggtgggtctggcctcatcagatgagccttttaagtctgggtctagagatcagagacagagcaagtcagggattcaaagcagcagagacattctcctgctggcttcaaagaagatagaagcatctatgagttctacagctgcaaggaactgaattctttcaagaacctcaatgaatttggaagaggactctgagcattagatgggacaacagtcccagccaacactgatcgattgcagttatctgagaccctgagcagagagacccagtcaaccagtgaccaaactcctgacccacaggaattgtctgatgataagttgtgtttttttaagctgttacgttgtggtactttggtactttggtatgcagcattaaaaacatgcatacgacacacaaagagacatattacagaagggttaaggaaatgttacagatgttctgagtagttagaaaatagatacttcttactttggtattttttctgcaacatttaaaatactgcataataaacatgtattaggttccctccgaaacactgaggactatttatttatttatgtatttattttaccaaaacccagtagagcacagtagttcaaaatctgtcttggttctggctaaggtcatatccagaggtataggagcctatggggtggtgaagagctggacagagaacacagctgagaccaacatgggcttcagggtgctatgtgtttgaagaaaataaagtggttaatttaaacaaggagtcctttactgaccttaacttggctaactaactgcttaaacagtccacagggtcatctcatttacaatctatctgtccagaaatgtttcagagaaaaggagttcttaaaagggaagaaagagatatgggcttgtaattttgtttgtgcagctttattagggctcaggggagagcacaaataagatcaagagaaagccctggaggagatgtcttggaccaacttcaactgtaaaccaagggtttgaattctttcatagcaaaactggcagggggtgaaagaaaggcactgtctatcttgcaaatcatttgtgtatttgtagcagatgggtgtagccctacctctctggttctgctaatacattccgaatacagacaacaatattgttgacaataatgacaggacatcctggattattaagctctggccatttcaggggcagtggggataggatggggtgggagttgttggaaagaagtgggaacaatttggtggactctgaggcttgtctaacaagacatttcaaagtggaaatgaaagcctggacttagaaaaaaacttgttaggaaatataatgaaggaagatgacagaaaggaattattcagaggaaagaggcatgctgcaggaatctttgatggagctgcgagcatgacactatttcagaatacagctattcattgtttgagcctgttggagtgctgaaaccagcaaggggcatttggatgttaactggcgtcatgtcaaaggccagcagtccagtcaggtggagactaggccagggcccctgtcctctctgaggctcagctgcttcagatccctctggctgggagccacctggggaagccctgggtagccagtcatgaatggcctcatttgcatagcaatgctatatgggagataaatggagggcgccatgggcatcccagctcagtaaaggatgctgttgtaggaatcaactgaccgccaagaaaaaagaagaaatgaatgtgtttattcttacttgtcctgtgaaggcaaggggttttgcaagtctcactgagaagtcacgtgtaaatacagtctgatatagcacaagagacctcaatggagggggttgcagatggcggggtgcacttggacaggtgctgtagcttccaccattaaactatgaggtgtatgtgtagtaggagtgatagtcaaaaccattaataagtgctcagacacaggcatgaaccaaatggatgttgcaacccatcggaaaggacatcaacgctaaatgcagttctaccagggcatcctggctagataccagtccagatgtcctcactcacatacacactacaggagtactgaacaaatttccatccacaaagtctttagggagtgagtccttccttagtcctgagagtacagcctttccactctcttcttaagcttccaagaacagatttcttggatatttatcaagagaattgtaaagcagctttgttaatagcaatttttagaaaattaggggctgattatccagctttctttttttcttctcctttcatttttccccatggtgtgattacgtgttttattattttttttttagtgtagtacctccaaatggaacaggcagggaatgaaaccaaatttggcaaaaataaaacacaagttataaaacaaaacaaaacgaaaacaacaaaaattaaaattaaaaattttcagaaagtagatgccaccccatcacacagaccacgtttgccatcattagttagcagaaagccctttctgagcacttctgggttccctttgctgggttcattttgaaaatgaagccctacccccttttaccactctggcatagcaagctaggaattaatatcctgactgaacatgaagaaaatattgaattttgagagcatttgtttgtaaaagtctaatgtataaaaaagtttatataataaattctggacaagtgtctccataattattgaaaagggttaaaagaattccaaccaatagacccagtaggtaccaaagttactgttttgcattataaactatttatgaatatgatattctacagctgatggctcttatttttgtaacgtgttcctagaggtattattaattaccaaaaggaattacattacattcagtatagcctaggcggtgcatactttattagtttctaattactttaaaactagtaaccttctaacggtatatatgatgactcttgtaggcaaaaattatgattaaccagaacatgattccattgccatatggagtgttttctatgtggtttattaaatgattcccactttttttccctttctgcctaatttcccaagaagttattacaatgacctctgacattttacccccaaactccccttggtttactctcaagtgagacttgagtggaatgagggcttcaggcgctctttggagacattccagcagcaggaatggatgggtacctgagaggaacgggaggagagtgtagggcagtgatttccaaccttcaaagagcaatgcccccttcttgtttttaagcaaatattttttacattccttcattaggctgaaactaaatccatagatggctttctacatacataattttctaaaagatcaatatcatgccccgtaatgtatgggagaaatggagaaataaaaggatatacatacaataatatgtgtttcagcagatatatgtcaggaagactctactagatgccaaaaatattcttacaaaatgtaaagcaccttagcagtgtggtaggaagcacttgtgtagtggttaagagtgggctctgggaaacacctccagagtggcagagtaaggactactggaaatctgctcctccatagagcaatgagaacacttgcaaatatgatcacagctgacctttccagaactctggaagtgaagcaaacaacaatctgaggggcatttattcaaggaaaaaaacaaacaaacataaatctcagtaagaagagtgactttgtggagttttaatttgccttattctcaccccacctccacagtagtcttaaaaaccagtagcctcagtagctttgcaaacttgcagcctagaaaccaatgaaggagagaaaatgagttttgaacactccgaaagctctttctctccaaattgccactgcttaacttgcctggcagctctctgaaaagctccattctcagggcttgtttttatttgatctgattcacagctcattctgaatcagccctattcatataatgtataaaaataaaatagaagcaaatgtttaacatcataatgcctgaaggggcaataccacttgagactaaaaaagggctatccaaaacactttgaaagaaaaaacagggaataagatgtccataggaggctttgaaaaactctgacatagatagccacaaacatgtgcagggctgtgagcatgcccaaaagaaaagccccaggaaggtcctcatctctcatctctggttgatcttgaggctctgtccacacaggaagtgaaggctaatgaagaattttaaactgcctgcgggttaattaaagactttccccaacacacacacaacgctacttggctaaagctggggagcttttggcccaaggtatttaaggaaatctctgtccaattgttatatgaccactaagctaactcagctcacttcagtggccatacatgacaagaaaaacagacttcatagaattagtccaagaaggtcactaaataaacgagcagcagcagcaaaaacaacaacaacagcaaacatcaacaataggtgctagagaacaggaaatctgattttaagaattgccacattatattattttaaatgttcagttttcaacaaaaattataagacacagaaaggatcagaaaagtatagcccatacacaggaagcagccaagagaaattggtattaagaaagctaagacattggacttacaagacaaagatcttaaattagccattataaatatgttcaaagaactgaagggaaaccatgagaattatatctcatcaaatagagaatacgaatgaaaagatagaaattatgaaaaggaaccaaatagaaattctggaactgaaaagtacaataaccaaaatgaaaaattcactagtttcaacagtagagttaagcaggcagaaagaagaatcaatgaacttgaaggtaggccaattgaaattatccaatttgaataacagaagcaaaaaactaaaacaaaatcaaagccccagaaacaggtgagatgttacttatgcagttgatgaagtatattaacattttcctaatgggagtcccagaagaagaggaaagagagcaagtagcagaaagaatatttgaagaaacgatagccaaaaatttcccaaattcaatgaaagatattattatgtacattgaaaaagttcaaaaactccaagtaggataaacttaagatatctacacttagacacatcatattcaaactgtcaaaagctgaagacaaatagagaatctcttttttactttttttctttttcaaatctcagacctgagtgaaacaaagaatctttaagacaacattaaaaaaataatttaccatgtacaagagataatcaataagatgattttagttttctctcttattcgctctcttatttttctctcttctccatttctatttatacttcatacatacataaaaagttaactcaaaatgaatcccagacctagatgtaagatctatgattgtaaaacacttagaacaaaacagaggagcaaatctttgtgaccttggatcaagttatggtttcttagatatgacaccaaatgtataagcatccaaagaaataattaaaaagttggattttataaaaattaatttctttagtgcttcaaagaacaccattaagaaagtgaaaagagagcccatggatggtagaaaatatttacaaatcacatatatgatagagagcttatatgcagaacatataaagaatagttacaattcaacaatacaaaagtaggtcaattttaaaatgggacaaaaatatgaataaccattttgccaaagaagatatacacagggccaagaaaaacacaaaaagatgttcaacgtcattggtcattagagaaatgaaaattaatcccaccatgaaataccacttcacacccattaggatggctacaataataattaaaaaaaaaaaaaaaacagaaaataaaagttatttgcaagaatatgaagttggaacttttgtgtattgctagtgggaatacagaatggagtagctgctttggaaaacagtttggcacttcatcaaaagaaattaaacatagagttaccatacaacccagaaattccactctaaatatatgcccatgagaaataaaaaacatatgttcacataaaaacttttacctgaatgttcattacaacattattcatgaaagccaaaaatggaaacaacccaaatgtacaactgatgaatggataaataaaacctggtttatccacacaatgaaatatcattcatcaatgaaagggaatgaggtactgatacatgctacaacacggacgaaccttgaacacgttacgctaagtgaaggaagccagacacaaaaggtcacatattacatgactccacttataggaaatgatcagaactggcaaatccatagagagagaaagtagattcgaggttgccagagttggagaaatggggagtgactgctaataggtatggcagaggggagagaaaatgttctggaatctgatgataatgatggttatacaagaccacaaatatactaaaaatggcctagtgccgtggctcatgcctgtaatcccagcactctgggaggctgaggcaggagaatctcttgaggccaggagttcaagagcagcctgggcaacatagtgagatcttgtctctacaaaaaaaaaaaattaaaaattagccaggtgtggtgggtgtgcctgtagtcccagctactagggaagctgagatgggaagattgcttgagcctgggaggtcaaggctgcagtgagtcatgatcttgccattgcaatccagcttgggtgagagacaacctgtctcaaaataataataataatacataaataaaaatatactaaaaattattgaattgtgtactttactttaaaggagtgaattttgtaaattttgtagcatgtgatatatatatatatatatatatatttcttttttttttttagaggcagtcttgctctgtcgcccaggctgaagtgcagtggcacgatctcggctcactgaaagctccacctcccaggttcatgccattctcctgcctcagcctccagagtagctgggactacaggcacctgccacagttagcctgcaatgtgggactacaggcacctgccacagttagcctgcaatgcctggctaatttttctgtatttttagtagagacgggatttttactgtgttagccaggatggtcttgatctcctgaccttgtgatccacctgcctcagcctcctaaattgctgggattacaggtgtgagccacctcaccaggccgtgaagcatattttaataaggatgttaattatttttatttatttatttttgagaccaagtctcactctgtcacccaggctagaggaatacagtggcatgatcttggcttactgcaacctctgtctcccaggttcaagtgattctcctgcctcagcctcccaagtagcggggattacaggcatgcaccaccacgcccagctaatttttttgtatttttagtagagacaggttatcaccgtgttggtcaggctgttctcaaactcctgatctcaagtgatcctcctgcatcggcctcccaaagtgctgggattataggtgtgagccaccacgcccagtcaataaggatgtcattttaaaaagagtgggctctggggtcagcccccttgggtttgtaattcaggttctgccacttattggctgggaccttggttaagttaccgtgccactaacagtaattaccttaacatgctgttaagaggtagaagtaaattaatacatgtcagcacttaaatcagggcattgcaaaaaaaagtatttttgtgaacatgagctactcttattctttgaaggtggcaaataatgttttttccaacactattgtgtgccttcagtgtatattctcagtcctctaatgctaaggctcatggtctaactccaggtgattttcctaaaaccaacttggccagaaatatggttaacaagaaaatgtttgaaaataagcatctctgataactgtccagaattggcaactgcaatgcatcatgggatatttttacaaacccttaagcatctttaagcaatttggtctacattctgaatttttcttctctactattttacttggaattcgtttttagatcattctgctttgcagacagtgattaaaattgaagataattttacaatataaaagtccaactagatgagtcatacacagcatctaaaataatgtatagaagtgacaataattagggggaggagccaagatggccgaataggaacagctccagtctacagctcccagcgtgagtgacacagaagacgggtgatttctgcatttccatctgaggtaccgggttcatctcactagggagtgccagacagtgggcgcaggttagtgggtgcgcgcaccatgcgcgagccaaagcagggtgaggcattgcctcactcgggaagcgcaaggggtcagggagttcccttcccgagtcaaagaaaggggtgacagacagcacctggaaaatcgggtcactcccacccaaatactgcgcttttctgacgggcttaaaaaacggcacaccaggagattatatcccgcacctggctcggagggtcctatgcccacggagtctcgctgattgctagcacagcagtctgagatcaaacagcaaagcagcagcaaggctggcggaggggcgcccgccattgcccaggtttgcttaggtaaacaaagcggccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaaggggcagactgcctcctcaagtgggtccctgacccctgacccccaagcagcctaactgggaggcaccccccagcaggggcacactgacacctcacacggccgggtactccaacagatctgcagctgagggtcctgtctgttagaaggaaaactgacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaatgcagttcctcaccagcaaaggaacaaagctggatggagaataactttgacgagctgagagaagaaggcttcagacaatcaaattgctccgagctacgggaggacattcaaaccaaaggcaaagaagttgaaaactttgaaaaaaatttagaagaatgtataactagaataaccaatacagagaagtgcttaaaggagctgatggagctgaaaagcaaggctcgagaactaagtgaagaatgcagaagcctcaggagccgatgcgatcaactggaagaaagggtatcagcgatggaagatgaaatgaatgaaatgaagtgagaagggaagtttagagaaaaaagaataaaaagaaaccagaaaagcctccaagaaatatgggactatgtgaaaagaccaaatctacgtctgattggtgtacctgaaagtgacggggagaatggaaccaagttggaaaacactctgcaggatactatccaggagaatttccccaatctagcaaggcaggccaacgttcagattcaggaaatacagagaacaccacaaagatactcctcgagacgagcaactccaagacacataattgtcagattcaccaaagttgaaatgaaggaaaaaatgttaagggcagccagagagaaaggtcgggttaccctcaaagggaagcccatcagactaacagcggatctctcggcagaaactctacaagccagaagagagtgggggccaatattcaacattcttaaagaaagaattttcaaccccgaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacatgacaatattaactttaaaggtaaatggactaaatgctccaattaaaagacacagactggcaaattggataaagagtcaagacccttcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagaaaagccctcctcagcaaatgtaaaagaacagaaattataacaaactatgtctcagaccacagtgcaatcaaactagaactcaggattaagaatctcactcaaaaccgctcaactacgtggaaactgaacaacctgctcctgaatgactactgggtacataacgaaatgaaggcagaaataaagatgttctttgaaaccaacaagaacaaagacacaacataccagaatctcagggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaataaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattctttctgaaactattccaatcaatagaaaaagagggaatcctccctaactcattttatgaggccagcatcatcctgataccaaagccgggtagagacacaacaaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacggaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggccaaaactggaagcattccctttgaaaactggcacagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccactgtctcagcccaaaagctccttaagctgataagcaacttcagcaaagtctcaggatacaaaatcaatgtacaaaaatcacaaacattcttatacaccaacaacagacagagagccaaatcatgagtgaactcctattcacaattgctaaaaagagaataaaatacctaggaatccaacttacaagggatgtgaaggacctcttcagggagaactacaaaccactgctcaaggaaataaaagaggatacaaacaaatggaagaacattccatgcgcatgggtagcaagaatcaatatcgtgaaaatggccatactgcccaaggtaatttacagattcaatgccatccccatcaagctaccagtgactttcttcacagaattggaaaaaactacctgaaagttcatatggaaccaaaagagagcctgcatcgccaagtcaatcctaagccaaaagaacaaagctggaggcatcacactacctgacttcaaactatactacaaggctacagtaaccaaaacaggatggtactggtaccaaaacagagatatagatcaatggaacaaaacagagctctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacagcttatacaaaaatcaattcaagatggattaaagacttaaacattagacctaaaaccataaaaaccctagaagaaaacctaggcaataccattcaggacataggcatggggaaggacttcatgtctaaaacaccaaaagcaatggcaacaaaagccaaaattgacaaatgggatctaatgaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcgaaaagtgggcaaaggacatgaacaggcacttctcaaaagaagacatttatgcagccaaaaaacacatgaaaaaatgctcaccatcactggccatcagagaaatgcaaaacaaaaccacaatgagataccatctcacaccagttagaatggcaatcattaaaaagtcaggaaacaacaggtgctggagaggatgtggagaaataggaacacttttacactattggtggcactgtaaactagttcaaccattgtggaagtcagtgtggcgattcctcagggatctagaaccagaaataccatttgacccagccatcccattacttggtatatacccaaaggactataaatcatgctgctataaagacacatgcacacatatgtttattgcggcactattcacaatagcaaagacttggaaccaacccaaatgtccacaaatgatagactggattaagaatatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacatatggacacaggaaggggaacataacactctgcggcctgttgtggggtggggggaggggggagggatagcactgggagatatacctaatgctggatgacgagttagtgggtgcagcgcaccagcatggcacatgtatacatatgttactaacctgcacgttgtgcacatgtaccctaaaacttaaagtataataataaaaataaataaaaataaaaataaaataatgtatagaagaacaatctcaatttcaaaaatgcacctacaatgtgtgaaacaccatatgagtactgaggacataatgagaattaggattatacactgattagggcagtgtcccaggtgtgaaagctggttaatttctgctctaaaatgtgctttgaaaaaggtttgtttatagattaagaccacccattgcagcatggagtttttatgcattaaaaattttttccaagcaattctgtttattcagtgcttgctctatgccctgcacactgttacatgctgacaaaacaacaaaaataaaatagatcagacactgctccccctgtgggtgggtgcattccggtggggaaaagctgagaggaggacaccaaccctcacccagaatcatcctatcagaccacactctctccagcaaaagaacacagggaggcttcttcatttagaaggagcgaagcctttcattgaaaaatctttcttgatcctagtaagtgccaacgtctctgtcttttaaaattgtttccattttgactgtgacctttgtataatgaggtgatcaagctgagctcttccaaggtgaggccaaaccattgctgtccccctgcccctctgagtagccctgactccctcctcactgagccctcgtattctatttgctgtttggactgcagctaaacattgagcaagcgtcttcattaaactgtccagtgattcatagctgccttccccccagaggttacacataattcagaactcatcagcacgctggggacaggcggccgaaattgctccttctgggatctgctactttgcatttgcccacttggggtttcatttgctaccctgggatctaattactctgccctgctctgcccttctgaggttcctgagtccccagccctctcctgaacagctaaggagctcagaccatggcctctgttggcgtcaacagtggggccgctctgtgcaaaactgtagcccccctgaggtgaggctccctcttggaaggaaacatccttcatgcaggggacctacggtggcaaaccaggaagcagtctgtccttgatggtctgcagtagtaaggcgagaagggtcacagcaagagacagagccaaacttgtcactcctggctctggagtgtggcgagcagaatacacctctcacaccctcttgtacttttcctctgagcctccctgctggctgatttctggtttcggcaggctgggatttggctgagtcatggagaagaggacaccctgagtcactgagacctaactggacaaactgattcatcacaaactgtggaccattgggacctgagtgttgaagaagaaatagatggtggaggatgagagattgttctcaggtctcctttacttggagaggagaggggccccagccacaaaccaaccaggagcggggaagacaggttgaggtgggtgtgtttgaccagagcctgtggagggaggtaagtatgaggccaatagctcctgagatccttgctaggaaatccatcaggccatgtgtcgccagtctacaccgcactgacctcacagaggtcagctgatgcccagcaaatcattcccacccccacctcagcccctgtttagcctccaccctcaccctcaccctcacccttcctcaccagccctatgctcaggcagcccctgcttcttaccagtgaccaataataattaaatcagcatcaggcctacctctatggtaagcactctacctggatgacctgatttaatcattatagtcactccatcgggaaatggtaactactaagattactttcattctactgatgaagaaaatgaagctcagagaggtgaagtcattttctcaaagccacacagcaagtagctgcccaagccagagcttgacataggagtgtggctgtggtgatcatgcactggctgatctgtctggggacagcccgcactaacctcctcaatccaggagagtcttagccatactcttgttttcctggaccacctataacttctaaggtgcatgggtgtttgcactggtgaggccaagtgtctgctttttctttaaaaataccccaaagtaacagaaatagcacagtcatcttaggacactgggcatccctctttttctgaccgctttgatgtacttgggttgatggaaacatattgcctctaagaaattccagctgtgtgactaataatgaaggcaataatagcagctaacgttcattaggcacctgttatgctcggctctgtgatgagtgaagcagggaatattgttctctccactttagaggagaaaagaggcacagagaggttgtgccttgcccaaagtcacacagcttgggcagtagcagagccaagtcttggcctcagatcccactgagccctttaatccctgtgcttcatggtctgggcacgtcctgagttgtgctggtctcagccccgcagtcagtcagagcatctgatcaggcatcatgcgttgaaaacctactacaagccaggcaaaggaagggaagaggagtctcgggcagtggtctgcagtggagggtgggtgagggtcccaggccaggaagaacagtctcagggtgatgggatatttgagtaaggcaccaaaggaacaaatggtgtcaggaaaaggggaagtaatttggagcagggacctgaatgaggacagggttaccaagggcaagatctaccttcgctattttgtattaactctgtttagggcctgtggggttatttgtaggagtgcctcatagggacttatttgatgatgggaggtacctgaatcaaggagctgggaaagataactttgaactgcacttagctacaaaggctgtgtgtgtgtgtctgtgtgtctgtctgtgtgtgtgtgtgtgtgtctgtgtgtttttaaggaagagatatggagaatgccaaataactatctttttgtcatttttaacaattgcaatgagtttttggggtgactattttggtctgttttgtcatcccatatacatgcagggctgctatattataattctgcaggcttaaagtgttctttaaatttctgttcaatttacagagacaaggttttgtcttacacgtgccctccagcttactatggctcagctcattcccttccaatgaaccgaactatttttaattcatggtagcactttgctactcattcagcaatttcatttcaacattctccaatgaatgtgtgcccctactggtgagttaatactgctgctacaactgtgatccattcctgtaacatgaagttcaggcacttctaacttttagttttgcttaaaatgaacttgtaacttcctaccatccccatttggatgcttgtataacagaaagtgttttagctttattatttgtgcatgagactcatttttggcttagaagttctacctagctcaatgcctgaccacagaggaacttatgccccaatttcctcccacacagaccttgataaaaattcttcctacttaaactcttaggatttttttcgtttcttcttagtgtattgatttggacttagggggtctcaaggaaaaatggaatttccctgggatcttaagttccctctagccagcttgtaacaaagctgttcagggcagtgagagaaccccacagctggttttggggaacaatttcagctttactcccatttctatatctcaatgaaaggtgacaatataatcaaggagaatctcatctttacattcgaaaagaaaacctatactgctgaagtcatttaaaaggttgtggttaatggtcagaagcatttgggtttattcccagctcaacagatgtatgaccgtgagcaagcctttttgggcctcagtttcctcatttgtaaatggcgatattaataacatccacctgatacaactaaaaagaactggataagatcatgcatacaccaagaccgatgcatagtaaatactaaataaatgttagctctattagtcccagggcactgacccagagaacgcttggctccaatacttctgctattaactgtaatattaatatatcaaggtagagaggaactagtataggcatatgcagcagctaaaactatgacctttttttggtggttgctattataaggaatgattgatttttatcactaggaacccaaactgtctcttcagtaacatttctaatcatttgctagaacattctttgacaatcagagttttctgcctgtgctgttgaatggtcctcaaaatagaacagaaacatcagattgagtctatcttgtggtaaatgtgtaacattactataatgtgacatcagccaatgccattgtcaatcaaactcaccacactgaatccttggtgagtttggaattcacgttcccatcttcttccaggaagatgtccatttgcaaattggcatcattatcatgggcagagaaataattggtaacaattcttgctggtattccaaggcatcgtaaaactacaggaaaggacagaccacagctaaacacatcaccagcatttaataaacacagagtgaaaaaacccttcttgtaggggactttcttcctgacccaacatgaaaagccctttggacatgttattctcaaatgttccatgctggaaaagggtggtcattcaaccccatgggggcggtagagagaaatcttgctgtgtgatccttcagaattgcagctggtgtcaggtgaagccaactagagtagaatcccaacagggttctaattgtttcgtttctaagcgtttgatcatcaacgtagtattattttagtcccatgaatgggactatgttcccgaaaatacaattttaaaaacccactaataggaagttaggaatttacagagtaggtccttggtggaatttgctgtcttggccagaatttgctcctgtgacatgcattggtgggtgacaccacagattcattttagttcattttaatagataacaaattatctgaatacctttcttgccatatgtacctactgattaaacttaatccaaatgccctccctgcctcccaggacaccagacatcagggctcattgaaaataattcagctgacaattttaagattaatgacttggcttgcctttttattttctccttcagaatagtttagcatttttaaccaaagactacccacctccttcaacagaacaaccttggaagtccaaactggagtctggtagagattcaagggtccccctccttaaaggacttgatcttaatgccccaaacaacagtggcagctgccacgggcctcccgttcccattttcctttcttgattttcagccctgttcacccagggtcttatcaataaaacgattgccactctcattctgtttctggctgaacactaattcacattatcccagacacgacttggtcaagactctgccttactcataatttcaagaaagtgaggcttgactttagggcacctgttcctccttcccccaatttccatcttcaggtttactctcgttgtgacttccccactgtgtgtttctgccttttcttgatttaccgccaaagcctgttttcaggcatagattggataacctttttatgccaaagacacgaacggatgtaaggtgttcactattttatcttgttgtgagccggaaggaattacactgggatagtgaaattgtaggcatggggagaacttgggtcctttctgtcttctaaaatcatttcacaagagtggttgcctctgttgggcatcttttaccttgtcttggtttgggagcctcgagggatgggatgacctccaacctttaacctaccatgaagttccggcttctatctggaacttcagagaccagtgcttctaggggactatacttttgattttcattgctcccaagaaatatgtattccttcttccctgggttatatttaaatggctaagaaaataatcttatcctgtttgatactatgggaaaataaaacaaaacaaaactcatgactttttttttttaaatttagatcaccaagtcttagactgttgagactttgagctaaaacaaataggttttgtaatcatttttttaaatgacctccctccagcctccaacccctccctttgtttttgatttaaaaaatgttagctaggtaaaaattctttattaatgagcaggcagaaaggacaccccaacttgagcttaatgtttctccaaggctgtagaaatgacttgtgaatgaaaatcattaccagtgatgaagacatactgaaataaatgtatttttaaaaatattcactgaattaattgtaatatcgtctgggtctagagaggcaaatgcctctgaaaaatgatgcatgacactgaagagaataattctgttctcatatgctttcctctacagattggatgttgggtggattaaaaaccagaggggaaactggagagggaaagattgttcattatgttctgatctctaattgctcaggggcattgagaaatgtggaaaaatgaatatgagaccacctgctataataccttccataactgggataaaaattaagtgtatatatttataaaattctcaataataaataaatacgcatatttatacaacttctcaatgataaataagcaatatatatcttttgttatttattattttagttttaactgttttagtttttttaaaatgtggtggctgaaaagaaaatggcttttttctctatatttttactgtaaccctctatttcttcgggtgttaagtgatggattacacaggatatagtctatcattctttctataaagattctgcagtcaaagagaaactatgagcatatttggcccactacaatttaattatgcattgactacatcccagaatggctcacccataaattctatagtgtcaacaggggctgctatgtctctttgttaggttatagaaaaaatgtcttagagtgaagtttcctttatattaaaaagaaattactcagttggatacttacatgtgttaaagacaccagcaaaaacccagcattggccataccggactggattctcagagctccggtattccaatagaatgtcaacgcttccagtccaggccgatggggggacgccataggcatagatattgtcccaggatccaacgaggacaccttcgtcatctttggcattcacctaaatgagtccgtgagaagtgagaaggaagaaagttcatttaggtttgtctactccaggctatgcatggcgcaagctatggctgccattgccttctatatgttgtgcccagtgaaaagagttccacttctgttcggtttaccattacattgttagaaaaaaaagatgcaaaaactaaatacgcaagaggagaccaagtaaccaagattgcctgttaaatcgcatattatagcaaggcaaagttgaacggcagataggaggagtgtgacacctaccggattggaagaagacatacataggacacttggtttgggctaggttagtgctcaagaatgatgtggggaagagaggaagaagacctacaaaagataaaatctcaagtagggaacttgtcttggtggaaagataactcaaaactcacaaatgagaaattagtggtctaatggattttgactttcattttgagtggtagactctaccgacttgaaaaagttaacagatgttgtcattttgagtggtagactctaatgaattgaaaaagttaacagatgttgtcttggaatcattaagagttaagaaaatagattcccatgggatgcttacagaggttttttgtttttgtttcttttttcttttcttttctctctctctctctctttctttctaagataaggtctcgatctgtcacacaggctggaatgcagtggcacgatcatggttcactgtagcctcgaactcttaggctcaagtgatcctcccacttcaggctcccgagtagctaggactacaggtgtatgctcggctaattaaatttattttttttgtagagccagggtctccctatgttgcccaggctagtcttgacctcctgggctcaagtgattctcctgcctcagccttccaaagagttggaattacaggcataagtcaccatgcctggcccagagcttctttttccctttgtaaaattcacttaagtattctttcttatgattgtttaaacagattaaagttttagagttttcttagaaggtatttctgtttccataaagaacctgggatgttatggtttaaatatggaagagactttagcagagaaaggcaatcttgaatatctggataaaacttgccacaccttcagactacattcatcttgtagcagcagacctaaagtgcaggagcaaagaccttttgtgtttacatagtaaaacaaaggccaagaggtaacagtttcaaggcatcttgccagtttttttctgggcactgctgaatctacctctcttggtgtaacgttgatcatgtttaattacagtcagaagagtttaggtggggagtccaggagcttttccaaaaactggtgccatttcaacaatgtttacattgacattacaatggtgtggagccttgctacttgaggcattcatggatcagcaatattggcattccctgggagcttgttaggaattcagaatctgaggcccctcccagaactcttgaataagaatttgcattttaacaagatcactgggtgatttgtgtgcacattcgtttagaagcacaggtctgagttataatgcaaagacattagtaagcaatgtgaaacatatgattgaagcatgtgtgttttgattatgaaaatcacagaagagacattaaaacatggtgagcttttatgtgtttgctgcctcaccaactaacaactcagcctcatcacctgcctagacccctctttttgacttgctgtgtctagttgtagagaagtctgtcttccccgctggtttatcaattcattgggaacaaagaaaaaaaatctccgtctttctgagttttaccaagtgttagcaaagactggatgctctgtagttgttcaataatcacttatatagtcaacaaacatataggaaatgtatatttgagtaagaataagaccttatgcctggagagagatggtcaagaaaccaatcaagtggatgtaaagattactggtattaagacagaaaaatgtagaggtagagtgggaacctgaggaagggagttatcagttagattggagggtggtggtggtgatgctggggggcctaatagagggagatgacaggcaaactggccagaaaaggccatctacatagtggaaacagttttaataaatgtgtagtgtcatgaaacaatatggcaggctctgggaccttctaggagctctgcatgggtattatgtaagtaggcaataccgaacgaaataaaaaaaatactagaagaaaacatgcaagatgtgcaagcatcttttactgtgaatgacaaagccttcactgaaatttgagatttactctagcactgagtggtatttcccaaggagggtcccttctggggagtgttgtctagaagatcactattcaatttggtttagacatgctatcttccccctttaactctgtgtccagtcaggttaaagtgaagaagaactttatgaaccacacagttaatttgttcaatgtaggaaaaaatgaactctttgggggtctctaaaagaccttgctcagctaattgcaaactcatgcctttgatataaattttgactttagcttatagagtcatgaaatgactggagtgcagcaggctttagccaaacattatggctatattaaagatcagtacttctccttgcagttggattgattatttaaaaatctgtatccattatcgtgaagattgaagaatgccttggtaggctatgatgtggtttggtctttgtgggtaggtaggtttagctttgaactcacattatcattcccttatcactgagacataaaataggctctatgaatttcagaggtaaaggctcctaaactgtggtcctgataactgattttcaaacagatagccattaattacaagggctatttatagcatagggctgaactcaatcagctaaggggaagagtaaggaaaaaaagctctgtcctctacagaccttttaattgttaatgctgagctgttcccctgttgctagataaatcacaaccctcatttattagcatttgggcagattagctactgttttctaattagaacattgatttctagggagctcaggccatgaaagaggtaagtttttagtgacagatgtaaagggttaaaataatatctcccctcataagcaacaagatatgtttggaggacatgtttgtcatttttcatgccacagttggctgttttaacaccctctcatgatctcagggtttgaccagtggcagaataaagtgtcttggtcttgagtcactggtggtcaagtagacaatacaagtccaggactacgtacaggaggcattattcaacttcattaaggctacactaaattgccctcccataatacctacaaaattagaaaaaaatttcaaaaacccctaaaagtcattatcagcataatgcaataaacttcaaaacatggtcccaacaaaacatgaggactatggagtaaagcagagaggcaacatggctcagctcctaaccttaaccatcttaccagctagtcaacaaaaacctgagatttctaatttatattttaaattctagaaagtaataaatataatcaaaatgctgatctttttggccaggcatgtaatcccagccctttgagaggatgaggcagatagattgcttgaggtcaggaattcaagaccagcctggccaacatggtgaaaccccatctctactaaaaatacaaaaactagctgggcatagtggcacatgcctgtagtccccgctactctggaggctgaggcaggagaatcgcttgaaccggggaggcagaggttgcagtgagctgattgtaccactgcactccagcctgggcaacagagtgagatcctgtctcaaaaaaaaaaaaaaaaaaaaaagctgatctttttattgttctgaacagaatggtggaaacacctgctgtggagaaacgagtgaaaaagtatctgcaccttaaaagaggtagagattctggaacacaattgggaaataatacaagctgagcgtatcccccaatggaactgagatatgcctccagttgtgggggtgggttctggagtgacagatgtaggagaatcttaagggaaagagcagaccctaagcatgataccaaagattgttcatcttctaatactgtagtcctcactccaatctcttgcagagtactgaagagtagatagaatgtggtacattggcctcaaattgtagttcagaagtgagatcaaactaaccttagattgagaagaatttcatttattacagcaaatagaacgtctagagacaagaatgatgcaagtttgagcataaatatagggaaaagaaactgcatgcagaggaagagacagaaagagagagagggagagatcatgaaaaaatatacatagaagaaaacgaaattaaggagcataagtcatttttctcacaaccttttaggagatcacagaccaaggcaacaaattgaggaccaaatcataccattacagagctaataataaattataaactgcaagaaacagaatacatattattaaaaataaaaattaatgacatagaagaaaacttgagatatcaaagaaaatactaataaaaaaccaaagtgatgaattatttagagagattctaatagtaccatagttatggaaaacaaagatgatacaacataaggatgattagtgtccttaaaatagagaacccaaggatttggatcatcatggtggatgggaggcaggactggattgcagctctggacagagcagcatgtggaggctcgtgctgtaaattttagatccaggtcgactgcaagaacaaaccagcaatcctgagaggaccacagactctctgaaggaagcagactgcttctgcaggacccgagagacccccccaaatactgtgagtgtcccaactatgcaagtgggaaagggagaccctcctctcccgaacacaaacctccactggagaagctgaaggtctgtttgtgggagaagtttccgacttcacctggtgctgggtcaacttggagagctgagggaaatacaggggtagaggaagcagcagaaaggccctgggagcttgctaggtcccctagcaggccatccctgcctggcaccacagagatccatcagaaaggtggacagaggagcagaggataaaactccacatggagaaggaaatctctagctgaactttgtagcaatttgaatggggtgagaagcctcctggccaaaacttgggggagggtgcaaatccggtgtgcagactccacaggtgtggaagaaccaaacccttttcttttgcagctgggaggtgggtagaccgggtcaggttttcaaggccatcttgccctctgcctggaaatggacttagggctgttgaggggggcacggtgggagtgagactggccctttggtttgcatggcagctgggtgactcctgtgactgccagcttcccccaacttccctgacaacctgcatgactcagcagaggcagccataatcctcttaggtacacagctccagtgacctagaaatctcacccccatcccccacagcagctgcagcaagacctgcccaaggagagtctgacctcagacacgcctagcccagcccccagttgatggtcctttcctacctaccctgctagtggaagacaaagggcatataatcttgggagttctggggccctgcccaccactggttcctccccatactaccacagctactgctctctggaaagcaccacctcctggcagggagccaaccagcacaaaaatagagcattaaacaccaaagctaagaaccctaacagtgtccattgtaccccctgccacctccaccggaataggcgctattccggtggctgagagggacccagagatggctcacatcacaggattctgtgcagacaatgcccagtgtcactccagagctgggtagacttgctgggtgggtagacccagaagagagacaatcactgcaatttggctcacaggaagccacatccataggaaaagggggagagtactacatcaagggaacatcccatgggacaaaataatctgaacaacagccttcagccctagaccttccctctgacagagcctacccagatgagaaggaactgtaatatgacaaaacaaggctcttcaacaccccccaaaaatcacactagttcaccagcaatggatccaaacaaagaagaaatccctgatttacctgaaaaagaattaaggaggttagttattaagccaaacagggagggaccagagaaaagtgaagcccaatgcaaggaaatccaaagaataatacaagaagtgaagggagaaatattcaaggaaatagatagcttaaagaaaaaacaagcaaaaattcaggaaactttgcacacacttttacgaatgcgaaatgctctggaaagtctcagcaatagaattgaacatgtagaagaaaaaaattcagagctcaaagacaagttctttgaattaacccagtccaaaaagacaaaggaaaaggaataagaaaatatgaacaaagccaccaagaagtctgggattatgttaaatgaccaaagctaagaataatcggtgttcctgaggaagaagagaattctgaaagcttggaaaatgtatttggggtaataattgaggaatacttccccggccttgctagagacctagacatccaaatacaagaagcacaaacaacacccaggaaattcattgcagaaagatctttgcctaggcacattgtcattaggttatccaaagttaagacaaagaaaagaatcttaagagctgtgagacagaagcatcaggtaacctataaaagaaaacctatcagatgaacagcaaatttctcagcagaaaccctacaatctagaagggattggaaccctatcttcagcctcttcaaacaaaacaattatcagccaagaattttgtatccagcgaaactaagcatcatatatgaaagaaagatacagcctttttcagacaaacaaatgctgagataattcaccattaccaagccaccactacaagaactgctaaaaggagctctaaatcttgaagcaaatcctggaaacacatcaaaacagaacttctttaaagcataaatcacacaggacctatgaaacaaaaatacaagttaaaaagcaaaaacaaaaaacaaaaaaaccaaagtacacaggcaacaaagagcatgatgaatgtaatggtacctcacatttcaacactaacattgaatgtaaatggcctaaatgctatatttaaaagatacagaactgaagaatggataagaactcaccaaccaactgtctgctgccttcaggaaactcacctaacacataaggactcacataaacttaaagtaaaggtgtggaaaaaggtatttcatgcaaatggacaccaaaagcgagcaggggtagctattcttatatcagacaaaacaaactttaaagcaacagcagttaaaagagacaaagagggacattatataatggtaaaaggccttgtccaacaggaaaatatcacaatcctaaacaaatgtgcactgaacactcaagttcccaaatttataaaacaataacaaatagacctaagaaatgagatagacagtaagacaatagtagtggaggacttcagtactccactgacagcactagacaggtcatcaagacagaaagtcaacaaagaaacaatagatttaaactataccttggaacaaatggacttaacagatatatacagaacattttatccaacaaccacagaacacacattctaatcaacagtgcataaaactttctccaagatagaccatatgataagccataaaatgtgcttcaataaatgtaagaaaattggaattatatcaagccatctctcagaccacacagaaataaaactggaaagcaactctaaaagaaaccttcaaaaccatgcaaatacatggaaattaagtaacctgctcctgaatgagcattgggtcaaaaacaaaatcaagatgaaaattaaaaaattctttgaactgaatgacaataatgacacaacttatcaaagcctctgggatacagcaaaggcagtgctaggaggaaagttcatagacctaaaggcctacagaaaaaagaccaaaggagcgcaaactgacattctaaggttacacctcaaggaactggagaaacaagaacaaacaaaaccctaacccagcaggagaaaagaaataaccaagatcagagcagaactaaacaaaattgaaacaaacaaaaatacaaaagataaatgaaacaaaaagctggttatttaaaaagataaataaaattgatagatcattagcaaaattaaccaaaaagagagaaaatccaaataacctcactaagaaatgaaacaggagatattacaactgacaccactgaaatacaaaagatcattcaaggctactatgaacaccttaatgcacataaactataaaatctagaaaagacagataaattcctggaaaaatacaaccctcctagcttaagtcaggaagaattagatatcctgaacagaccaataacaagcagtgagattgaaatggtaattaaaaacttatcaacaaaaaaatgtccaggaacagacggattcacaggagaattctaccagacattcaaggaagaattgctaccaatccttttgacactattccacaagatagagaaagaaggaaccctcccaaattcattctatgaagccagcatcaccctaatacaaaaaccaggaaaggatataaccaaaaaaggaaactacagaccaatatccttgatgaacacagatgctaaaatctttcacaaaatactagctaactgaatccaacaacatatcaaaaagataatccgccatgatcaagtgggtttcataacaggaatgtggacatggtttaacatacacaagtcaataaatgtgatgcaccatataaacagaattaaaaacaaaaatcacatgatcatctcaatagattcagaaaaagcattcaacaaaatccaacattgctttatcattaaaactctcagcaaaatcagcatacaagggacataccttaatgtaataaaagccatctatgacaaacccacagccaacataatactgaatgaggaaatgttgaaagccatttcctctgagaactggaataagacaaggagtcccactgtcaccactcctcttcaacatagtactggaagtcctagccagagcaataagttaagagaaagaaataaaggacatccaaataggtaaagaggaagtcaaactgtcactgtttgctgacgatatgattgtttaccttgaaaaccccaaggactcctccagaaagctcctaggactgataaaagaattcagcaaagtttctggatacaagattaatgtacacaaatcattagctcttctctacatcaacagtgaccaagtggagcatcaaatcaagcattcagcccccttttacacacattgtcgaacatgaagtacttcagggaatatggtacctatcataaccaaactattaatacttgaaagtgatatcaaaataattaggggctgagtcaaacaaagaacccaggaacagagactctgtgataacagattcaggggtgagaaaactctatataagttaagcatctttgggatttacagttacagatgaattttaagacttgataatataaaaacaataatcatcctaagaaaaaagataggagaaagaggagaggaacagtgaaaatggtaatgttttagtgtgtgggtctctcagttaattgataccatctaacattaaagtataatttaaaagtacataattactttattcttttaatggtttttataatttttaataaccttaggaaaacctgttaagaaatgatatctcttgtagtgaagaaatatttatttgaagtttaataatttcttctgttgcaatttaatttctttcctattaaagtaaaattcaataaaacttaaaattaaatagaatttgggtacaattacatgtaatactttcaaattaagtagcatgacaccatttggtataaatacaaacagatcaatgtgacacaatagagaacacagaaatagactcacacaaatacagttaactaatttgtgataaagttgcaaaggaaattttatggataaaggataatcatttcaaaaaatgaggtggcatcaattggatattcatatgcaaaaatacgagctttgattcataccttgcaccatatgtaaaaatgaactcaaaatgaaccttagacctaaatataaaacctagggttataaaacttctaaaaggaagcaaaggagaaaattgtgtgatcttaggttaggcagtttccttagataaaatatgaaaagcatgatccataaaaaaatttgtaaatcagacttcataaaaattaagaacctttgctctttgaaaggccctgtgaagagaatgaaaaaataaaactagagtggaagaagatatttgtaaatcctttatctgattaaaaagaaaaaacttgtatccagaatatgtaaagaacccttgaaactcaatagtaagaaaacaaacacaaccttaaaacaagagaaaaatattggaacagatattccatcaaagaaaatacgtgggtggccaatcacaacaaaagatgctcagtatcatcagccattaaggaaatgcaaatcaaaaccacagcaaggtaacattggacatctatttaaaagtctaagattaaaaagactgatcatatgaagtgtccgggaggatatgcaacactttagactctcatatgctgctggtgggaatgtaaaatgcccatccaatttaggaaacagtttggtagtttcttaaaaattaaacctatgtttagcttatgacccagccacctcactcctaggtatttacctaagagaaataaaagcttacgtctatacaaagacttttactaaagtcttccaagctaaagtttctggctttatttgtaagaggcaaaaacggaaaatggcctaaatgtccatccacaagtaaatacatgggcaaatagtgattcatccatacaatgaaacactactactcagcaataaagaggaatgaactactgaaacaaaaaacagcatggatgaagctcagaatacagtaaggaagcataaaagaagcctcacaaggagtacatactgcatgattatatttgtgtaaaagtctagaaaacacaaatcaatgtataatgacagaaggctgagcagtgatgggggatggtacacaaagcagggagtggtttaaggaagaaattacaataaggaaacttctgggggcaatggatatattcattattttgattttagtgttcgtttcatgggtacatatacatgtcaacattatccaattgtacattaagtatgcacattttattgtcaactatatctcaataaagctgtgaaaatcaatgaagacttttaaattaaaccagcatctatagtataatattatctatgattttaaaattatttctcctgtataattcaaagaatagaaatagccctaaaacatgacccgtactggacttctgtttaattttggtcattggaatatgagcagattctaacttgatactgaaaaataaagaaatgtgacatttcttgattcttcaatttcctgtagcgcagacctttacattttgtatagttactatttctttctgctttttaaaaaaatatgcaagggtacttttctcctctgtgtgcattttatatggctatgatgaaatgacttttctctgttataaacctatcatattccgttaaatttcattgttaaaagttatgtcctcataaaggctaggatttccataactcttttagaaaatagtcttatacctaattttgtccacaatggtttctcaaagaccattggaaatgaattttgatgttgggtaacacgaactaacatcaaaggcctagcgttaagtttggcaaggagaagaattatttcctgtagaaaatcgtttccaggttttgtgaaccacaaatccccagctacagtgtggtggtgaccagacttaatcacaggtggaagtggtgtggtggatgtcaaattgtgcttcatgacatgctagggttttgcaaaagaaactcagtagttacggtgttgtggggtggggcaggtgagaattgaatgttgatagtcaaggctgcagtcaccacctttctttaataatagctgctctgctttttctcttttatgtatttggattcaattgctgtttgaaaaaattgttctaaaaaataaaatttaaaaggtcacagttctgggaatgtagagatctgtttttgtgcctgctccgccatttgccaagttatgttgtaaggataggaagggagatgagctgaaggtcaagtactcaggttattccatgggcaggcatcccagaaaatgcacaagaaaaaagaaatagggtagcagcaattctatttcttcccttgcctggctcttcatccttgattttcttctgggcttttatggcacttacaacagccagggtcacatacttggtcgaaaggaaaggaaaatcatctaccatgtctttggtttttcatagtggtttgcttaataacaagctgttttctgccttgttgttgctggaaatgttattctcgctccctggaatgtccatccacactcaaacctcttctttacctggtgccctattgatcctttaaaactcagctggtttcaccctgggaatctttacttatcaccttgatttggatgtccttactctttgatcacatagtactctttgcatagtactatccatttatcacattgtattgtgtcattggttagactgtccttgttcttttcccagactttatgttcacagaaggaaggaaggcactatgctgttttgactttatattcccagggctagcacagagtgggaactcaataagttctgttgaatgaatggatgtgctatcactggaagatggctataggctacattttaatacttctttaatagatcaagacaacgggacagttagaatgccaataggcacttcattaaagctggaaagttgtttccaaaatttacatagcaatacaaaggatctagaataattaaacataatattgaaaaagaagaacaaaaatgaatgactacctgatttgaaggtttactagaggaaagcagtaaaaaaggcagtgtggtattgtcataaggacatacatataaactaatgaaacagaaaagagagtctagaaatagatccatactcatgtagacatttgatttctgacaaagtcaccaaagcaattcaatgaagaaaatgacagtcttttcaacaaagaaactctttgcaacgaatgaaagcctttccaacagtcttttcaacaaatgctggtggaacaaatggataaatttggaaaaaataagatttgatccctacctcacacaacaccaaaaggtaactcaagatggatcatagaccacaatgtaaaagttcaaattataaagcttcaaaaataaaacataggagaaatagtggcaaacatgggcaaatagtgattcatgtgaaagtcttcatgtggaaagaacatttactggggatgactattaaagaacaatgaaaaaatttgattttataaaatttaaaaacttttgttacttaaaatatgccatttataaaatataactacaagccatagtttggggaaaatatgttctatacatatctgacaaatgagaggtatatacacagagcaactataacttaataataaaagtacaaatgactgaataagaaaatcagtagacttgaaaacatgctgcatatatatatatatatatagccaataaatgtattaaaagatgctcaaaatcattagccatcagggaaatgaaaattaaaactacaatgaaatgccactatatacccatttgattggttaaaattaaaaaggttcaagacatcaagaataggtgaagctgtggagaaactggaactctcatatgttgctggcaggaatgtaaaacagtagagctgctttggaaaactagccaattcttataaagttaaatatatacatactttctgatctaggcatgctctctttagctatttactccagatatatgaaaacacatacacaaaaacacttgtacaagaatgtttatagtaactgtattcataatagcttcacattggaaacatcttaaacatgcatcaataggtgaatggatagacaaattgtgatatacaatgcaataaaatacttcttagtaatggtaaggaaagcattgaaaacacatgtaacagttgatggagtaagagaagccagccctatttctactgtgtgaatccatttatgtaaagttgaagaatagacaaatgtaacccattgcaagaaatcagaatagtagctacctaatgaggtggggattgaccggaagaagcacgagggaaacttctgagcttgtggaaatgtctatattttgattggggtggtgattaccccaatcaaaagtcattgaattgtgcatttaatatccatgattttttactgtatgtaaattttacttcaattaaaaaaaatcctgtaactaactgtaatgaatagtatgaagcatataactaccgatatatgaatgtcctttggtatatatatgacccaagctctgataggggtgggtaattagactcatttttcatgataactatgaccacaggaaattattaaccttgtctctctcagtatctgaggatgctcatttggccaaaacatattttactaattgacaataatgagagaaataagcaaatgtggactgagagagaaaactgagatttcaaggtctccaagtgtggcctgctgttttcattgccataccactgctgcatggtgtagagctggtatagaacaggcctcaaaaatatctgaattaaaggaatggacgtatgagagagggaaaaatgcagagcaggaggaggaaaaagggaaggatgtaacaggaggagacaggggaaagaaagagggtatgaagggaacccaaggtgcatgaagctgtgcatatcctaaagggctgagctggctttgctttgctcctttgctatccatctatcctggggatgctggccccaggagaccagagcagcaccaaccgctcagcttggagggagtgctgtaaagcatccctgtgcttcagaaatagcctgtgtgattacagaatagctgcagcattgaaacctcattccaggaagcaattcagggaaagcagacatttagattgcccatgattatcacattcgagagatgccttgtaataaatgtctgtttttctccaaaaatatggggtgaagaggcataagaaatgtaagcttaataattgagaaaccaagctgtttgaccacaaatggaaacttcattacactgctggcttttaccataagagaaaaaagataatgtctgagcagttcatcgtccccccactgcccccacctgaaagagaaggattgaatcagacaggacatgtaaaaggcattatatctgtatccaaggagctcatgtgaccgggagagaggacagacagaggacaaatccaggggaaatagaacattgtgtgtgaattagtggggccaggcaactcatgacccacccccagtgctaccagcaaccttggataaagttacttaacttcctgatgcctcagtctctccacctgcactttggttatttatggaatggatttatgcaatttctcaaaagtggctatgaagatactttctgttagataaattctattttcccactggcttccaatatatctgtcaattttttaaaaatcttcaatgaacagaaatgaaaatccctggtgaataaggtgaccttatggtattgtttactttgaatacattagagaattgctttgagtctgtacctctcattcatcattgaattccctgggtcattttagaatcatagaaatgactttcattcttagaaataccttgactttaactttaatggttttctaaaaaatctttttagagttggtaatttagtactttactctgttggactacagtaacactcttcattaatataaatcagtggattctcccaaagttgtcaccccgagagctcctactaattgatatgcgttacaattggaaaggttgcaaggaacaccggaggcttctgcctttttctgctgttccaaactgagaaatttcattcctgatatgaatcatagaaagagacaataacacttttaaataaaagctgatagggttggagacccagaagctctggatggagactcaagtccatgatggaacctacatctggcagtggtcaccacctggggaattttgacctctaggcatctgtgggttagtaatgcaggtaggctgttgtcgcttttataaaagaccagatggaagttgtatctttacccccacaaagtgacaccgaatcatattcagtgtggtcatactcattatctggtagagatgattaccaccaccgccaccatcattagaagttcccattggcagttatataaatctgacacaagaatggggtaacaaggtattattacataatcatgatttgttttgatagatgaactttttcaaaaattaaaatccatatgggtaaatgtgaaaaagttccttggtgatttagaaatgccaaggacaatgcccattgagcacctgggtcctcagatgtatctacgaccgttcactccaaaaaaagaggtttaagctgctttataaaccaaaggatgggttagatattgctttgtaattaaaatttttcttaataaaactgttacgaaagtaccttgtgactggtctgtatgatcaaggaataaactttagaaataaatacaaactttatatatttatttctgtctttacagttcatttgggatgactcaggtgtgaaatttctaatcaaagtgaacttttaaatgtaatctgaatatttataattaaggtttgttgcatgaagaggtttgctcaacgtgaagcttcctataagatgaccaagtaaacaattgaaagaaaatgaacaaaacatggttttatagttaaccccttgaggagctgcttggcaagatataaaagtagttatgtcattactgtctttttcatgcatggaaagaaaaaaatctttctaaatactgggacaaaaagagggggaggaaaagatggacaaagggaaaataactttattttctgtttatctgtaggatcacagatgcatgaggatcagaagcactaaagtccatttcatctcaaaggtctacagtcattcatcttgtactgtgtcctagaaaaatccaggacctactccgaattgtggtcagtttgatttactagctgaagttcaagatttttttacaatgctaaagagtacatcgaacatcgattggttaaaaaagtttagtcatgagttagttcccaaaaggcatagtcagagcaaagtattaatggggattaatgatggcattgtggttcgatattagcaaaaggccagggttaaaaataaatgcatacatctcaagggaagctggatagtccaggatggcagcagtacaaacactgaaatttaaaaatatgtaactatattgacgtttttttctctcctcctactttcctaattttctcattaatattaccttttttcttactacaactgaatcagaataccatggatcaagtaactgtaaatgttgagatcctatggaataaacttcagttgtgtcaaccttagttttctgaattgcaaaacaaacaagcccccagaagagcaaataaccctctactacatttttcttcagtgcttttggtgactagctgtttgtatataatttccaccatggagaaagggtttcttcaaataatagcatggttaattactgtgggacctcagacattcttctatcttttgatccaatgtttagtcctgggaaacctttgagctacatttgagagatttgctttcccatacaaccctatgcttatttccatcacagaatttgccatgctgagctaaaattttctatttactagtctgtgttctctgttagactgtaagctttgtgaaggcagaaacttaattttgttcacaattgtactccagtgttcagactggtagattgccataaacatttgtcaaacaaatgagtaaatactgagtgttttaccaccatcaccaccaccactaccactatcaccaccatcataaatcaccaccaccaccacattacgccatcaccaccactaccaccatcactcccaccaccatcactcctaccatcaccaccaccatcaccgtcaccatctccaccaccaccatcaccatcatcatcactatcaccaccataatcaccctaccatcaccaccattattatcacaatcactatcaccaccaccgtcaccaccaccatcatcactaactctatcaccaccaccaccaaacaccaccaccattatcatatcatatttggtacctgatcgtctttggaagctcattctccagggccccagtgcctatggctatttagaatcctctgattgatacctttcttcacttattccccattttcaataatttgcctcatctgggctccattcccttggggctctcttcttttctaggaaatggcaattcaatcttacataattattgtgttattggcaataacgtgttgatagtggccctctaaggtaatatgatctgagagtaaggaccatatctggtttcagctcagccacttatttgctgtgtgactttgagtgagggacaccacttccaagggcttctgcttcctcacccagaagactcttggagagtcctccccattgcacacgctggttcagcatgtgtttcgacacagatcctccactggtaatgccttgacccactggagcaaatatggatggaggtggtacatgtaggtgtgtcacagtgaataacgagcctttatctgcagtagcggcagcctttgcagaagcagctgcatctccttgggggaaattctctgcccatagttgctgccagatcctatcagtcgggaggcaggaacaggcatagacaggtaaccacgccgcagtaatgccaggtggttgcacagccttcccttttccccagaaccatgctgcccttgtcacaatatgtcacggcccaccttctttgatagtctgactcagggctcagagtccatgtctggcttattcacagaaacttggggctagcaatagaatgctttattaatgccatgtgagggaagtaagtgttcggatggcacaaagttaagcattctccttagctttctctggcaattttcctggtgggaactgtcacatcagaaatgcattgaaaagaaagcagcaatcaagcaatgcaatttaaagggagaagtataactgtgggcaagtttcttcattttttctaattgcttctcttttttttcttttctctcttaaatcaatctgcagtatagcttggtaaaatgcaccactcagtatttaaaggagcctaagcaaaagttagcttatgtaaggttataatatctcaggcctaatctctagatgatgagaatacaggattttggacttgctttctcctgggaaactccaatagccccaggctgtccagattgtcataacttttcctacttttacatcaaagtgaaataacagcaactcaatataagaacaagggaagttactgaatgtataaaggaaaaaatagaagaagggagagcactattttgaagaataaaagagtattcttgctgccaatgtggtttgagtacagagacaaaatttcactttaaagacaaagatgcgaggccagcagaggtgagttatttaccctgggtcacatagtaagttaatagcacaaccagaatcaaggtccaatccctcgacacgagctgagtcgcttcccatatgatgctgccttcactttcttttcagtcaaggatgaaaaccagcaggttttgagtgagttaggaagacagattcgctatgcaggtgagaagagagtgttacttacattccataggtggagaaactgagtcacagaggggtttagtgctgtcatcctcactaagggtgatttttacccccagtagacatttggtaatatgtggaatcagtttgagttgtcacaactggtaagggaacagttatgacaacttgcatcccccaggtagaagatagggatgtcgttaaacattctacacaggacaaccttctacaacaaacaattacccaaggtcacatacaataaatataaatatactgaacaataaatatttttatctggggattgtgcacttaaaatccttttgagatggagttttactcttgagtgcaatggtgtgatcacagctcaccacaacctctgcctcccgggttcaagcaattctcctgcctcagcctcctgagtaactggaattacaggcatgcatcaccatgcctggctaattttttgtattttcagtagagatagggtttctccatgttggtcaggctggtcttgaactcctgacctcaggtgatctgcccgcctcggcctcccaaagtgctgggattacaggcgtgagccaccgttcctggcccaaattcagattcttattatgattgaaagtttgcacaatttgggttatcggtgcttttttcaacatgcacccacctgttgcctgaaaactccttgccaaccttcagtgctagacttgtcctggaccacagtaagcaaatttgtctttggggccccagtcgtgtgctctgcatcttgtccccacccagctccactctctccagatacccagcaaagactggtctgctcatcctcactgtttcccagcagcaagtgccctcaggaaagttctgccttccttcactctcacctggggatgaactgagatctatgtgctatttcttctggagagtccacatgccacctataccgctgctctggcatttgcaacctgcgaatgggatttctagcctctatgaccaggctgggaggtgtttgagaggaattcagaacaactctgcaccagcctctgttttacctgtgaggcctgggcccagcccctgagaaaacacacacagctctgtcgccctgcaacagggttctggctaagagtccacaacttcagaacattttcttgtgggctctctaggcacatcttttcatactaataaagtcaaatcattcattgagaaatttaaagattttttttgtctttgttctttgtttaactgcattcagaaatttcatgatagatttccaggatttgtgaacgggagagtatctgcctgaatgaccaaagaacacttgatctttcctctgtgtcattttttaaattgatttttggaggctcagtattttagcttttaaaattattaaaacggaacagattttggaaagattcacagaggtattctaaggtttaaaggagctaatagaggtgaaagtgtttttgaaaaccattgaatattttgtgtatataaacaagggtatgacggaaatggaaatattgctcaaaatgtctcaggtcaggacctctaccccttaacacccaaattctccccctccaaaaataaaaccaaaccgttttccaaatggattttctctgtctagttttaaatcttttaattgggatataaattttcaaacttagaacttcataggctttacatgattaataaaatctcagggcaatttgcattaggagtatgtgtgcttattcaataattaacagcttccgcttagccagctgccaccacagacacattaggttaactgcttcctgtctgcttctcttttgcactggcttctgctaggcagtgatttctgacttctgggtgcgtaaaagtacacacagtgtgtgagtaagcttatgctgatgagtgtgccattttagaatgcttaagaaggaattaatttaaatttaaccactgctagctgttgcttcctttcttactgcaaaattgttatggtaacttcaaagaagaaaaagagaaatcttgtgggcgaaacagtaaaaatagtgatcagatgcaagtctaatatatttgttataaacggtcatgacactttggtaaacatttcccaaattcaacattcccccaaatctttggaattcattggcttcccattatggaatgtaaatgcataggaaacaaaactgcctttacatgttggtttctatttttactttttatgctctgctgtttcttaaattcacatgtagcttagttattaataaaataaaagccaccattcttaaaagctaaccagaaattatatttcatatcattcacagtctaatatttttatattaacaatattgatttcatttagctcaaaagaatatacaaaccaaactcaaacataacattctttcaaaaagaggatttcttagaaaacttagggaaattggtaatataagtatttctttttttcagtctttgattgtttgaaataccacccagtttaacatttcttcagaaataatctactcttcagccagattgggtctacttctctgtaccaacatctggctctccatgttgggtacattgatataatccaggactgcatgggtcctggacatcccatttaatccacgtcctatgcctggcccacccttcccactcatgggagttctatctcctttctcagaaagttgttccactgcaagatctctgcattctcaaagttgttttaggatatcctgcagagagcggcatgaaaagtagaaaatgtctagatttgaagtcagcagaccggagttctagctgtggctttgtcactgaaagctgtccttaccctgtgtcctaacttgtaaaagtgcatgagtaatggctgccctacttaccacacaggatcctgcaaagaatcaatacccacttcgtaagtgagaaagccctacagtgacacatccttgtgacaggagttaggatgagatgtagccattcatttcttcactcttactatcagtgtgaaaattgagaaaagctgtgccttgcacatcttctgtgcaccttgatgtttggttgatcaactgtttgattatagtcattgacatttttgtcatgatcactcctcagtctctaggcaaggggttcttaagaataactggtctacagtatcattatatctatcattgttttctaaagccaaagaaacatacagtattgagacgataattttgttttatagcacatgataagctcagaaaattccaggagctataactgggtgtcagaagctagaatcttacaaatgaaagtttattaagtgtaagtcatcatttcagcagctcttaatgaactggcatatatactgaggcaaatgacaggtgtaacagattttaggtatcagtaattgctgcttaccattgcagaccccacacggctgactttgatgggattccctcttccagagaggtccatttgtgctctgtccatcacatacaggcaagtgtccaggatgccatcttcaaactatttggagaaagaaaaacaaagagaaactagtgttcactctgcaagcaaaatattctctgatgaaaaataacatgaaaccacaacctaatgtttagaaatgtgtgtttcctgtatagtgatctcccataatctttagtatgaaatattaaagtagaaggaatgagacatcttcttttgtttttcattaaagtgaataagaatataaaagcaagccagaaacataaacagaaatactagagagttgatatactcagggatcataagctgacttgaagttcttcagaaaatgattcaatttagaaggtcttttcaacatattggctcctgtacccaagaagaaggaatgaatcatttaccaaagtcaggccagagtcttaggacctcgaaagtaatgtgaatcctcgtgcatttagaaaataaagagctctcaggtgtatcacaggaaggtgcttcacactacttagtttgcacccaaaatagtaggagacctcatatagtgactgtccctctaaggtttcccctcttctgagacaaggtggaccccaggatcaaggagagggcagaaggctgcagaaagtagattacactatcaagggaggagtctggtaccagttcagtcttcttagaaagaactgctagccacaggcaataccagaattttcttaaaaaggaataaagatcaaatagcaagacaggaagattttacctatactgtacctcactgtagtaagagattttcctgaatagagaaaccttgtgtgctatccacccaagtgcttgtgacagaaaccacaatcataatggctaattaccacacaattctttattcagtccagttagaatacccactctgggtgtatcccaaactgacaggatggatgcagtaatgggtaattgcactagttcttcaggtatgcaaatagctcagtattttggttcttattaagcagcttctctcagctgtgtttgctgggcaggatagcaactaactggagagttaaggaaatagtcatagaacggattgattccctgcatcactgtaaacatgcttggctggttattctggccaaaggatacacaccaatagcctctttgagtggcagaagatacaatcaagtgactgtgctccagggtgcctacccaaaggcaagctggcgaagagtgccctgactgggcttgggacacttttccagacctccttgctgcccaccttgatgacttttccccttgttagctatctatagattgtcatatttgggccataaatagaatcaccaggctaaaggctagaaattggggacccaagacaagggcatcaggcagtaggcagtatagtcaaaggttgcatgtcactgaggaggggatggcttgaaaccagggagtcaggcaggaatccaagaacagggggtgccaactagcttgtagcttggcaggacattagaaatgcaggcggggaagcctgagcactgggcatgtaattctccggagtcagggaagctgttcacaaagccaggtaggcaggataacacgggtactggagcagtgggtaaggaacacagggagatcccatatggaagtcaaagcaaggcatccggagccaagaaagtaccctgtgaccaccagattccatgaaaactccctgctggatgcccagcgcaatgatgcacagttccagccatcccagccaaaactcctgagaaatgacattcgcccccgcttgtgtcgctaattaaaaatcattttgaaatcacaggacatgcattcatttatggaaaattggtaaaatatcattcatttgctccattgttaaagataccaaactgaaatagtttgaatgactgaacatcttaaagaaatgccatttgctactttgtgtctagacaatcaacttgcagctgataaaatctttctatgtaaaagctcagtggcccttcctttgatgaaatgataacactcttttctaattagcagtaccctaggctaacacttaaaaaaaaaaaaaaagaagctatttctttgaattgggcacaccccttgcagtattctttgcatcactttgaaaatacctttctttataagccaggttgaactaatgagatttcactgttctaagtggccaaagcatttctcaatagaatgccacattattcatggaatctctcatttctgtaacactgtaatacccagagatatgtggtttcagctgataaattacgcagttgtctttatgagtccctactcctatgctctctgccttggagtctcagatcctaaaaagcaggaaattgtgcttgtctaatatcgatatatgggatcctgtagggatacatgtgacaaaaaatatgaagtaaaaatgtccttgacaataacaaattttaagtggctcacctgaccatagctccagcttctggtcttgatgtcattgacctctccataaaaaattaccccgatgtcattcaggacatactcttctctttctttctcattgtccagatacacagcatcatctgcatcagggtttaaacatagtgactattaccaaaccagactgtttccaaacacttgcaagtttatgcaagtttattttgtttctaaactacatttaatcagccaaatttttaaaaaatgccctttgtttcaccaagcatagctcatttcccaatatttttagtaatggtgaacataatcagcaccaaattcagtctgtaaatgatgacatttgttagcaaaatgctgacgaactctggctctttaagttccaagcagcagaattaaattgatatgtctcattaaacattttatgattctgttgcatcagtagtttcagaattctatgatgctgatgtacgtctctaacactaattaaaatataatttccaaccttttaacattaatagaaaactagatgaattgaaaatgacttttaaaacaaatctgggacacgtgagaaggcccacgtgtcatgtctgttttgtggcccatcactggcaggagggaagcagtaggtcatctccttttaatgaaagatacttgtgaatgtgcaagtatgtgtgtgtgtccaaccagcttccctggccagtgtctttcattgcaaggacttttcttccctgtggctagaatttcaggaggatcatcctccccgtctatcatcagtctggtacttattcccaggcctggtgggagagcagcaaagcatctttaacacagacaggaccctacaagtgtaaatcgcactcaggaaaatgtgtgtgtttgggacaggcatctaagcgtttttacacgaattctacctcaaggtaacgaaataattgattataataaatgcaaaaggaatggtagaattagaatgtcacgatcttgcaatccctaatgaagtaacgaattgaggcagaaataattcgttaagaagagaacttcgtaacgggtggatgagactgataaaacgtgaaccagatactattgacaaacctaaatatatgtatcttctgccaggatgaatgtcctaggaagcaatggcgtgacttatgaaatatttttgccccttcctccaaaaaaaaaatgccacttggagctgaatctgacagagtctgtagatctaaccagctgcttaacagaaaatgccacagtggttaaaaaaaaatcccacagtggttagagaaaaatatttcatgacaccgggggatggaatcagcaaaattcagaatatggaaagttctacataaaaaatgactcagtttcagccataagtttgtggcatgaagaaacagatgaagaggattactctagaggaaaagatttaagtgacataccaaccaaatttaatctacagaccttaatccaaataaactaactaaaaagataatttttagacattgggaaaattaaagatggttcattagataataccaaggagctcttgttgatttgtattagctgcaataattatacacaaacacacataaacacatacatacacacatatgtacatatgtatctatgtatactgtatatatgtctatttttaaaaagctacacgctaaaatatgtacaggtaaaataatatgattactagaatttacttgaaaatgctaaggcaaaaaataaggaaaaaagggatagataaagcaaatgtggcaaaatcttgataaccattaactctgagagtcatataagtagatattcattgtgctactctttctgcttttgagtttatctgaaaatatttataagaaaaattaactttgtcaaaagatataaaactgaaatacaaaatgaacacatacaaaatgtttccaattggatgtgaacattcagtaatgtaaagatataaattctacccaaattagtctatatgaccaatgtgaacccaaccaaacttctactcagaagttttggaactttgcatgctcattcaaaagcttatctggaaaaaacaatgtgaaagaaaacagccaggcagggcgtggtggctcatgcttgtaatcccagcactttgggaggctgaggcaggtggatcacttgaggtcagaagtttgagaccagcctggccaatacagtgaaaccccatctctactaaaaataaaaatataagccaggcatggtggtgtgtgcctgtaatcctagctactcgggaggctgaggcaggagaatcgcttgagcccaggaggccgagatagcactactgcactccaggctgggcaacagagctagaatctgtcccaaaaaaaaaaaaaaaaaaaaagagagagagagagagagaaaatagccaaaaactaatatgttgaaaaagaagaaagattgaaggacttgcccaaaggtaaattaaactttggaccccaatttatagtttcctgcatctatgccctttgccatgtaactagcagttcttccctctaaatgtggaatatcctctcttaactttaggcttattttggctaatggggtgttagcagaagcaatgttagcagaagcaagtaggggtctaaaatatgactgcgcagctgagcatgtgatcatacaaatctgctgttaccctgaggaaaatatgacccagcaagcccactggtcaaagaaggatgagaggcaccagagcagagggtctccggagctctcagggagagacggatcctctccagctgttcccaccggaagcagagctggctagtcaagcccagtctggatgagcccaatcccagccaagccccagatccctgagtaagtgcttattgttgtatgccactaagattttctggttctttttaatgtagcattagtgtgattatagctaactgaaacaaagctacacttaaaactgacattagcacagtaatggacaaatatatggaaggagctagatgtgtattaaatcttagtaaataataaagatggcccttaaaatcaataggtaaaaatagatctgatcaatacgtggtgttttgacagctggttatctatgtaagaaaaaaagtgtcagtaagatctctttatcctactatatacaaactgtatccatagatttaagaggcacatgtgtgtctctccctgacgatctttatttcacctgacatgttccagatataagcaggtagagaaacataacgttcaataaatatatgaaaaaatgctcaactccactaacaatcagagacataaaaaccaaattaaccatgaaataccaatgaaataccataattctcctaccatatcggcaaatattaaaacaaatgattaaccaccagtgccaatgagggtatgaagagatggatactctcatctactatggctgtagtgtaaaatactgcagccttttagaagggtaattaggcaatatctatgcaaatttaaaatgtgaattcactttgcccaatgctatttctagatgtctattctacagtaacatttgtacaaaatgtatgtgcaaccttcaaaatggcataacgtgctatagtaaaaatgggaaacaatccaaatagttgtaaacaaaacaccaaaacaacatgatatgaccataccaagcagccattaaaaagaagatgcaggtactgatatagaaaacgctccaagatatactgagtgagaaaatgaggtacagagcaacaggttgacacaatctcttttgtggttttaaaaaacctaaattctctaggtatatatatgccatcaatacataaaatgatagcaaagtatctgtaatgatatacacagttaaagttggttttccctggggattctctaggattggaagattggtgaaaaggaaagttttcttttagccatgtaaatgtacatgtgtgtttatttgaaaagaacaatatattcaattaattgccaattaaaaatgaaaagcactgaaaatactttaaatggatgacattacaacaaaatgttaattgttagtgtctctaatttgtagatctttgagctctttttatgcttttattattttttatttctataatgagacttttccatcagataaagttattttctaaaatgtgtttccatttaagtgaagctacccatttaaaaagagattaacaagtccaacttttgtgcattagtttttctttaagagcaatatagggttgtgctcttttttattatcagagtccttcaacacaacttttttctccttctttaagtctccctgaaccctttcctttccagcacagattgaattaaaccttgttcccttagtgccctatggaggcgggggtaacatttatcccactgtatggacattgccgtttaatgattatatttattgaataagtatgtgtttaagtatttacttcttaattttttttaagtagtagcatgtaaataagcattgttatactgcttatttatggccaggaactttctaagtgctttataacaagacacatgaactcatcaacactcataacatccttgtgaggaaagtagccccatttcactgatgaggaaactgaggcagagagaaacataacttttccaaggtcatgcagctagtgagttgtgaagctaggatttgaataagctgccttctaagtagtccatggctcttgggtccaaaggatcggatgactgcgtccccagcccccaacactgtgccttggaacacggtaggaaatcaatcaatgtgtactgaaagaatgagagatggggaagatgtctggagcttagagagtaaggaagaagtccaagaaaatgaaggatttacctttgggctttgcgttagtattgatgggaagtgataaatttaagtggcaaagcatgatagagaggagttctggagctccagactaggccaccctttcccttccaacacttgaattaaatctcacctcaaacaggcagacattatcatgaatccacagtatggcaaggaagtcaaatgggaaggctcgattttaattttaaatttatttatgattttaaaaagaagattgagggtggaaagcagtgctttatttcccgtttttattcagatctgtcactttaaaatatagttgtccaaagcaaggttaaaaaaaattgtatcacgatggaaactccaaaaaaactccctatgtttggaaggctaacaaaaatagaaaaatgtaatcatttgcccttggagatttttgctgttggctttttgatagtgttttcgtttgtttttaaatttttggttagcttcagagcggtggggtttcactaagtttcaggggaagctagttcttcacttagtaaaatggaaggctcgactaataggaaaaacaaactaacaaacaactcactattctagaaacccaacaatttggactggtagaaggtagacgtgtatgaggcttgtgtggaatgtgggagctggaaactatacttaactgaggactgaggggagaaataaggtctagacagctcccagagtaggagcggctgcaccttggaccaactgacaactctttgatcgtaggtgacctctggcagacaaccaccattacgataaaactctgagaaaaacagattacacatggcaccattggtgagtgtgacacagcacctccatccactgcccagagcaactctgtcaccagaacagaccttcaaaatgcctcgtaaataaccacccttgcaggctgactaacaatttacaagaggcatgtagtgaagaataatgacctcatttattttactgttcctctggtgggaatggaagggtagttaaaaaagaaaagagtgggccaagaaaatttggggtggatttcagtcaccctctgacattcccactgtcctcccgacccagagaaggtaaggatttataacaaacatgtaaaaacaaatgctgagcctactgattttagtatctgtataacctctttgtgagaaggaagatcattcatcattgcatgggctgatacattccttctgcttatttacatgctatttcaaagtcagagcaagttccatttccttggtcattaggctcaagtctggcaaagggagcccaggaattaaacaaaactatggtgctagaacagctaacctacatggtctctttcaacagtttaaaccagagtttggtgttgtttctaatcctttagaaggaataatggtttggcccttccaaaaggcaaaatgagtcaccatttagggaaggaaggaatttagagcgaggggattaggaatcacttacacttgcttccccctttatataaaagctgagcaccactaaaaagaggaaagattcatgctgggagtgtgtaatcactcttagagggagtggcttgatctgcagagcaaatgtgactccggactggtgtcaccatgatatgtttttccatcacaaagtacatcaaaaggggtggcagattctaacaggctgtgtgtgctgtggcataccaggagtaacttcctgtcggtggcaattgtgagcatattaaggaatggcatttttagagtctgagctttttattctggaaggatccaaacgcactgccttcctaaaatggtttcatatagccactccagagacgttgcttgcctatctagtaacactggaatggaatcaatctatgaagcacaagcaaatggttcctcaatagtcagttgagtttgcttctttccttttagccccttcagtataaagtagagtagttcgccaggactggtatcctcgaaataacaatgactaacaccgcttctcttggagacccttgagcctagaccagaatttgcaccctcaggctactgccattcatccatcaattcacagatattgatagtatatctcccacagtgctcacgacagcacaatcatccgtgcgtgcatagtacaacatagtttacattccttacaaacatgctgcattacagctcacaccagcttgagaaggttactggatttgtgctaatttgcctgttttgctggttaagggctttttagtgtactgagatatcttcagaagatagactattattcatgaagcaattctacaaagaaaatgtcagagcttctttacttagcacatatcctctaagggagcctgtgcccttgttggtatgctttaattttttttcccagagaaagctttcatttgatcttgtaaatatcaacctgaatttatttatttatttatgtatttatttattatggcagaaatttccacgttgattaggtcattacagaatcttctcggctggccatctattggttttttttcttttgttacacaatgccagatactgatggcttttgttttaaaaatataagtgcttaccttgacagagtcaggatgctccagggttagcctcagtttgtttcttaattttctataggactttgagaaatgcacgtaacatcacagaacctgctttctctcttgaaatctgagtctaataatcgtctccttgcctctcagaatggtgattatcagttcagttcagcaaacatttactgaacattgactcaattccaggcaccacgaaaggctgaatgagataaggattacaccttccaaacacacaatctagggagatactgactatgagcacactttgaagcatataagagactctacaaggaaggaattgtaaaccacatgaattggtgggtgaatgtgtctctgcattagacacttccaaccatgctctttctagaaacaccttgtaaagacctttgcacctcaatcctggggtcacctacatgccattgaaaagaaggtttactgtgagctctctgggatcctttctgattacagggccacactaaatgatcctcgcttggcataaaaagcataataagtctctaatgactcagatactaggaagaatgatgcatactattttatttaagaggaatattgagtaaataaaggttaaaatttttccataagctttattaaaacttcataaaaattcaattaaccaactatttgattactatcctatgcaaatactgttctgggtgctagccaaggtgcaaagctaagccactggccagtctctcctcgttccccaaataggtcggagtccccagttttgtgttcttcttgtgcactgacttattttagtactttttacaattgtaatcagttttttattaggagctcatttgtaaaatccttgctagaagctatacgaagattgtgtctgcctttttcactgccatagtcccagtacctaattcagtattgactttgaatttttctgaatgaatacataatactgtcgtactgtgcacaggtcattgtgttgtcatgggcatgggatgcgacatactatcaatatttgtggattgatggatgaatggctctagcctgagggcgtaaatgctggtctgggctcaagagtctccaagagaaggaatgtgggtcattgttactctgaggacaccagtcttggttacttactccattctgtatgaaaggggctaaaaagaccttatataaatacaaagcaaattggctaaggatgaatttaatgataaaatacaagcaggtcatatttatttatttgctgttaaaagcatccaagatattgggaacatattgatttcttcatattaaattaaattgatttatttgtttaaagaaaagtgaaaaaacacattgaataaaaaggaaatattagatgctaatttggtgtcagatgctaagagatagagaaatccacacacacatcacccacagacacactcctcccagcacaccagatatgtttttgacttttctcaagatggtaaggtctgagattacatttacaagttatctgtaatgacagggtgcggcgaacctagagtatttacttgggattattaaatcaacacagcaaacatttattaaacctcaagtgtgccagaggctaaggatatgaggtcgaatgaggtgagggaaaagcagtgatggagaatggaatgggggaacaacttatcaagaggagaaagatcccttaaaggtaactgatgcccaatcaaaaatactgctcactgcttctccagagtactaggcacagatatcagaaatctaaatctttcaggacccactatctggcactagtgctagactaccaaactggaacattctatatttaaatagtgaaatacattcaatagttcagagttcctgagtagttagaaaaacatgatgaattcataataactgcccgtctcactcctgctgcctttgtgggtacagttctctctaacacccaggagaagggtttcctcccagaatggacccgaagcccggttagcaccactaaactaaaaactaagcaagcaattattctccccgcatgcacccctgccttcactgatgtggcattgctattgatccccattaatgatttagtgattaaggaggataaattgcctatgaatgcaaagcaggctgaagggccctcaggagcacagctgagcattctcctatcaataagtgctgtgcatgctgctgtaattttcagcccagcatcctgtgccacctcgggccacaatcttgttcacctggctgtcttttgacaatttctggaaacagttttccttcttatcttctgctatctttttcacttgggcgacagtctcacccctctcttttgacctactttccagttaccaggccatagcgctgaatcctttgttatgcattaacacacacacaagcataaaactgcaggggactgctgggctacagtgtatgtgcttgtgtgtgtgttggggggagcggttcatcatatcatcccctttttgggttatgctttgcgtgctaggccgggaaaccacacaataagtggggagatgaactctttctctcacttcatttaaaaaaatggtgttcagggcccaaaagcatggttgttggaagagatcaagcaacaaaaataataaagctcactggatccctctgcattaaggaaggagaatttgctcctgggacagaatgggagagaaaagttcagagaataaaggagaacagtaggagagagagaaggggtggtaagggagagagactggaattaggttcagggtagagccagtgaaattttaagaagagtaaattataatctcctgaggttttttgtttgtttgttttgtttttgttttttgagatggagtctcactctgtggcccaggctggagtgcagtggtacgatctcggctcactgcaacctccgcctcccaggttcaagcagttctcctgcctcagcctcctgagtagctgagattacaggcacacaccaccatgcccagctaatttttgtatgtttagtagagatggggtttcaccatgttgatcaggctgatcttgaactcctgacctcatgatctgcctgccttggtctcccgaagtgctgggattacaggcgtgagccactgggcccggccctgcctcttgagttttaaagttattgcttattgtctttctttcttcttagagacaggctggcggggctgcctcgaactcctgggcccaagcaatcctcctgcctcagcttcccaagtagctgggaccgcaggctgctctgggggccatgcccagctttattgtttcgtgattattatgaaaccagtggtccgctaagtgttgaccccgaccagcagcaacagcatctcccaggaactggttagaaatgcaaattctcaggccaggcctcagacctactcaacctgagggtgctgcacagaagtggctgaacaagccctccaggtgattctgatgtgttccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccacagagtgcatccttcctgctctcaccctccatcccaaactgcagttaaggtctgggcattcacagatgttgtgtgtggctgcttttgttgttgttgccaacattgaaattgaaggtgacggtcaagtttctcacttgcagcagcacaagtgtgagtaggactcctagaggcagaggcagccatgaagtcagaaatccctaaagaatttgcagagatgtttgggcctccacaggccaagtaatgaagaagattgtgctagtttgccctgtgttctggaagcagggagcaccctcccggcatgtccctgtaataagttcaccttctaccctccagatgactagctcacatcttccctatcaagcgtttcatgcccttccttgctgctgcttctcaacacatgactttgctttacacttcactgacaaaaaaaaaaaaaaaggagtcacaaaatggcaatcacctcattcttcttccattaaactggaaaatctgcacccctcttcttctactctactcctgtctctggagagagtagatagccccacccatcacaggcccttcttcacctgttccctggattccaaccactcaaggatttcactcctgaaacttctcaaccttagctccaagaatcacctgcagaactttaaaaaaccccaaagcccaggctgcagtccagagcaattacatcagaatgcctgcatgggggactgaagcatccatagtttcaaagcttcccagatgattgcaacgtgcagccaaggctgtgaaccaccgtcctctctctggactgcaaactctctttcctggttcctctccgtcaccataaaataacacccactctctcttgtctttaaaaaattctcctttgaccttcgcttcaacatctaggtgctacagaaagtcttgagaaaggtgccatctcccgccgtctctactttctcgcctcctgtttacaacacagcccatgaccatctccctggcttctgtctctatcactttagtgaaaccgtccttttcaagatcatcgaagacatccatatttccacactatatggccactttcctcccctatcctattcaactaatcatagcattaaacagagttgactgctgtcttgaatctatcaatgtgtctggctctgggctcttttgatctccttgcgctccactgactgctcctgctcagcctcctttgttgacttctcctttgtctcaactcttaattgttaatgaccctgaatcatttgtgtccgttattgctcctaaccgtgcccatgtttacatgtctagctcagccatctcctttgagttctagattcactttattcaagtgcttacttgacgttttcatttgcatgtctcatagacatcaccaaattaacatttctgaatgtaactcttagcttcacccccagtgcttcccctccacttcccacagttttcccagctctgaaaatggcaccgccatcaacccaattggtctaacaagaaatctagagttattcttgagtcctcccatttctttacttctcatcttgaatccctgtgcaatttttgttctaaatacaaaatagatctccaatctaaccccttctcatctccactggtaccaccatgtttagtttatcatcatctttgtcctagaccacagcttccaaattggtctctggtttttgtcccaccttcctccaatcctttccatgaactgaaaacctaggggaggtccctgtacagcctctagaacaagaacgcctccagacctaagtgactttttcagaacagaggtatctggaagctgctcatcatggatacaactgaagatcaaggcagcaattagaaggttattagattgtccacctcctgagtagttatcctgaaagttaatatgtcaagcaacttaactaacccttttcccgtcaagaagagtggtcacataagttgaaatgaatgcagacacatatcccatttacacacatgatataatccagaaaagttgcaaacaaaccaaagtctgggtaaattatagcattcctgaaatttcctagagttctgaacagttatatgtagcctaggattttctttttgtaataaaaagaaagtcaataacaaactcttgattgataagtatgaatttttaaatacaattttcttagaataggttgcttcctacatactcttccatctcattctcttttgctgactccttctctactggactcctaaatgatggtgttcctgaaggctagatactatatcctatttccttctttatctatattttctccctaggtacagataactcccaaatatatatctctgattttcttctccagattcacatacctatttgtcatttctgctgtctatctatggttatctccaacttaacatattcaaaatcttaatttatatatctgtaactctgatcctctcagtatttttcatctctgtaaatatcaccccatcaaccagttgcaaatgcctcacatctggttttaagattactatcaagagttcattttttgaactgcacatggcccagttaacatttcctgttaccatttaccttgaatatctgtctcatagataggagtgttgggtacaatatgatgaggatggatgtatagggagtgtaggaatagcttggcgccttttgccaacactagtggaacaggtaattcccaagccatgctgggcatggtggttcatgactgtaatcccaacactttgggaggctcaggcaggagcactgcttgagcccaagagttcgagaccagcctggacaacatagtgacaccacgtctctacaaaaagtaaataaatataaatataaaacaaagaaaagatcagtaggaccaaggtgtatgttctagatgagtagcaaatattgttgtgcacttatctatatctaggacagattaaccctgattcaaatgtgactttcacatacaaggatcattcaaaatcagcaataatatgggctcattttggatgatgttagagagcagtgcatatggggtagggtgccatgggaagtctcctgccccatgtgagctttcatatctttcactgccttatttcctaggacctagaagtggtctctcccacattgatgctgctgcaacatctgcatctgcctctggaacttaaaacagcttcgtacaaagtgtgggagcaggggagaggtatgaaagggcagagatgaagatgaggagaaaatgctatgtgtgactgaggcacaaaacagaattgatagagaaatcattgaacttgactgagttttatttgaatataactagattaagcttctgccgcagacagaaaggaagactgaaaatagcactagagatcaagttatattatattaaagtacagctacatctttgcacatccagagttatggtttgcaaaatttgcacccactatgcacataaacaactttgtggaatcctttagatatacagactttctgttcttaaagtagggggatagagaggttagttctactatgaacagcgtcgactttattttatttttctgaagtcagagttatagactctaatagttttgataatcaagcttaataagcccaatttgtttacagagtaatagtgtacagaggttatactgtcaacatatattaggttggtgaggttggtgcaaaagtaattgtgatttttgcaattacttttaattacaaaactgcaattaatagctccacaaataactaactgcaactttagacaatctccaattaatcccgaaataaatgtatagcagcattgacttcacatatagaggttttatcttcatacacatggaggatgaattttctatctttctctttcaatcattaaagatggtatatgtaggagaggcatatgtatttagaataatcttactaccccttcaaaaagagatgtattggaaatacatgagcttgttttttttcttttttcaaagacggagtcttgctctgttgcccaggctggagtacagtggcacaatcattgctcactgtaacctccaactcccgaactcaagcaattctcccacttcagcctcccaagtagctgggagtacaggtgtgcaccaccacacccatctaatttttaatttttattttttagagactaggtctcaaactcctggcctcaagcgatcctcccatcttggcctcccaaagagctgggagtataggcatgtgccatggcaccccgccaaataggtgaatttttaaatgagaaaactaaatgtctgcctcttaccttcacaccaaggattgaagagaatgtacgtgtctgtttctgggtttcgactggttcgaagtacgccatagggagtccagacagcaacatacatgcggaatttccccacaatacatttgggggaagactggatggacagccgcacagacctgtcctctctcatgacaatcttggccccccactttccactttgtaactctgagactataggcactgggatgtaggttcccttgttctcctgtgggtagcgacctatgagaagagagaagaaatactctgttaggttgatttcacaagccatttttgttctcactctgttatcttatagctgaagggacaggagtaatccattagaattattcttgacttgaagaaacatacaaatcaggcaagtctgcaaattactttgattgtaagcaggagaaccttcaagagcaaaacttattcacttcatttgttttctataaagcatgtagaggattccacattaagacaagcaaacagtgctccattgtaacctccctaattactaatttcaaagatctttaaaagagtctttggtaggcatattgtcagagagagaacattctaaggaggtggttacataagttactgctgtgcaattctgtgaggatgcttaatcttaatgaaaataataatttacacagtgcaaaccactgagaaagattagaacttcaacactttgctattagggatataggttataccactcagaatgaatatcacatatacttgtaaatccagcacaaatttaaacattgttttctgcctaggtgccatggcatctaagtaatgctcttgaagactcatgggactcaccctctcaggagcccctccataaacccacctgcataagcatgtttgttccagaggcacccatctcctgtttctgctccctcttcgtgcatactcaatcttgggatgagcttgccctttttaccagaggctttgtttttctctggaacccctttcactgttgacgtgtagacatcaaaggcaatcttgccaggtaaatgggacccataattcatttattacagtggttcccagcagctgttgtcactaaatactgatttagattcagaatacgtcgtatttaaaaagatgcaagtttagtaaaaataaacttagagataaaaatctacgtgttaatgatagatttaaaaaaaaataagggatgaaaggaattttaaagctaattatgtaaggatgcactttggggaatagcaaaaaactagagaagtacatctgaaagcactctttgtacctgttatgtgctcaacctcagcttcacctttgtgctaacttccacttttgttttaaaagcttcacctttgtactaacttctacttttgttgggaacatggaaagaatgaagacaatcactagtttccactgttacactttaaattaagacttcaaagactcatattgaatttcacctatcaaatccaagttatacaaaaatagtaaagcaaaaggaaagctatgctttttcatgctgactttgaatccagtcataacctaatttaaagactacttctgacatttttcattcatatattgatattgcctactatgtgctagacattatcctaagtgctaaggatacaacagtgaagaaaacagacaataacttctgtgctcatagagctgatattccacagaaaaagccaaagcatgtggcttaccatgttcttattacccctttattccctataacaaaagatgagaaggaaaccattatcatcatcctaatttgacaaatcaggaaactaagagtcattaagcaacttacctagggtgatacaactagcaaatagtggagttcagatttgaacccagaccatctggtttgagagtcggcctgttctaagctctatggcagctgtgtgagttgaaaatgttttggagttgatgagaaccatgtcaaattctgactccactattaactactggtgcaacttcaggcaaatcacttacttgtcttagcttccattttcttgattctttgcagtttagtttgggaaataaaaagacaatagattttataatataatgaaagctttatgcttagcacacagtaggggctggctgagggggcactcattttttttttttttttttgagaaggactttcactcttgccacccaggctggagtgcagtggcatagtctcagctcactgcaacctctgcctcctgggttcaagcaattttcctgcctcagcctcccaagtagctgggattacaggcacccaccaccatgcctggctaactttttgtatttttagtagagacaagtttttgccatgtagggcaggctggtctcaaactcctgacctcaggtgttcccccccgcctcagcctcccaaagtactgggattacaggtgtgagccaccatgcctggcaaattgttttttttttttaagtataacttctactagaaagtaaaggcagaaggaagaaggggtgatttcttttttgctctctggttctgaatctgaagaaaggtgaatgtcccaaggaaagtacgttacttgtgttgattgagatattgtggctaaggggaaagcaattcagctggctctaacacttctgtgtgatctcgggcaaagcactcatcccctgtcaactaaaactttgcttcttctacaaaatggagatcatggtggtcatagtttgtgatggggagggcagcttaataattggtagttatcattacttccctgttgtcctgggctttctgattcctctaagtgatccttctctgctccatctgtgggaaattaggatgggtttaccaattgccaacaaacctatcaaagcccaaatctatttcaaaggccaattcatcccaaactaaaaaaccttgagctgactgatttttccatcaggagaacttgtagaagtaaaaaaagaaaaaaaaaagggttgccatttattagtaaccaaaagccttaataattccagaatcatcatggagtcacctgaaacctcccattcaatcataatttctgattttctgagttgttaatgatcaatgtaatctccattcatcctttagagcaatggttagaaaactatagtctgcgggccaaatgtagcttacctactgtttttttttttgtttgttttattttgttttgttttgagatggagtcttgcactgttgcccaggctggagtgcagtggtgcaatcttggctcactgcaagctctgcctcctgggttcatgccattctcctgcctcagcctccctagtagctgggattacaggcgcccaccatcacgcccggctaatttttgtatttttagtagagacggggtttcaccttgttagccaggatggtcttgatctcctgacctcatgatctgcccgcctaggcctcccaaagtgctgggattacaggcatgagccactgcgcccagcctacctactgtttatataaagtttaattggaacacagttatgttgatttgcttgtgtattattgtgctacaatacaaccctactcttgtaagagcagagttgagtagttgtgacagagtccctatggtctgcaacgcctaacacagtagctggcccttacagtaaacaattgccaacatctgccttagaggatttcacattttatttatttaaggagcgatttattacagactcttgaagtctaacacttgagcctaagaagaaaataccatcacctagcttctccttccaaggagaaatatgtttctaaactattcgcaaacatctgtactactagtaggtcaacctttagtttccttaaagtcgcctaaattccccacagtctcagggggtgttgaaaacataggaagtttgtagctttttattgattttatgattcatggctaaaatattcaattttaagattgcaaaagttgtttagagttgccaaggcagttcacatagtgatgcaaataaagtgacaggaaataagttttatttcttggggtccttacaaaacctctgtgaggaaatttttacagatgggaaactgaggcttggtgagggcgtcatgtgtgcacatcacatagctaggcagaagtggagacagaactggggacagggaagcctgttctctttgctccatgtcatgcttcctctgtggaggaaggtggagaatggcaaaagggatctagggagatgaaaggagacaagagaagaataaaactggaaagtccaaaggaatatgaggaaaagggacattgagaaaatatgctgccgtggataagagttgtgtgagccagaaatgtggatcaaaggaggtaacaactgagtgagtgaagagaaggaagaccaggtggagagaacctgcatgagggtctctctgggccaactcatttttttgtgatttgcattgggaagacttccaaagtaatgtcagacaccaaagggtgaaggctgagcaatcctgctgatacgctgatgccacgtggcccgggaacaggttatggaagcgttatcagggacagggagtggtgagattaattccaaaggaaggaaaaagaatcctgattggcaggcttttcatattcctgtatgggaaagctggttaggaatgtggaacctgatgtgccaatagaacctcagggactgctctattacacccatgtttaattctgaatgtaatgatttcagtgacagcactggggaagtactctccatgattgaattgtgagtgaggaagttgtgacagagtagtatttcatttcactaaatagcccttctcagccccaggagtcggcatggttacgagaccacaatccagctaccctgggaaaacccatccatcaacatccatgactgcccatcagctatccttggcccaatctggatggaaaacatggctccatacagggaacctccatgcacgtgtttgcctagagtatataatgcctggatagatgtgtttttctcccccaaatcatgcaactttgcgttaaaaacatcagggcaagaaaaagacatcgggaaagacagcatccaagaaaggaatcccgttttgtttttaataattgcagcctttgaaattggactactaaacatgaggaaatattataattaccaattgcattttttcacacttatcaaaaactagtgccatcttcccaagtgatctagaaattaacatatgctcttagtttcagtgcttgcttccatttgtgaattattattgaggccacaaaactaatgtttttaaggcaaaagccgcttggaccatatgcctatattcgaatgtctcattgtccctttactgagggcctcactctccttacacagacctaccttaatccccccagctgggatgtaggaggaagaagatgaaaatctttaattccatttgtgatgttactcttttccaaccttagctacctaggcttgattgagctttgtgcacagtttcttgatattagtattcttcacaagataggaaagagaaatctagccacagctcaaattcagtgctatgtgaccctggggaaaatgtcctctcaacctttcaatgcattccacagaccagagagcccactgcacgcaaagccctgcattggtagtgcccactagaagaattcattgccttttaaaaaattaatcttttgggttagttgatggctttgaaatatttttacattaaaaatacaatgtcctaggtggtgattaggttcccaggtagtctagaaaggacatcaaatagcacatggtatggtcagtatggttgaatattgttcctaatagaactgttctgactccacctctctcatgcctaggacctggaagaacatacttgccatcaaggagggttggtatcagtgactgagtagacacatctatcaatcactgctccctctcgtgctccaaaataaagaagctgataactcaggacactcccacttctctcctcttttgggcatgtcatctgtaagtccagtggctgcagtctgtgcccctcatatgctatacttagtaataagaagacttctggccatatcgttagggaaacgaacgtaggagagccagggtcacaacctttttaaatcaactgcatctgaaaactagcaaggcactttccttgccagtcaaaacccatggtcctaagatgttgacagctaaggaaacaacttagtaatgcctgcaaggacaaactcctacaacaacagaaagtccagatgtcccaatacccataatgatatatactttcaagagaattacagttatgctttgatatactcacacactaaaatgtcaaggatagttttctttaaatcaatagaataataaattttgtcatgctgtcatcctacccacacaaaagcacagctttgtttagtctttacatagacaagactcctatgtaagaaaagcttaaaacaatgacagcgcattcctccacttgctttctgaggataccctactttgtaatggagcagcttttaataaactatctcttctcactgctctctgtgactcaccctgaattccttcctgcatgagatccaagaacactctcttggggtctgcatcgagaccccttttcctataacaattatttgccagaaaagcccaaacaaacatttttctccttattcacttagatatctattccgcttgttaaactgaactgaagacattgtctaatatgtctgtatagctcccatagaatgtcacagtgttttgtacccagtcggtacctaataaatgtcagtgaggctgaactgagctctctgcaaatggcaagccccactaagatcatcatagagatgttagaagctctggaatgagatgcccacagcaatctgggtgttcaatccaagcacccctcacaagaaagaaacttttttatttctaagcttcttcctcagagggtgttttccattcttatataaacacattttaagctgagccctgactccatctacctgcagacttcccttaagagttcattcttataagaggactgtctctaaggaacacaggaatctatcatgtcttcagctgagaaggtaaatttcatgatgttaattcatttttccatttgattcatttgtttttcccaaggcgcacctttcatgttcaaaataatcaatctatttccaaatgggcccttgaagtatgaaggtaacagcatgatgtatgtggcagcgctggaagtgtgaatacagttgctttggaaaaggaagcaaaacttgtgctaacagtcttaggatggaaagggagtgtgctgagaccaagtgggaataagtcaccaaataactcttagaaataccaggttaccagctacaaaaacaaaatgccaccaccaaaaaagaaacaatcaaaaaggcacagaaatcatggatgatagcaactaagaggagagaaacacaagtattcaaaagcaaatcatctctttgaggactgtagaaatccgccctttccattgctaagttgccattggcagattacatacatatttccagatgtttcctaaagaaaagagaccttcctggccatgtttattctagctcaggcaaacttaggtagggttggggggaaactttgtgaagacagagatggagttttgtttaactttgtatacccagcagcttgcatgatgtttggaacgtagtaggtgctcaataaatatttggcaaatggaagctaggtacttgttaaggtgtcttttctaccttgattttattttacttttctttcagtgcttcctacatcacttaaagcctcttttggagtaaatgtaaggcgtaattttgtgggatatacatgaaaccagcatcgtgctaggttttttgagtgaatcagaaagaaatcataaggctgtcacctgatgctgactacctggtccctggctttaagaagtgcaccacttagatggctaaccaaggcaggaatgtgaacatgaggacaccctgtctcaggatgatgccagtggcattcacaggaagtaagaacataacatgaacttcagagaaaatacgaacagcattgagataggagaatttctccctaagaatggcttatttctgagaaagaggactgtgaagccccttcagtgaaatgtgcatgcattttaaacattcctacagcatgccagcctcttcctgggactactggtcacgaggaacacagtgtggaaacccagaggaggaagtggctaacagtgtctgtggaagttgaagaagattcctcagagaatgtggttttgggatacaatcttaaaggtggaaaaggtagagaaaagtcttcccagctgggggagtaaccaactgagggaataaggaaaggatggtgcataaagggaatggcaggaaactcaggatacctgtggcagaagaagcatttgacccagggagggtaaaaagcaaagggacctccaacgctgtgcaaaggtatgtagagtgtgtcctagggaggggatggagatggggcaggagccattgaaaagcttaagtgatctggtgagattacattttagaaagatcagtctgtctgcaagatggaaaatggtttgagagggacaagagtggagcaaggaaaccagtcagagggtgctgaagtgctcaagggaggcatgatggtgtctttgactgactctcgggggaaggtaagtggaggggtgccagcggaagcaggaagtagacgcaacaggtatttgatgttggcattaagtaggggggcagagccataggcgaccccaggttttgttcattcttgaaagagtttttcagtgcctacaaggtgccaggcaccattttttttattttttttgtttgttttgttttgtttggagacggagtcttgctctgttgcccaggctggagtgcaggggtgccatctcagctcattgtaacctccaccttccaggttcaagcgattctcctgcctcagcctcccaagtagctgggactactggtgtgggccaccacacccactaatttttgtacttttagtagatagggaattttgccatgttagccaggctggtcttgaactcctgacctcaagagatccacccgccttggcctcccaatgtgctgggattacaggcgtgagccactgtgcctggccctaggcactgttttaagtgagatacagccatgaaccaaacagtcattccctctaacccaaagattccagactaagcttcaagcatgggagaacatgctgctttatgaggagtttgctccaaaagttaggacctggtgttgttaactgcgatacaaatttactccaggaagctagttttctagaaattccctaacccacatgtgtgttgcctcatttaagagaagacaggatatttttagtctttaagaaaaaataaccagcagaaaatgttctacaatgtagacaaagttggttacagagcataacattacactgcagatttgttcacgttgcccattcaattccgaaggaccaggaggaacaggagtcaaagaatctggacttgtgtttcctgttgtccattcgggaataacaaccacttatagtttgtctcagcaactccacctattgacagactggctgttctcagacctattgcctgcacccctagaatcttctgtcaggttccacaggaagccatgttcccacgctcctctgctctctgacttcgaggtaggttcggccaaagagaggattggaagcaggaggaggggagatgtcagggtgtgtctcctgtgctctctctgtcttgaggtgagagtctgagtctcctccatggctccagcacctgctgatgccttctgggttctgatgggacctcctcctccatgtgcctccagctcctggtgtggtggcagttttctactgttcctaattcctgggttgcctcaccatgtcgtttgtttggcttcttagtcattcactcgcttgtgtacccaattgcctccagtaagctcccactgcttacaaatctagagcagtttctatttgctctatcacctttaagggttatgtccattttatatatgggaaaactgaggctcaggtaacttaagtaactagctctaggctacatagctatcaggatgcagaacaatcatttgaacccaggtcggcttggtccagagctgtgactggggaggctaatgaaccctctcagtgcattttccatctgtaaaattggcattccagaagatgaggattaaacaatagtgtgtgtgaagggcatttcataaactgaacaaattattattctccgtattatatggtgtctgatggctataatagcaaagaaatcttactaaacttattttatttttatttctgagcataaccacacaggtagtgaataaggtgtgagaactaaaagtaaaatcttatccccaccccactcccaaccaactgtacagactctttcttggctaaggggaccccagagaaaccttaaaaactgagccgcagccatgatgggatgggaggtggtacacacctcactatattccctttccttttgctgtttagacaaaattgaacagaatcaatgttaaaatagagatcataagactgacactgtgcaggagatcgagaccatcccggctaaaacggtgaaaccccgtctctactaaaaaatacaaaaaattagccgggcgtagtggcgggcgcctgtggtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaagactgacactgtggcaataaaatatataattataaacaagacccaaggccacaccaggcaaggattaagtcatgaacccctgcatttaaagaataaactatgttctaactgccacaaagtttttctttttgtctagcagctaaacaagccctggtctcaagatgagcaatgttggaacaactacagttcatccatcaccagatgctgactaactaactcacattccaccagccacaactacagttttgattgcgtaagagactgatttcagcatctttctcctggtaagagactatcaaccatggactggttctggacgatttaccgaagctgcacactacaatgcattcctgtccctgcttcaccttttgatgtatagggcctaactgaagcacatataaatgttaagtctcaccccaaagcgaacatgggtcacacataacatgcatgtttattcagtatgcatacattaagaccctcttcataaatgttcatagctcctcctgtaacctgtggaatatgtatatttggccaaccagctcagcataaattcctgttccatcttcctttcccttgaagtgcccacctttcagcctctgccagaggctgtgcttctcagcctgtccggatagtcactctgcaggctgtaaccttttataagaaataaagactcctttccaaatgtatagatttgtgatttttcaattaacaagtaattgttgctgtggcacgattcaggatctttttcgtcaacaggttatttattaagcaccatttaagtgccaggcactgttctaggtactgagaatacagcagtgtcaacacataaagattaatggagtgtatagtctagtgggagtatacggacaataaacaaataaatacatgatacgtcaaacggagacaagtgctatgaaaaaatgactagagcagcttaagaggacagagagggtcagagctgggggtgctattttagagacagtggccagaggagacatttgagaagagacttgagaaaagtgagggaatgagcagtgcaaatatcaggggacaggtgtcatcagtgcaaagaccctgtgggaggtggtacttggcatgcttgaggaggccaatgtgcctgaagcagagaaactgtgggaggtgaggtatctgagcaggggaattgggggaggtatgatgcctggggcagagggaattgtgggagattaggtgcctgagcagagggaactgtgggagataagatgcctgggacagagggaattgtgggagatgaggtgcctgaacagagggaattgggggagattagacgcctggagcagagggaattgtgggaggtgacagtgcctgagcaggggaattgtgggagacgagaaagttcctggagcaggggaaaccatggaagatgatgtcagagacagccagatcaagcagggctttgtaggactttggatcttattctgattgagaaaagcagtcactagaaaagaggcatggtctgctttaagttcttttaaaaaatcactttggttgttctgtgaagactgcaggagagcaatcaggattgctatgaagatctcttgacctctcaatattccccctttgcttgttggtaatgaaaatcctaccaacagaagagaaattagagatgatgctgaaatgtttatatccctgggaaaggcaatgtgtttgcttaaatttactgcactatgtacctttcctaaaagctggaactgggtgttggaaatagggaggaaagtggaggttggaaatagggaaacttgctcaggggacatggtataaaaaatgtggccaccagaagcacaaagttcatctacatgaccattgtttctagggcagtttccagcccttccttggcatgagtttaaacaagactgtgttattctatcaatccatgaaggctaaactctttaagatctagagatgtgagacagagaaataggatgttggtgtcacaatgtctaatttattgtagtttgccagatttcacagttataaaccaaactgcatacccagctttttgccccatctgaccccaactgttatgcaattctttcaactgacaaagaatgtttccatatttcttgggtttctgacccctcgtgctggggtctggaagcccaaggggtggagagggacttggtggggaggcacactttgcactgaacatgaaggtcactgaccagatgcactgcatttagcatcttcgagacccatctctttcatgttctcagtcagctcagaacacatgccgtaaagaatctcctacagcaactgaatttcccccagcaaatggcaagtctatggagccaaagcaccatttgctcatttgcttgtgttccatccattatatgagcagaatgagccttctaggttttacaagaaaggctcatttcgttaaaatcatggcaactgacttaaaaaataaagtgtcattagccaacaaaggaaaaagtttagctgaatgtcttccaaacaaaacaggccaactgatgacatttttgctaaaacagtcaattcctgttaataattgaatggcaacaataatgagaataaatcactggtaattctgataaagcatttgtttgtctttggagtatatatgaatgcaatatataaaagcaagtgttaaatgagtttgcattgccagagattaaagcaattactggagaaacaaaaatcaacatagaaaacattctaaggagtatggtacagtccatctagtattaacctacaagtggatatttacaatacatactcaataaacatttatttaaacagatgtttactagtgcttatgatgagcagagtgataccacttaatctggaggagacagggtggtgaatgtgctgagatatgatacatttcctgtgctcaatgggtttataattaaatacgcaagtttagactgtaatttaattcataatactaatgccacatgagaataacagagcaagagtagtagaccgtgggggaagtcaacgactttattaactacatgacaacaaatatggaactcaaaggactggcagaaagaatgacacacatttgcattttgtttattcatatgtatatttatgtgtggatgtttatttgcttactatagatgttcattgttccttcataagttgattaccgcttatatttaaaagcatcacttttaaaaaactgtattcaagcctagttttttgcaagtgacatagataaacaatacaggagaccacggatgtagctgaaacacagggatgtaaagaaaccgtattgaggttggaccatccttgcctaatgatgccttgtgggggaacacaattgttcttgacatctttttaaggccttagaatatattccaatcttctctcatttcctctggtcatgtgttccccactgatttgcctttaataaaggtcactgctgagtacctctttatttgtgggcttgaaggggtacaatattgccttccgtaaataacacctaattccagtgctttggaaagtggcacagtggaatttcttctaaaacatctgccactacttaaattccagagtgctttaagcatgtaccctggagtttcatactgtttgcggagtggctggagaatcctcactttgggactcagctgggccagccttccctggcagcacctagtcattgaacatcgcatggctccccatgaaaacggtcatttggcaactcgttctaagggaactggtctcagctaacagttaatggcaagagtctaataaattcattttgctaaaatgttaatgtctaagaagagtgctaatacttcttcttacctccatatttacactttgtagaaaataattccttcatatcttaaatgaataaattgccataatagaatttcactcattgcataaaattgggagagggcatgctctttacttcacattctgaagaccttgtcttcttcctcaggggattttacagtctcaatgtaatttcttctaagacctttccagatcccaggcccagtgtcagaccaggtataccaggaccagccatcggatcctgattattctggaccatttagagccagaataatcaggatctgaattccactgattcctccctaagggacgacactaggtaggaggagctcagttaagatgtcattacaccttttatatatcattataccttatatcaaaataataaatgtttgttgttttaagccactaagattatgatattttgttacaacagcaacataaaactaatgcaaacacagagcacactgttggcacattgtgaagactcagtaaatgacaagctcaaagataaaaaatgtatggaggacggccgggcttggtggctcacgcctgtaatcctagcaccttgggaggccaaggcaggcagatcacgaggtcaggagatcgagaccatcctggcgaacttggtgaaaccccgcctctactaaaaatacaataaattagccaggcctggtggcgggcgcctgtagtccccagctacccaggaggctgaggcaggaaaatggtatgaacccgggaggcagagctttcagtgagccgagatcatgccactgcactccagcctgggcgacagagtgagactccgtctcaaaaaaaaaaaaaaaaaaaaaaatgtatggaggacaagagtcatgaatcaggggtcaccataggtatgacagagaggtgaaaagaatggtaagtgagatatacctaggttgaattgggaaatactgaaaggaggtaaaatactaatgagcacacctaggatctagaccttggtttctaaatactactttctattaaaatgaagtggagttctttggagaaatgtttctccttagataaatggttattttgagggtaggtgcagggaaaactcaaaacgggcctgaaacatcttactgtaacagactatgaggaagtaaggatactgaaactagttggaacagtccaactggcaaaatcgaggctgtttgaacattaagttatttaatgataataaaagatttaagtaacctatttaattaaaagagaaaatcaggattcatccaggtattaatcaatcattctatcaataataattttggtaataaatgggattttatagtctcaagataatttcctataaagtacttattaactataaaaggaacaaagaataactttgcaggggtaaccccaacagtcacctctgtgttgggctctgtgatgttctgcccaagacaccttcggaaatgaccgacaggcttatcctcagctgctgggagtgatgacagaaaatagtccttggtggttcaggcctccttgggagttgccttagcagaagaaaactgcctcatccagggtcacacctcattccaggggtggctcacatccagtgactgatcactatggaggaacaaagccccatccctttgtcctcatctcaggagcactatgaagagctatctcagctccagagtttcacagagggtcatctgaggcctttggtgtgagtgcattgcagcctgactcccccactacctaatactgcttccttccacaggagttgatcccaacagcactccctaatcaacagcttgcatgctaatttcacagtctacttcctgggcactcaacctgtgccaccaccttaatcgagtggttaagttaacatcatcagtaatgggatctgtaaaagttatgtgcaaccaggtaggaggcaccaagaagaacacagcatcatttctgcaatcttcctgtgaaagatacgtgacttgattttaacatcaagtgaggaaacatcagtcaaacccaaatggaggggcattctaaaaattactgccttgtaatgttcaaaagtgtcaaatcatgaaagtcaaagcaagattatgaatctgttccaaattaaagaaaactaaagacatgagacatgacatctaaatataacatgtgatcctggactagcttctgttgctataaggtacattactgaacaagtagaaaaactcaaatgtgttctaaagattagactaccatcaaatatcagtgttaatttccttattttgatggttgcacagaagaatgtctttgctcataggtagtacacactaaagtattcagggatgacgagacatcagattgacaactctaataacggttctgggaaaaaacagttctttgtatggtttgtcttgtaaattttctgtaaagtggagtttgtttcgaaatttaaaaaaaacttttaaacaacaacaatacatgtacccaatttttgtacaattatcctgtatattcatgtccttccttttttttttccatcagcgatgtaggtttttaagtttcttaagagaaacatttttgaacgaactttgtgtggagcaccaatcttgattcttcaaagttacatgctaagggataccctcctggttgccctacccttggcaacatcctatctctaacaaaagacacaaggtggcctttcccctcaagaagcatcagctgtaagagaagatagaactaactgctgaggagcagaacagcagtgaggtgttccacccattgcataacaatgcaaataaatccagaggctggagaaatcaactcgcaaggggttacttagtgaatcactgaagcaaggatgattgagtaccacaaggccaggtttaccaacccatataaatctaagggaaaagaggcagagagcaaaaagagatttgtttctaacttccaaatatgattaccttatgcatgcgccttcagtaattaggactgtgattttttttcctgaaattttgtcttgatggctataaacacaagcactgtctttatgaatcatctttatttttaaaatttggctaacactccactcaaatgtctttgacatgtttaaagcaatttgtttcacaaatatgaaagttagaaaaggttgaaatgatggaaatgatggaagtgaagtaatggagagagtgtgtcattttctatcacttagaaatatgttgcacaaatagaaaagctgtttgatggaaaatgccactgcagctgtctccactacttcatttccgtcattttagtcacagaaacataagggtttcttcctctttttgtaaaattaattgctttaatacaaaaggcccctgtccaccctgggcactaaccaagcaataacagcagactgattgcatgaggggagcacattcctcatgggcctgcctgatgggcctttcctgccgctgcaagcttcttacaactccagagccttgaaactgagtggtgtccaaactccaaatgcagccagacacttgattcagggaaatatttccttctcactagaagcttgtttgcatcagcagaacaataagctcctggactaccaagaatgccgtcctccttgcatggagggtacatacttcgtagccctcttggaatgctcccagttcctcaagagtcatctcaagacctccctgcccttttctgagattttacccttcaactctagctgatcctcttgctcttgactgcccagagtcacttcggccagtcgtgtcacacatttctggaaggcaactgtatcagtatagctcaattatatactctctgactgtgttcattgtttgtggaattcctctcactccaactacagtaagctctttaaagacagagatggtcaaaagtttgaaaccagcctggccaacatggtgaaatcccgtttctactaaaaatacaaaaaataaattagctaggcctggtggcgggcacctgtaatcccagctactcaggaggctgaggcaagagaatcacttgaacctgggaggcagaggttgcagtgagctgagatcacgccactgcactccggcatgggcaccagagcgagactccaactcaaaaagaaaaaagacagagatggggtctttcattcctcttaaaccccctctggggtgtcacaaactgctggacacagcagaggtttctgcatcacaaattcactgaaccagacatgggacaagatgttatagagatttgtaaacagaattggaaaggaaatagacaaggaagttgaagaagccaaagcaaaacctccaacagtgcagagaaggagcatcccaatggctaagctaggctttagccagagatgggcagcacatttagcacatccagccccagcttcctgaaggctaaagaaatgctcatgaacagacacaaaaacggtcagacccacctcccaagggtaactcccattacttctctaacaaatgagtaaatacctatgctacagtaggtacctagtcaggcatgagtaggggaggagagggcttcccccactacgcacacaccaggaatggcaggcgaccatcaggtgacggtcattgttaaactgtccttctaaaataataattggtcccagccagtgctagggaagggcagtctcccaataaacagaaatacctgaaactggtgatcagcagcttcccaataaaacctcagcagttgggtgagtgggctcaggcatgcgcactaagagccaaaatggcggaatttaaccagtatgtggccttcctccagggacactcaactggtaaggaaaaaatgcatcaagtggtcacgagtacaacactagtaaacgcactgtgcatgctccgcttctaagcgctagcaggccactgcacacgcagacacaccacttaagggaagaatcacaggagtagggacgcaagaccccagaagtatgccaacaggtaaaacctgaagtcagtcaggtgcggtggctcatgcctgtcatctcagcactttcagatggattatttgaggtaaggagtttgagaccagcctggtcaacatggtgaaacctcatctccattaaaaatacaaaaattagccgtgtgttgtggcaagtgcctgtaatcccagctactggagaggctgaggcaggagaatcacttgaacctgggaagtggaggttgcagtaagctgagatcgcgccacttctctccagcctgggtgacagagcaagagtctgtctcaaaaaaacgaacaaaaaccctaagtcaaagtcaaactgtacacttgtctttcaagttacccacttggcccttttccaagtgtattttctttcctttcattcctgttctaaagcttttgaataaactttcactcctgctctaaaacttgccccagtctctcctgccttatgaggaggcaagaattgaggctgctgtagatccatgtggattcactgctgctaacatactttggtgctgtgggactccagtacatttgctgccactaacacctagacgtgcatccacaggacagtgtgtatgtatgcatgagagacagacagagaggaagagcaagacagaaacagacaggccgggatgaaagtaatagaaatcttaagaaagaagagaaaagatcagaaaagaggccaagatactgagaagaaagagggtgaagagggtagcaagagagaggtacagctatttatagcctgtcttatggttgtgtaatacctgtctggctctggctgctgttatagtagcattttatgaaggttatccttccttaaggaataccataagaatttagctttcctacatagttgcaatattgaaaataaggctggtaattgggtcatcttattaggaaggaactatcacgaagcagttcaaagagcttccagttattccctcattaatccttacaacatgcttctggagtaactggagggcaaagatgaagaatatttagtccatttggatcctttctttagtgggctgtaattccacttgcatgctctctttttagattagagactcaagagcaagttatcgcagtgggcacatttgttttcattaaatattttcccccacctttttcacctcttgcttcatatgctgcaagaatgtcttagaatttatgtggaaaagccagggaatgcccacagtccgtcctccctgagttcagaccagcgctttctggtggagtacagtttcaattatgtgggtgcaaatgagccacgtttatgaattcttgtaagtgaaagaggtcatcataagatacaagtgtgaagacagagagaaacagacataggagcaagggtgaaggcaaattaggggaataggaaagaggggagaaagcacaggaggcagtcagggaggaagcgtttgtggatgttctgagtgttctcattccgatacccatggcccttcataagtgctctgtgtggcacccttaatgtgacaaagacatcagcgactctattaccctagggaccataagcttcactgggaaactccagctctgcagacatgatgtgggtgacagggcagggctgaggaagcacatggtaaggtctctggcaccaaaatatggatggcaatcccacctactttgagattaaactgtttctgtcacttcagctagaactatgggcaaataattccaggcagaacttggcctgtggattgtcagagcccctatgtgactaatgaagctgtcagaatggatgtaacaaggagactgggtatttctgttgggaggttcagtgatggttgtctttgccaccaggagacaaaagacatgagagcaatgccctcctatttgcttttggaagcattttctttgtgcgtgtgtagatgttttttaaaaaatagacaatcacttatggggaatctattgggatacaatgtgaagttttgatctatgtatacattgtagaaagattcaatcagctaattcacatgtttattaccttacatagttacctttcttttctatgtacatggaaaaaagaaaggtaactgtggtgaagacattaaaaatctattcttttagcaattttgaaatatacaatacattattttaaactgtggtcaccaagccatgcagtagatcactaaaacttattctttcagtctaactgagactttgtacccattgatcaacatcttctttttcctcattccttgcccccaagccccagcctctggtaaacaactttctactgtgtttctgagattgactttttcagattccacatataagtgagatcatacagtattcatctttctgtgcctggcttatttcagttagcatagtgctctccagttctacccttgttgagaatggcagaattttccttcttctaagggctgtatagtactccattgtgtctatataccacattttctttatccattggttaggttgctttcatatcttggttattgtgagtgatgctgaaatgaacatgagactacatacatcttttcaacatcctgatttcaattttctttagatacatacccagaagtgggattgctgaatcacgttagttctattgctagttttgtgaggaactgccacacgactttccaaaacagctgccttaatttacattcccactaatagtgtatagggttctctattccctgcattcttgccaaggcttgttatcattctctttggtagtaaccattctaacaggtatgaggtggcacctcattgtggttttaatttgcgtttccctgatgattagaggtgttgagcattcttccataagccagttggccattttggtgtcttcttttgagaaatgtttgctcagatcctttgcccacaacctggggtaaatcacttaatccctgtgaacattggtttccatgtttttaataagttttatttctaccttccctgcctcccagtttattgtgagaataaaaaagtggtttcctatacattatctcctttaacccataaatggctgtttaaaataaatagtatagtccttatttgcaggtgaggaaacagtaatgtgatggggggtggggtaaagtgattctgtcactgctatccatggtggagctcgggttctgactgggcactgccttgagtccaagccgcctctttccccaccaaaaagggcttcatttagccctttaatcacgtgagctgtcatccctgagatggcctacaaatggcagagggccagccactggggcatattgttagtcctcagaccacagtgtgttacttcactacaggtgagtcccattttactatgcaaatacacacacacacacacacacgcacacacacattttactacttctagttatagaagtaaacataagttcctttgggggaaaaaaaggaggggaaaaatcatacaaactcatgcagcatccatttatcctatcatttattagtgagatttttttcccccttgagtctcttactaatgtccctaacaaaatctcggtcctccaatttatcttccacacttctgctatagtaatctaaaaagtagaaaaaaatcagatcttaatactctacctaaaatgctactacagaggcttctggctgtttatagaattacatctaaacttcttatcaagtcatacaaagacatcagtgtgcttccaaaatgtcatgctccactgaacttttctatttttttttttctagaatgtatacaatttccattcccctgggtcaatttctattcgttttttgagacccgcctcaaatagcactttctggaggattctttcaactattcttgccatcagtcactccctccaaagtagcttctaagcattttgttcaaaaggttggcattgaacacagcctttcctactcagactgtcccctctggacaacaaatcctctggaggcaagggatgaacatatcttactactctaatcccaatatggtgctttgcacatacaaagtattaaataagagttcaataagcacattcaaaaagaaaataaataggctttatggttgaaagaagccaaataaatatctgaaaaataaatataaaaacatactcttaacaattatttttgaaaagttactaaatatgaatgccaaattaatagttatttcaatgtttgcacaaaatcttaagtgtcaaaaagaaaaaatggatataaagttatcacaacacatagactacaaatctgttcaagttctgtcagccacctgcctcagtgttgtatggaatagaggtaatatgcctctatagttcagcatttcctggaatgagttctgcaccttattcaatggtattataaaaataaaaatgtggtagggtagtgtttatagtagaacaattttgggaattattgggctaaacaagattcattttttgactacgtgtctactcatagccttttatatattaatgtgccttgggcctctatgagaagagacacaaaacacagcatgatccaactgtatttgatgatggaacttttttcccccaaggagaatctcacatgacaggtgttcatagagaacacactctgggaaacactgtcctactttcttagatgccattattagtcacttcacagagatgcttaaaaataaacacgttgatcatcaatgcagaaacccataggagcaaaaatctgaaatgacattctatataaatgttgcttcaaaatgatgaaataggctgtctattttcaccaaaatgcagcacaaaatagttgaaagagtataggctaagaaatagttatctacacgttacaagctgcacagtttggggcaagacatttctcaatagagaaagtatgttatgtatgtgaaaatcacacatcagcatgatgattttacctggactttctgaaacaaaatccataggaagacatagtcttaaaggatatggatgatgttttcagatgtaagggtactcatctgcccctctaagaccctatagcacctgctcaccacctacatctttaaataacttgagattgtcaggcatgaggcttagttcatacttctccacctacggcagtcataccctccttcacctctttctcgacaaccttggaagatgaggaattttccttcctactcagcccctcacccgtgcccctgtcctctatgcttctcctccagtccctcctgaatcttcagaattcttccttgactgattcttccctctctgcctgctacatgttccagtccctccaatcctgaaacaaatactgaaattgaaacacccctcctctcacccacattcctctctagttaccacccaaattttcttttcctctccttcaaatttctttaaagattcatccaaattgactacacccatttcctcacatctccttgacttttagaccattaaaatttggaatctacccgagttcaaccagtgtcccccaactgttgactccagtgggaagttcctatctcactgcatctcctagttatatttaataacattggtcatgctttcctcttgaaacacacaactctcgtggattgagtgacactgcaacccccttattttccttctgtttatctgctcatttggtctttgtctcctccaggggctctagtttctggactgatgccttagaagttgttttccccagggcttaagcctcagtccactgctgacttgatttacctttttctgagtgagcttgcccacgtgtgtatgatatccaaattatctcctgtccaacccaaacctcctcccgaagcttcagactcatattatctattggacaggtttacctgaaagtccctcaagtaattcacactcatcaattcaaacagaagcatattcatacctccaccatctccttggtggaggctcccttggtggaggtagtaagcattgtaagtagaagaggctgcttgggtccaaattgaggtcccagcactttccaggtgtgacctgggtaaattacttaatcctttcaaccattatctcatgggaaaaatggagatggccatagtccaatgcccagagggctgcttgaacaattaaatgggaggcatacagcacctctgcacagcaacagtgccaatgagttatcaatgaagctactacctccattagcattttccacactcgattttttccctctggaattccaggcattctttatctcatttggaagtgctagcatctgtcatcatagtcacataagccagccacctggaagtcgaccttgaccctcctcccttccacccctcacagactccccaacacaagtcctgcagattttgcctcctaaatatttctcaaaccctgtcactcctgtccatgtctacaactgcagccataaccccggttctcatcctctctcttctgatcatctcctctcctatcctgaattaccctgattccctgaagtgggccagagcaagctatctcaaatgagaatcatccatgtcactcccaccctgaaaacaccatccaacaccgccgctggctttccataaatgctactcaagaaataagtgaaagaaagatattaaagtgttgctgatgacatttccatgttttatagggtttgtgatgcagaacatgtgcagttgacccagtcctagaaatgcttgagcgggtgatgaacaacctgcctcaaggctgccagcattaggacagcacttttatactcacaggatggcccagctaggggggatgcccagcacacatgactgcgggtccaccagcacccactttcagctctgccccatccctctcctctgaagagactggaaaaagggaatactttcacagcttgccttacagctaagggtagcaaatgaaacataaacgattgccagaagtgcctgggaaagcttttgttttcctgataagtggggtggggcatgctaatgccatccttctcctcatctttctgctgtaaccagaaatgtgaagcttgaatctgtgagggccatcatagaattgagggaaaggtcaggagaatctccaaagcgctgacctggacacccccaggttcctgtggttgaactccagggagaaagaaacttgctcatggaccctactgtcacttcggagggctcctcagggagtgaaacctctgccgttttgagggggagacctggtaagaaatacagcttgggatttcaccctcaactgggtatcaaaaaagcaggggcccatgtcaaagtaacagcaaattaacaccagaagctgctcccaagctttcacagtctcagccacaggttagtaaaacctgtgattaccactcccctccttgcctttcatgatttgtcgaggctgcaggctcagaggtgagagagagagaaggccctgcagactcccagggcatttttcagccacacccacctcctcagattcattaacacctcccacctaacacagagatagctgtgctctgccagcaactcatgaacgcagttatcaaagcacaaagaacccctgcagcacagctcatcaagccgtggccaggtaaggcagtagctctcctgctcaccttctctactcagagcccagcacaccatccaagagccctatttatttaaatatttagaaagaaagaaggaagaaggaaagaagggaggaagggaggaagggagggaggaaggaaggaatggagggagtgagagagagagggagggagggagggagggagggagggagggagggagggagagaaggaaattggttagaaggcagaatcacataaataaatcccatgacctaggttctgagaacagcaacatagggaaactccagtgtactaacatatctcagctcatctatacaggcacagggaatgagagagcaacctcaacaaaaaaactgaatgcaaattggaagcaactaagtataaagttattttttctgtattttaaatataataatagcttgctttatgaaacagctatgtttttacctatataacaaacctgcacatttacccccgaacctaaaaaaaaagtttttttaagtatatagtgagtgtgatggttaatactgtcaacttgattggatggaaggatacaaagtattaatcctaggtgttgccaaaagagattaacatttgagtcagtgggctggggaaggcagatccacccttaatctggtgggcacaagctaatcagcttccagtgaatataaagcaggcagaaaaacttgaaaaggagagatgggcctagcctcccagcctacatctttctcccatgctggatgcttcctgcctttgaacatcagactccaagttcttcagttttgggacttggactggctctcattgctcctcagcttgcagacagcctattgtgggaccttgtgaccatataaattaatacttaaataaactcccctttatatgtatatacacacaacactcacacacacacacacacatatatatatatacacacacgtatatgtacaaacacacacacacacatatatatatcctattaggtctgtccctcaagagaacactgactaatatagtgagtgacagtaagtcaatctttgttggtaagtctcttgttataaacactcttaaagatgtactggtagagattcttttttttttagtctttttttaaaaatttatttatttattattataatactttaagttttagggtacatgtgcacaatgtgcaggttagttacatgtgtatacatgtgccatggtggtgcgctgcacccactaactcgtcatccagcattaggtatatctcccaatgctatccctcccccctccccccaccccacaacaggccccagagtgtgatgttccccttcctgtgtccatgtgttctcattgttcaattcccacctgtgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggatatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatctctgaggaattgccacactgacttccacaatggttgaactagtttacagtcccaccaacagtgtaaaattgttcctatttctccacatcctctccagcacctgttgtttcctgactttttaatgattgccattctaactggtgtgagatggcatctcattgtggttttgatttgcatttctctgatggccagtgatggtgagcattttttcatgtgttttttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataagctgtaaggaagggatccaatttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtactatgctgttttggttactgtagccttgtagtatagtttgaagtcaggtagtgtgatgcctccagctttgttcttttggcttaggattgatttggcaatgcgggctcttttttggttccatgtgaactttaaagtagttttttccaattctgtgaagaaagtcactggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggaattcactcatgatttggctctctgtttgtctgttgctggtgtataagaatgcttgtgatttttgtacattgattttgtatcctgagactttgctgaagttgcttatcagcttaaggagcttttgggctgagacaatggggttttctagatatacaatcatgtcgtctgcaaacagggacaatttgacttcctcttctcctaattgaataccctttatttccttctcctgcctaattgccctggccagaacttccaacactatgttgaataggagtggtgagagagggcatccctgtcttgtgccagttttcaaagggaatgcttccagttttggcccattcagtatgatattggctgtgggtttgtcatagatagctcttattattttgaaatacatcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttactgaggatttttgcatcaatgttcatcaaagatattggtctaaaattctcttttttggttgtgtctctgcccggctttggtatcaggatgatgctggcctcatgaaatgacttagggaggattccctctttttctattgattggaatagtttcagaaggaatggtaccagttcctccttgtacctctggtagaatttggctgtgaatccatctggtcctggactctttttggttggtaagctattgatcattgccacaatttcagatcctgttattggtctattcagagattcaacttcttcctggtttagtcttgggagagtgtatgtgtccagaaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgttagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattttggatctttcctgctttctcttgtgggcatttagtgctataaatttccctctacacactgctttgaatgcgtccctgagattctggtgtgttgtgtctttgttctcgttggtttcaaagaacatctttatttctgccttcatttcattatgtatccagtagtcattcaggggcaagttgttcagtttccatgtagttgagccgttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagcctcccattattaatgtgtgggagtctaagtctctttgtaggtcactcaggacttgctttatgaatcttggtgctcctgtattgggtgcatataaatttaggagagttagctcttcttgttgaattgatccctttaccattatgtaatggccttctttgtctcttttgatctttgttggtttgaagtctgttttatcagagactaggattgcaacccctgcttttttttgttttccatttgcttggtagatcttcctccatccttttatcttgagcctatgtgtgtctctgcatgtgagatgggtttcctgaatacagcacactgatgggtcttgactctttatccaatttgccagtctgtgtcttttaattggagcatttagtccatttacattcaaagttaatattgttatgtgtgaatttgatcctgtcattatgatgttagctggtgattttgctcattagttgatggagtttcttcctagtcttgatggtctttacattttggcatgattttgcagtggctggtactggttgttcctttccatgtttagcgcttccttcaggagctcttttagggcaggcctggtggtgacaaaatctcttagcatttgcttgtctgtaacgtattttatttctccttcacttatgaagcttagtttggctggatatgaaattcggggttgaaaattcttttctttaagaatgttgaatattggcccccactctcttctggcttgtagggtttctgccgagagatccgctgttagtctgatgggcttccctttgagggtaacccaacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttagaggctttgctcatttctttttattcttttttctctaaacttcccttctcacttcatttcgttcatttcatcttccatcgctgataccctttcttccagttgatcgcatcggctcctgaggcttctgcattcttcacgtagttctcgagccttgcttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaacttcatttctttggaggaggagaggcggtctgctttttagagtttccagtttttctgttctgttttttccccatctttgtggttttatctacttttggtctttgatgatggtgatgtacagatgggtttttggtgtggatgtcctttctgtttgtcagttttccttctaacagacaggacactcagctgcaggtctgttggagtaccctgccgtgtgaagtgtcagtgtgcccctgctggggggtgcctcccagttaggctgcttgggggtcaggggtcagggacccacttgaggaggcagtctgcctgttctcagatctccagctgtgtgctgggagaaccactgctctcttcaaagctgtcagacagggacatttaagtgtgcagaggttactgctgtctttttgtttgtctgtgccctgaggtggagcctacagaggcaggctggcctccttgagctgtggtgggctccacccagttcgagcttccaggctgctttgtttcagtaagcaagcctgggcaatggcgggcgcccctcccccagcctctctgccgccttgcagtttgatctcagactgctgtgccagcaatcagcgagactccgtgggcgtaggaccctctgatccaggtgcgggatataatctcctgatgcgccgttttttaagcctgtcggaaaagtgcagtattggggtgggagtgaccccattttccaggtgccgtccgtcacccctttctttgactcggaaagggaactccctgaccccttgcacttcctgagtgaggcaatgcctcgccctgcttcggctcgcgcacagtgcacgcacccactgacttgtgcccactgtgcggcactccctagtgagatgaaccccatacctcagatggaaatgcagaaatcactgtcttctgggtcgctcaggctgggagctgtagacctgagctgttcctattcggccatcttggctcctccccccgagattcttttaagtgccctttatttttaacaaagtatttattctcgtctgtttttttttttaatttatgttacattttggttcacttttaatagtaaatgatatctcaaatgtttagacatttagctgattgtaaaacgttagctaaaatggatcttctcttgaaatggtgttgccagatttttaaaaatgaatagaaattatattctttttcgtttttaaaccatcacttttaccttctgagtttctggaaattgaggtgcacctgtatatagaaacctttgcacttaatttcatttctagttcacgttctatacttgtctcttctcattatagcaattagccttaaaatctaatttccttggctttattcagtcctattgaaacaggcactgaattttaagagaattatttccccagcaatgttcttttttcttcctgtcttacaactatggcagccatgaagttgaggctctcatgtaacttcctgaatgatgtgagatgcagaaatgactctgatcaagataaatcctctaccatgggtccttccacgcccctcgaagtgtgcttaatttctacactaaatagtagagtgtggaattttgtcacttgcctttcttgtatctacaacaggttgggcaatgaaacatcttcaaatgtgtgtgacctataatagaaaatcttcaaatacatgtggccctgtaatggcccacacatactagaatacagcttaactctgaacgcacacatcatgggttctgaaaggtttagaatacatgttggtttaaaaatatacagattttatctcaaaaacaaattagctatgcttttccccctcttttattgagggaacaaaagtaatagtatttcttgtgtaaaaaagaaaagaggacttaaaatgttcactgtaatggatgctgtggtgggctgcctggacctttcccattgttgggagtgttggtggctgacaattctcattcatttagttgctttcaggggttaccctcagccacagagaaccaattacaccaaggctgtaaccccagtcaaggtataaaaggtataacaggcccatgcccttggctcaaggcgagacaactctgaagatccaacccatagctagagttcaccttgagatccacgggggccctgtctgcactgcagttcaactcctccctctgtccaacagtgattcctccactcccttgcagatgttgatcctgagagatctccccagtaaactttctgcgcacaagtcttcttctcagagtttatttcctagtaacccgatctaagacattcatcttaccagtttttctaagacttccattatcataattattttctgaacggcctatgagagtgtttcaaacctcagacaagtccaattcagaattgaagcttccctctcctcttctccccaccctaaatatttggctttaaagatggagataaaacttccctcataattgcagcagaactgtggtccagagcttcaaacgtgaatttgttgtcatgcacgggatgtaatatgttgttaggcaggtgattttgtcattgtgtgaacatcatagaaacaaagatggtacagcccactacacacctaggctatatggcagagcctactgctgttaggttacagactcatagtgtgttttactgtactgaatacagcactgcaggcaattgtaacacaatggtaagtatttatatataaacatagaaacatttatatataaacatagaaaaagtacagtaaaaatacaatataaaaagtaaaaaatggtacacctgcataggacacttaccatgaatggaacgtgcaggaccagaagtagccctgggtgagtggtgagtgaatgcgaaggcctaggtcattactgcatgctactgtagactttataaacactataaacttaggctacagtacatttaaaaaaataagtaatctcactattctattatgatagctatgacatcactatgtaacaggaatttttcagctccatcagaatctcataagatcacctatgcatgatctgtcattgactgaaatgttgctatgtggcacataactgtacatggttcttgctttcttctacagtgtcagagtttccagtttttagttaagtctgttaaatttcctcaaaaaattgtcttttttacattaatactcattccatctgagatttactactgtatatgggacaagatgagggtcaatttttaaactttcttccagttggagagtcagttatttctgcatcatttatgtaaaaacaaacaagcaaacagataaaatctcatatggtcttcttacttcatgaaaccaacaatcatattaactcatatactgaaatccatttctggattctctattatgtcctactaaatatttttcatagtatgttctgatagccgcttcagaaagaaaatactcttacttattatttctttgtatgatttccttggttatcaccaggtaattattatttcaaatgaactttaagattattttatacaagtccaaaaaaccaaaaccaaagccaaagacaactcaaaactccactgggattctaattggaaatgcattaaatttacatattaattttgggaggcttttaaaaattgacaatcataattgtatatgtttatggggttttgggatgtgatgttttgatcaatatgtgatgttttgatcaaaatatacattgtggattgattaattcaagctaattaacatattcattccttcacataccatttctttgtggtgagaatatttaaaatctactcttttagtaatttggaaatatacattattattaactatagtcaccatgctgtggaataggtcactaaaactcattccttccatctaactgaaattttgtattctttgaccaaccccttgggagactaaaaatgtatacagaaagacttcccactcaagaacatgtttgacttttcattggtttctcatgttttttattaagatttaatagctggtttatataggttgcgtgttcaggttttagtcctacattttatagttttggtcatgtgaaatttttttatgtctatttctgggtgcttagtgctggggaagataaaagttattgatttttatatatttatcttctatctagccaacttacaaagttttattaatacagtgcttttttcccttgaatctgttgggttttctacatacacaatcatagtattagcaaatatatagttttacttcttagtttccagcatttatagcagatgtatctcttacattgttcatttactaaaacctttaaagtacttctttttaaaaagggaatgatgatagcaggcatttctttctaatttctgattacagtgaaatttgttaacttttttccacttagatatcaaaagttgttgttttgatgtaagcaatctttattatcattgaggtgttttttttctaaatttttccccttaaactcttcctaaaactggatgctgaattttaccatgtacctttctgtgactgctgatttgattgcctaattttttcctttaatttgtgcataggattatatgggcagatttcctatgttgtgccacccctgcttctctgtgcatgtatttccttgataatcttataaattcctatagaaatgtttaccaaaatgtgtcaaaagttaatagctataacttaataaaagggttccatgatcaaattaatttaagaagcaccagaccaaagttaaatggtccttccccagacctttgaagctaatgtgcatcgttaatcttcaagaggaggttaaaggctgggcatggtgtctcatgcctgcaatcccagcactttgggaagctgaggtgggtggataacttgaggttaggagtgcgaaaccagcctggacaacatggtgaaactctgcctctaccaaaaatacataaaattagctgggcgtaatggtgtgcaactgtggtcccagctactctggaggctgaggcaccagaatcgcttgaacctaggaggaagaggttgcagtgagctgagatcacaccactgttccagcctgggcaacagagcaagactctgtctcaaaaaaaaaaaaaaaaaaaagggtgattaaagtacaaagtgtttagtgaagtttattggactatatttttcacgggccatcccatgggactagatcagagcagaatcaactttcggaatgcatacttggattgcatgctaagatttacaaacattttcagcacgagaccaattaaatcatggagataaaagttagaatcataggatgccaaaaccatttgtttgaggaagaataatttagttaagcaacacattataccagttttacttttatttatatgagattttctccttgggtgggcccaagttatcaatatttggcactatacagaccagtcttagagcacagggtaattcaggggctggatgtcattccagctcctgccactgttgacatatgacactaggaaatcacacaactgtgcctgtacccacctctctctacaatgcaacccatggtgtcaagactggagcttgcacatggcactcaccaatgacgtattccaccctgaagagatcccttctggggtcatatggacgactgaagtcaatctgcacatagaaagactgccctctgcggacaatcagcttgttgttttcatacttgtcagtgtggtggtccaccttgttagtgtcccatctctccttgaacaggtgaacgctcgtgacattaagaaactctatgaacaagaaaaacaagggttgaagaaaataatcaactaactttagtttaaacataaactcaaaaacaagattattttccctgaagaaggcaggtagcaaggtctgctgaatgaaactctgtaggaggcaggggtaggggaacacagtctcgagagtcagcctcttgtgacattcttgtttttgaagagagctttttaaagctttttccacctttgatctcgtttcagaccacaaggcactcactgtgggatagatggatgcctgtctgggagatccaaatacagagaagctagggccagagttgaagtcttcaggttctcagtctcacgctagttttcgttatgttagaagcttcccatcatgtcactgcctcactctgtgactaaccaggcagaagcagggaatagccacttcaattttcttatctttccaaaggaaggaatcaaatctgacaaagcctcaaggggacattcgaaggacaaagttagccattaatctaaaattctccttttacctcaaaaagggtcaaatgcctcctccctctgtaattctaaaagtagatctcatccctcaaatgcaggaaagagagggagcaggtctggagaaaggacactaagatttccatgagataagtgtgattgttttcagtgacacagaaactatcctcagctttccttagctactaatgggccagttcaaaagtcaaaacctggactgtctgatgccaacattcacaggtttttcttttgatttgtggcatcaggagtgtaaacgtaaatcacatgtttcttagttgtctaactttgtatgtgtgacttaaattcatttcttcatcatagaatggagacactaatattcatttcatagcctaacatgttccacttcttacaggaatgtgacaggagacggcatgagatgacacgtatgcaagcatttagcaaagggtctgacacatgaaagtcagctctcttcctgcccttttccccttcccctctatgaatgatgactgaaagtgggggtcatcctaactccctgtcctcactgtactttagaagatctagtctagagactggtttctgcatgtgcatttggcattgtaaagagttattggggagaaggtggggtgggagggtagaagggtcggcaggggtgccctggcctcttgccctccccctccctgcccctgcctgatgcatgatttgccttcatggctataagcaccatgtgcgcagaaagcacagttgctgagcttgtacccatgccggggcatctcctgccatagtcgaatggcttcctttacctccacacataaatcctgtgcaggatgcctggtccctttggaccccattgtgttccatagtcaaaaccaagaagttgggctctttaagatcctcttcggtcctaaagtccaggagttcctgaaacactgctgagcaattcaaagttcaggcaatcctgagtttgaatctcaggtgtcaaaattactgcgttaaggtactttacctttcagaatctgaattttcttattttaaaatgaggatactaataccctgagaaggtctatgaaggctcaatgagataacggtgcagtgggtctggcactatgcctggcacatagtgggtcctaggcttactgtggctcactgcccctaaactgtgacagccatttcacagggcgtggtgctccccgggttaccctgactgcagcattacggcaagcagaaagtgcaggatgcagttttatttttacctcttctcagaaccctgttgtatacatgttcccctgaagggcactttctttccattatgctgtgagctaaagatgtttaattctctagacctctctattccaagctgcctttctcctaagtcctctggtcttattaagaccacaatccccgtgataaaccagcccaagaatgagctggaggagcacaaatgttcctgttgaaaaggagcttagcaatcaactcctctggtcctctttcttagcacaggggctttaaagttttttttttaaaaatagctaaacaccaaagtccttagaaatgggtttcatcagttctccgtttaccagcaccaatggaaggaatatactgatattacatccttacagaatctcacagaacagcaatagcattttctcagccatctggtagaactactataccctgcatgaaacattttcatgagagccctactacttgggcttctagcttccatttgaacagggaactcattttttcatagggcaaacagtccatttttaaacaactctaattatttgaaaacttctcttaagataaactgacatctgcttccttgtaatttttctaaccatgggtcctcgttctgacttctagataaatatagaataagtcctcttattcattttagctggcactctctaggtatttaaagactgctcataggattttttttttttctgagtaaaacattcttcatttatttaactgtttgcttgtttgaaacagagtcttgctctgttacccagactggagtgcagtggcgcgatctcggctcactgcaacctctgcctcctgggttcaagcaatcctccccacctcatcctcctgagtagctgggattgcaggcactcaccaccatgccccgctaatttttgtatttttaaaaaatttaatagagacggggtttcaccatgttggccaggctggtcttgaactcctgacctcaggtgatccgccggcttggctttccaaagtgctaagattataggcgtgagccatcacatccagcctatttaactgtttttaagaagttatttctagaacttttatccaacgctctgttttggaatattttccactttgtcaatttctcttttgaagtgttattttctggaattaagtacattactctagttgtggtttttctgtaaaaaaaaaaaaaagagaccattacatcttttaaaataaacagtctattatttcaaatcaagatattgtcagtgtcttggatactcttaactcactgttgatttatattatgcatctgataaagcaaaacccttaaaacacattcttttttttttttttttttttttttgaggcagagtcctgctctgttgctcaggctggagttcagtggtgcaatttcagctcactgcaacttctgcctcccgggttcaagcaattctcatgtctcagcctctcaagttgctaagactacaggctcacaccaccatgcctggctaatttgtttgtttttgtttttgttttagtagagatggggtttcactatattggtcaggctggtcttgaactcctgacctcaggtaatccccctgcctcagcctcccttaaaacacattctaatgttatttctagcaacaatggatcaaaattcagttgaggcccctacaagtcacccactcatgttgctatttggctatatttatttgtgcaattgttttcttctgtttagttcgatattaagactttgcatgggttaaatttcttcttattgaatttggctcactgtcccatgctcttaagatcattttaacccctaagtatgcatttaatatatttaatattctccctagcttcttgtcctctgggaatgttataagtgtgctattttatgttgccactcaagacatgggtataaatgttgattaggcaactgtctaataactactaactaagtaaacgcacagcagtagatgctaaaatgtggacagataattatgacacagtgtcagacatctctgacaaaggaagtaaagagaactgaggggagtatcagggaggagcccctaacccacatttagggggtagaaaataaggaatttctctgaaggaagtgagacataagcagtgagcaaaagaggagtcagttgtccatgtggaaaggggggtggagaggaatgcttcaggcggagaaagaaggataggtgaagactgaggcaagagagtgcatagttgcttaagaaattgaaagatgatggttggctgaaatgtactagtgggagccacggtggaagagtaaggaggagcctgctcatcacacgagccttggagaccatgcgaaggagtttgggttttaattgcatggtggatccagtgaagaatctgaaacagcaaactgacatgattagatttatatatatattgaaactgcttctggtggcagagtggaaaagggattggaaggggcaaagctggaagctgaacccagttaagaagctgttgcagtgttctgggtgaggggccacgtgagtttagcctgcatgtaggggttcaaggcactgctcctctggtactcctggatttgccttctctattcctaccctccctccctgcatgataatgtgtccctgaaatgagtcctgccttggcttcccaagcagctctacctacaaggcaaagtaaggctggagacggagaaatattcgagtatttctttggtatcattggtatgtctcatccatcctagttctcattgcaaatgaaaacctggctttccagctttacctcctagcctagtgtacctggttaatgtctagtgagactggttagagtcagtccatcatggcatagtgctagttttatgggatattgacaggtattggaagaattagagctccatgtttaaaccagtgtggaaaatgctggcctaaccaaagctgatcaggattctttactgaagcattcatgtgagactttaatatgctgatgtataccacagatatctcagaggggcaatggtttccaaatgtaaatgactatggaaacttttttctttggagatctgcatttttcagaatatgtttttggaaatgcttcactacttacttattgtgcagcctcagaaaagttatttaatctatctgagcctcagttttcttatctttaatatgggaatgaagtacctatcttatagagtggctgacaccaagtacattcttaataaatgtttattattattgttgttgttattattattaagagaagtagaagagcatagtaagagcatagactgtggagctaggctgcctgaacccaaatcccaactctcacgtactgtctttgtgaccttggcaagttacataaatgtcctgtgcctcagttttctcatctgcaaaatgaagttggtgtgaggattaaatgagaaaatgcaccgagtgctctatcctagggcctggtacatggtaaatgctcagaaattgatggcaataataatcataatagcactgagcatttggattggcccttaggaccaatcattaagtagtcaggtatctgagaaggcatggtgtgaggctggaatctgagcaatggaagtcacaaggtaaagaaggtccctgggaagctttttagcagtggccttccagccttcccagggaagcatgccattttatactccttatcttctgagcagacaggcttgctttgaatttccacaggtaaatagaaagcatttctcctcttgattcgcaggaaacatctgtctttttttttttaaaaaaaagtatcattgtctctttgtattatctttatataggtgattttttagccatgggattgtaatccccttgaagactggaccatgtcttaattatcttgctatagtgcctggggcagtgtgcagaaatgccacagcaaatatgcctcctttcacctgaacaccttttacgtgaaaatttggagcgtagagttgatcattcatttcaaaataaattatctcatttactgtaggattaaccataggtgtcctttaaatgtcatttaccattttattctcaaaatatgctagtttcaggacatatatatagttgaaggtatgatgtgggaatttataacataagacctccagatcagcagttttgtttcacattggaataaaatactgtctttctagcctgcttatatgttgataacaaagggtgagaaaaagggtgctgattaatgcctttgagaatagaaaacctaagtcaaaaaaaaaaagacaaaaccccagctcatgggtttatagtttttccatagtgtaaacaaacatacatatatatcatgaatatatatgtttatatataatatataaaaacatatattgtttatatattatatattgttcatataaattatatatattacatatgtttatattatataatggatataaacaaataatatattacaaatatatattatttatatattatatattacaaatatatatttatatattatatattatttatatctttatatattatatattgtttatatataatagatataagcaaactatatatttgtttatatatttgtttgttttcactatgaaaaaactataaacccatgagtttggtttttaaaaatatattgtttacatatataatatatagtttttatatattatttatgtatatattgtttacatattataaacaatatatttatatatgatatgtgtatatatattatatataagcaaactttttatatatatataaagttacatatatataaagttatacgtataaaacaaaatttatttcattgcccatgagtcagccacccacaggtcaaccaagtatttggttcttatgacagctgatagtatcaattgttttaaattatatcatctatactggtatactttagacatttaattctaagcatgatgttttctaacatgttactttttctaagtgatcttttgattctctgttgcaatatcacttcaacaagccaatgcctcaggaaaaacataaaatcacagtggtactataagtggggaaaaactaaggcagtgataagtaaaactttcctgtataatctcttaaaagtgcgtcttgggggccgggcgcggtggctcatgcctgtaattccagtactttggaaggctgaggggggcggatcacgaggtcaagagatggagaccatcttggccaatatggtgaaacccagtctctactaaaaaaaaaaaaaaagaaaagttagctggtcgtggtggcacgtgcctgtagtcccagctactcgggaggctgaggcaggagaaccgcttgaacccgggaggtggagcttgcagtgagccgagatcgcgccactgcactccagcctgggtgacagagcaagactccgtctcaaaacaaaaacaaaaaaagtctgtcttaaaatgatttaaacaaagaaagacatttcataaaaaataaaataaaacttggctaagaaggggaagattaaaagctacacagagaggttgagagtttaaagaaataatgttccagactgtagtcaaatggaaaagacatgagcaagcttaatgggttgtccaaagtattggggatagaggtgaggtccccaataccactgattcaacaaaatttatttcattgcccatgagtcagccacacacaggtcaaccaagtatttggttcttataacagctgatagtatcaaagactctgaagatgactgtataaaatatgaacatagacataaaaatatcattgttcattccattgtccattttgcctaggaaatgtcccttgccatggagtgtgttccagcaagcattgatgaatctagcatattgatttttgctttgtttactgggttaacaaggcagtttagatggaaaaagtcttatcatcatccagactccgtttgccacaaacaggaaatgaatttgcttcccctgtccaagcctagttcctggcaaaatggaacagctcattgctaagccgccttttttttttttttttttttaaatacggtagctagaaacttggcagctcgctctttcaaagtgacagctttcaaactgtctacctaacacaatttagcctaattccaaacatatcggaaaatggactgttaaagaaaagaaaaaaatctccggaggagcaactgcctccctgtcctcctactttttgtctaatatgaacaaaatgtaaattattgtctccctaggttgtaaaatattcttcagagaatgattatacctgtcacagatgggatcttgaaataagttaaatgtttaggtttatatactaggaattccctagtgaactgaattctccatgcaatttttggtaatattgttattgaactataagcataaatgctatccatgagaaactgatttatttaaaaaaaaacaggaaaaataactctttctcacatttcttttgggtacccagaattttaacatgtccttaattagaatgattaaaagcattttcttaagtggcttaatttataaagtgttgttattaatacatcctggaacctataatgttgaaggattgctcaggtgctcagaggaagctggaacaagagaaatgagccccatacctccaggggctaaaacccctctggtctattcctcttctagcctggagtatctctacagcttccaaacatatctcctgttctccattttctccttactcttttttttttttgaaacggagtcttggtcttatcgcccaggctggagtgcaatggcacaatctcggctcactgcaacctccacctcccaggttcaagcgattctcctgcctcagcctcccgagtagctgggattacaggcgccaaccaccaccccaggctaatttttgtatttttagtagagacagggtttcaccatgttggccaggctggtctcgaactcctgatctggtgatctgcccacctcggcctcccaaagtgctggggttacaagcatgagccaccgtgcccagccctccctaccactttgtaaagcataattctgattatgtatttctgctaattagaatccttctcaagtcccgcattatctgcaggaggaaagcaagatccccaaggcctggtatggtgtgatgcctgccatcttttcccaggcttatatcttctctttcatcttttagtccctcctcacttgcaatatactgttccctctactgcaaacacttttccatgcgcttgcctgtcaggaacactcatactcatcctctaagtctcggctccaatatccttgcatcaggaagccctcctcatcctcttccccactccaccacaccgctagacattgatttctgttatttcactgcaatttgcataaatcacagtcacagtctttattacactgaattgcaatgatcttttatttattttgtcttctacactgagagtttcttgaggccagggactaacttactcaacttcatgtcccaagggacagcctggagcagctcctgacacatatgtgaaaaccagtgtatatttttccaggaactgaatgaaaggaggaactgctgctggacaatagcatttctcagtcatacactgaatgcctcttagtctctcagtaaccttcaatccagagaggtttactctgcacaaagaggaggtttatcattaattggttgatttaattctgacaaggagtggtgggatggaggagattcttagaaaggtataagaccccattagcctgaaaaactactagaacccagtttttaaatagggccaggcttgctttccagttttaattcaatacaatagaactgttaaatgattccaattactgctacaaatggtcgcctattgttaacaatatagagccaaagcagaccaacaacataaggtttcttctggaatattacatttccagctacacataacctttcagaccaggaaggcagtggagagatttttcagaaacaccaactaagcctgcagaacagtctattagaaattgatacaaatccaaatctgaggagatcgtctcagtacctttcctggctacaactgaattcaaagggtgacattaaagatgcctaaaatcatgcaaagatgtcaaacgctaccactgaatggctggtcccacctctgggatttccgtgcctacctcaaatatttcattttttttttcttgaatatcatggtgtgtatgagaggaaacttacatgagtttatacattttaaaatacagattttaccaaaataattcttaaccaaatgttaccaaagccatgacttaagggcgttatatacactcagtataccttagaacactgtatatatcacacacagtgatgggcaggactcactgctacagaactattagaaatgaaaaagccgccatttccccccttttcctcttcttgcctctctgcatttctcagtcagtattacaagagcagcttgctaactggaagagtggccactgaaaaaaatggagacaagagtttaacttggggctggtgttcctggagccaaagtcatcatccgcagattggtaaccgcggatacaaggcctcttagaggccactagtggccactgggtgaactgcatgaagatggcattttaaaaatgagtgttctttccaaggtttagtcgcttagcaaatttcgtcccttagtgacttggagaaaacttgatatatagtgccagaaaacctgcttttagaacaattaaatataaatctgaaatgcaaaaggtaaccaggagatagacctccttgttcagatggtttgtgtgctgctatgtgtgtgtgcatatatatatatatatatatatatatatatatatatatatatatatatatatatatatatatatagtttttttcctgtccttctcatctgggacttgctgtcatgattctgggcttcagaaaccgtatccccagagcatgtaacacttatcttgtctgtgaaaaatattaaatgaatgcatatgtatgaaatctgtagcttgttattaataataaattataatgccactagagctatgagtcattcaattcacaagtgattgactgttcgttcattcattctacagtcactggacattcatattcctatgccagtgcctctaatggatatcccagaatgtcacttgggttgtggacacatatgtctgccaagtaaataatgactgattttttcagagtaattcagttatgctgctccccacctgtgcctccagaaatcaacaaaagcagtaatcccagattttatttttcttaattggcctacctgcacatgttctctgacagttttaatgtcttactagcagcattttgttcagatgtcagatttatgggggctacaggtcgtacatattcctcataggaacaagtattccctggagtgctttcctgaccttgctgggatatgataagttgcacattcccagtcaatgaacacttattggtcacgtgctgtgggtcagacttgatcacagacactgctcactagatgctcacgacaatctgtgaagtaggcattgcttccattttgctgatggagaaactgaggcttgggcaccaatatgactttcccagagtgagcaagaagtggcagatgtggaacaggaagccaggtcttctgcctctgctctctgcttccctgcttccctgcactgcctttgtagaggttcccgtttttcccaatcctggcaagggtggctgtgtcctgactcctcgtggcaaggacggttgtgtcattactcctcctgttcttactgcccacttcttccagtgcctacaccccctttccgggggcccagagtcttttgggccacaggggaattttgctagaagatggaatacacaaaggcaacctgcttaataatttgatatctgtaggcttttgcattttatttgcattcttaaagaaaaagactcgtagactgggtaagcagtgaatatcaactgcttaccttcagcctctatttcctaacatataacatggggatgaggattcattgattagcaagtcctcttaaactcagttctgtggctgtcaaggtggggttttagagagtggcatccagctgggagacagatttcagaactacaagttcgtcttagcccctcaaactctaccacctgactgaagatgcccttctgttctgtgaacttcttttcccaaacttggatggtactggatacctccctgatttcactatttgatatcaaatcatctagtgtgacagtaacacaatgacaccagtccacaacacctgggcaagtgtctggcttgctggataaactgcacttcccctttccctttgctatatggagagctgcatcaatctgggctttcaggcattggtctccttctaatgaggggaatcgaccacacagctccagcatgaccatgctcacctatcccagcaaataggtgtttatccccagtgaaacccagcacagaacacccttaggagtaaaattagattttggtgcatgaatgttattgacaaaaaagactccctgctcaatgccactcggggacatgagtctgaatgtccctgccatggcccaggggaatgatgtctgtatcaccaaaccagtgctggcacctggaccttgtcaccactgacagggctgagaggaggtcagctgccggctgctgtacccggaacaggtttctagggatcaggcagaggcaagaggctggggaagcagcttgccttgccagctcaccaggctgctctggagagaaatagagggcttctatctctattactgtcagagtctggcacttctccccggctctgaaattcacagcaatggatggaggagggaggagggagaaggaaggaggtgcaagccagacaatcaaaacagccacaatattttggaagtggaatattccagctagagaaaattctctaaagcattgagcagtagggctggaagaggccctagctaatccagcactctggttttgtagaggaaatagttgagaggcagaaagacaaagcaacttctctgaggttacaaggtcagtaaggggcagaactgggacaaggctctgggtcttcggtgctttcaccacttaaaagaaagcttttgctttcttcctttataaaaccagagattggcagggggcttccttttgtgggaaccccagtggagacagaggatgtttacctgcagggaagaggggccagggcccggctgtgcctggacccagagtggtggggaaggggggtatgctcataccttgcaggttgacgccccggggcaccacgccctgaagctccactgtgggcaggtcatcttccgctgcattagagttattgggtggaactgctcttctgcctccaaaggcggtcctggaagtttctgacatttttgactttacaaggtccttcagaaaaaaaaaaaaaagaagacaacagaaaaggcatgtaaagtgagtaacatttgagacaaggattccaaaatagagaaacagatatatctgtgtgtgatagcacttgagcaacacattttgccgtttgcataaataaaaactgagaagtggcagcaaggattagtctaatgatggaatacagttccccaaggatcttggggagatttttgtatgtgtcaaaacatatggaaagcagaagaaaaggggcttattcaaagaaatttaaaaattaaaagatttttggagacccagattcccccaccctccataatcctacagcagcatcttcgcaagaaatgtttcctgttatatgcatgtgctgtatctatgttcatttcatacagatttatgagattataagtcacttttaagaataaacgcacacaaccatgtccagacaaatgttgtcttctaaagcgtttacatttgcaatttaattcaaccaatatttattgagggcctatgacatgccaggctgtgatctaggtacatgggatacatcagagaacaaaacagaatgtttgctctgatagattatagtctgatagggttagggtggagcccaagaagagccataagtaaatccacttaggggtgaggaggtaggaactgctttggaaattgagccacatggaggaggataaggaggtggagaggttgggcatgcaattttcaatagggctatcaataggcttaagaagtcagggttgccaacatttcccattccccaagcctgcttccccttcccttggagcttgtgcaggcactgagccagtttaaacaacacacacctgacggtcagtgcccagtaagtacttgttgaccaaatgaccaaatgaagggggactttgtttctgggcccagtgaaggttcccccttgatcccctggattacccagtcatgactcctggagacttggctattttcaaaaaccaggcacacccccaagaggtgaagagtccccattatagaggccaccagagtagagagatggttccagagacatgtggagcactaacaacatgctggagaaaagacaaccacgcctaaggtgtctggtctgagaaggagacaggagtgtttggatgcataaggtgtgaatgggtatccataagtatagataaatatatttacagtcattggtgagctgacgggggaagggagggagaagagcgaaaaagggttaatgatagggagaaggctgcgagagccatcctctagtgagaaataccgaaggtaggctgcggcattgccaggggtgcagaacagtgtggcgcgctgtcgggagacacagtgctaagggggagaaggggggagccccaggtgcacgcctggctgggtgagtgcggcgggcaggagccctcgcttctgggcgggtctaaggaggagaagtggctcgagttcagctccaaattgggacggaggcaggcgatgcgcaggagtggggaggcgcgcaggagtggggagccaagccggcggggttccagtctagcaggctgttctcacttggccccactccctccaccttttgtgttccagctccataatctgctccctgaggaaagggggctcgtcccttggggaagcacctccaactcccccatccccatttggtggcattctaagcaagcaacggcttcgggagagctgcctcgagagcctgagagaagtcccgcttagaagctgggctgggcaggtgcggagttgggggcgggaagccaggattgggcaagtggagctgcctgtgaccggcgccacagggcccagagcaagccgcttgctggttcaaccaggaaaccgaggtgcagaaggtggacgcagcgggccctggctcatagggtgcagggtcggtggcttacctgcaggcgctcccctccagaggtgccctcgcgtgggcttgctctgtgcgcctcggggacttcctcaaacggactcgggaaagacaagacagttggctcttaaataacttcctaagaggagccctcaccctcctcccctgtcccacagggttttctcctcccccttctccacagctggagccagtaggggagctcagaggattttctatttacttcatctggcctgttatcccggcaggtgcgcccttctctcccacttgcccctctgactcccaatttcccattcccacttctcctccccatccccatccctagatctgccctccccaccgcaaccagttgctgggagtaccaggcaaggggccctgcagtgccaggaagtccccacccgtcccctttggtcagagggtctgggagggtttcctttacaaaggaatgcttttgcctggcaggtcagctgctactgtggcttggcaggaggggggtctgccctcccacagacaggtcacacagacagttgtgaccatgcatgcagtgagagcaacgtgtccctcctgtgcaaataaggcatggtctgcattcctgaatcatcccagagccacagccaccgcctaaccacaagacttcctgcaggaatgggatgcctagccccaaggaagatgagtaaacatctttaataatgccatgcagattagaaaataacacttggttttctctgaaaatcattttagtgcatgttcaaaaattagaaaattttccccctaaaattttaatttttttcttttactctttctttctttctttctttcatctttctatctttcagatgaagtcttgctctgttgcaaaggctggagtgcaacctccacctcccgggttcaagtgattcttctgcctcagcctcccaagtagctggaactacaggtgcatgccaccatgcccgcctaatttttgtatttttagtagagatggggctttaccatgttggccaggctggtctcgaacttctgacctcaggtgatccaccctccttggcttcccaaagtgttgggattacaggcgtgagccaccgcacccagtcaaacatggctatttctaaccttctttactgtcttcaaatttctgaccctgccactcaatctcccaatgttataaagaagaaaaaaaaagatgccattggttagaaattctctcaattttctgctaccaatctatgaacctgcctgcaaccttatctatcttttcctctttcttcttgttactgaagttggaaaggtccctcctccctctgcatctccaaaccaggcttctgcgttgccttgttctccggggctttgctgtgactcttacgtactcttcctcttgcagcttcaagctcctgcttgctaatagtgggtcttctcagcattcatgcaatttcaggtctcttcagtatttttttaaaaacctcccccaacctatgtccccactcctgctgttactcctcctctcctccccttcatcactaagtatctgccatctggcttccgcctcatcattctactgaaagtggaggtcacggtctccaaggcctgtgctcaggccaaaagacaggattcagttcttatttacctgaccttttggaagcattgaactctgtctttgaaggtatttttcctaggcctccttgacattgaacactctgtggtttcctccagtgcagcgcaatattccttgattgtctgaggaactcccatagttttcaaattccatctatatcctgacacctcccaaatctgggtctttagccaagatcttttccagaattgcagattcccgtatctaagtgcctactggctatcctcatttgtcacatcccagtgacaacacacgctcatcatgtctaacatgagatgtatcactttcctggaaaacctggtgcatctcaggagttccctacctcaatgaataccatcactttgcacgcaggtggtacaccagacacatgggcatcattcttgaggcttccttgtttctctccctcaatcatcaaatccgatccttgagcaaatattttctatcctacctcttaaacagcccttgaatctacccgtgtatgtacccctttccagtccattctctacagtgcagtcagaatgagcatttcagggctaaaatccgaaatcaaattatttgcacaaagcccttatatggctacttctctttgctttttggataaattgcaagctgaaactgacaaggcctatacaagctggaccctgcctctagcactgctctttccctcagcatccatacaatttgaggtctccagtatttttaaaaaaccttcccccaacaccaatctaccctccctgccttccactgttgtttctcctctcctcctcttcatcactaagcttctgccatttggcttccatctttcttccctatcatcttcctctgccatctttcttccctgcccagtctccctccactgactccccagttgtcttgcaaggagtttgccttgttgtagtgctcctcacactgcatgatcattttctgtttccttggctgtacctgcactagagtacaaaaaggtagggactccagccagagttccctggagagaggctgctgaccacttaactatccaaaggccgtctttgccacatcccttgctgagtgctagagaaagaccctaaagatgtctagcactgcttcccctcagcattcatacaatttcaggtctcctcagtatttttaaaccctcccccaatccttaacgatcatattctggtagttctcctggcaaacatcaaatctgagtgtctagaattccaagataccctcatccatgtggggttggaggatgagcagccacccttgcacccttcagatgaggttacgcagatgccaggtacccctgggacttggggttgagttgtgcattcagaacaggattgtcaccctcacaaccacctccacggtgtcacttttggccttagactaattattggctttgtgaacatacacacacagtggttggctttctgactcccccaaaccactaacctcaagagcatcataaatgcaatggctttccttgtgctaaacaaagtcgataaaaatgtgtctaagccaccaagccctagaatgcggttgaagcccattcattttacagggtattcctcatggttatatggctgagacatcagaacaaaggtttctggtcacacagtgaatcttgaactgtgctagggatgcaacttccacaggtgcataggctctgaggtccttaaggatgggatggtgtcttttatttctgaatgccccctgcctggcatggaagtggagccatgtaaatatttaaggcatgtaacagacggggttcatccaggaaaacaaaaaccactttaggtctttctaaaagaaggaatttaaggcaggggattggttacacaggtgagagaagagacaagaaaccaaacacgagaaggtgaatcaactccacaattagcaacagcagagaggagttggtgtcgttgtagcgggaggactgagggtaggtcaggcactggaaccgtgtggtcctgtctggtgggagctttagatcccataattccaagaaacactgtctgaggtcaagagggagggaagaatgatcctagcttgtccctttcttcccgctccctctccctcccttgtctgccgttttgctgaactccactagaatcagttgacaaaggactctggaaaataccgcctgcaaagttagccccaccactcctgtgctggggccccaaggctacccccaggttctgtgattcactaggaggactcaccagactcggccacccacgtagctatgatcagatacaaatgtacatatatcatatatactacacgataaatcatgacgaaaagatacaaatccaaatcagcagagaaaaggcacttgggcaaagtctggaggaccaggcagaagttcccaaaggtcctgtcctaatcaaggcacatgggctgtgcctaccaaccctggcaatgagttgtgacaacactgatataatgtcatctgccagggatgctcaccagaggctcagtgctcagggtgtttatggggggctggtcacataggtaccctctacctagctcatagccattttccagactccctgaaggaagcaggtgttaagcatgagccacaatttttgtacagtttaggcccagccagccccacttgtcagttagggaacagtgggaagactcctgaagtccaagttcccagatgccagacaagggccaagcttgcaagtagggctttctaagccagtttcaggtttgctatgttaactctttactgcatccatacagggaaagggtgaggaaaggctctctgggcaaacagttccaggactgccacaacacactgtgctctttcatcatggcatggccagtccctcacatgagatgtcaataggcctggagcacgaggagactccaatgagaacgtcacaagggtaatccagttctgcccctactttcttggccttaccagctcagcatgagacctccaaggagacgtgaactccctctggctgcacgggcctgggcataccttctcactcttctgaagctgaagggctcaccccattgcctccccaagaagcagggtaaaaattcctaaacacatcactctgggatcctggcgtctctcagaaatatgtagtaaactttgggagttgtgagtaaacagaaaatacgtgggaggagggattccggatccccttaccttgatcctttaattctgagttttcatttctatggtattgacacttttctctgcagtctctccagacaaaccatctttctcctacttggcaatacccaaggagcagaccatatttgttcaggcaatgaattttctggcaaactctatttgatttacatgcaaaacttcacatctcaaacaaacaaacaaaaaacccagtcatgtctggacgctgctggttttttccagctgaacaagacctggattttgttggttatagatgtaattccagagggaggtgagtagatacataaataacaactggccttgttcaaagatgccagaccctctgacatgaatgacccaagttcgtctcttgggagagtctttctcctgcactgcccttcatcctgtaggagctggagaaaactttccactccagatggaagtgtcctgggggagaggatggaagggaggctgggtgggcagtttgtagtcaggttctagccacagtagtgagcagtgggggaaggcaagcggccctctgtatccattcacatatttttcaaagcctcacgagcgttttcacaaagtctggcaatgacattttaaaaggaatttataaagcatcatcgcagttgccaccacaatagggcgtgggatctaagacaggaccatgtctcccacagcctcttttccttcttctttcaggaaagatgaaaacccatgccagggacaggtccagatggcaggagttttctctttgctttggcttccctgggcatagcccactcttgccagggatctacgatcacctgtaatctaccttcccgaggagcagtgatggattgctgggggctgcctcacctcatggcaggcaaatggaagaaagctgttctcgccttaggaaagaaagatttaactaatgtacccaccttcttacagtaaatatctctgtcttaaaaaaaattttaattgtggtaaaatacacataaaatttataatcttaaccatttttcagtatacaattcagtagtgttaaggctattcatggtattgtatgacccatctccagaatgtttctgtcttgcaaaactgaaactctgtttccattaaacaactccctgtgaatatgtgtgtctgtgtgtgtctggctatatatttgtgagtgtatatgtctgtctgcatgtgactgtgcacacatctgtgtgagcgactgagtgtgtctgagtatctgtgtgtatgggtatttctgagcatgtatgcctctgtgtgtatgcattgtctacgtgagtgtatgtgtctgtgagtgtgtgcacatctgtgtgagcaagtgtgccgtgcatatgagcgagtatgcaggtggaagggaaggactgaggaagcactgagggtttagctccagaaaactttctccactggcttcctaactcctccagagtcctgatggagtttaaggagactccaagagatttttaaacttgaaaagactttataaaacatgacgaagggtcaactagaagtaggtctgttacagataacgatttttcaagtttaaaggaaagaaatttcataaaaaatgaaaaattcataaaaaaagaaaatttcataaaaaatgctagaaacacccacagtgggaagagacatcagtcatgccagcctcactgcatatgacacagatgcatgcatggtttaattcaatacttttccttaagtgaagcaagagaccccacatccacccatcccaagtatctcactttgccagaggaaaaattcaatgataacaaaacattatgaaaaaattagtaattaaaataatacagcaatgtgtatgaacaaaataatcaatgaaagtgaaacctaatagtaattccacaaacttattacaaagctattaatttaaagagtagtggcaattgaaaaccacaaccaacaccagataatggggatgctataaaaacaatgcttgcttcagtaaaactatcagaatgctgactaaatgtgtatgcacatatgtgtgcatgtgtgtgtgtgtgtgtgtgtgtgtacaagtacagtaggagctttggagtgttcccaagagtaatatggcagctggagttagaatctactatctatgtaaccttgggcacattacttaacctcacctgtaaaatggtgatcctaataatgtatacctcacaagattatgaagatcaaagaagagaatacctataaaaaggtttgtatagtccctggcaagaagctagctctaaataaatattaccagtaatggtatgtgtgcactggacaaccttcactcatccatgatgaatattttaactttttgtaatagttattacctgtattttctcattatcatcctcatatcagggaagtgaatatttaagttgctaataattttggataatttgaagaggccattatcagcatttattgcagtattttctgtctagaacctcttcaagagcttcatgtgcaattcatgcttgtcaaggggtgagatttataattggctggttgtggttgtatatgtgaggatatgtatatgtgaggatatgtatatgtaagggtctatttctcttgctctgtcacccaggcaggagtgcagtggcgcgatctcagctcactgcaagctctgcctcccgggttcacgccattctcctgcctcagcctcctgagtagctgggattacaggtgcccgccaccacgcccggctaatttttgtatttttagtagagacggggtttcaccgtgttagccaggatggtctcaatctcctcgtgatccgctcgcctcagcctccgaaagtgctgggattataggcgtgagccaccgcgcccagccaatgccttccatttttaagctatataagaaagatgtctggggagtgggtcagagactgattttatttgatatataccaagtgaaggcaccagcttccacatggttgccagtgaagggaccagcttccacatgttgccagttctttctggaagcccacatccaggtaggcttcctgggcagacccacgggcatctcaccaaactcttctaatgaggtctgtggctatgggtcagcagggtgcccctgtcttgggcactcttgcccaagagtgccgctgccctctgttgtagtcgcacaactgcaccttcttgctgatgaggtgaagcactaacacaaggccagaaatggaagggacatgatgtcagctggagtcttcctaacagcagaacttctggataatgatctatgaatttctaaggaaagccaaaggccattgcataatcgcatgtgtgggtgctaaaacagccaaataaaggggcaagttctcctttctttgatgctccctcagcaatttctgcagtgaagtttcagataactgtgccagagcccttcctgtgaaagtgtttcttgttaatgcatttctcctctcacaatggtaactataagtggttaaaatagcatcagaaacactaactctatcatatggacatatatcatgattcactaaaaatatttcccacaatgcagttttaacttaaacaaaagttgtttatatatacgtgtgtgtgtgcatgtgtgtattaataaatatagacagtgtaacttacccagaagagttccttatgcctatgttctgaaaaagacagcacagatgcccaaaaatataagaaattttataaggggcttttagtggtccaagattctcctgctggcttctatgagtgataatgatctagaattcttcgaaaagccaaaaagaagtcttccaacagccatgacttaataaagtccattgtccctgattattcaaactccttctgattgttccatctgatttcatgatcacaaagcctatgaaaactttctgttctgggaaacagaatcaataatgttttataagcttaactgtgtgatatgatgtgatattgtgttttatggaattggacatggcctatgtctctactatattttcaccttgtatgcaacctcctgggataccattacatatatatatatatatgtgtatacacacacacacatatatatatacacaaatacatatatatacacatatatgtgtgtgtgtgtatatctgctatatacatatatatgctatatatatatacacacacacatattatagctaggtatggctttatgtagtactttcttaaacattcaccctcaaacctgaagggttctttaatgattgtgttcatttattcatttgggattagctagtttccaaggatggatcaaccatccatgcctcccggtattcccagccatgtgtagtccccttccacagtgaatctggcttcaaccaacagggtgcagtggaagtggccctatgccagttctccacctaagctatatgatgtcctaacagctgccttttcatgcttttagaacccttaaccaacattaagaagtctagctacactcctggagtccagctaacatggagaaaccatacagagaggccacatggagcggtggggacatgagaatgtgcagggagggagaggagtccagctgcctcataatcctaccggagcccaggcatcagccatctctgccaacctgcagcacgagtgaggacgcgagtgtgccacctggcaagtggatcctctggccccagtcaaggagctgcagctgatggtgcatggagcagagagaaactgccctgctgagccctgccaaaatcataaaattgtgagcaatgaaacaaagtggctgttattttaatccactaatatttgggatagtgtgttacatcgcaatagataactgagacacattcatcaaataaatatttatctaacctgctgtttataataataatacaacactaatattgagtatgctgtaatatatagcaatataattaatatggtaatatttatctatctattattgacagactttgtgatgagtaggaaattgtatctatctttaaggcctgcagtcaagaaggggaaactatattaaaagctagtgttttggaatttcgtcaacaagtctgtttccacgatttaatagacttcaaaatattctgtgttttcctcctataacaaatatgttccttgtggacctaatctggcatataatatatgtacaaaaatacaagttaattaatgaattaaagtcagtggaatctcttatgtcagtgaaagcaatagggttgctgacaaaaaaagaaagtaaaagtttttagtgaattgtatatgcaccactggtttttatttcacctttatcttaaacagtcagccactcacttaaactttggcttctgaggctgagagccacataaaagggagcactaa

SEQ ID NO: 1078 - DNA, 23005 bp, Homo sapiens
ccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgatgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgacatcaagccgtgagggtgtgttggtcttcctgtgagagccttgctgacttcctgccaccaggtcagtgggctggacccatgagagcaaggggtggctgggtgtgcctacctgggaccaggggagtcgaagcccctccttgaaccaagatcatctcacaccctgcacctgccccgccacgacatgggagtgtcttctagaatattctttccccattccatttgcacatttagtgggaattagaagcgtctccttcgcccgagtgtctctcatgcagaacccaatttaaagatcatggtgtttgctctaaggtgtttgttctaagcttcccatgcccaacctatccgtccaggcccatgcctgcccacccaccccacacgaccaccctctgtactccttggggccccacccacttcctggctttcaccatcattttctcctcatctcctgccccctgtctgcatcccaagctccacacctgcttccgggtagcagaagccccagctctgctgtgtcccctggctgacatacctggagggttccaaggcagaagtggccagcccctccccctcagtatgggctcctccatcctctgtaggggaggggccatagcttcctcccagtgacccatgtgctccctgtacacccaagcgtctctggcagttctgaccacacccccaccggagggtcagggctcccagggagcgtggcaagccagaccggaggccgccctgtttccttctgccttgatcccatggctggggatgcccagggtcctctgtgggcccccagactggctttccttggtcagaagtgctgcaggggctgggaaaggctgtgctggtcccaggagagcagacaaagagcagatctccgaggtggccctgccctgaggggtcccctgccctcaagtagggcccatggccttgatgaggtgatatgacatgagttgagagaggttcctcactggccctgaagatgtctccgctgtgctggggaggggaccctgtggcaagggacagagagtggcctccaagagccaagggggacctcagagccaccactaccaccaggacccaaattctgcccaagtccacttgggcccagaaaaggcccccgagcagcagataaggacacagcccagctgacaccttgatctcagcctcatttgaccctgaaccaaagacccagcctcccaggctggacccctgacccacggaaacaaaaggtcatagaggcgtgtggctgtgagccacattcattatccagagatagatacagcagcattaataaagccgctgcatgtccagcacctccccttccacctccgtcaagtacggggaggtggctgagggtctcaggaacccctactgaggggggaaatgaaagaaaaaagaaaaaattaaaaagagaattaagcttttcctgtattaggctgacttgtctcagaggcagcaacaggcacagcccagacccaggaaaagtcttaataatactaagaagccaagacacaaaggaatgtgctctggagcctctcccagcactccctcaacatagggagaagaaaaacaaattttcctttgtttcatggtatgagtttatagattcctgctctctacacctagtgacttcaaatattctgttttatcagcagtggagtgaaggtcataaactgtctgagcagcctgagatagagccacctgggtgccatagtgatggccatggaataagccatgctaagcactagggcaaacctacataatggccatctgagttgcacagcaacggtcatgtctaatcctgagttatgagcctgttataatttgattaactgtctttgtcctgcctctgtatccctgctttcacgccactgtaagcctgcttcaagctaacccacccctttttaaaagtgtgtttaagtcaagtgctgtctttattctaggcccagtttttagacgttgagtccagtgggtctgagtgcactcaataaagatcctcctgtatacaccccaaggtctctcttttcctcctgtttccacaacactacatgtgatgctgacagagggtgctgggacaggggcttccagtggggccccatgaacatttattctgttgctagtgaggtgtttgtctcactggcttttgcaacatataaccagtgcttcccgcctgatgtcctcacttgctgagaatgaggctaactactccaaacagcaaactgaataccatccagcaatcacgttcctttgtatttgcccaaaggaactgaaaacttgggtccacacaaaaacctgcacaagagatatacgcagccttattcaccagtgcccaaactcagacacaaccaaggcgtccttcagcgggcaaacggataaaccatgtcacctccagacaacaggatataaaacgaaatgagccatgaagctgtgaagacatgaaggggccaggcgtggtggctcacacctataattccagcaccttgggaggctgaggcaggaggatcacctgaggtcaggagtttgagaccagcctggccaacatggtgaaaccctgtctgtcctgaaaatacaaaaattggtcaggcgtggtggcacgcgcctgtaatcccagctattccagaggctgaggcaggagaattgcttgaacctgggaggcagaggttgcagtgagccgagatcacgctactgcactccggcctgggtgacagagcgagagtctgtctcaaaaaataaaagacacaaaggggcctcaaatgcatctaactaagtgaaagaagccagcctggaaaggctgcacactgcatgattccaactatagaacactctggaaaaggcaaaagtatagaggcagtgaaaagatctgtggttgccagggggcagatgggaggaagtaatccataggtggaggtgggaggatttttagggcagtgacgcaactgtgcgacactatggtcaatggtggacatatcatgacacatatgtccaaacccatggaaggtacagtgccaaaagtgaacccccatggaaacgcggggttccagaagacagagccgtgtccatgcagctttgtccgttgcaacaaaggcaccgcttttggtaaaggacatagatagcgggggaggcttgcatgtgtggggtggggttacatggggactctgtaccttctgctgaatttcactgtgaacctaaaactgctctaaaaaataaagttttttttaaaaaagcaatttgacccaaagtcagtctcaggaggccagggggtgggggacagaacaggccagggcaggaacttgcagggacgggtgcaggcaggctgaggtctcaggaatgtgtctgcacctctgtggtttcccttctcttcttcccttctggggacctttgcaatctgggctggctgctgggtcccgcctaggtttcagattctgccccaccctgaggttggccagtcccttctctctgtggctctgggagtggagcctcagcccttggtacagtggagcaaacaaactctgatttggggccccagagaggaagcgctgggaatccaggggttggacaggctggaccccaagccctgcttccaccatggctgtccgtgcgaccctgggagtgactgtcagtcctggtgagacagggtcacagcacctgcctctcatggccattcaactgggttaatgtccctgcccagccagggaatgagaggaggtggcaccatgtttgctgctggagtgtaatggcgcgatcttggctcactgcaatctccacctcccgggttcaagcgattctcctgtctcagcctcctgagtaactgggattactggcacgcaccaccacgcccagctaatttttgtatttttagtagagacagggtttcatcaaattggtcaagctggtcttgaactcccaacctcaggcgatccgcctgcctcggcctcccaaactgctgggattacaggcatgagccaccgcacccagcctgcccatgtggcttctaacttgttccctgaccctgaccttttgctggaggcagtgaaggcaggagagagtggaggccacatccaggagcttccagggacctgaggggttggaggacaatgaaatccaggacacgccactgacttgcgcctgtctgccaatttttccccatttaaaaaagttatttaaagggccaggtgcagtggcttacacctgtaatcccagcactttgggaggctgaggcaggcggctcgcctgaggccagaagttcgaggtggtgaaactccacctctactaaaaatacaaaaattagccgggtgtggtggcatgcacctgtaatcctagctactcgggaggctgaggcaggagaatcacttgcaccctggaggtggaggttgcagtgagcagagactgtgtcactgcactccagcctgagcaacagagtgagactctgtctccaaaaaaaaaaaaaaaaaaaaaaaaagttatttgaattgtggtcaagtttatcttaatgatttttaagtgttcagctcagtggcagtaagtacattcatattgtcaccatccatctccagaactttttttttttggagacagagtctcgctctgtcaccaaggctagagggcagtggcacagtctctgctcactgcaacctctgcctcccaggcgcaagtgatcctcccacctcagcctctcgagtagcagggaccacaggtgtatactaccacactcggctaatttttgtatttttttgtagagatggttgggggggtgtctcactttgtggcccaggctggcctcgaacccctgacctcaagtgatccacctgccttggcctcccaaagtgcagggattacaggcgtgaaccacctcacccagcccagaactcttccatcttgcaaaactgaaacactgtggccttaagcactcactccccaatccccctcccccagcctctggcaccccccaacccattctacttcctgtctctatggaggtgaccactccagggacctcccatgagtggaatgactcaggatttgtctttccgtgaccggcttatttccctcagcataatgtcctcaagattcatccacaatgtagcatatgtcagaattcccttactttttaaggctgcctttttttttttttttttttttttttttggcagagtttcactctgtcacccgggtgggagtgcagtggtgcaatcacagctcactgcagcctcgacctcctgggctcaagcaatcttcccacctcattttttgattttttgtagagacaagatttcactatgttgcccaggctggtcttgaactcctgagcccaagcgatccctctacctcggcctcccaaagcactgggattacaggcatgagccaccactctgaaacagcccggcctggctgtctgccctttttaagaaaataagattttggccgggcgtggtggctcacgcctgtaatcccagcacttcgggaggctgaggcgggtggatcacctgaggtcaggagtttgagacctgcctggccaacatgatgaaacctcgtttctaccaaaaatacaaaaattagccaggcatggtggcgggtgcctataatcccagctgctcgggaggctgaagcaggagaatcgcttgaatccaggaagcagaggttgcagtgagccgaaatggcaccattgcaccttcagcctgggcaacaagagcgaacctccatctctaaataaaaaatattttggccaggtgcagtggctcatgcctataatcctagtgctttgggaggctgaggcaggtgggtcacctgaggtcaggagtttgagaccagcctggccaacacgacgaaactccgcctctactaaaaatacacaaaattagccgggcatagtggcaggcgcctgtaatccctgctgctggggaggctgaggcaggagaattgcttgaatccaggaagcagaggttgcagtgagctgagattgcgccattgcactccagcctgggcgactgatcgagactccatcttaaaaaaaaaaaaagtttttatggaaagtaacacagtgcacagaaaactccaacagtacaaaacagacacatggtttcctctcctccaaagctgtcgcgcccagcgtcctccgggaagtacctgggcagtgtcgcctgggtacagcttgtgcctgacaggggcaatgtcatcgtcacctctgcttgctggggttcccccgacagcctgtgctgccgtgttgttcccggggaggggctgttggcgggcacctccctgctttgtgctgctgtgtggatatcctcccaaggacatcttcctgtgcgtgtgtctggcagaaattcctagacatggaacccttgagtataagggcatgtgcgtcactatgttttttttttttttttgagacgcgtttcactcttgttgcccaggctggagtgaggctggagtgcaatgatgcaatctcggctcactgcaacctttgcctcccatgttcaagtgattctcctgcctcgcctcccgagcagctgggattacaggcatatgtcaccatgcctagctaattttgtatttttactagagatggggtttctccatgttagtcaggctggtctcgaactcccaacctcaggtgatccacccgcctctgcctcccaaagtgctgggattacaggtgtgagccactgtgcctggcttttttttttttttttttttttttttgagtcggagtctcgctccgttgcccaggctggagtgcagtggtgtgatctcagctcactgtaacccctgcgtcctgggttcaagagattttcctgcctcagcctcctgaggagctaggactacagacgtgcgccaccatgtctggctaatttttgtatttttagtagagacgggttttcaccatgttggccaggacggtctcgatctcttgacctcgtgatccacccacctggcctcccaaagtgctgggattacaggcgtgagccattgcgcccggtcgtgcatcactattttgatgcatcatcttcaaaccaccctgccccagcatcactggactgccggtgtgcccagcctcccctgcacagcttcccactctgctcacagagaagacggtggaggggggagcccaggcgtgggttttccgtgtgctgagggtgtcctcagccacctttttccccaagtcattgacgtgaagctgattttctcattggtggccatggaaactgcccagaaatgggagcagggcctctgagaccctgccccagctagactctctctccaggcttcagtgtctcctcctggagctgggtgttgactctgtccaagactctgctcagtcacttcctggctgatccccgagtgctcaagtgtgtgatgagattagggctcccccaggcaggaaacggccacattggacccctccctcccccatccctagttcattttattttccccaatcctcatggctcccaactaggccctcctgctcccagacccccccaagccctgtcccccatcccctgtagcccagcgctgagcacactggggccagaaccacccataccagactcccccagggcacgacgggttgaggcctctctgaggcagggagggacaacactgaggggccttgtgcagaagagggaaggggtacccccccgagcttcagtttcttcatctgcccgatgagcccccatccaatggtacccaggagtggggatgtgctggggctagaggagggaggccccctggaggctggcttggggacccttcaacctggccacctcactcagggtcagaggtcagagcaggcgagccacacaccccgaagtccccccggtcctcggcaggtgctgtccccagcatcactgtctcccctacagatgcccgtgtgtcccctgggcaagagtgaagtgaggcactcatacaggggtgccttgtgagtatggggtcagccgaggatgctgaggggctctcgaggttcagccagagtccctgacgctgggctcgtgctgctctgggggtctgaagggaccctcgctattaccctctgggaggcgcccatccttggtttttttttttttttttgccgagtctcgctctgttgcccaggctggagtgcagtggcaagatctcggctcactgcaacctccacctcctgggttcaagcaattctcccacctcagcctcctgagtagctgggaccacaggcatctgccaccaagcccagctaatttttgtatttttatgagagatggggtttctccatgttggtcaggccggtctcaaactcccaacctcaggtgatttgcctgccttggcctcccaaaatgttgggattacagccgtgagccaccgtgcctggcctagcagggctcttcttatcctgctcaccagagataggaagtcggggggtgacttcaggaaaggcccagagcccgtgatgggcgtggggattggggtgaggacagggctgtcgtgagaacagtggctgcagatgtgagcggctggcaggaagtggccacttgaaccgcagatgcttcctgggctggtcagggaccgggggtgctggctgcagctgggacccccccccctgcatcttgctggcctggcacctgggtccctgggaggcgccacactggatatagccacgtggggcagcccggtctccataacccacactccagtcctcccacgggctggctggcaagcggccctggtgggtctgcgggggcaggggcagccttcctggtttatctctaccggcgcgatctgctcgtccgcctcggctccagaagctggggctcagggtccggcgaggcaggaagcctgaggccacagcccagagcagcctgagtgcagtcatgtgggggcgactgctcctgtggcccctggtgctggggttcagcctgtctggcggcacccagacccccagcgtctacgacgagagcgggagcaccggaggtggtgatggtgagtggtcctggctttggggtgcagagatggggttacatcagagatggagctgggggcccggagctggggagggggaggccgggaagttgcgggcttcagcccagcccactctgtatcccgtctctgaccccatagggctgggctattcccttgagtgtcatgtccagctgtttcccaccagggcagaccccaggctctgagcacctccctccctgctgcttctcgtcacctgccgaggcaggggctgactgaggtcccctctctctcccagacagcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcggctgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctggtgcacccgctgcgggcccgcgccctgcgtggccggcgcctggcccttggactctgcatggctgcttggctcatggcggccgccctggcactgcccctgacactgcagcggcagaccttccggctggcgcgctccgatcgcgtgctctgccatgacgcgctgcccctggacgcacaggcctcccactggcaaccggccttcacctgcctggcgctgttgggctgtttcctgcccctgctggccatgctgctgtgctacggggccaccctgcacacgctggcggccagcggccggcgctacggccacgcgctgaggctgaccgcagtggtgctggcctccgccgtggccttcttcgtgcccagcaacctgctgctgctgctgcattactcggacccgagccccagcgcctggggcaacctctatggtgcctacgtgcccagcctggcgctgagcaccctcaacagctgcgtggatcccttcatctactactacgtgtcggccgagttcagggacaaggtgcgggcagggctcttccaacggtcgccgggggacaccgtggcctccaaggcctctgcggaagggggcagccggggcatgggcacccactcctctttgctccagtgacacaaagtggggaaggctgtactgggtcgaacagggtcccttcccccacttcacgtccttcctgggacctcagaatgtgaccttatttggaaatagggttgttacaactgtcactagcggaggtcactttggagaagggtgggccttacatccagtgtgggtggtgtcctcataagataaggagaggccaggcctggtggctcacgcctgtaatcccagcactttaagaggccaaggcggatggatcacttgagcccaggagttcaacaccagcctgagcaacatggtaaaaccccatctctaccaaaaatacaaaaattagctgggcttggtggctggcgcctgtaatcccagctactcaggagactgaggcagaaggatcgcttgaacctgggaggcagaggttgcagtgagccgagattgcgccactggactccagcctgcgtgacagagagcctgtctctaaattaattaattaattaatttaattcaattttaaaaagacgaaaagtgacggccaggtgcagtggctcacgcctataatctcagcactctgggaggccaagatggaggattgcttgaagccaggagtttgggaccagcctgggcaacatagggggatcccatctctacacacaaaaaaattttttaatgaaccaggcattgtggcatgcgcctatagtcccagccactcaagaggcacaggcgggaggatcacttgagcctgggaggttgtggttgcagtgagctatgattgtaccactgcactccagcctgggcaacagagcaagaccttgtctcaaaaataaacaaactaaaattaaaaaaagaagacgagagatagtgggtgtggtggctcacacctgcaatcccagcactttggaaggccgaggtgggcagatcatctgaggccaggagttcaagaccagcctggctaacatggtgaaatcctatctctaccaaaaatacaaaaattagccaggcgtggtggtgggcacctgtactggggaggtgcccacccagctactggggaggctgagtcaggagaatcgcttgaacctgggaggcggaggttgcggtcagctgagatggtgccactgcactccagcctgggcgaaagagcgactctgtctccaaaaaaaagagaagaggagaggacacagagacacacagagaagaaagccatgtggcggcagaggcagagatgggagtgatgcggacggacacaaactaagggatgccacgatgccaagcacagccaacagccaccagcagccaggagacaggcctgggacgggctctccctcacagcctccagagggaaccagccctgccaccaccttgaccctggacttctggcctgcagaactgtgagacaataaactctcattgttttaagctgcctggcatgtggcactttgtcagggcagcccaggaatctgaaacaggatcaaactctgcttcctgggccctgccagcatctctggctcggctttctgggctggatgcagcccacgacgcactggtgtctgagatggggctggagctggggctggggctgcattccctggagactcactgcaagttcctgcccaggaggctgagggcaccccatcctcagtgcccaatgctgtggccccaccaggcccagagcctggttggccattctcatgcccaccagcttctggctttgggatgtctcttgagcaaccagaatagcacccccaactctgctccccaaaacccatcactagcacggctcagcctcctgctatcccctgactgctggggaccctcgccttccctcctctcacctgcaggctgatccttcttttcactttctgtcaatgtcaccagggataaggtgggacaatggggggtgggggtggacagtgtgtgctggggggttcgggtgctgcagacctggaactcccttctgccaggatgttggcagccggttgtaagccttgcacgggacagaccacaaggggccatgccagtggctgtggaggacacagctggtgtgtggggaaggggagaagcctcagcacctggtgcacaaacacacacacagacacagacacacacacacacagagacaccgctgctcactccagggagtggcacagggcagtttcaaagaccactggggcatgaactatgggggcaaggcagagggttggagggccactgttgggctcctcattgggtctatgtctctgatcagcccaactttgggcagccctgggctgggggtgtcaggtgcccgggacacacacatgcacacacacacacatgcacacacaaagttcatgtgcaccccagaacatgtgagtaagatcagtaacgtgtattcttgtcaatatcctggagtgatcatttaccagagttttctgagatgttaaccacaggcacaagctgggtgtgtgggtatgaatggtccccaggaccaaactgcggtcccacaactgcatgtggttgtaggattatctcaaggtgcaggtgtttgacatccataaaccctcctccccaccactctgaaaggctgggctgtagacgaagacagggctcagaagccctggcctgtgggcccccaccacccggccactatgtctctgaggggccggagtctggccccatctgtggaacgggctggcgctctgggtgctgctttccaggttcccgctgctcacaggaggccgaggcccggctgtgaccctggagatgaggttttatcttacaacatcctctacagcaagtgggcacggggcctcgggctgaggaaggagccacagggcctgtcgcttgtagggtgccaggggtggggaacccaccggccagggcagcctcagaccttgatctcacaggcagcgaggggcctccgtgctggcagagatcagggctgagcggtgttggctgaaataaataccaccccggagaagatgggcaaatgcagacataagcaggtgccaggggtcacaaaggggaatcaaagtctgctggtactggtggcaggcagctggtagggccccccaaggcaggcaggttctgggcctgggggccctgggagtgggctggtcctctgggcacgaggacatcaggaactcacggtgaggaagcaccggggtcacccagccccggcagccggaagctgaaagtgcatttgctgagagccatctgcttccccgcagggccttgtgatgtgagcccgaggtccccggggggcgaaggcagagggtgcgagagctgggacagtcttagggcaatttggggtcctgggtgccccaaagggaggccggggctttgtgtttcagagaaacgcagcctgttccgttttgaagttgcccaccggctggatgttttgctaatttagtccacatcgtgtttgctcagaaagaggcttttggccacacgagtgctttctgggaatgtttcttctcccgggaacagaatgtcaggctgtgggagctgccgtggccccaggaaaatgatgcccagctccaaggctggggggttggggtgcttggagctccagctgtagctaggaaggtgggggatctcccaagggacctccagctgtcccccctgcaccacaccggtgactgctgagcccacacctgggtcccaagagtctcatcctagggacgggcagatctctgtcattctgttccttgggttcatttagaggcaggtgtcacctgggctgaggtctgcccacccaccatacagagtcacaggctgatagggacaggatgcagccagatggtgtcgtcctgctctcagcagggcagccgttaggaagagaagccgctctgactggccaggagaggagaaagattcctatggggccgccaggacttcgggatgggaccccacacccctttcctgaacccaactccacggggctcaggccagctgccacctcctcatttagatggcagaaccccaactggatgggggacacatggcccaggcctggcactgtacaactctgcctcctttccccttccagtggaccacagtgatgggctctgggtgtccatgtgcggtaagaggggagtagcttgtgtcagaccaccaaccaaatcgaaaagctacccatagcacactacccagcaatacaaaagaacaaactccaggccgggcacagtggctcacgcctgtaatcccaaagctttgggagactgagatgggaggatcacttgagcccaggaatttgaggctgcagtgcacaatgatcatgtctatgaacagccatggcactccagcttgggcaacatacagagaccccatctctacaacacacacacacacacacacacacacacacacacacacactagctgggcgtggtggtagtgtgtgcctgtggtcccagctactcaggaggctgaggcaagaggatcacttgagctcaggaggtcaaggctgcagtgagccatgaccacgccactacactccagcctgggcaacacagtgagacctcgtttgaaaaataaaagaataggcctggcatggtggctcatgcctgcaataccagcgctttgggaggccaacgcgggtggatcacctgaggtcaagagttcaagaccagcctggccaacatggtgaaaccccacctctactaaaaatacaaaaaaaattagccgggcatggtggcgggcccctgtaatcccagcttctggggaggctgagacaggagaatcgcttgaacccaggaggcggagattgcagtgagcccagattaaaaaaagaataaactatggatacacgaaacaacacaggtgaatgcaagggaatcatgctccaaagattatccgctctgattccatttacctggcattctcaaaataacaaaattacagacgggtagggggaaaatggcttagtggttgcaggtgttgaggggagagatgaagttatggaagagcagctggaaggatcctgtgcagatgggctgtttgttgactatggttgagattacacaaatctgcccatgaggaaaccgcacactgttaactacaggcaaaacttccctagtccaaaaatcctaaatctgaaatgttccaaaatccaagtctttttgagcagcgacttgacgtgctcaaaggcaatgctcattggggcatttcagatttttagattagggatgctgaaccttagctaactatataatgcaagcattctgaaatgtgaaaaaatctgaaatccgaaacactgctggtccccccagcatttcggataagggatccttgacccgtatgcgcgcgcgcgcgcgcacgcacacacacacacacacacacacacgcgcgcgtgcgcccgcgcacagctgttcgctggtgggtgttgcgtgggccagggtggagggaggatgaatgtcccactttgtccccaggaactctgagcctctgaccctgagtcactcccactgccagtggggggtcggggcggggcggaggagtcggggcaggtcgtcgggggaggttggtaggggagggaggtggggagatattgagcctatgtctcttatctctggggtgggcccagctgttacctgtcctccgcctccccttcaggctcagggtctgagtcctccacctcaaggccggctccattcagcttcacgtcctgctgtaaaggccccggggccacagaagccaggtcatccccgtaggtggaggacgacgaggccggcagccgctgctctggaaggaagggggcctcggtcgggagggcgtggcggggaggggacccaagggccgaggggaggagatccgtggcccagagcagcagcgatggtgtccccgaggctaggcggggggtagggtcctcaccgagggcgcagcagctgggaggcgcgggctccaggggcgcggcctggcggcaggcggcctcccgcaggcggcaggcgctggcgtagaccaccccgtcggagccgcacaccgggttcccctgggcgccgcagtcgtggtcgcagccgcatcgcgcgatcgccgccccctcctcaggggccacggcagggcccgactcgccggggaaccagcctgggggacgaggcaggctcgacagaccccccaccctgaaccttgcccgcgcccccacagaacctgggggtggggaagatgtccctgggtcccgggcccactaccccctcggtgggtcttggggcgcgacagttaatgggaggtcctgagccctggccttatggaatttcacgcaggtatttgcctaatacttacaaaaacagaaacagacttttaaaaagcggttgtaggagagaaaggagacagggcgtcctgtctgggccgccctgcaacaacagccccgtcccctgccgcgcctcctccgcactgaccacacccaccccaaccccacccccaccgcactgaccgctcctatcctcaaccccgccccctccgcggtgaccacacctaccctcaaccccgccccctccgtcctgaccactcttaaccccgccccctccgcactgaccacacccaccacaaatcccgcccctcagcgctgaccgcacccaccctcgaccccgccccccgcactgaccacacccaccgcaacctcatcccctcagcactaaccacatccactctcaaccccgtccccttcgcactgaccacacccaccccgttcggccccgccccccgcactgaacacacccgccctcaaccccgcaccctccgcactcacctccccctcgccgctcgaccccgccctcaccacactgaccaccctcaacccattgcgcccagtccccaccacagtgaccacaccctcactggctcggccctgcccccagtatactgaccattccccagccacttcccttccgcacttaccactcccccagccacgcccctccccgctgaccgctcctccagccccgcctcccccgtacaggcagagcgcccgcccacctctatgctgcgttctcctgactttacgttggcccctcctctgccaagcccccaggggagccctccctggcgtccgagggtgggagtcggggtgtggcaggccgcggtggggggcggcagtggctccgcgcactcacccgggccccgggcaggggcgcgctccacttcgttgcacgcgggtccggcgcacagttcccgggcgagtgggctgtgggtgctgacgttgtagaagcgagtggcctcgaaggctacgggacgagggtggcgggtgaccaagtgcaggcgcgacgggtcagggaccgggccgggccgggggtgcgggcgcgcgggcctaccgggttcgtagtagtcgtacacggagactggcagcgccgacgtcctgcccaccacgcactcccggagagcacggaaccgcacgcacgtcaggcaccggctggggatctgtggggcagcggcgggcgcaggctcgacccgggccaggaggcccggggcgctgagctcaggcccagaactggctgatttcagggatacccaggacgcgtgaaacacagaagaaacgtgatcccattttctttttttcttttacttttctttttttttttttttcctgagacagagtctcgcgctgttgcccaggctggagtgcagtggcgtgatctcggctcactgcaagctcggcctcctgggttcaaatgattctcctgcctcagcctcccaagtagctgggataacaggcgcccaccaccgcaccctgctaattttttgtatttttgatcaagacggagtttcaccatgttggccaggctggtctccaactcctgccctcaagtgatccgcctcggtcccattttttattctttgggtccttccatcccactgggaaaacgtctcaggtggcctctgaaacaccactcctttttgtgtgtgtgcacgcatggctgagcatgtgtgggtgggagtcagcacattcacgatactgtgcaatcatcacctctgtctagttacagaacggtttctttctcccccaaagaaaccccatcgccatcagcactcactccccactcccccagcccctggcaaccacaaatctttccaactctacggatttgcctgttctgggcatttcatgtcaatggaatcatgtactctgtggccttttgtgtctggcttctttcactcagcatcatgtttctgaggttcatccatgctgtagcatggatcaatgcttcgctccttcctacagatggataatatccactgcggcccctccctgctttttctaccaactgccatcagccgagggcacagagctgtcagcatggccaactctgcctggaatttattctcccagtgtcttatttttttttgtttttttttagacaaggtcttgcaggtcttgctctgtcacccaagctggagtgcagtggcacaatctcaggtcaccacaacctccgcctcccaggttcaaacgactctcctgcctcagcctcccaaatagctgggattacagtagcgtgccatcacacctggctaatttttgtgttttttgtagagacagggttctgtcatgttggccaggctggtcttgaactcctgatctcaggtgatccacctgcctcagtctcccaaagtgatgggattgcaggcgtaagccaaagggcctgggcacttttttatattttttgtaaagatggggtctcgccatgttgcccaggctggtctcgaacccctgagctcaagtgatcctcccacctcggcttcccaaagtgctgggattacaggcatgagccaccatgcccggccccagtgtcttttttatggtacaagatacttgcagggagccacaccaggcagtgaccggtgcaccctcaccaacatgcacaccagggaagcctcctccaccaaccccggctggtggtacctcatcaaagtagaagagcactcggcgtccagccacttcatacctcttcatccccatgtgcttgtcaaggagcagctgcagaggaagccagaagtcagggtcctcagactctctacttgcttcctctcccatcccctgggggcagtggtcagtgggatgcttggacttgcccacaagttaccatgggctggggtctgggtgctggtcagtgctccccaggccctgccagcctctcagcacccaggagaggacgctcaaggatggctatccccgctgggagcacctgcctcgcctccctatacactccctcaacccagccccaagcccaggtcaggcttctccgtggccaaagaggtgcccggctgagccctgccgcctgctggtgtctcagctgcactgttcaagttcccctcccagcctgggatttttttttttttttcagtttttgatttaaaaaaatccacacccactccaaggcctctgaattgaccacatcctcatcccctggtgctccgtgcagcctccttggaggggaggtgacaataggcccagctttcctgttccaccctccccacactgcagacctcctttggtccctgaaaccctcgcttcttggtcctctttctcccccagccagagccgggcagcaatccccacccccatgtccctcttccttcctgtacaaaatggggacatggcactggtctgtcttagggttgtgagggtgacagctggtctcggcagaatgtggattgagaataccccatggctccccacccagggccaaagcacatggaactttgctgaagttctaggtggcatttataatagtgtgacagtgggcccggtgctgtggctcacatctgtaatcccagcactttggaaggctgaggtgggctgatcacccgaggtcaggagtttgagaccagcctgaccaacatggagaaactccatctctactcaatacaaaaaaattagctgggcgtggtggtgcatgcctgtaatcccagctacttaggagactgaggcaggagaattgcttgaaccggggaggtggaggttgcagtgagctgagattgtgccattgcacagcctgggcaacaagagcaaaactccatctcaaataataataataataataatagtgacagtggccgcatgggagatccacctgttggagcagcccccacctcaccccatctactcctcagtagacagatgggccatttttgcccagaaaggggaggaaaaaaggggctgggcatagtggctcatgtctgtaaccccagcactttgtgaggctgaggcgggaggattgcttgagcccaggagtttgagaccagcctgggcaacatggcgaaaccctgtctctgccacaaatacaaaaattagcagggcatggtagtgcatgcttgtagtcccagctactcgggaggctgaggtgggaggattacttgagcctggaagttcaaggctccactgggaatttgagccaagatcagatcattacactgtagcctgggcaacagagcaagactatgtcaaaaaaaagaaagagaaacagggtaaaaggggagggggaggggaagggggagggggagagggagagggaagaaaagaatacccatagcattttacaaaggtctggactgccagccagcctgacctgggtgcctaagccctacctattgttcagagatccctgcccaccgctgctcaccggcgctgcctcacctgctccaggctctcgatgtctgcccggaagcctgacagcaggggcacctccaggacagccatattggaagaccctgcatgcagccaccttccaacaacaggggagagagagaggccctagagctcaagcccagaggtggaattcaaggtcccctctccccctggagcccacacagctgatgtcccaggaagcctgccctggggcctggccggcaggccaacagcacacacatccttggctcggtcaactcagtcaacctattttacagcagggacactgagaccagagggaaagggccttgccaagggctctaggcctgaccaggtctcttgactaagcattgtgttctgtcctggacttcactctgtgtccccagcctgggaagcagctggcgaccccactctggacatggttgcacagagcagccacagctcaggtgcttcaacactgccaccctgcaggagactctgggaaatcaaccccctagctccggcctcagtttctccttctgtaacatggtggggcggggagggaggtaactgggcactctctggagcctgcaatatgccaggcgcttcctatagggcgttggggacaaggaagaggaagccaacattcagagtggagcttgcagctgcggggagtgcaccaagctggactctgatttccagaactttctgagatggggaacttggacacattcgggctgagagtcaaggtcagggcagccgttaccggggtagcggctctgatgggctgcgagtgtcatggcaaccactcacccaccaatcgtcgccatggtgacaagca

SEQ ID NO: 1079 - DNA, 92313 bp, Homo sapiens
taatgataataaaaaagatatttgccttgactataaagcaaaattttaattgaatgtaggcttagatactaagaaaaaggataacaagccatgatttaaaaaaaaaagataatttcctctggggaaaaaagaaagaaaatgaaaaaaagaagaaaggaagaactaaagctgctgctgtttaattattaattaactattagctccttaatagttcaaaaactgagacaggtcaaaggtcagagacagaaaataaagaagtaggatatggatttaagaaatcactgggaggccttgtattctaagtacatattctaggaaaagccataatctaatttaacatctatccacattcgtgaaaatttaggttgtaaggaactgcagaatatcattagaaagggtgtttaaaaagcatggcattaggttaaataggccagtatgctaaagggagctaaacaggatgacaagatgtgttttagcaaaatagttcatgaaaatgattacttcaaaagaagttttcttatactataaacacctgtatgcaaataaactagaaaatctagaagaaatggataaattcctggacacatacatcttcccaaaactaaaccaggaagaagtcaagtccctgaataggccaataacaagttctgaaattgagggagtaattaatagcctaccaaccaaaaaaagcccaggaccagactgattcacagcagaattctactagagacaaaaaggggagctggtaccctgaaactattccaaacaatagaaaaagagggattcctccctaacacaatttatgaggccagcatcatcctgataccaaaacctggcagagacacaacaaaaaaagaaaatttcaggccagtatccaaaatcctcaataaaatgctgtcaaaccgagtccagcagcagcacatcaaaaagcttatctaccacaatcgagttgacttcatctctgggatggaaggctgggttcaacatgcgcaaatcaataaatgttatccatcacacaaacagaaccaatgacagaaaccacatgattacctcaatagatgcagaaaaggccttcaataatattcaacagcccttcatgttaaaaactctcaataaactaggtattgatggaaaatatctcaaaataataagagctatttatgacaaatccatagccaatatcatactgaatgggcaaaagctagaagcattccttttgaaatctggcacaagacaaggatgacctctctcaccactcctattcaacatagttttggaagtgctggccagggcaatcaagcaaaagaaagaaataaagggtatttaaataggaagagaggaagtcaaattgtctctgtttgcagatgacatgactgaatatttagaaaaccccatagtctcagccccaaaatctccttatgctgataagcaatttcagcgaagtctcaggatacaaaatcgatgtgcaaaaataacaagcattcctatacgccaataatagacaagcagagagccaaattatgaatgcactcccattcaaaattgctataaagagaataaaatacctcggaatacaacttagaagggacgtaaaggacctcttcaagaactacaaaccactgctcaaggaaataagaaaggacacaaacaaatggaaaaacattccatgctcatggataggaagaatcaatatcgtgaaaatggccatactgcccaaggtaatgtatagattcaatgttattcccatcaagctaccattgactttcttctcagaattagaaaaaactactttaaattgcatatggaacaaaaagcctgtatagccaagagacttctaagcaaaaagaacagaactggaggcatcacgctacctgactccaaactataccacaagcctacagtaaccaaaacagcatggtactggtaccaaaacagatatatagaccaatggaacagaacagagacctcagaaataacaccacacatctacaaccatctgatcttcgacaaacctgccaaaaacaagaaatggggaaaggattccctatttaataaatggtgctgggaaaactagctagccgtatgtggaaagcagaaactggaccccttccttacatcttatacaaaaattaactcaagatggattaaatacttaaatgttaaacccaaaaccataaaaaccctagaagaaaacctaggtaatactattcaggacataggcatgagcaaagaattcatgactaaaacaacaaaagcaactgcaacaaaaggcaaaattgacaaatgggatcgaattaaactaaagagcttctgcacagcaaaagaaactatcagggtaaacaggcaacctcagaatgggagaaaatttttgcaatctacccatctgacaaaggtctaatatccagaatctacaagcaacttaaatttacaagaaaaaaacaacaccatcaaaacatgggcgagggaaatggacagatacttctcaaaagaagacatatatgcagccaacaaacatatggaaaaaaagctcatcatcactggttattagagaaatgcaaatcaaaaccacaatgagataccatctcataccagttagaactgtgattattaaaaagtcaggaaacagatgctggcaaggccgtgaagaaataggaatgcttttacactgtgggtaggggtgtaaattaattccaccattgtggaagacagtgtggtgattcctcaaggatatagaatcagaaataccattggccccagcaatcccattactgggtatatatccaaaggaatataaatcattctactataaagacacatgcacatatatgtttattgcatcactatttacaatagcaaagacttggaaccaacacaaatgcccatcaatgatagactggataaagaaaatgtggcacatgtgcaccatggaatactatgtagacataaaaaagaatgagttcatgtcctttgcagggacacagatgaagctggaagccatcattctcagcaaactaacataagaacagaataccaaacaacccatgttctcactcataagggggagttgaataatgagaacacatagacacagggaggggaacatcacacaccaagtcctgttagggattggggggcaaagggaggcagagcattaggacaaatacctaatgcatgcagagcttaaaacctggatgacaggttgataggtgcagcaaaccaccatggcacatttatgcctttgtaacaaacctgcacatgtatcccagaacttaaagtaaaataaaataaaaaagaagttatcttagtataaaaaaggagaaaaggttgtgtttttttgtgagtgttgaaaaagcataatgagtaaagtattagggaaatgagtgcattgaggaggaggatggggaaggtagttaaatataaacctggttttatttgcaaagctttaatcttgataaacgggaccttcttaaagcaaatatcttatatagggagctcatatttgggtttcaaaatctaggttatagtccaaacgatttcaaatctgagagaaactttttttagagtccattgtacttagtgttaatatgacaacaaaccacaaaatattaagaagccagtaattatgaagaaaaaataggtaattattcaaaccaagacttaataactgaaaatgtataaataagtttgttagatctttgagggctctgccagggactattctttgcagtagctaaaacttccttttctataaatgattaacaagaaatatttgtttaattgacttgaaaaactccaaacatgctatgttcacttttaagaaagatgattattagaaagttaatttatgctaaatgaagtataaataagaactagattgcacatatgtttgaatcttgatatctttgccatctattctgtgaattggattaaggtgttctacccccagaacagaaagatgctgttttccaaaatagcaggaaagaaattagattaataaaaataattttctctatttacgtttttttgcattaattgttctgaaacatttgccttctattgccatttgcttatgatagaatcttgtgcaagaacataacaattttgtaaaaatgcagttgttacaccttgcagaatacacaatcttgagctcattgtcacagagtagataacaaaatcatgccttagagaaacagtatttatgatatgagcctttgcctgaaggaaaatgatttttagaggctgtaaaatctacctttggcttaagccagaccagcaaagagcccctgcacatggaccacacagcagtggcctctgaagacttgtttttactgaactgtgctttggtgggaagtcctcagcaccttctgcacagaaagcagcctatataatgtgctcttgttagaggcattctgctcattacatagtgacctctttctgcggacctttgggagaagtttatttttaacttcagtctcaataaaagtgtgctccttttgtacattttttggggacaccatatggtataactgataaggtttttttgtgcattggctgtttaaaaagttcacttaaacccaagttcacccatagcaaggtcgatagctttatgatatgcattttcctgttagcttttttctgcttcctgtttatgtttctacctccggttttgctttcttccctacttctaacatatgtcatctagtagtattttttattttttttaagcagccttaagtcttggggggacaagatgagagagaaatatattcattcacacatgcctaaaaatatgttgtatttagtcatttgggttttattttctgccaagaacattgtgtttcacaattattttgccacctgaagaaatatgataactttttatttaaaattctagctgctaggagtgcagagaagattattcataatgctggcaaatatgaaaccacactatcatcaccagccaataatttttaataacctactttgtgtattgcagagaagtacagttttcacaatatctactataacctagcatgctgactgttctttctagtttattttctggcacaatttatttacctctcccatttaaactccttcattggcaactaattgattttttttttggagagaaaatttttacttgattttatttaaatcttcaaatttgtggatagtttgataatttctgaatcctatactaggcctgtgggctcaggatgtaaactaatgccaatagtccctacccctgagaaaaacataattaggtcagttaaacccactgaaaaaagtccatgcaagctgttcaattatttgtttagcctgaataattaaagcttgacctctatgtgaatgtcttcagaactctggctaagtacagttgaaccagacatgccacctactgggaagagcatcaagtatgggtagaaaatagagctgcaataaaaagtaatgagcagtggatggtggtgatggctgcacaacaatgagaatgtacttaatgccgctgaattgtacacttaaagagtaacttttatgtgtattttactacaatttctaaagaggtaatgagcagtattaaaaagcattagagaatagtagaaattaatattagtaattaataccattatattcatagtatatcatattttcattataatgctaataataaatactgatagaatgcttactatgtaccaatactattgcaatcatagaattatagcctttgtcactatttctcccagtctattcataaaagaaaagctttttaaacatttttacttgtcacatctgtaaacaaggttgccacattccagactttcagaaagtctttttaatcagcaggaaggaacttcaatacaaggtggagataactaagacggtaaagccattaccaaatttcctgtcaataaaaagcaggtggggtatgaaattaactgcacaccattcctaagacattgagaagcttcttctaagtgtaaaacatgaaagtacagatgaggtagaagtggtttagatgtggaccagtggtaaaaataaaaccatcgcataagaactttgaactcttgtcattgtccaaacatcctcaatgattgtctcatctctccattagtcaatttctcacatacaacatacttttacccgtcttctccccactccagtgtcattctcctatcaccctaagcaagtcagaatcctgttcctcatgggcgtcttctataatatttccaaaggtgacccacttttaatctggtcactaccatctgtaattcacgatttggagattagggatatgtattgtatctgtttttgtgtctttccccaccctcacatcatcagttctacccaggtaattcttatttgttttgaccttgcacatacactggatttatgggcatggtacaggagatggagggaggtggataagtcattattagactatatagagagggtagggaaaatgagtaggtatgtcagagaaagcttaactgggccctgaatttgagcataaagctcttatttatcctggtttttattgatccttatcccagtcctctcttctctggagttctgcacaggttgccttcatacacatctaatatcagatgacctaggttaaatcatctccaaaagttttcacagtctgattccatcccacaaggctactcatctaattgtctttttctttactactcagggtgtaatctgttaggcttaataggctcatagtgtctatttgcttcttatgtttgtcttctctatgcaactagatgatgtatttgaataagccagagaagtgtcttttatttcctttatatactctcccctacaatgcctgtcatagtggtttgctgtgtcgatagaatgagcttaatactttttaaaaaattaaaatgatggtacatgtagagaggttaatatcaagttttctttacatgtaccaaatgcaaaatacatgtatatgttttggtggggacagttcatacaagccagagataataaaatcttaaagctctgtagtctctcccaacaatttaagtacttggatatgaaaaaccttgttatctgggcattgaccatgtaaatattattccacacataatcattttgtctttgtctacagctttccctatctctaggctatgagaatatatgaacttgggagaattaggcattcagaattttccataaaatacttctccattaggaaatataaaacaagaaaaatgctaacatggagctatcagatatttttaagtatgtgttaggcccactgcattggggcatgtgccaatatttcgtaaaaccaaaattcactgcctagtaaattgttccttcctggtctgtccagagaagtaaatggtgaaatattcatggctcttgggaacatccaagctatttggcaagagcttttccctgggtttgccaaaatggccctgaactcaaaatatggtgtttattcaaaatgattataaaaatggcatgaagtttgttatttcttttaataacttgaaagaattctggagaaataatttcatgtttcttctagtcctttcatatttttgatacattcacagctattcttttccaaattgcaattagaatgactaataatgtttagaattttatctgttggtttctcttaagtcatgattctaccgtgagtcatttaacttctttccaaagcacccagttgtaacaaacagtggtttatgtcactggagacgtactatgtagtcaaacttgtaatttcatctaagtgagatcagagagagaaataaaaagtgggtatcttttttatttcaaaataacaggggttttaatatttctacacagcattagataatagcccaaacatattattgatccccaaacaagtattttccagatcaattaatagtcattatcaattaatattcatgtctacctgtctgagcaatggattagaaacattataagtttcattttatggaagagaaagcagactaaaagtctagggatatgatcatttggtttctggtttcagttctgacactaacaagcaatatccttgggcaagttgtttaatctttggggccttatttttctcaagtagagaataacgaagctggatctcatgctccattcccatctcttccctaccccccattatttcataagattttcttgcccctattatgccttagtaaattctagatcaagagagatcctgcccaatttcagagtagagaagcccaggactagctgcgtaatttgtggggctcattgaaaaatggaaatgtcgaattccttcttaaaaaataaaggatttcaagagggtaactgcaaagcattaaatttagcatgcggtccttctgagcatgtgaccctttgcaactgaacagatcacacacatccaagaagctggccctgtagaaaacaaagaaatgttttcccccaccttccaacattctcttttgctcttaacggaatggaaatcttagaaatgttgatgggacaatgacatgaatcatgaaaagaaaggaatagtgggaatacgaatattagaaagccaatgttttgtggatgtttgaaactctcatatacattcatagggcttaccccactggtatgggcaacaggtaactctggtagtttctaaagatgctcccagtgaattatgcctcctggtatgtggtccttatgcagttcccttctacactgaatcgagactggcctgtaatttgtgttcacaacgaatagaatgcagcaaaagcaaagccctgtctcctagagattctggtatgttgtctctttgttctcattggttttaaggaacttatttatttctgccttaatttcattatttacccagtagtcattcaggagcaggttgttcagtttccatgtagttgtgtggtttcgagtgagtttcttagtcctcagttctaatttgatttctctgtggtctgagagattgttatgaatttcgttgataaaattttatatatttatggtatacataacattttgatatatgtacacgttacaggatgattaaatcaagctaagtaacaaatccataatctcacataaattttttttggttgctcttttaacactaagttttggggtggtttatttcagacaccccaaatgactgtctatctcatgtgattttaaggatgtctaaaggttccccagttgtgcaatatctacaggatcactgaatgccaagtccccagggaaaggaatgatgaaaggggaagttgctggaagaagagagaggaggaagttgaggccatagagaggaaggccctgaaagaaaactttaactgcttgccagtttggccagaggtctctttgagcaggaacaactgcatttagaccagcagttcccatgctctgttttacaggtctgagctttccagtaggtgaaattatgttttgaaactgtgtgccatgtagtaccagctagaataaagccaacattacacattcagttctaccatggttatttcagttctgttccatatctaatgaccaccaaccttgaatatcaatgtgtgcagtccttagggagaccaggacggattcacaatttcaatggggctactggaaagatgcttggctgtttttttactcatggaaagtcagaaaaatcattgttatatgggaaagacaggatattttaagtacttatttcatttgataatattgtttttctcttcactcaagaaaaaccattaaaaaatcatgtgtttgtgaaagttatccaggtctatcaattattatttaaagtaatatctgttttactagtgtgtaaaggatttaaaagagttataatgaagcattttaactacataaatattacttcatagcattttcaatcattaagaaagataagcccttttcttgttggttcttgatattttcctacctgtattcaaattaatgcagaagtaatagccattatcttacttactggtagcaaggagttacattataaaagcttcttgtataaaattttattcactaatagaaaagaaagagaaatagtggaaaactgttaacatttaacacagcgtaaaatacattgcccattctaaatggtttgaggtcttaaagagtctcttccaggggtttttgaatgttcaattctagtaaatatcacagccaaagagttccaggcgaagtgcaatactttgattccatgttttaggaatgacacggataaacctggaaatgattggggggttgaaaaagttcttcacatgtcctttggtattagtatttccttcaaaaatctgaaagccaaataagagaaaatctttaatgacaacataaatggctaaggttttttgtttttgtttttttttagacagggtcttattctgttgcccaggcttgagtccagtggcacagtcatggctcactgcagccttaaactcctctcaagtaatcctcttgcctcagccttccaaagtgctggcattgcagacatgagccatcatgcccaacccagaaaattttttatcctattagctcaaaatgagcatatcaaagaacacatagaacactctcacagagatgatcctctatcagttatgaaatcacatgccagatagatttcatctcaccagtgatctgacttaaattagtgaaaaataaacaagtctcacatggtgctgtggagcagctgcaaaaccatttctgccttcagcccgtctgtattagctgtatgactgaacaagttacttattctctgattcttcatttcctcattggcaaaataaggataataacattttacctcacagaagtcattgtaaatatttaaaaatgtatgtcaacgtaagtgcatagtaagtgccaggaagtggccaccaataaatgtttgactattgctaacatttaaaatgtgaccatgcattttaatttatttattcttgttggcatgtaccttatatcctcaactaaagtgtataactttcccccttccatcatcagcaagttccccaaggtttacacacaccagaaataaaatcactctttttttttatgacaatgatatttatcctcctatgagggcaacctggtgtagtgagaaataaaacaaaccaaaacagacaaccaggagtttgtctgagaccaggcaccttaagaactaagatttagaagacttaaagaggtggtacatgtcactgcatatttgtcaaatgcaaaatactgttattctcattatagcacagtcttcagattgctttctctttgcccagatgccactctaccttgtccaccatggaggatttcagcctgtatggtttccattccactccctgctcactgtagtggatggtatagctctttacatacatttcagaggacagagacttgcagccctgtgttataattgccgttatcttcttgatcttgagtagatcaatttctagccactgcttattgttgtttgcctatgaaaatgacaaaaacacatagataaggaagatgttaaaacctttgctttttttttagaccaagttatgcaaaaaagcacagagctcaaaaggattttgttctatcttatcccttaggattcacagtctcctagaagctttccctctttcttcttcattgccacaatatgtgtgtaaatttttattgaagtatttcacacattgtactataattgtttccttcttagcattccttactgcttaagggtagaggcttatttcattttgtttcctggtactcaccacaatgttaagacactcagttggtgttcaataaatagttgttgaataaatgaatgaataaatgagctttatttggaaaaataattaaactgctaaattatctgtgaatattattttcttaagcaaatttctttaaatactctggtaatattgctgcagggttatctgggaaataattggatagcattctctctctatttcacctgttttacaaaacacaacttctctttccccctgttaatgtcaaagagcagaaatagttcaatttcttctaatatttcaaataaatgtaacatttgagagacctgataaaaccataagtagagcttgatacacagtacagttattgtcctgtctctggcctaacaaaatgcctaatcacatggttggtgatatgtgtttggagaaagatcagaaggtctaaactgagttttagagtcatctaagataaatttttacctttgggagatttatcgtctaccataacctcattcaattctaaaggaaataatattgatatgtttcttcaacatcacccacacatacataagtgtatgtgtatatataggtgtatgtgtatatatgtgtatacacaaaaattcacatgctatatgtattttaaaagcaaattaactgaattagaatgattatatgagaaaacttttaagtctataacatcctctagtgacatctgggtggtatcttagtgtgtcttcatatcaaggttgtaccagtgatgcagagtataaccagctagaggttttcacaggcataaaagaggtagagacattttagttatggagagaacagcatctatgtgcatcactgcatatgtccagctttgattttcaacctctctaaagagaccatataaagacatttcatgtgaatggaagggggttaagtaaaacacatatttctgatcccgaattctaactttgaaatgacaccattaaaaattagcattttatctttgaggcccttgttatatcacaaagactaagagcaaattatagagagtgcaaatttttttaaaagattgtaaaatgaagtatggagtgacaaggttataccatgaacaagtctaaagagtcatctgaaaaagaattggataacatctctttaattattatttatattgctatgtaaattatataaatgtaatataacactatttttattattttaacttctctgggtgtcagctttgccctctgcaaaattgcaaaatgaggtatttgggctgcttcaaatggtggaaggagcatggcctgtttactgggagaatgggattctagtcctgattctgctaccaaactaagctaaaattatttaatctcctgtgtatttagaattaaaaggaaaaatctagaccagatgctttgctccttgctactgtaacattctgtgattccatattgggccagaatgagtttcaagacacagatatcagttcccaagactgtgtggaatccaatcttttctatttacgccaccagcaccacaattcttttttcctttctagtggcctaatttaaggataggccctggaattctatagaaagccaggaaattggagtgtaggtatcttaagggagggagatatgaggatagaaattagggaatttggatttagttggctgaagggatcatcaagttattcatgccattctgatatctcaggtcatttaaagaattaataaaaatgagtcaaatattaagagttacccccaaattaaatcacctgaattactcagtgggctaatatcagggacagtataactctctggaaggtgtttgtttaacttagatcactgattttataactctggttttgcaacattttactatgcttctagttgcctcaaggaatatcacaaagctcttaaaataaggagggcggggaagagaacaaaaaagtttagatgacatttcatttaggaaaatgaaaaaatattgctaaattgtaaagaaaaaataagagatgatgttgcaaatctaaatcatttttttatcactaatgtaagctgtctaaatgaggagttggcaaactatgatccatgggccaaatttggcccgctgcctgttttttgtaaacaaagttttattagaacacagccagctcattcatttacatattgtttatggctactttactgctacaatggcagagttgagtagttatggcagagaatgtatggcccacaaagactaaaatatttaccatctatccctttgcagaaaaattaatttgcttattattggtttaaatcaagactagaccaaaaaccacagagatgataaatgacttctctctgagacaaagttatagtcaaagctatcaagtccacagacatcctggactcttggacctaggattttaatctgcagaaacagattaaaatactcctgcttcccagatcctccatgtttgtggtagtgagggcctttgctttcttctggagccctaagagaacaccatgcatagagtatacttgaccttggcttgccaggcattcacacgtccctgggcattcagacgggcacggaagggttcccagtaatctccccaccaagatttcttaaacgaagaagctgtgatttgcttgttttctatctttccattttccatacccaggggtgtggaacatcctatcaaaagaaaagtaacgtgattaattacacaccaatattccctgcatggcttcatgcactgcagaggagataagaaataatattactaccaacaaatgacaaaaacaataaccacaacaatgaagatttattgaatccaagtgccaaatactgttctcaggctttacatgtattatataatgctcataaatatctccattttagtacagccaaaacacagtaacttgtctaaggtaacacagccacaagaatcagaaactgaattgagttcagacaatctgataccaaataccatgttctaaacatttaaactcacttcctccttctgagagtcttggaaactttggtctttgctttcaggtgacaataatcctaaattatctatatataaaaatactctgtttcttctaacaaaagctaccaagaagatacaatggaccctcagtcactatttaatattttctgtttcaacccttagagggtaattcgagttatgtaccctttggaatttttccaaggtgtaatttgaatatcataggcagcaaggcagacctgtgactgtaagaaacacagctagtgagtgaacctggctgaccacccatcatctctgtgacactttgttcttgttggtaaatcatgcagaaattttcttgaagtgatgccttactttctccatgaaaaaaacaaagggtcctaaaaataatacccactgctaataattacctaagtatcaagaaaatgaataagaagaaaataatgcttcttgtataaaaaatagatgttttaaataagttagcagaattgaatgtcacattttagggtagtttattaggatctgaacaaatctatttataccatatggaaagaaaaaaacgcaatgacttatggaactgtttcaaggagtggtcctgccgatacaagatctgtgttttatttgggagatgttttagactactgctatctggacattggcaaaatacccatatccatccaagggtatactgtgccattatctgcttcaacaggaaactgattccaggtttcagctactttctccattgtgaatcatggtggcttctctccacccaaagggaagtactgcaactcctgacaggtgtgccacggcaggtttctagtgcacctatttattgatccctcttcccacctccagcccttcagcagccaagtggggcctggatcagccaagccttagatttattgcttcattcttttacctcagaatgccaggcagatattattttctttgtgtgctttgaagtaaaaaatattggaaagcactgctttaagagtccaagaagaacagttaagactcttaaacatccttgctatatatagtagaattttattatgaccatttatgattacctggatttatttataccacaggtcacattacagcccctgagaaatagcagctaacatagaaaagacttgagtacctacacagggtatgaaagaaaatataaagaagaattgtggtttcaggaagttgggaagccaattcagatttcaaaaacactcattgaacaccatatatatggcagtgatgttgccagatactgtcatgacattgaagtttgagtgacctgaggactttggaagagtcaggcctagtttgaatctcaggtaggtcttattgaaaatgggctgatggaggtaattccaaattagagcccttccttggagagttgtgatgtgtctatataatccaggcactttcttcacagagatgctgtcggcactctgattggcagaaccattcttggtctagatcacactgagagtttacctgagtagaacctctgtttcacaaaggttttcctaggagcctaagtcactgaaaagaactaaaaattctactcattctcctatacctcccaaatcttgattctttgagtggcagtgagaaaataatgcatctttgtaccttaccatttacctcacaaccttgcagttccaatcgaagggtaggtctgttataggctcgagttggagagatcctaatatatctagccacaataggtgggtcaaactgattctcttttattgtagaggcatctgaattgccattaaaatactagaagaaaagaggaaagtttagttatgtaacaatgatctataaagtgactttatattaaaattttgatctaatttaatattgtaatactacattttcatggggtccaaactaaatcaatttggttataaaatatacttggggataattccagttccaggaagattgtatatatgtactttgccctattcctcctgctaagtacaactaaaaactttggacattatagctcagagaaacataagaccctgaaaagagctcagaagacagactggctagggttctcggaaggaacaaaatggtgatcagtgtcttgaattttctttttgcctcataaatcccagacttagagatgaagaagccggcaacctggaaacaccaatgagtacagactgaaaaagcccaaataaaatctgctttctctaaccaaagtaccagtaaagggcagcatagcgagatatgatagaaaactggtggacactgacttctgtcctttagtcaaacaccacagaaaaacctgaggcccctccccaacccacaacagcaaaggctgaatggggagcctagacttctatgctcctgaggctaaagaggcaccctacaccctcactggggttgtgtcagaaaaggccatgtagggatttagggctttcatctccagcccctaatgaagctcctgcccctgcagtatcagtggaggccaaatggggaacttcccttcccacccagccaccaaggaacaatcccttcttaggtggcaatggagtggggaacctggactttgacccccacttggcagtaaacaggctgtgccctaccccttttcctgacagagcaatgtcagaaaaagccaactttttaaaacagaagattggagcaggtatcggtaatactgaaaacagaaaaacaatagagaaaaatcaataaaacaaggctggttctgtgaaaagattttttttttttttttttttttttgagacggagtctcactccgtcaccaggctggagtgcagtggcgtgatctcggctcactgcaacctctgccttccggattcaagcgatactcctgcctcagcctcccaagtagctgggattacaagtgcacgccaccctgcctaattttttttaatatttttagtagagagggggtttcaccatgttggtcaggatggtcttgatctcttgacctcgtgatctgcccacctcggcctcccaaagtgctgggattacagacgtgagccactgcgcccggccaagaagatttttttaaaatcgacaaatctctagcaagattcacacaaaaaagaaaggaggggcagatgacaatatcagagatgaaacaggcaaaatcactacaaacatgaaaaaggataagggaatatacaaacaactctacacatataaacttaacaacgtagagggaattgaccagttaattgaaatatacaaagtatttcaattcacccaatatgacatagataattttaatagccctgtaactatttagaacataggatctgtaatttaaaaactgcccaaaaagaaatctgcaggcccagatggtttcactagtgattcctaccaaatatttaaagaattattaccaattgcagacattttctcctagaatgtagaaaagagcatgcttaccagttttatgaaagctagtataactgtggtatcaaaaacagaaaaagacaattaaaaaaataaaactatataccaatatcctctcatgaacatagacgacaaaatctttatgctatggactcaactgcaatctgtgttttctctcataatactgattagtaagaaccataatttaggatttcaatggttctgagacatagtataaataattattaaaaataggtaactaataaacagtaaataattttatataaaatataagcagaaacagactcaaggttattggtataataatggcaggcagactccttgcattcagacttctttggggaagggaatagagaggaggagaagagttagggcttatggctgagcccctggaagaaccagaaggagaatgtcattcctcaggcatggccccccaaaaagtctgagaatcacactgcctcagaggcttactagcattaacactactatttacttcaggtacactgaaataaagaacaaaacaaactacaatagtaaaatcaaaagtcttggtagccaatttttagcatgagctccttgaggcgcaagaccagatgttctactctgccgtataccattggccagtctgagaaatctgggtattttgtttgatgataaaatgattttttaaagttttgtggggttttgaagtttcagtaaccctgcttctctctttaatttgtaagacacagacctatcatattactgcttttctccatatgacccttagaaagccattcacatttctaatacccagaaaggtattttttaaaatacataatcattaggtatagtcataataattctaggccaagtctagagtctagagattcagatagaaatatgcacacaaaccatcacattccttgtgctgttccctttgaagatctgccagttgatctggttggaactgtaagctacatagaactctgtggtatagcaggacttcaggtagtgtttggcaccttgggtctggatccctgtgattatgacttccttttgcatgtccacctgcaatataggaaagccagtaaacagaactgtccttgtcaacaagtcacacactgcctaaattcattatacaatcagctttcttcagaactaaagagctagcacataagatcttagcaaactgatacaatgactacatgcaattcatatttgggcacagagtacctaaatttgaatcccaactcaatgactaattagctgtgtgttactttgggaaggtaggtagtatctctgtgccttttgttttttaatctataaaacaagatattattagaaccaacctcagagggttgattttaaggatataaagtacttagaacagtgcctcacacttagtacttgctatttcccctaacaacattgcaagaacaataacaaggaattactaaatcactttcatttttattattacgatagcagtaaatattatcagtctattaagacaaacctggatccaaggtttagaggcaaattctgctgcaagtttttctacactccaagcattataagatccaccattgtttaatcttgctaatctgggctcccagtaacctaaactcaagggaagaaaaagatttattctgaattttttaaaaacccagcaatttctcaagtgagtttaatccagtggaaaaccagatccttggaggacctgtgttgtagtcaggagtctaggcatgggcctcagctactaggccagtccttgatgatgaaatctgggcttcaggtctgtgtttggtcaactgccaaccacctcctatcccctttcttgcacacaggtcatgtttgattttttctgttgtgtttatattcctaatgctgaatgtgcctgcctaacaggaagacatggaagggtatatgggagcctcatcatcctcttgatcatgacctcttgatcttgggaagggctttgaggcagtgtgggaaaactttggaggagttcctcacatatagtggaggttcaacaaagttttctgaatagatgaatggttgccacaggcaaagggccatattaatggggactataatgcctggctgataagaccctgtgaatctggctgaaatactacatgtgtggtcaaacccagaaaagatgactgaggagagttttggaaatgggcgcgtggtcataagagtaaggtatctgatccttgccaaatccctgcagagaggctgggctttttatgtagagaaatcaatgacccccagctatcggtttttcctggaaaagactctttgggatcattatacaccagaagaggtggcagtgttaagagcacactaacaggcctttagctcctaccatagtgttccttcctttaccatatatgtaccccaaatggagctgcttcactacattgtagtagagaaaagcataaagagaaaaactgattcatagataggattgtcatgtatggtttcataggctgcatgctgcacaactgtagggggtaccattcacagaccatggtgctacaacttacccagaaactctgaagccttgatctgtgaatcagatatgataccagtgcttagtcccattggcatcctacagtctatgaaaaacagaaaaaaaatgaataatttttgcttagaaaatatatacaataaagtaaaactccatggttagggattatgtttctgactcaataattagatatttttacctaccttgtgtggccctgacttaaatatatctgattataaaatggtaaatgcactaacaagactggtgctttaatagatatagtggcatcctagaagaaagcaactgaaatcctgaaatgtaatcattttttaaactgattttcttctgcttttatcttaaattatgctattttacaacattaggtaccatccatggccaggtgcagtggctcatgcctgtaatcctagcactctgggaggccgaggggggaggattacttgaggccaggagtttgatcttgggcaacctcttctctacaaaaaaaataaaaatacaaaatataaaaatatgaaaaaaagttctagtcctgatgagactatgttctcaaaagttgacctcaaagttacaaggttatttatatcttgatcaaggaagggataccagccactgtgctacctggatgttggcacagtgcttcatactcaacagtgcttagtaatggcttaaagaatggatgaacagatggacagatgaaaactgtgtttcctaaatgctgaaatgtcaagtttagtgactcagtcattgttaaattcctgtgaccttttccctcctcaactcttggaagctggaaaatttcttatatgcacttgtccatggatcacaagtcatgaagaaggatgctttacacaggtttcccaattgacaggaatgcttttgatctgactgatgtgttttcaatgcaatcagaccatgggccggaataaaagcaattatggctacaaattatgcctttgtcacatcagagttcttagagttgaatatttccaatctaaaagttggtaatattctagtaataggcactctcctgccaaaccaaatatcacatggctcttgtgatacctctgtccatgataagaaatggcgtttgcatccctgctctctggttttctccaacctctgtgtttaggagccaccagccaggttttgatgccttcatttcaagagttttaaatgaacctaaaataaaaagaacaacattacatttgcaaaaattaacaagtaaatattgtggttgatagttctctaagaatcctaaaattcctgcttcacaagaggctttcaaatagaatttaaccatttttctttaggtaggactgaaagtataacagataaaaacaaaacaataacaacacatacacagagataactaaaaaaaattttaaatcaccaccacacctcactagaagaaactttcacttatctaaatataatgttacaaattaactcacatacaatacagcttcacagtcctaattatcaaagtgacctcgaatgacatcattgggcttcaaaaatatcatacatgtttcctttccctcttttcatttttgcttttttctcttttttatataagaaaataaaaataaaaccttcttcctccatgttttcaagttttccataaagcttacatatttgaatagagatttacataaattgctcagaaaaaacactgaaagaatgagatttctaaaacctctggctatccattctggtatttaacattaccccctggcagttaatatttaaattctgttgactataatttatgactgtttcccagattgtgggtgaaaatgaatagatatgattatcttcctcaaacacactgaaaaatgtctccagttttcctctctccaatgcaggtatttaggtttgcagatttagagacaccagccaatcctagcttctcagtctgtctgcaggctgataggaaggatgactgatcttctaatacttgatgaaaagatgagtaaatttgactgaatctcttctgtctctgattttaatacaataaattatctattaattattatattaattaattaatatgatattaatataatacaattaatactctctagatgtattagtgagttactggcatgtgaaaaaccaataagaaccctctttttttccctgctcttaatcaaaccagtccatttggacttctgtgcctgcatctgaggcagattcacacaacgtcacccaaagtgctgtcgaggggctgccttcactaactcctcaggcagcatgtgttaggttggtgcaaactataattgcggtttttgccattacttttaatagaaggcaaaatagaaggaaggctgcttgttaaaaatacagactccttggaattctgcccaaaatctactttaaagtctctgagaacaaaatccctctgccttcacatctgcattttaactgacttcctaggtttttatactgctgcacaagtagatacacttacaaacaactcattggcacagaaacatcccttctgtataattgtagactgtttaaatctacatttatctttattttgcacatgaaaagttctaaatacctttgttattctttaacttttattattattttttaaaaatgttttcctcttcaaacagtctataagtcagtttaagaatgtgattcctggagtcacttgcccaaagatattagggtgatagggcctagaagaggagcagaactgaagaatctggaaaccctcccagcagagatagctgtagctgcctgagccctgtgggattcattttttcatctgcttaagacctcatctgtatgacacacagtggcttgggagaaactgcatgttatgttgcaactgagttgggtcacacatttagcctgtgtggtgctgcaaatagttcataaattaggtgacatttttgtactccgtatatactttgggtctatgggtttgcctaggctctatgccagaaccctgtgttctgaccccttaggaagtatatgcacaaggaagaaatgagaaggagttacagattgccttttccctgtatttcttagcagggacctcttcccattacccaatctttaccaggcagaaggggccagacccctaactggtgctgtttattgccattttccagcaaggtctggccgtgaaagtgaaccacgtgaatgtcttgggagccgcctatgttcagcaggtgtaacctcacccactcttgctcatacattttcaggccaggcaagctgtagatcatcccattaatggctgaaaggacaaagagttgaaatcaattaaaaatctgttgacacagagagggcgagtggtaaggaaatatggggcaacccactcaacacccatgttcctcatgattctgcattcccaggcctacctagccatggaaagggccctcttgtatgtcacattagtgagaggctaaagcagaaccactagtccttctcatatcattcacaccagcctacagcagaaggcagggggaactccctttccaagcagtttatcactcttttcctcagcttttacagttccgtgctttacccgtgtatactttccattaacagtcttaattttccttaactacaaaagataaatacaaatatgggcagacaaagtaaactccagggattagagtcagcaaggagatatgcagcatgtcaccttaaggccttctaaattcagagaaagtttcaggcaaattaggaagtctaggagtttataaaattaggagtttatcgttggtgtatccagcaaccatagcaagtcatgtttattctcttattggtatgacaactcctctgcccacttctcagattagataactagggttctcaggctttatctactctccccacagtaaaatacgcggattttttaaaaagttcctgagaaacttgatcaccttaaaaatgtaacacaaaactgtaaagataaagtttagtgttaccaaacgtttaactgaaaccaaagtgaaggaagtgctttgtttcctccttcttaagttagaggaactgctgtgaaatttcagaaaccaggcaggtgaatttttggagagggacgggttgagatcatttgggcatccttcaaattatatcaggcgtgagaacacctatctacatattcataacacaagctcgtacctttctcttctcagtttctgtttcagttactagcttacagggcaaattttccttgtgaatttccaaataggcacacttttcccagtgtgaccacccaaatgctctcttgccactattctcctattacctgggtacctagtttcttatctcattttgttctcatatgctttgggtgccacctggtagctgctgagagctaaaactgttagcgtcattcttattttagaaaagacacacaggtgatcatttcttttatataaacacttgtgcctttagagatccagaaacaagcttattaactttaaattgcagaacaatgttaattccttttcaatgtatgttaccagctgaagcacactggctttttgttgttgtggttttctgttggtttgttttgcagcagcttctctgtgctatctttcagactttctctttttgcctcacccacagtgtcacctgccagattacatcagccctctggaatgttaaggaaccggttttagttgtagctctgggtgtctcagaagcatctcatgtctaatcttgtgaatatctaagggcagaaatcactgtgacccagtgtgatttaattaggagattagatcaaagtctgaggaaaataccgtgaaactcatgggattttttcatttctgaggatgtgagtctccaagaacttcgggacttcttttcatagtaccagctcttcttttcatcaaaggtcataaatagtaagacaaattctctcatgtccataggcatgttgctgtccttatgtagtattcctttttggcagattaggaggggacctatcaagcctgagtgaatatctttttcctggaaaaacagagtaaattgtattgcctctttctcaggaatttccttgctcttctgataatcactcatcatatagaaaaggaaactttctgataggctctgaatttgaagatgaagattataaatgaatggcataataagcctggatatttatcacctaattctgttgtattcataatcctccttcctctgattgatctttatcccagtaacaatgatgataataataaattgataatataagggatactatttattgagaatctattactatattaaatgatttgcctgcaatctcccatttaatcctgacaactatcttatatggtaaatataaattcattcattgaacaaatatttaccaagtgcttaccatgcactatgtactgttatctcatttttaacttctgataccaggctaagagaggtcaaggaatttcctaggattatgcattgacagggtaaaaatttaaatctgagtctgtgctctttccactatgcctgaaatggaggagttgtttctctttttaattgacagataaaattgtatgcatatactgtgtatgacatattgttttgaagtatatatacattgcagaatgtcagataaaggagtcttgactttgcagttcttttcataaagaaagagcagaacatagctaatacttgttcaagaaaatttcaaataaatgccatcttctgtaaatgtaggcattctaattcatggccaatcattcaagtaatctttcctcctctccactgaataaatgtttctctctctgtcatctgaagagctgcatggagagtccctggttatgataaatgcagactgttaaccacacccttatgcattcctcatgaaaagcaagacagacatttgacaagaaataaccccgactcttccatttggtggacttcagattacgaggttaggggaatgagaaaaactttcaatgaaagtacctactgggttcacagctgagtagtaggcccaagcccgacaggcagagccaggactttctggccctgatcgctcagtggcatgccatacgtaggtataactgctatttggctgaacagcattatcttccttaaaccattcaggagagtcatcttcataagtctttccctctgatgatttttcataggaaagtccatgggcatgtagagaatacggtctggatgctaaatttttaaaacgaacctaggaaaaggaatgatccacaaatgtacttaagcttaacaaaaatctaaaccacaaaaatgtcagcattataagtcaaaatggctggttataaaatcggagctaagatataaggtacaaaataacttatgtatattatttcatttaattttcataaccatcctgtgagatatggcccaagtagttttctccagaaataccaaaagatatttgttcttaggctcaaggctaaagtactgacattatctactaatgaaatgagagtgataggtagtggagatgtgaagatgaaagaagcttgattcttgttcataagaagcttttaagctcctgctgaaacagacatgcacatgggcatccacactacaaatctggagacaacaggtgctatatacaaagtctaagtgggttcagatgacaatgccctggaggaacaatttggttgaatatttaggagtggttggaagaattaaggtaagtttcttagaggaaatggaattggccatcatagaatgaacaggagctagaaagacatttcagactctcagaagggcagaaggatgcctgtgagcaggggagtaaaggaagagtttggggaatagcaaggatctcggtggaactgggctgtgaaatgcacagggacaggtggaacctggtgagaaatgaggctagaaaaggagcaggttggggccagatggtaaaggacttaaatgccatatgagaagtcttcacaccccagcagtcagacccatgaagctcctcccagcccttctataacttctagtgattaaagactccctaattgtctgttccttattttattctacaaagccagcatcaccctaataacaaaacctggcaaagacacaatgaataatgaaaactaccggccaatatctctgatgtacatagacacaaaaatcttcaacaaaatattggcaaaccaaatccagcagcaaattaaaaattaattcatcacaatcacataggcttcattcctaggatgcaaagtggctccacatatgcaaatcaataaatgtgattcaccacataaaccgcattaaaaacaaaaacagtatcatcatctcaataaatgtggaaaaagcttttgataaaacctaacatcccttcatgataaaaaccctcaacaaactaggcattgaaggaacatacttcaaactaataggagccatctatgacaaacctacagccaacatcatactgaatgagcaaaagctgaaagccttccccgtgagaactggaacaagacatggatgcccaatctcatcactcttattcaacatagtactggaaattctagtcacagcaatcaagcaagagaaagaaataaaaggcaaccaaagaagaaaagaagttaaagtatctctcttcattggcaatatgattctgtacctagaaaaccctaaagactccatgaaaaggctccaggaactgataaatgacttcagtaaagtttcaggatgcaagattaatgtacaaaatcaattatacaaaataaaatgtacaaatgtacaaaatagcatttctatacatcagtaatgttcaaactgagagcgaaatcaagaacgaaatcccattaaacatagccacacacacatacaaaatacctaggaaaacatctaaccaaagaggtgaaagatctctataagaagaattacaaaacactgatgaaagaaatcatagatgacacaaacaaatggaaaaacattctatgcttatgtattggaagaatcagtattgttaaaatagccattgtgcccaaagcaatctacagattcaacactattttttaacaactactggaatcattttcctcaggattagacaaagctattctaaaattcatatggaatcaaaaaagagcctgaatagccaaagcaatcctaagcaaaaagaacaaatctggaggtatcacagtacctgacttgaaactatactataaagttacaataaccaaaatagcatggtactgatacaaaaacagacacataggccaatgaaacagaataaagaacccagaaataaagccacacacttacaaccacctgaactttgacaaagtcaacaacaacagcaacaacaacaacaaaaaacaaggggaaaaggactcatatttaataaatggtgctggaatagccggctacccatatgtggaagaatgaaactgaaccccaatgaatccaatgaaactggattcatcatatacaaaaattaactcaaaatggattaaagatttaaatgtcagacctcaaactataagaatcctagaagaaaaacctaggaaacaccattctggatatcagccttgggaaagaatttatgactaattcctcaaaagcatttcaacaaaagcaaaaattgacaaattaaactaaagagcttctgctcagcaaaagaagctatctacagagtgaacagacacagaatagaaaaaatattcacaaagtatgtatctgacaaaggtctaatatccagaaactataagatagttaaacaattgaacaagcgaaatacaaataaccccattaaaaagtgggcaaaagacatgaacagatacttatcaaaagaagacatacaaatagccaacaaatgtgaaaaaaatgctcaacatcactaatcatcagagaaatgcaaatcaataccacagtgaaataccatctcacaccagtcagaatggctattagtacaaagtcaaaaaatagatgctggtgaggctgtgaagaaaagggaatgcttatacactgctgcttagaatgtaaattagccactgtggaaagaagtttgggggtttctcaaagaatttgaaacagaactactattttaagggaggagaccacccctcatattgtcttatgcccaatttctgcctccaaagaaagaagaagtaaaaactaaaaggcagaaatgaaatccacaagcagacagcccggcgccacaccctggacctggtagttaaagatcgacccgtgacctaatcggttatgttatctatagattacagacattgtatagaaaagcactgtgaaaatccctgtcctgttctgttctgttctaattactggtgcatgcagcccccagtcacgtaccccctccttgctcaatcaatcacgacccactcacgtggaccctcttagagttgtgagcccttaaaagggacaggaattgctcactcggggagctcggttgttggagacatgagtcttgccaaagctcccggctgaataaagcccttccttctttaacttggtgtctgaggggtttttgtctgtggcttgtcctgctacaatttgacctagcaattctattactgggtatatagccaaaaaagaaaataaattgttcagccgggcgcaatggctcatgcctgtaatcccagcactttgggaagctgaggcaggcagattgcccgaggtcaggagtttgagaccagcctggccaacatggtaaaaccctgtctctactaaaaatacaaaaattagctgggcatggtggtgggtgcctgtaatcccagctactcgggaggctgaggcaggagaattgcttgaacctgggaggcagaggttgcagtgagttgagatcatacctctgtactccagcctgggcgacagagtgagactccatctcaaaaaaaaaaaaaagaaagaaagacagaaaatacattgttctactgaaaagacacatgtactaggatgttcatcacagcattattcacagtagcaaagacatggaatcaatctaggtgcccatcagtggtggactacataaagaaaatatggtacatatgcaccatggaatactacgcagccataacaaagactgaaatcacgtcctttgcaacaacatggatgccagctggaggctattatgctaagtgaattaatgcagaaacagaaagccaaataccacatgttctcacttataagtgggagctaaacattgggtactcatgaacataaagatggcaataaacactggggacttctagaagggggaaggaaggagatgagcaagggatgaaaaactattgggtactatgcacgctacttggatgatgggatcaatcataccctaaacaacagcatcacataatatacccagataacaaaactgcacatatgccccctgaatctaaaataaaagttaaaattattttaaaaatacacaaatgaagtcatttttatctagtgaaatccagggctaaaacaaagattcagtatttgatttttttccttttgcctaaggctccagtatgtctcaatgcaacattgttacttatcctgtctttattcacaattgtgaggttttgtttattgtggctttcgtgcattaattttgatttttaaattttttaaaaaacttcagttgctttaggaatgcaagtggtttttggttacatggatgaattgtatagtggtgaagtctaggattttagtgtacctgtcacctgagtagtgtaccctgtacccaataggtagcttttcatccatcccccgttcccttttgagtctccaatgtccattataccaatctgtctgccttcgcatacccgcagtttatctcccatttgtaagtgagaacatacagtgtctggtttttgattcctgagttacttagaataagttttttaaatattgtgttaaattatcgttcatcttgaaaaaggatcccctaatcataaaagagaatattgcctcccatagcttcatggaaaatttagaataattaagattcttatatccctatgtacttgtttacgtttttaaaaagagcaaatggtcactgaaaatgtagtgaatgcttacacaggtatagtagattatattttaaaatctagaatagcttactttagaatcagggttctttctgggtttttgaatgtgagcggttagcaaaaatggcggaagtaaactttgttataaaagcaagttataatcgtgggtctggacacaagattttgaaagaaattaccagaactaggaagacactgaagaaacttgctcacttttggagggcatggagacatctttactttccttactcattttatttaacttcattttatttaatttttaggaaaacacctgaagatatttctaaattactattactactagcactgctactgccaccaccaccaccactgctatgaaacccaattcaattgctcttgaatatattaattttctgtgttaactttagataggttagctttagatagaaattacagaaagattttccacagattatatagttttcagcatttaaaaaatgagatcttttttttttttagttcgaagattgccaaattgcttggcaaggagtctttgaaaagaaatgtaattattcattaatcctggaaaacaaacaaatcacctatagctctcttgccacctgcacctttacaaccctctggtgcttgtggaaattcctccgaagatcttagcagtgctcaaaagacttacttggataacatcatccacttcagctctgataataggaccaagaattccgagatgctcttcatactcccctcgaggatcacgtttggtaaaagtgctgtcgaggtactttcgaaaaactactttcttatatgtggtatcttctggaatatcatcagagtcttcaatatctgtttccctgaaataataatactatttgtgtaaaagaagaaattaaagactgttcccagaatttaggaaattgtctctttctaaatatagcatctagcatagagaaggtctttaataaatacttggtggataaatgagtaaatatataagtggataaaaacaaaagccagtaaatatctttcaattcctaactcaaatattattttataggtaagtcttcctatgaccttttagactaggtcaagtctctatatcaatttctcatatttctatagtattattatagtatatatagtaaattcctgtagtattcttataatatctctagaatatatattgtagattatatataatttatttgtgagattatctattaatatctgtctctcactgggtataagtgccatgaggtcagccattgtgcctagtttgctcatagtactctctccagtggtaagcacattatctgacacacagcaggaacttaataaatttttgtcaaacatataaatgaatgtataaatataatcgtatgttaacacaccaaattttaagatcaaaggcagacaaagccatgtaatgggacagtgccagagcttggggctatcaggtgacaatggtcagattaattagaaggtcacacttatgaaagtcactggatgggtgaatgttttgtaccctaaaagtagccactcttctcacatttgttttttgctaatgtccattattcttaagcttcttgacattggtgtggacaaagattttttggatttgacctcgaaagtacaggcaacaaaagcagaaatagacaaatgggattgccatcaaactcaaaagtttatgcacagcaaaggaaataacagagtgaagagacaacctttggaatgggagaatattcttgaaaaccagatatctgataagaatattaatattaaaaatataaggaactcaattcagcaaaaaacccaaatagcctgattaaaaaatgagcaaaagacttgaatagacatttcgtaaaagaagacatacaaatgaccaacaaatatatgaaaagatgctcaacattactaataatcagagaaatgcaatttaaaatcacaatgagggctcacctcacaccgttaggatggctattataaaaatgacaagagataaatgttggcatggatgtgaagaaaagggaactcttgtatactcttggtgagagtgtaaattagtacagccattatggaaaacagtatgggaggttcctttaaaaattaaaaatagaattaccacatgatccatcaatcccacttttgggtatatacccaaagaaaatgaaatcagtatgttgaagagatatctgctgtcccacgttcactgcagcattagccacattagccaagatagggaagcaacccaaatgtctataaacaaatgaatggatttcttaaatgtgatctacataaacaatgaaatactatttagcatttaaaaaaaagaaaacgaagaaatgccatttgtgacaacatgactgaaccaggaggtcgttatgttacataaaataagccaggcacagaaagacaagtactgcaggatctcacttataatgtggaaactaaaaacattgagctcatagaagcagaaggtagaacagtggttaacaaagggatacagaggtggagcattgagaaaatggtcaaaagataaaattcagttagaagaaataaatttagaagatctgttgtataagatggtgactgtagttaataacaacacactgaatttttaacattgctgagtacattttaagtgttctaaccacaaaaaagtatgtgaggtaatgcataggttaattagcttgatttagccaattcacaatttataaatatattaaaacatcatgtttacaccataaatgtgtataaaacaacaacaacaaaaaaactggggtacacccatataatggaatacatgcaataaccagatgaatctccagagaattatactgagtgaaaaaataccagtccccaaaggttacatgttgcctgattccatttatgtaatattcttgaaatgacaaaattatagaaatggagatcagactactggttgccagggaataaggaagggctatggtgggaggaaggcagatgtgactataaaggggtaatgagagggatttttatggtgatggtgaacattctgtgtcttgacagtatcaacatcagtgtgctggttgtgatatagtattatagatttgcaaaatgttacccctgggagaaactgggtaaagaatactcaggatacccaaaggatctctccgtattatttctcttgactgtatgtgaatctattttatttttgttccaaaataaaaagtttaattacaaattataaataaataaataaagcacattatttccatctagttcattggctcagtctaggactgaagcatgtcgaattctcccactgactctcacatttcccaagcctgtggaaacaagccaaacactcacccatcaaacccataatatttgctatatactgtgagtcatcaacagagaatctccttctgcctttcttctggtctacctcccctactaatcccatctttccagactctgagcataacatgcaaactcacagaacacaagggagtgggtaaagcaactccgaatgccataaaagtgggttgtgagccttgaatggaatacaagattttgaaggtggttccatccctattcactctggacaggccctgcatctcactccctcggggccttgcttagaaatactcaggtagctagttgttctcatgtggtattgagtgcaacatttaaataggaagtcataggaaaaggtgttttaaacagagttctaatgtggagatgtcaggcatcagattaatgaactcatatgcataagtcacaccatacattgtgtttgcctactgtaattacactttggttttttaagtgattagtgtaacagctttagtaaaagctgtgggcatatctagacagctgatgcacagtcatcatgctatatccctgagaatttgtagttgactaagccttgctcctttcctcctctctcttctctttctgtatcttcatcccagaacaaagagcccagttcaacatggctttctacccctaagcaaaactgaattgtaaatattcttttaaaaaagggatttggatctcttagaaattctgatctaaacaagtaaatgcaaaaaggagatttctacatcatatttgagtttggatttgaggctaacttcaattaaatcatattgattagcatatagctatggataggttgggctctgcctggagcaataagagtcagtagaaacatgggtagtaagaggagaggacacagaaaaatgcttaattacagaatattatagagttctcacagtgattgttcttatattgtccaggggtcatctaaggtaaagaagcaatcttggaattgacaaaggaaaaagaacaggccaacttgcaataggggaaccacactgttcttagtataatttgcccacaattatccccctgaattgtagtagctacttttttcagcagtaatggaaaaatgagaataaaaaaggagaaaactggccaaacctttgtacaaattctgaataatcccaggatatttcttcagcagcaatgtaataatttcttctgtttccattgttgctgcggaggtaccatgctgcaatgttgtcaggatctctggaggagttgatgtttgtcctaacatcagttttgtaggggtcatcatagggcacataatcaatttcagcatagtcatcttcactgctctggacctcttcctttggaatgatctcaatgtaatctgtaccatctttactgaggcccactataaccagtggattaaattcctttgatagaaaagtatcattgagagtaggagatgaaggagatggcatctgaccaaggtctggataaggaaaagactcattaaattcttgaagaagcaatgactgactagattcagaagggtagaatatctgatcaaggtctggaggaggtgatatctggctgagatccgggagaagggtggtgtcactgatgtctggagagagagtcacctggctgaggtctggggaaagggacatctgaccaaagtttggggaaagatctgtctcaccaaggtctggagaaagtgtcatctggtcgaggtctggggtaaggggaatttgactgagatctgcaaagaggggcatctcactgaggtctggggaaaggtttgtctgactgagttctggagagaggtttgtctggctgaggtctagagaaagggttgtatggctggggtctggagaaaggggcatctgaccgagggctggggaaaggtttgtttgactgagttctggagagaggtttgtctggctgaagtctagagaaagggttgtatggctgaggtctggagaaatgggcatctgaccgagggctggggaaaggtttgtctgactgagttctggagagagagtcatatggctgagttctggagagaggtttgtctggctgaagtctagagaaagggttgtatggctgaggtctggagaaaggggcatctgaccgagggctggagaaaggtttgtctgactgagttctggagagaggtttgtctggctgaggtctaaagaaagggttgtatggctgaggtctggagaaagggttgtatggctgaggtctggagaaatgggcatctgaccgagggctggggaaaggtttctctgaatgagttctggagagagagtcgtgtggctgaggtctggagagaggtttgtctggctgagttctggagagagggtcacctggctgaggtctggagagatgactgtctgccagacttcatgttctgaggaaggggacatttgacttatatctgtggggaaggacttgtgacttcggtcatactcaagcatttcactgagctctggagaagaggatctgtgactggggtctgaagtagagtgcatttgatcagggtcttgaatggggaatgtttgatagtgttcctctgggggcactgtctgataaagacctggaggacagcttgcctgaccagtgtcatttgaggaattctgattatggtcaggaagtgaggctatccagccaaaatccatagagggcaatgtctgattgaggtctgtgggaagagatgtttcattggatttatgaagcaccaacgaatgcttaagtcttctttctgaaaatgtgttgtaggcttcacttcttagagggtgaaaggtcctcggagataaaggagcatggtgtgtgtgcttctcttttttcttttttcgtgtcttaatgagaaactggcttttcttcagtctactctttcctccatcctgtcttacttgtagagatttatgtctaactctaggaaactttgggtggccactctgctttccaggcttgttggcaagaggggtgctttctccccaagcacgtgaggcattctgggggctgatcagccaattgttaacagctgtgtcttcatcagtatcttggattatttcatagctacctttctcagaagccaaatgccatctcccaaccaaaatcttagatgagttactttgttttaagagtaacagatcactaggagggtccttccagggcctcattctggaaggagaaccagtgtcttggctaggaaggtcctcccagggcctcattccggaaggagaaccagtgtcttggcttaggtgtctcccaactttatgtgctagtaatttcatccaggagaacctgtgctttgctgcttgatctctttctaccttgggtcccttatgcttagcatgttcttgacttttgaattctccagcaccaagtgaaagtagacgtatccctgtgacatctggctgtagaggatcctctatagggtcttcagaatatgggctggaatgctctgctgtggaagaattgagaactgagttcttgccaatgaggtgtctcagtggggaaccagctgtggtggcttgttggtgagaaggggctttctgaggttctgcaaggttattgacagtgaacttactaatattacttggggaagaataatttgaaccaacaattatatctgtgtttgaagaaacgaattcagtgccattctccagagctagggcagtaagattgaactcttcttcttcctgattcaatgatgagtttcggaatgacctgattcctaatgctgcagccagtctgttctggtaatcatagtcagcatcactctcttcatcttcaggttctaaacgatcatgcattttccgtgtagccatgactgtagattctggaggttcaaaaatctcatatgagtcttcatcatcatctgggatacatttaacatccctgaatttcagcctcagctttttgcttcttggactagaattcatggaagttaacatccaagttcctacagaagagagacagacagaagagagatctggaagtctgggaaaagacatgaaaacacaataatccattgtggcaggtaatttctaataaactttcgtcaggaatattcaagtatgggctgtggaccactgcttgtctgtgacctattgattactgggtcaaaataacacaaggagagaaaaatgagaatgaaatatttagtaaacttttgtttttctaaagcaatttgacattgctgtgactctaagcacatgaccagtgcgttcatctcgcttaacagaataaaaaacaaaagtgttgcttagtggagattagaggggaaaaaaggtctttcagcacagatagttgctcactattttaaaatatattaagaaagggatgaatcaagaataaaatggacttttaatatcataaatatcctaacagcacatcttgtcttagaattaaagggatggtgatgagctctatccccacaaataagagacatttagatgtttctaagtaataattcacgaggacaattttgaatctctgaaatggcatgcattgctggaacatcaaagatttcttggtgagtctccaatagttaccattgttggtgtctactgagtgctaggcacttggcgcatattactattttaatggtcaaagtaactctgtgagatgtgattacactgttttccagataaatgacttgtggctcagtgtggccaagtaacttgtgtaaggttacacagcaatcgattggcagatcaggacttgcattccagtctgacaaactccaaagctgttgctgaagcagcctttaaggcactgtacctgatgattgaagatgactgttgcaaaaaaccgaatagggcattttgataaaagaaatgctcttttgtggccaaaatatttatgcttcttcctcagagttatgccttatttttctgctgttgtatatttttacttcctactttgcccagagaaggaaaaatataacccacactaaagaactggatccatttaagtcattaatttctcaaagagaaatcatgagaaacattgaaagaaaagcctgcagggggtcagggagatacatagaggagcactggtagcctggagagttgcagcagacctttatagaccagaaattcaaagcaagcttcctctgtgagtgtccagactcttactcaccaacattatccattgtgaccgtcacagattctccacgcatggggaagagggtcaaggtgtcctcatgcctctttccatagatgaatgagtgcccagtgaagtggatggtcaaaatttcattctgggtccccacactacagaagtgccactggacagtgtcatcaaagcagaatccaagagtagttatgctctcaggcacatagccattgatagctgaaagtgtaaaatctgttaaaattccaagtctatgccaacaaaagggcatgtgtctaattatacctaagataaatgtctccatgttaatttggttgtgtcaaagcagtgattatccaagataagctttatctagtctaacatgtgactagaagatcaaactcagaattttcaaatgagagattattctcctaaattagccaaaggagaaatctcaggaaaaagataaagccttccatttacattgatttagtcattcatcaaatgtatagtaaatattttgtgctccattctctgcctttaaagatattctaataattccacttggaggaaaagcataatataagaaattcatctttttgatatattagtcattgggtaagaagtaatgtccctaaaaataaagcccatttagcatattttatagtttttattgctgtcttataatctacatagtattcacagtttccatttgagtatccagttcatacatttcattattgttaaaagggacactgctgtaggcaatatttttatttacttatgtactaagcatagtaaaaaaccaaaggtatgatttctacaagggcagggctcatgtctacctcgattaccactcttagccttagtaccagtataatgactggcattaacaaatatttaaatacctacttaaatcacttaagtgactttaataatttacatgatgtattattagtttatacctcattctagatgtttttctaaatggtctataactgcattgttcaatatggtagccactggctacaagtggttatcgagcacttgaaatatgggtagactggactgagatatgctgtgagtataaaatatacattgaatttcaaagacttagtaataaagtaagtctcattaatttttatattggttacatgttgaaatgataatattcaggatatactgagttaagtaaaacatattactaaaattaatgtcacctatttctctttactttttaatgttgctatcagaaaattttaaattacgcatgtagctcatacgtagtttctattggacagcactggtctagaactatgatagattcactgccaaaaggaagttatgcaaagaaagctgagagtaattttctgtttgaattatttgacctggcacctgtcagctctgataatccctagctgtcagtcatctgaagctatatgaacagaacatgcagaaatcatcctcacatgtgtgattacctactagagaaggtgattaccatgactctagactctgaggatcagtagggggaccctggctgttgtggagaagtttgcttccagctggctcagtgacatttctctcagactgccatggcagtgcttttggccactgaactttagaactgcagcaaatgccggaaccctcattcagggaattccttttgttctgaaaatcttactgatcacttgaaatgtcttcatgcatgcctttccaagactcttgggtccctatactcattttgctctactttgatgtgtcaatccatctttggattacttgccttctttctgtcctagccatatattcaccctgaactcagtctaggatactattgacatggactataacaccttccattagtcctactctctcacccttttcctcaccacgcagagtatgtctgtgtacacacacacacacacacacacacacacgcttggaatagaagatcaaacgcatttctaaggatgtgagcctttgacctcttgcttaaaaatgttgctatgatgtcacccacggatttcatcaccaagtctttggactggaagtgaggattggaggtgccccttagcgagtagattttaatccatgtctctgactctaggcacagtcatatttcaaccacaggaatgaaaaactgatgaacaaaaatagtactctgacttactgctcatgatgtttgattcataaaacttggggtcatcacgtttcacctcatcaggattttcacaaaacttgttgatgttgtcctcaaggtaccagcttttgttctcatcaaacacagcaaacacagcctgctgttcgatgtctgctgccctctggaggacaaaacagtatagtactggtacaagaacagacgcatagaccaatggaacagaatagagaactcagaaataaggctgcgcacctacaactatctgatctgtgacaaaagcaagcaatagggaaaggattctctattccataaatggttctgggaaaactggctagccgtaggcagaaaattgaaactggacccctttcttacatcatatacaaaaattaactcaagatggattaaagacttaaatgtaggcctggcgcggtggctcacgcctgtaataccagcactttgggaggccaaggcgggtggatcacctgaggtcaggagttgaagaccagtctggtcaacatggcaaaacccgtctctactaaaaaaaaaaaaaaaaagaaaagaaaagaaaagaaaagaaaattagccaggcatcgtggcttatgcctgtaatcccagctactcgggaggccgaggggccgaggcaggagaatcacctgaacatgggaggcagaggttgcagtgagctgagatcgtaccactgcactccagcctgggcaacagaacgagactccatctcaaaaataacagaaacaaacaaacaaaaaacaacaacaacacacttaaacgtaaaaccccaaactacaaaaaccctggaagacaacctaggcaatattatttgggacatagggatgggcaaagctttcatgacgaacatgccaaaagcaatagcaacaaaagcaaaaattgtcaaatgggatttaattgaaataaagagctcctgcacagcaaaagaaactatcaagagagtaaacagacaacattcagaatgggagaaaatttttgcaaactatgcatctggcaaaggtctaatatggagcatttataaggaacttaaatttacaagaaaaaaacaaacagccccattaaaaagtaggccaaggacaggaacagacacttttcaaaagaagacacacatgtggccaaagagcatatgaaaaaaacgctcaacatcactgatcattagagaaatgcaaatcaaaaccacaatgagataccatctcgcaccaataagaatggctattattaaaaagtcaaaaactaacagatgttggcaaggttgtggagaaaaaggaacacttatacactcttggtgggagtgtaaattagttcaaccattgtggaagataccatggtgagtcctcaaagacctaaagtcagaaatacctttgaacccagcaattccattacttggtatgtacccaaaggaatataaatcattctgttataaagacacatgcatgcgtatgttcattttcgcactcttcacaatagcaaagacatgaaatcaacccaaatgcccatcaatgacagactggatgaagaaaatatggtacatatacaccatagaatactatgtgaccatcaaaaagaacaagattatgtcctttgcagggacatggatggagctggaggccattattctaagcaagttaacgcaagaacagaaaaccacatactgcatgttttcacttacaagtgaaagctaaattatgagaacacatggacacatagaagggaacaatacatactggggcctatcagaggatggagggtggaaagagggagaggatcagaaaaaataactaatggatactaggcttaatacctgggtgatgaagtagtaagtacaacagacctccatgacacatgtttacctatgtaacaaacctgcacatcctgcacataagtacccctgaacttaagagtaaaaaaaaaagaaaaaaaagtgctgtattcagtcattaacattgcagcaaattatctacaccactgagttctcagaaaccaaagtgacatagttcttggaactactgaagccatataattcaggcatttatgagagtccattgtgtacacagcacttgttagagctaaaggtaatatgcaaaagcaaacagaacagataagaaaattcagagattaaaatatcccaaaagagccgggcacagtggctcacacctgtaataccagcactttgggaggctgaggcaggtggaacaccttaggtcaggagttcgagaccagcctagccaacatggtgaaaccctgtctctactaaaaaatacaaaaattacatgggggtggtggcgggcgcctgtaatcccagctactcaagagactgaggcaggagaatcacttgaacccaggaggcagaggttgcagtgatctaaaatggtgccactgctctccagcctgggtgacagagtgagactctgtctcaaaagaaaaaaaaaaaaaaaacaaatcccaaaagaaaaatctcatttcgctatggcagctgaaagtctgtctatctctgtaattgcacacctttcaacatgaatgattgactgaatatgctctgaataagtgcaaaggatgaaagagaaggttgcaatagaaaagccttatgcttctactacctgtttcctttcctagctcaataaatcaggatcttccatatgtccagaaattcatttctgctttttctaggcatatgtttattttgtatgccttgagataagacctctttggttacagtttagcataattgggaattttagtttaataatatgagactacaattcttcaatgaagacaaactcagaaattcagtatctttgttcacattcttctgtatactttagtctcaacagagatgggccataatctgggtccaatttcactaggaactatgtctctaaatttggttgctttcagagaatctctcctctgtctccctattgcaggtctctaaaaatagcaaagactggtaaagagctttatacttttaccagatggtatctcactgaacccccaaacagacctgtaacatttttaggagggttattacccatttgataaaaggaagaaattaggaaaggctaatcaacttgctcaacacatccaataccaacagacctggaatttgaaactaagacaaaatatgttatcacactctagacttgccttcggcagtgatggtactgataaaaatagacaagacaaaaaaaaaaaaagaataaatgttatcacactggtgctaaaaaggactacttgacaattactgttctcttgaaggaaatgccccattatttagccaggagacctaacatgttctagccagaagaaattctcagaatttctgaaaggttacttcaaggacaaaatacctgtattccttgcctgtccagggatctgctcttacagattagaagtagtcctattagcccagaggcgatgtctctcatgatgtccacgtcactgtagtatggtcttgttaagcactgggcatcattttctgtgggttcatcaaactctaagatgttccacttataagtataggtttcccctggttgaactgctctgatcatggtgttgttcctgcctgaaagaaaatatattcaaaattgttttcatttgcaaagttatttcatgataataaataaataaataagctttcgctggaaccaattaatattgcaaaaggaattcttttatttttattttttttaaattatactttaagttctagggtacatgtgcacaacgtgcaggtttgttacatatgtatacatgtgtcatgttggtgtgctgcacccattaacttgtcattaacattaggtatatctcctaatgctatccctccccccgccccccaccccccccccccgacaggccccggtgtgtgatgttccccatcctgtgtctaaatgttctcattgttcaattgaattctttaaatattctacttggaacctggataacatgtagccattagataatgctccactagaggccactatgacactaataaaagacaccatattttgttaccactaagagacaaaactcctgaagtgagaagggtttggctgtgatttttaggatactcctacatgtatactacctgactgcagtagtgacaccaccgggcaaggagaatagcagaaaaatgtggcagcctctcagaagttactagttggattcagtagaagtgaaagattcaaacctgaggtgaaagaagagttgacttcatcttcataaggcgagaaggtcactccatgagggtaaatgctataggggcggctggccatatttttgaacacgatctacaaagttaaatcaaatttattctaggatttaaggttgatcatgacaaataatataagatactagctttgcatattcaccttttggatggtgtgtgtgtatacatgtgtacacacagtaggaaaattagatctgtttatctgagcagtaacctcccctcatcacttggcaggagcattggagagagtgtttcactcacacattaaggtggaaaatggaaagagaagtctgactttagaggataggttaggagaagtgacgttttcctcacagtatcactctctccaagcaagtcctccttcccctgcccttctcttttcagcttgggccacatctcattttgaatctgcttctcatctctagaccatgatccccttcccctgcccggtagattttttaggacactgtctttgaagtcatcttctcagctaggttcagtggctcaaacctgtaaccccagcactttgggaggctgaagcaggtggatcacttgagctcaggagttcaagaccagcctgggcaacatggtgaaacctcatctctacaaaaaaatacaaaaattagccaggcgttggggcgtgtgcctgtagtcccagctacttgagaggctgaggtgcgagaatcgcctgagcccaggaagtggaggttgcagtgagccatgatcacaccactgcactccagcctgggtgacagagtaagacccttggtgggggggaaaagctacttgcttgagaggcacagacaaatagccagatcctgaacttttaataaggtatgtctacacttgctgagagcacataaaagggatcagaaatggaagaagggaaagaggcatggagaaaaaaaactgcttttgtcctttggctattttaaatgaacagaatagaccttgtcaggtgcataaaacacacaggagtcctagttaggctctttaatctgcaaaagagaaccttaatcctatcttctatttggttgattgtcaaagcctttggatcatcctttgtctgtagattaactacactctaggattttgtcaaagattgcaacctttaattctctgctgtccaattcttatctatcttggtgaagtgacatgacatttaaggagaattgtctgaggaaaactccgtgctcttgatacatggagtttaccttcatcagagtccaaccattagagagctgcatacctagactacattaaaaaatgagtaaaaattgtttctattcaattgtgtttactgttatatcttagctataatgagaaatattttaatgcaacttttaatctattattttatgcaacttttaatctattatgctggttataagaattttatcaaggatgccatctactgtatcactcagcactctcttttgtagaactcattaaagaagttcctcttagatcttaacatcaggataaatggtgctttctttttgtagatgatgtaaacttcaccctgacatatttccttttttacactgactgccataaagcttaggacaaaatttgaagacagccttacagggtcacatggtatctacttatctgtggctttattttctttgtccccgtattctatcccaattacatagactccttgttttatgcctttataacttgagaaactgtctcagatcctttgtattactgagtaagctgtaaataaatacaaatactaaataaaaactaaaagttgcatttgaatttaaaattatatgagcatctttttcttttaaaattaaaaaataaccaggtactccataatattttactatgtaatttctcccatgattctgtatttgtgttacttactttgagtgtgtctctgacctgggctctgataataggacccaaaatcccatcttctttcatattgggattcactgtatgtttggtgaaggactcatcttcgtactgtgtgtacataactttcttataatgttttccaatttggtttgagaaattatccaaatgctgagacctgtattttcttaaagtgaagtaaaaaaaaattaaaccactttctcaaatagagatctcggtaggatggggaaacccttgtgcttaaacattctgctcttagattagctaacatactagttctctaaaaatttcttagtgtagtttgcaaagtccttatgttttctgtctagttggaaaactggaaacttctgatttgtctcctgcatcactgataaaagtcataggtaactggttagaagcagctacttagatcttcctgtcattcttattgctacagcagacatttgatatctctgggaaaaggcctatactggctgaaaagatactaggaatttttctaaagtctgtcctatcacttattctatgatagcctttttggttttaaaggtatttcttaatccctaaaagcaacttccaaccccaggaaacatttactagcattgttaatcatagttctgtgctattgggctatctcttccaccatctagccaattctctgagctgactgaaaagcaacctccttcacccatcttttgtagctactgggataaatactttgggagcagaaacatgaaccacttttcccctgccctctttattaccttagtttgcaaaagcaactacatgcggccaaaaagcacattttaaaaagctcaacatcagtgttcatgagagaaatgcaaatcaaaaccacaatgaggccgggcgcggtggctcacgcctgtactctcagcactttgggaggccgaggcgggcaaatcacgaggtcaggagatcgagaccatcctggctaacacggtgaaaccccatctctactaaaaatacaaaaaattatattttttgtattttgtatttgtgttggcgggcccctgtagtctcagctactcgggaggctgaggcaggagaatggcgtgagcctgggaggcggagcttgcagtgagcagagattgcgccactgcactccagcctgggcgacagagcgagactccgtctcaaaaaaagaaagaaaaacgcaatgagatgccctctcatgccagtcagaatggcgatgattgaaaagtcaagaaagaagagatgctggcaaggtcatggagagaaaggaacacttatacactcttggtggaatgtaaattaattcagccattgtggaagacagtatggcagttcctccaagacctaaagtcagaaatatcatttaacccagcaatcttttaagatggaatatcattttatgaatttatttttcccagtggaaagcactgactgttgccaaacactcctggattcctatctcagttctgtcaacaattctataatcttggccaaattttttttgttctttttcctagtttaattgtttttaatagaaaatacattcacataatttttattacagtgaaaactctcacttttctctgatgactctcaaaatgacctccctaccctccctgaattttctaggtagccatatattaatttcatgcgtgtaattccagaatacctttatgtcttacaaataagaaaatataaatattcttatccctttcactcctttaacaaaaggcagctatgtatacacgctatactacatcccagctttttaatttaataacatatcttggagaactttttgtattagtacatacagagtgtttgcatcctctttttttgatgcttagtattccattgtatgaatgtatcctaatttattaaactagttttctactgatggacattttgggttgtttccagtcttactactactaacgttgcaacagtgaatatgttgtacatacatcatttcacctgtgaacaagtgtatctgtatagttagatttccagagtgagatagctgagtcaaagggtatatgcatttagaattttgatacatattgccaagttattcttcagaatccttttaccaatttaatcttccacgaacaatatatgatagttcttttttctcacagccttgtcaacagatgatgtcatctggacttgtgaatgtgatagataaaagtagtattcccatgaagtttaatttgcatttctgttattatgagtgaatttgagtaacttttcaagggtttaagagctatttgaatttccaaatctcttaatctctcagacccatttcctcatctataaaaagaaataagagcagtatctagtttgtagagttgaagcgaagctctcagaaagggacaatacagtgcttggcaatggcaaacattcaacaaaaggtagctgctgttgtcatttttattattattaggctgaatttctttggtgatttgggggtaattcaagattaatttttacaaaaagacttgaatagaaaccaatacatgtgtccccttgagagctgtgaacttacatttcaccccaaacatctaggaccctatggaatgtgtcttgaacctttgcccagtggtatgaaccccaacaactcacttgtccatattcgctggtattacaggtgcatagtcccaaatgacttcctctgcagcaatgaagtattcccacctcttcatgtgccgcctctgctcacgagttattttcttaagattcctggttttctttgggcagtttttaatgtcaatgtaagcctgcatcccagctgagttaggacagaaagacaatgaaataactcaagagaagaaattatggttgattgaaatgcatatcctttaaatcaacttgtggaaggtttatattaatataataagagtgaaagtaatgctcaggcaatttttgaacattttagtttggaactctttaagtggcatccagaaaaggcaagaattttaaaagggggaaaaggaggaggggttagggaaaaaatttggaaagattccctttatttcttcttgagcaggcaaatttctaataatttttaacttcttaagaccttatgaattaagtcttgttaaattctcatttttctgtcatctgtcccttaatctataaaatgaagtagcaccagtacctaataaaattgttgttaaaaattaaatattaataacaatacataatgcacttatcctcaacaaagaaacaaaagttacattgttgttttaatattattgggaactctatcttccacggatatcatgatggttttattacttcaaatataattttgactactcgtgtgaaaagaaacagaaatgatctcatgaagtatctcttccttatatgtgttgcttatacattattttggtaacaaaatgatttcctattgtgatatcatttccttagattttagtctccatttatatgaactctaatctcaacagttttaaagcaaaaatgtgtagtagaacaatcagttattttgtttacacgataccacataacgtgggttgatttattttcccacctgaattccccagtgttctttggagctcacccctcagtatatgccatgtatgatccattcaacacacattcattgagttcctctctgtgctagactttgtgttcatcccactgtaaaggttaatgttttcatgctaaacttttacactttctacaacttagtgcttctgtaaatttgcagtttgtcttgtgctagcatctaggtcttttttgcatatgaagtaacccgaagaaagaatatctctatgtatgcatttgttttcttcctcttttcttctttcgaggaagttagagatctctttagcttttgcttaattaaaaaaaaaaaaaaaacctttgccaattccttcgctttctccatccccaaagagcaagttataaatctaagagcaaaatatctaagtttggttgttaggaactgaggaaagtttgtctgcggtgcaggtggcttgaaagggcaagggagaaagagggagttagtgcatgggaagaaaggattctgcattgagaagcaagactgtcaggagagtttcttgccttgcaaatgttttggggtgagagaagatatgatccactttccctctgggcccacagtcatatttgcggtagtggatgtagcactgacaagggtgatggctgagaccttatgatggttctgctccaggacctggccgttgaaatgaatggagaataattctggccccgagctcattcccagcagatgccagctgatgtggtcatgggcacaaactgttatatctgagaaagagggagagacacaggccaaaataagcattcagtcaagtactctgtgatcaaacattcactcaccaagtgtattgagcacctgctgtgtgtcaggcattgtataaagctttgagggaacagacactccagttgtagtttgtgccctgcaaaagcagacatctgagtgaccagcaaacaagcagtgacaactcattgtgataaatggcattatacaggtaacaacagagcttagagatggtggatgtgaactcaaaaacacagggattgctaaaggattaggccaagaagggaaccaagaaggtaaccgactgttctggtctgaggggtttcccaagattcaggactttaactattagaactggtaaaaagtccacggcaaaatggaatgtttggtcaccccagtctgatctcagctggagggagtcaaatcaccagaaccgccaatagggctgagttcaagcacttaatcctctcagctctctagctgtagtggtcgaagctctgcctaagggaagaagatgtgaagatgatatgaggattttcaattgttatttttacttactttttgattgttttaatgacaagtcaacgaaatcactttggggttacacactctccttaaaatgcagtgtacaagtcctcattatgctgagccattgggagcttttcatggaaggagtagtgataactgaatataaaaacttagttttgctccttctttgctcctacagtcactgggaaaatgctcatttgctctgtggggagactccatccttggcttttaggtttctgttttacatctcagatacataatcactagatactagataatgggcctgagaatcagttccttacccacacaaaggcttgttttttttaggagaccattgcaacaaagccaggattccttgcatcactaggaggctttggtggaagcgtttatccatgccaaagaaatgcttatattgagttcagcaattaacatatctgtgttagcatttatcatatgtattcaatttattctgctttataaggcagagggtttttacaaatgtttactattcttagtttctactgatggtctttccctaccttgtcccatttacccccaattattcttttgggaactataaattcgtaaactctaagctcagatcaatttatttttatttttgtgcatatggttttgcttttcttggcatccatatacttatacagattgttcactctgccaggaaatagatgttaggataaatggttagtccacttttgtaagtaagcacattgagacaactaatttatccagggccacagaaggtagtctgataatctgaagtctgaactcagattatctaaggtcgaggtcagttaactaagccccagtttttacaagctcctagtattggaacttgggatcaacattgagagtcatatgagtatattttcagaaaaccaagtggaaaatgtagtcaaatgaaatagaatacaatttaaaaacactacccagatctcaactcttaacaatatttgtgttttagtaagtgaagctatttgtgattttcagatggcattagagaataacctctaagaagtttagtgttttgaaatatggtttatttagtaaagtggcattttaattttttaatgtttttccctcaggctagtatcatataccctggatctttagttgtaggtcagttctaccagagagaaatagaagagatgtggtctaagtgggaattagttattttttctcttaacgattgctatgattttgccttctcataagtgcccaaatgcaaatggaaagagaaaatattctagatgccactgaatattactcttctgtcaccttttgaaatgctggttttttttgtgtgttgaggattactcctaatctgttcatctttactgcaatcttcctgctgatccttcctgctagggcttgtccttgaagaagccatggtcatcatatagaggaactgcagaactcggagagagtggctgagctgataccttaaggtcttattcaaagtacaggccaaggtgaaacctactcaggtcactatacctaacaaggctgcacatttcttctctagcttctaatttgtctcttctatttcctgtttaaaaaaaaaaagagaaaatatttccttcttgatagggagttgcaaaacagtgagtatggtcaacttctctagtgctttgaagaaaacaggaccgaaaaattactaatgattttactgttgtttaatggtacacagccctcgtgttacctggcattgtcccattcacatatccattgactgtgtacattagggatgatgactggctccagctcttgctttcatcaaacacagcaaatagtagcacgatttgcttgtcaaacgtcttctgtgtcccaccctcagttagggtccctatgaaaggaaagacatgttttcagtagcactgcagatagaagacgctcattagctttcctggatagcaaagagtttagggcaagcaatcaaccataatgatttcaacttgaagaaattcttattttttaaaatagcatatttatcaagtaataatggttctagggttatttaaaatctggtgccacactgtcttctttgataccttcttgctttggggaacaggctttatttcatccagcttgggaagaaaacatttggtgactctcaagactctgtacaagtatccatttcccccagtctcaatagaagagtatatagatacgttagctcagttggtaaaagcatcatgccccaagtttaatgctgtcatcttatttgtatatgaaagggggcattagataattgggtggaagtatcagcattaatccattctcactatgagaaaaacatgctgctgatggtaaaatgcaagaagagtcttttgtaagttttaaggtttttttcagtaccatcacagtatcttatatataccaggaaatggaaaaaaagtctttgtataatgagtaaatacattgggcatgtatgtaggtatggcctgagcgtgtatgtataggcagatggtgagtccatcacgttatttcccatgctgtggctcactgtggttgtttgttttaatgaaagatgggctggattctcatgggataaaatgaaaatccaagcttgctcctaagaagcccagccaataaaagttcttgtaaagtcacttgagtgtgtttgaaacctaccacccaaagttttcaacttgtttgtaagaaaggaagctggcatttcacgtgtttatagagcaaattaccagcccaaacctcagatatgtcaaacatgttagccaaagttctttccaagagctctttcagcagagtataggctactgtatactttctaaaagactttggccttgaggtaaatgttacagatcatacaagcatgacatcagaacatactctcaaacaggaatttgcctgggagaaccttaaggactgagatgaaggaggaatgagaagaaacagaggtggatccacaccctgaaatagcaggtgtttttttctcttgtcaaacaatgatctggtctccgtgccgtcttcctctgcttgatgtacaagaagttaccaagatgctcccaagctttgtcccatgacagaactcctgaccattccaacatttagttgttgaatcttttggtgggggtgttcttaccttttttacagataagcaggggcccaatcagccccgagttgaaatcctcgatcagattttcatgggagtaatagatgtgtgtgaggcatggagggtcatcatgggtgggtccactgtcctcactgatactccattcataggtgtattctcggcctggagccacagcgtcgtccatcttctccgcagggaatgtgtggtcaaggtaagaagcacctggaggagtaacagccatcaagacatgtgggcagtttctgaggattgcgttttcaccactctcaaatctggggatagctaagatgagttctctggagatgcatatgtccttcaatagtgaacttttattatttggaaagattcacatatgcccatttctatgctcatgtacttacaaaggctttgataacatggtgatcttaagaataacaaatgttatttgtaaattaaagtttagcaagttaattttccagggtacctgaacaattattatttaaatataatcagagaattgaatcgcctttgattagtaaaccatctcagaatataagaatgggtgatatcttctttgtggtgtttaataagacatacttagcctattaacatgagatgggaggatagtcagagctgtttatgtattattttgttttgctatttcagatcttctttccaactgctgtgatcctcagctttgttttatctctttatttcatcttagccatctgattatctcaattttttcccccgagccacagcgtctaactcccctatgcaggctggttgtctgtatgaatatgaaatgtgtccatcccctgaaacttagatgtcttactttgtactttgtgcacccaaagacacatcattaacacctccatgtatattggactttccctactgataggagagggagaggatgaagaaattggtcttctttattgaagagaaggaactgagatactcaatattaaaagaagtgtagagggttgggtgaggttttcaataataaaatggagcaagtgaggtcaggaaggggagaggtgagtgccatagagagccaagtggaatgaacagtttcctctgcctgaggaattcctcatttaattaggtgaaagattccctatcatcagctggtgacagaatttctctttgggatgcagttatttttgtttggtacaataacttgataaattctttacgagaagaaggtgagaacatcagtgtggatgtaggcagacaacaaggatctggggaaaaaagcctgaaatgttttacatgatggggtaaaaggccaataaaactcctcttactgaagcaactacactttttgaaaactgaaatgattaatcctttccctccccttcctttctcttccctttcttttctttttcctttcctagtttcttttcttttctcctttcttcctttctttgtcttcttccttccctattccccaccctccttccctctctttcttcctttcattatcctcattgaggtataatttgcatataataacatttaccacttttaagtataatatttgctgagctttgattaaaacaattacccagtcttatagctatagttccaatcaagatagagaagagttccatcattccaaaacatttcttcatgccatttgtagccaatgccctctgggcccagacaaccactaatctgctttatttcactataatttggcttttctgtaatgtcatatcaatggaatcatcattacacacccttttgtgttggattagtgttagctggtatggtatataattttctatcctttattttttacctatctttgtctctctcattaaagtggatttcttaaattctgcatacagtttagcattgcttttttattcaatcttatttgtttcttaattgtagtgttctttccatttacttttaatgtaattgatgatatggttgaatttaaaactgccatctttatatttattttctatttgtctatctggtctttattccttttccccttcctttctgttttcttttggattgagtatagttagtgatgtttaatctccattgttgccttcttagctttgttttcttagtggtgcccttccgtttacaatatatagtacatttttaacttgtcacaaacttccttcaaataatattatactatttcacttgtaagaaccttgcaataatatatttccatttcttccctcccagcctttgtgctattgtcatacattttatttatatatacataatataccccacaataaattgttactattttgctttaacatttagataatcaattgcctttttaatagattaaaacgaggaaaaaatttctctatatttatcaacttctggaacttttcattccttcttatgaatctaaatgtctctctgacataatatttcttctatctaaaggagttcctttaacatttttttctgctctgttagtgagaaattctttctgcatttgtatgtctaaaacactctttattttgccttcatttaaaaaagactttttgacttggtatagaatactaaacagacagattcccctatcttctaccctcccaacactttaaagatgtccctaattgtcttctggtgtgcatagtttctaacgataagtctgctatcatttcttggttttgttcccctgtatgtggtgtgtgtttttatctctcactgcttccaatattttctctttatcactggtttccagcaacttgatagtgatgtggcttggtgtggttttcttcatgttccttcttcttagttttgtcaaacatcttgaatctgttggtttgtagtttacattacatttgggaatttttcagtcattatttcttcaaatactttttctgttcctgctacttctgggatccaattacacatatgttagatcacttgatatggtcccacagttcactgatgctctgttcactttcttcagcctttttaatctctgtatttcactttgcagtttctattgcaatgtattaatattttctactatttcctttcacagtgtctaatgtgctattaatttcatccagtgtttgttgtattagtggtatccttcagtttataatatatttttttatcctttattttttacctttcttttctatgctttattttttacttttcatgtcaacaattgtattcatctacagaagttctgtgtatgcatatttatattctctatcttcatcatgctcatgcttttctctgctttctggaacatattgagaagatttatgatagctgtcttactgtctctgcctgctgcttctattctctctttcacttctcaatctgttgagttttttcttggttatgagtcatctctttctgcttcttctaatgcttgtttatttttattaacattgtgaatttacattgttgtttgttgcattcttgttaactagtattgagttttattcacagttaagatacttgaaatcaaatcttgttttttattctgttgcctcctcagcagcctgtagtctaattttatccacccactgtttctaaatccttctgacaattctatccagtgctcatttattaggaggtctttctatgtttgatggtaggaacataaacgattaccggccctgagtaaggtccagggactgttccacctgttcctttcaagtgacatttttcttaccctcagtactttcctcacatgtatgtgcagatcagtattcaacttgacaaaacctctctgtagattctctagagctctttctctgtgattatactgtcctctgcaggactctgccctaaaatcacaaattctagccatttgagcttctccgaagtccaaactctatttcctcaacccatagagactctgtctgggttctccctgcttgtgctgttccctggaaacactcttcaagcagtaagcttaggtgctcatagggcacatctggtttgttactcttcttttactgtcttgagttgtctgtcattcgatgtctgaaaacttctgttttatatgttttgtctgcctgtctagttgttgagaaaaagggtaaatctggttccttatgttctgaagccaaagtctgagatgctaaatttccatataaaatatttttttacattacagcaatgtcagcttcccttctttaattgtacctttccccatcccaactgtggaaaatctattccactcaaaacgctttgcatgagtttgcatggcatcagcatatgtttggattctccaggtgggagtggaaaataaggcacatccattcaatagcaatgaaggattcaggtactacagtaacgtgcaatgtatctcatgaggttctgagcatggaaaccataagttgagtaggtatatctagatttacttcttgcataaagtccttaacgtggaccacaagtccatgtatgatttacctctacttctctcttcagtcttatcatacgtcttttctcttgtttactatgggctccttgtcccttgggtcccctgtcagttccccagacatccaagttctgtcctacctcagggtctttgcagatgccattccctctgcctagagtgctcttcctcccgtcttccttttgataaatatgtgctcatcattcagacatcaccttgaatatctgttcacttctacctttatctccaattctgatacacatttttttcttttacagcacccatcacaatttgtaattaaatgcctgtgagattatgtgactaattcattttcttctactagatcataagtatttgtgtcctgcacattttggtcacccaagtgtgagttcctcaaggaaaagtgctggattgtatttgtcttagtgtctctggtgccttccataggtacctagagaagcatggaacatgaacatgaagaagatgctcagtgaatatttattaaactcctaaaatttaaggtcctatgggctacagcctaggtcaacaagtcaaagctcatggctgtgtgttgttatgattgcgtaatgttaaaatagattaaatgccaacattaaacatccggagaaattatataagaatttggattactggtttctctttaaaaaacaaaaacctggagatctggttaacaacaggaccaaactcctgcacagaattttgttggatctggatcttagctgcccttttctgctttctgatgatcagttcttactggaccaattttgttcactgaactacttatctggctactataggcatctgagtttgtgaactttgcgctagcataaagtggactttgttgtgtcttcccccaacacaccccaaaggatagcttgacactaataactaatatttactctaggctgtactttcactttgataataaaactgtcaagagctgagaaatgataaaagcttaagtcacttcctgtaagttataacataattctagtctataaaagaaaaaaagtttatggagaaagtctccactaataagcaggaagcattatctgtgaaagattacaaaagagctttggtaacaaagcacaaacaggactgataaggagagttgccctctcaggtcagaacttgtctattaactgaaattagcatggctagttgatgagctgcaccatctaccttgaatcaagcatgacagcccttcttcaatgcttcttgctacatggcctcataaagttgaaaaatgatgtttctggacaggcagcttccactgtttcaactgttaaaacatcacatggggtttctatagtagaaaatgatattctttccactgccttcacaagctcccctaagggcaaaacattatattctttgcagggtaggagataacttttgaagttcttcctccctttatttttctgggtaaatgtgtgctcattcttcagatgtcagatcaaatatcatcttacacccttcttgatctctgattgtgatacctgtttgtttgttgttggttttttgacagcactcatcgccatttgtaattcagtatttgtgagactatatggttaacgatacttttttctgctagatagtgggagaaagcacttgaacttcagggtcagagttgaaaatatcttggtggttgtatcatttgctaactgtgggaacttgggaaggtttcttgaagtccctttaacctcagttttttcatttataatttaagataatataatcctttttctagagataactttatcctttttgatgggttatgaagactggaaaatatttgtaaaatttctggctcctaacaaatgctctgatagcctgtgggaatacatgttcacattttggttaagtattttctttcccagtcatgttgcaattaatacagcctctttcctttatgttctactttagataagatagatcttaagtgtgcttgagttctggtaacacatgtgagtaagatagaaattggtgattttcttagtttgggttgctgttaacaaagtaccctggattgagtggcttataaacaacggacacttcttcctcacagttctggaggctggaagtttaaaatcagggtgccagcatggttgggttctggtgcagggtctcttccaggttgtagactgccatcttctccttgtatcctcacatggtagaaagagggtgagtgagagggtcccttttataagggcactaatctcatcatgagggctccatcctcattacctaaaaatctcccaaaggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaatctcccaaaggccccacctgctaatgccatcacactggaggttagatttcagtatgtgaatttttggaggacacaaacttccaatccattgtagtgatgtatctattccaaaggcgatgaaagtaaataagacttttttggtaaaagtactttttttttttttttttggtaataagtaagacaaagtacctgctcaaaattatcagcaaaatcaataattttaaagcaagggaaaaataatgcatagtccttactttctaatcagtcctcggcccctcagtttagttcagtaatgattaatatcatcatgatcatgaccatcatcatccactaggttccaggctctgtgctaaatgccagagtacaaatgtaaagaagacagggcctgggcccctgaggggctctgcctagttaactctagggtacatgttggtgccctaattgtgataggtttgacctctagatttcttctagggctacaattagaacacactgtcaatctggaatgagaaccaaccaatgtaagtatctaaaaattgcccaagatgctataacacttgtgctaggtatagcagggtgactgattttctaacaatattgaacctatctgtaaacaatcaatgtttcacacctagatttattttaacacatactgggcttaaaaaattattgtatatacttgtgtacatgatattttgagatagataatgaaaggttactctagtcacacaaattaatgtctgtctaattgatcaaactaaattactcagaatttcacattcgcctgtcagttacatataagatgaatttcaaataattaaatgaatgatgttaattaagtttagtatactactaaaagttgaattatgagcatcttgaaacagtgaatgatatagacttgtacataggatatattctataattacactgagtgagatggctaatgagacaattggggtgtaattttatcaatgcttttattcttttcacttcaaattattttacctttagtctagaataaaacaggtttgttgtatctttgattttacaacatacattaatataaagtataaaatacaaacagctattaagaggaagcatttgtgagatgcagttttggtgaatgtgattttgactttgtaatcaaaataaaaaaaattaagctctaaactgaaaagaagagaaatggacagggacaactattgtgctagagcacaagaagtccttgttcagctgcttgctggaataaaatctttacacaagggtagctcttcatttatatttactcagttctgttcatttcctgctcagtcgatagtcagctttgtattgtatttattcttgtcatgatgtactaattacttgccaaaggctctcagtattttttaaaaatgaaaaatggtgcatacaagctttgggaaagtgaagttacataaagagcctttttggttactcattagggtgctcactcagtaactcttcccttgttacttatttttgtgaacaactcttttcctctcctaagttaataaacttagtgaatgcttcactacattcaaagattcagaatattcttttagaagctataatgtaggcaatgggcgaatcaatgctgacgttttataaagagctgatttcattgcacaggacttgcaagtctctttggaaaagggatccacatttttgtgatttattaaatatacaaactatagccgttatagtttgtttcaggtgtttatcatatactcaaggaagtctctacataaggccaaaatattcagatgagaagtgaaaaaatgtaatcacctacattaagtcaagcattggaatgttttggaaaaatctagaagagcaaatttttgtatagagaatttggcaacacttagatacaacgaacaatgtctggcagaaaacgtgttttatttggagagctggcttaccagcagatggctatatattatagaactaattttgtgacatcacattcatatgcaactcatatatttaaaatatgagaatataactaaaagaaaagaataatattaaattctccatgaaacaagctttttaaaggtaattgaccaaaacgactttgaaaattttactgaacaacaaactttgctcaaaggtgcagcattgaagtcaatttgatgcatgctagttacagagtttctgaaaatttaacctcaaattgaaaccctttagtgacagcttttaagtgattagttacagttgcagatactttattccctgatctaagacagtcttattaaatacattattaaaggaaatgtccttacaagcatttttacaaatcaccgtttgtccattctgtcaaaaagggttatccagagttctcttatgttctgttgtggtttctcaagccagtgtaatactatcttaaccccctaccacctatctctcaaatatctacctctgagatagaggaatctggattctcatgtaactggctcagcatgcagttagtttatccccactcccaaaaaaatagctcaaaccacagagggaggctataggtgagggtgagtgtcagacatggaggaggagatgttttattttaatgcagagggcataataaaatcaacttataaggcttgtcttttaccataaaagatactatctgcttactaggtttgcatctcatttccaaggtaaaattttactttccctaccaatatgtatttacctttcttagattcataggaccagaggcaatattatatgccaataatcatgtctccagtgaaagctgtgggagcattttaagcaattgctcataaataattgctggctgtagggaatgtagggacaaataaacagtaaaggaagagggatagtgttgcaaggttcattcactgtgcaaacagcccaggtagggtccaaagtctacaattcttacctcctcccttatttgaaatgaaacctgcatgtgacattttgatattttgaggtttctcccccttcttctttacattgctgaacttctgatgcagtcgtctagaagcctcataagtaggtgaagtggttgttcactatgtcactgtatgattttaagaacataggagaaactcctgttcccactacctcacccagagtcttgccaaattcactttggaagaaatctcagtgccacagttaatgcttcattgtttttcctcaagccaaagattaagtgctaatgcaagtactcctaaggaaggtagttcattgacctattatcagtcacttataccttagtgggtatgagtttgacaacagtttatatagaaaacaataaatttaaaaattactttctgattttttctgaaactaacaagttttaagataaatactaaattatttgaacacattttaattgaagaattatctttactatcatggctaatatttattatctgttatatgccagtcattattctaagatttcacgacaacaaacctgtatgacagagacatgattattattaccattttacagatgagaaagatgaggcacacagaggttaaataacttcataaaagtcactgagccaggatttgcacttattagtctagttctaaaacctgcacataaaccactctcctactcaattattctctcaaaggtatgatggctggaacatgtagaaggaaagatatttaaatgtgaaccatgaaaagtctgaaattattttaaaatgttctcataccaacaactattataatatggatacaattttttataccagtgcctgatggaactctactatgcttacaatgatctgaacatcagcataatgggataattagaaccatattaacatcaggtacttactattcagcggctgatacaataacttgcatgactattatctttatgattattgccatcattgtcatcattatttatagagagcttatccgatcccaggaaccatgtttagtactctacctaagtgacttcatttaaatttcaggcaatcttatgggtggttataatcatttccattttatagatgagaaaactgaggctcagagatgctaaagtcgtagaatcagaaatgataaagctagaattttaacttgtctgcctttaaagcttactttcttaaccacttcactatgtccaaaagtctaatactattaatgcttctagtctcaccaccaccaaataccacttattgagtgtcatctatgtgccaggaagcctatatcaggctagttctatgtcactatgtcagtggctcatgggccaaacccaaccaatttcctgtttttgtaaataaaattgtattgtcagaggcggtcttactctggtgtatgacttgagggaaagaatacggtaacaaagttaattagttctggcatctgtaaccaaagccaaaaaaataggtatcgtctatggctgcttttgtactaaaaggcagagttgagtacttgcaacagagatcttatggcctgcaaagccaaacaaacttactatctggccctttacggaaaaatttactgacccccgccttaaaccatctttcaatgtatgtattattattcccattttaagatgaacatatgagaattcagagaaattagataacttgccctcccaaacattaaagagtaagaacccagtgaaaaatgcaggtctagaggactccaaaaccttttccttttcttctctcaaaacttacaacagcaacaatttttataattaccagttgcaagagatttccctaacaacacgtggttaacagtatagttttaaatgttgatgctggtattaaagacttagacattttcccttttcagaaaaatattagatttatcttaccttctgataatttactgtacctaattccttgaggatggatgctcaagggcttatctgccttatttttaaagtgaacttttatgatgtctccgacttcagcatataaagtaggcccaagaagtcctgtgaaaacaaatatttaaactatgtctgtattcagggtcatcaaaggcagagttgctaagcaagaaaaacaaacagatgataccaagagtgattgctaccattcctcctggtcctgaggctgactcacttattttcaatctagaaggttttagcagctcattaactcaacattacatgtacacagatcacaatagaatggtagaaacacttgtcctggacccaaaagaagtcaacagagtaggagaaatagttctggccaagtcttgcccactttgacccactgtcattccttagcaataactttctttgcttaagaaagatgttcatttcaattacagagggtgatgcgagagggtagttactttagatttctctgacatgggtgtgctcagagacctagatgaattgaggaaccaaatcacacagctctctggctctgaggcaggagtagtcttgatgtatctaaggaacagtaagaaaaacagtacgggaagaaagaagagatgaggtggatggtaggtgtgtagaacaagggaggccctatgggctacggtaagaacttgaattttcttctaagtgaaatgggacatcactggagcatttttctttttttttttgagatggagtctcgctctgtctcctaggctggagtgcagtgatgcaatctcaggacccactgcaacctccgcctcctgggttcaagcaattctcctacctcaacctcccaagtagctgggattgcaggcatgcaccaccacacccagctaatttttgtatttttagtagagatgacttttcaccatgttggccaggctggtctcaaactcctgacctcaggtgatacacccgcctcagcctcccaaagtgctgggattacaggtgtgagccaccacgcctcgtctaagtgaaatggagcatttctaagtaaaatgaaaaaccactttgtacagcagagacatagtataacgtgtattaaaagttcatcctaaaacaaaaagttcatcatagctgctgtgtagagaatagtctgtgtagggacaagaatggaagcagagagattaggcagtataggaaagagactgcagtgtactgggccagcacatgtagcagaacgtgatgagtagtggttggagtctggacatttttgtaggtaaggcaaacaagacttgctgatggattgcatgtggcttgtgagagacagaagtcaaggatgacctcaaggtgttttatcagaacaactgggtaaatgatgttattagttactgcaatgggagaacacagcagagacaggaggttatgggtgcagaaatcaagaatgaggttttactttctacatgccaggcactgtgttagaaagtttctggctacctggatcaaatacagtccctgtactgaaggaactcacaagctagtttggagatagatgtatgataggagcgactgctgagatatgggcaaaatattacagaagaagagaggatgaagcacaaattctgtctggggagttagggaaaaagttgatggctgagtcagaatttgaggaattgtatatagtcagccctccatgaccatggttcatattcatggttacacatccatggagtcaaccaattttggatcaaaaatattcaaaaaacaacaataaaaaataaacaataaaaacaatacaaataaaactctaacataatagcaatttacatagtatttacattgcattcagtattataactaatttaaagatgatttaaagtatatgagaggatgtgcataggttattgcaaatactatgaaattttatataagggacttgagcatctgcaaattttggtatctgtgagtagtcctggaaccaataccctgtggataccaagggatgactgtactagaatttccaaagtgtagtccttggagtctctgcatcagaatcacctagggtcttaataagaggcagatttccaaatatcacctcagcctcaatgaatctgagttctggaggtgaaacttgggaatctggactttaacgtgtgctccttggtgatcttgatgtctttgaaatcttgagaatctatgaccaaaagccccattccagacaagtgacagaaatcaactactgtcatttctgagccatccacaagtgtcatgggattggcttctcgccattaggcgtcctagaagcaggagaaggaagtcacggcactcatggagttcagccagcatttgtttgcagtggtgatgataatcataataaggctttcctgtactgtttcccttaatacattcaagcactgtaagtccctacattaatcctcacaagtttttaaggtagatattaagatcctcattttataggtgaggacactgagcctcagagagtttaaatatcttgcctaatatcacacagcatcatgatttaaagtttaatatgtctgtctctagatcgtgacttttaagccacttctttatactacacctccaccttgtattcattcctttattcattcctttatttattcaatgaatatcaagtgcctatattatcctaggcatcagaattgcaatggtgcgtaaaagagtaaaatagatacacccactccctgccttcatagagtttataaaagtcaaacatttttatagttctataactttatacgtttttatagtaggaaagacagattttaaacaaatgatcacaaaaacattcaatttaaacctatggtaaatattatgacagaaaaggagggaatactctgaagagtatttgacagtggaatctagtccaattggaggtgagttggggaatcccttcccgaggaattaatcctttaactgaggtccaaaggcagagaggaaaagggatggccaaagacattctaaaaagttagagtagcgtgcgcaaaggccctgaggtgccagaaaatgtggcctttttagagaactgacagttatccagtggggaggtggagcttagtatgtgaaaggaaggggcagaaggtgaagccgaaggcatcctcagagtcccatcatgcagggctttgtaagcctcatagagttttccctttagcctaagagtatctggaagccattaaagagttttcatcaggggtgcaacatggaccagattttggttttaaaatctctggctgtatttgtggaggatgatctcggaggagactgagcagagaacaattgagagaacagatagaagactccaggagagatggtggtgactgagattatgatgagatgatgaggagagaatatattagtgatgtatttatgagataaaatagttggaacttgaagatggattggatgtggggtagagaataaaggacatcagttgctgtggatggctgatgaggttctgatttggggagctgggtggaggagggtgccattctctgagatggaggacaccgtgggagggctttgtttggtgggtgtagtaggcagaataatgtgcccctgctgagatgtccacgtcctaatctctgggacctggaaatatgctactttatatggcaaaagggactgtgtatctatgattaagaatcttgagatgagattcttctgggctgtccaggtggatcccatgtaataacaaaggtccttatcagagggatgcaggagaatctgagttaggaagagcttggaagatgctactcagctggttttgaagatggaggaaggggccatgagcccgtgagtgtaggcagcttccagtaactggaaaagacaaggaaacaattctcccccagagcctccagaaggaatgcagctctgccaacaccttgattttagcccaataaaacccattttggacttctcatctgcagatatataatcataaaagaataaatttgtgttgttttagccactaagtttgcagtaactggttacagaagcaatggtaaactctgatttctgggacagaggtcctatctttccctacccctgtcttgccacccacggttgtcctattcctttccttgaactcctactcctggagtttattctgatcttgtgcctgaagctttttgtttgtttttatgttagctttacacaggactgtggaggtcacaaagttcagtccttattttagttaacaaagcctgggaggtaggaatcgggggacaaaggtgacttgcccaaggtcagtcagtgatctggtagcattgctgggatcagaactcagatctctggactcctgagccaaagctctccctattccttccacggggcaggctcaggcccccatctttatagaatagtccagatgtctacacctcttttgactcctgacatgtcggactccactgactgacccccctcttccagctgctaccctctgtcttggctcctgatggaagtttccactgactattcccacctaccccagctgccaatgagcccaacagggtgctgactatgctgccaattgtgtgccgcatttagttgccatggttctcttgcttggttgatttgtttgttggcatcacatgcctgcaaataccagatgcccagagaaagtctcctaagttatttaacctaataagacctattacttcagtggacagtttggagtatttattcaacctcccctcctgcttcttcagatttaaggcaaaacaaaaggatgttttcataaatgcataccaaatactttcacgcatgtaggaaaacacatggctaaatggttttcaagctgctctttagctcctccaacagccagatggcctaaaacccttctaaccctctcctcagtgcccaaagctggattggggaaaggagtggcctacttcagggcttggggaagccagcacagcatgtacccaatttagtgcagttgtggaactggaaaggactgcagaaggtcaactaatccaatcccctgctcttaggtgaacaatgcattacataacacaaggtagtgattgttgcagctatttcaaaactccttcagggacaaacattttataatttgtccctgaaaaatatgcagactcaaaactagccaatttaattaattatttatttatttagagatgaggtcttattttgtcacccaggctggagtgcagtggtgtgatcataactcactgcagcctccaactcctgggctcaagtgatgctcttgtcctaaatgaccctcttgccttagcctccccagtagctgaaatgacaggtatgtaccaccatgtctggctaatttaaatatatatatatatatatatatatatatatatatatatatatatgtatgtatttttttaaatagaaacagagtctcactacattgcccaggctggtctaaaactcctggcctcaagcaatcctcccaccttggcctcccaaagtgctgggattacagtcatgagccactatgcccagccaagactagccattttaaagcccaagacagaattcctaaaaatgaccccagctgtactccctcacctgcccaaatgtccacaaaccttattggatgggcatcttcatacctccaatcctacagcccagccccctacaattacaagaactaacaacaacaatagttcatgctgcaggagtgaggctcatgactttttcagggctcagctagaatcacacccagcagatgagtggagcaggacataggggaaaggtacaaataacacaggactagtctggggaatgggagaggccacatagttaatggcagtgttcaaatccagatcttctcagtcaaaataaaaggcttttccttcacgccagatttgcctccttgtatcaactactatagagttacaaaggtgaataagataccactcctgcacttcataagttcatagttaagcaactttggacattcaggaagagattacattaaaatggacgtcgaaacacctttgtccacatgaaacaaatatattctgagatacacaggggttgacagaaaggtgcaaaggccttacacataaattggagactgttctcaccaactgtcagagtctacctctaacaaggttaaatcaggaaatcactaaaaaatttaatcatctgaaaggactttgatcacagaacccttttcttcaaaagctatccatgcctttttattgtttaaaagtcttcagcctggaattagtcctttccgtctcttatggcatttagcacaatgtctcacacagcaaagggattaaaatttgcttagcttggcaaaagccacaaaaggtacaccttcaaataccggccccaatcctcttttcctggccctaatgagtatgtttcccaccttatattcccttcatctacctacaatttaatttaattaaatagttcttaagtatctattgtacatgctaagcttggagctggagctatgaaaatgaatagactctgtgatataggacaggacatccttcaacttcctactcataactacaaacttaattttatttgcaacgttatcctctgctttcctggccccccatgaaggtggtagccattctacctaaggccaagccagcccaaggtttgaatcccaatgcttcctgcttcttctaagtctccattaatcattctctctcagatgttttatccccacattttctattggaaaggacttcatggcatttctatagagtcttcccttaaatatttaagtctctgtattcctttttataaaattctcaaatgtccttaagctcctcagtacccacccccacccccgaaactaccctgtctctcctcccatctggaaccaagtttcagggaagagttatctataagacccttgtgcttcagtttcctcgccttccattcactcctcaacaccctgccatctggtcttgtcccactattccataacaaagggaccatattttgacccttatattaatagcatttgaccctttgcctccaggataacacattctctagatttcttctcccctccctgaacaggctttctcaagctccttggtaaacttttctttcttggctcatcccttggactttgctgctactttgagctctgtctgcagccttctcttctcatcacatcctccctgggtgagttcacaccctctaaattcttcatttgccatctttgttctgatgtctcccaaatgttgacagctagctcagatctctcttttgagggccaaacttctacacccgtctgctcacttaacatctctaggtagatattctatacacacctcagactccaaatctatacttatcaccttctctcacaaactatctccttttcttacattttctttctcactgaatggcaccctatccattctgctgttcaaaccagacaccttgaagtccataacaattcccttttcttcctcattatctgcatctaatgagtcaccaagtttaatcaactttagctcctaaatatctttggactccatctcagcttctctgctatctggattgatacaacagtcccatgactactttctctggctctggactggtctttctccaatctattctctataattggacaacataatctttctaaaggacaaatatttctcctgctgaaatccttttagggactccctattcctctcaatataaagcctagcatggatccctgatccccatctagttgcatctcttgttaattccttccctgaagtttgtggtccaactgtgctgatccagttatggttccacaaatataccatactctcacctccaaacttttaaacattctgtgccttggtttaaaatgcatctatcacccaaccccttgcctccccacttggctttccaagatcctactcttttttcagctatcaatctagaaatagaaatactttcctgaccaccagactggagataggtctcctatgtcctactacagaatcctcatcatagttcttccttattactctactgtcattgcttgtctatccataggttatccccaatagctgattggctcctggaaatcaaggtccatgtcttattcactttatcccagagcctagaatgtagtaggttctcaatatacttttttgttgttgttgttgttgtttttttttttttgagatagagtttcgctctgtcacccaggttggagtgaagtgatgcgatgtcagctcactgcagcctccacctcctgggttcaagtgattctcatgtctcagcctcctgagtagctgggactacaggcatgtaccatcatgcacaactaatttttgtattttcagtagaggcggggtttcaccatgtgggccaggctggtctggaactcctgacctcaagtgatccatctgccttggcctcccaaagtgcatgagccaccacgcctggcctcaatacacaattatttaaaaataaaagaatatttaaatgcagatctgtttaaaattaaataaatatataaatgaacacatgtgaagactatataaatgagtggagaaatatagatatatagatatccataatactatgatatatatgatctaagttatgattagtaatagcagcaacaataacaataatgtagctaacttctactgagtgcctattatgtgtcagcatcattataaatactttgtacttattaactcaattgatcctcttaatatctttagaaggtagggattaattcaaggtactggggatgtatagaagagggaagatttaattctgctggtattgagggggtgtcaatgtagcttcagagggaaagtggcttctgggtaggtagtagtgaaagccttggttttgggtgagattcgaaccctggggaagaatatctggtggggatactgagcaggagtggtaagagaagtctgagaaaaccaaggggaagtggcactagaaaaaacaggtaaagcgagagcttcagaaaggaagagtgttaaatgtcctagtaatgtctagtagtaaaagaacataggctctggcacctcaagtcctaggtgcccttttgtgagagtaattttagtagacttattcatactaaagcagattagggaaggaatataggcgaagaaatgtagagaatgatacagagttctcatacagaaaactggtagtgaaggaaaggagagaaaaggaaaaggcaggcagggtcaaggggagatttttttttttctttttctagataggagttaactggacatggtttgatttggttttggtttagtcgttgatttttaactgaaaggaagactcccattgactaaatattgaagattaaaggagatcagaagaggcaggacagactaggatgattctgggaaagacagcaggtcttcatctgattggggaaagggacaggtgaattactgacaaggggattcaactggaggaagttctcccttgatggtctctatcatccctgcggaatatggtatcatagttaagatattagaaccctattcaacccagtcttcttgataaaggaagagatgaggaaaaaataagagattttctttaaaaattatggctattgtatatatcacactaaataaacagaagaatagacgggaaagagatgcaaaagagtcagccatacatagttcctttgaatgaatctagggagccaaatggaagcaaaatatcattttgcgaaggcacatctatgctcattaaactagaccataatctccatgaacccaggatatgagactgtcttgtccactattgcatccacaatgcctatttcaatgcccagcccataccaggtactcaataacagttttttagatgaatgaataaaaattcaaacacttataagttttatttagttattttaatcaaggttaaaaacagagccagcttcatgggtatgtgacctgggcagtttcacagggccccatgccccaaagggcccctggcttggtttaatgctttgcagtcactgtgaaattttcaataatatgaacaaggggactcacattttcattttgcactgggccccacatattatgtagccagtacttcttaaaaaaaaaaccacacgtttctataaattttcagtaaatggatattttagatgcatgtgaatgccaaattacccatagaaatttatctttaaaattaaaaaagtatatttcaggcttacctgaaatggtagattgtggtttttctttcttaaaatatggttcatactctctgtagacaattttcttaaaggaagttacagaaagattcaaactggaaataaaatacaaaaactaatttgaaaggcatattcaatatctatttctcacattacaaaaaaagtagatctctcatatcttcagacttctagtagaataccagtatctttattgtatttcagaagtccacagttttataaatatgatcaataagtaaagttaatgaaataattattggtctcttcaaaaatatcctgttgtgataactatttgttcacaagttaatctaccctaatatcattcctcagaatcaattttctaaaaagaacccaatatcacagtagaaacccaaactgtaggtttagattttatatgattaaaatatgaccaaatcctttatgaataaatatatgagctgtttttcaactgatcaatcaaatatagttttaatctactggggaacattgtgaaaaagtattgatttggtggaatttatttctagttgagaggtgagagatggctaatggggtaaaagccctgggattcatattggaaacaaacaaatgaaaaaactgttttggaaagagtcagtaacttgtccaagagatacagttgataagtggcagaaccaagattaaaaaatgtgaaaccactgcattcatgattttaaataaaattagagagaggacagacaacagggagagttgtgagtggtgggttactttcctgtttttgctgttgttgttattgttctgtacctctaaaggcaaatcagtcttatccttgtcttaaactcaaagatgagggtaaaaggaaagagaatttggagaaaataccttgcaaatgtctaaatcagttgatcagagtggctttgttttgcttcctaatgtggggacagtggcccagccataatcaagacataacagcacccacatatgccatgacttctatacagcgcggtggctagggtgcaggctgtgaattcagtatctctggacttgaagcctatatctacctcttattgttttactttgaaaagtttacttcatccatttgtgcctcagtttctacaactatgaaatgagattaatactgaaatctccttcacagaattgttgtataattttaaataagttgatatgtgcaaaaggcatagagctggcacactagaaatactcaatccatgttagctagtaatattattttgtaaatgtaataagagttagtctttacccttcaggttttctcagaaagcaaaaacaaatctgtagttacagtaatgctcacaaattgtaatatgtggaatacagaaactgtgttaatatgtgggggcagaattaaaggaggcacgtaagtacttttagaatagctagatagagaaggtagtggattctccatcactggaagcattcaagtagaaattagacaactacttggtaaggtcattggtgctgagggaaaggggaaaagtagaaggttaaagcgtggaagttgaatatgaattaaatgaactcttagcattcttctaacttaagaattccaggattctatatactaatgtccctaatgtggaagtccatttttatttatttatttttagtacaattgaaaagttattgtcctcccctgccccagatctttaatacagaaatgtagatgatggtgtaaaatctttactaaaaaatatcagtctcttacgtggagtaatttcaacagagagatgtttcctaacatgtttttactatgtatgctgtgtattcatactgaggtatgtctattttgatctgaacaatttctattggaaaataatctatctgattaaaaagttacagatcatatgaattcaaacaatgtgtacgacgagtttttcatttataaggattgtttaaagatgatttgttcataatcacaaaatcatataaagctagaaccctagaaggaaaatgtatgtatatcttttcttcaatatctctttgtatacatgtgagtgactaaacaagttttctaaggaaatttttgaaagtgttcaccttagacttggagcaagaataatagatacattttacctttaaaaggcattgtcctgctaatattatatgaaataagtagatagatgtctgctttgtgctaaaatacactttgccaaaagatggagttggctatgttgatattcacctagtgagtatcatagctctaggggcaggacaagttagaacaagttcttagtttaagcagccagatatatggattagatttttcataagaaaatgctagagagaaatgatatgatttagggttaaacaatatgacagtttgtctgggttgtgtttctatggttttgactcaacaattcctaccagaggaacgaatctccagaactttggaaacttacccacaggatgaggggacagaatgaccagtcatggttccctgtgtactcaccatgtgaatcagacctttgccctatctggttctgcctccggtattttgcttgttattttcaacgctaactacagacaagagaaaaaactcccaagcatgaacccagcatgctacaagaaagccaacaaccaagtctgcattctactcatgagcaggcaagattagtgttagaaggactgttattttccttggggttttagcttacggcagttcccaaagggtgtgggtgtgacctagattatcactttgaagtacgatatttaaaatgattatttttgagaaggagggatctcttcttattataagaccaagatggtatgtaataccctccaaaataacccagttacaatgagagttttaaaaaggttaatattatacactaaaagatctcaaaatattacattattttttggcagattactttggttttgtaattgtaaaagaggaacacatctttcataatgaagtgtgatgtaaggaaaaaaagtgagtcacactagcaggtttaccatttaaaaaataactaactggaaatattgaatagactgtatgatttagttaatttctgagaagtcttatttttaacatttcaattagaaaaaatagtttgcaactcaaggatagtattttatctgaattaaacctcctctcagttacatatgcctttaagtagccaaggtaaaccatatcccaggacatgatgaacagagagaaaaaaaaatgaagagtcacattcaataggataaataagtcaaatatgaagcagaaaaaaggtgaaagtacaaaaacatacaagaactgatgatattttgaaagtcatttataaggcagcaataaaattatatgacaaaaagcacaaggtgttcatttttagttttagaagatgaagctatgtagacaatggaataaataatatgtaactaggagtctcataaaaatactatacaactaaaaatctggaacaggagtttgcaggaagggctaatgagggagcaagtgcctggtgcctttgaattaaccaatatataagccaacacaaacatactaacaaaactgtattgaaaataaacttgaaaagaaggtagcatctaaccaatcaaatagggtgctttctaaaccctcagaatgataaactacattgttggatgcaaaattagcatttgcccagtttatttaattcagtatactctcctattagttatatttacttacctgaagttaaaaaaaaaaaaagccatgacattgcaaagggaatgttctctaaaagaaatagattttcctctctagagaagcccacccggactccacacctgagttaccttgagtttgtgggctcaggtcggtagctccaactgatgccctgagcagccacgtagaactgccttagctgtgccgcttctgtcccttggctcccccagcctacccagctggtgcccaagaccaccaggacccagaggcgtgggcagcctgggaacatgcttcctttcctgctcccgctggctgccaccaccccaggacctgggcagcgcttgccgagctgctaaccacactccgggctgtcccagctgcaatgagctctagaggctgtgggtggcagcgtcctcctcccctgcagttcttgcaaacggcagcagcagcctctggctctcactccctccgctttttctggggcttttcctggcaggggtttggtgagatcacagctcccagtgaccagaggtattagggagagcaaccaaactagtgactgttttactgcaggtgaagaaggggcagagatcagaggctctagcaggcgggacaatgcccagggattcatgagccggacaaagctgtatccctccatttccacctgccaacaccacggaagcagtcgtccgttaccactgacctgaggcctgcctgggtccaagctcacacttggagaaccttctgtgcagtgcagtggcacccaaccaccttaagcagatggctccccttttaatctgaggaaaagagtattgtgccctgttactgggcactgaaacactattttcaagtggtgaagaagcagggaacaaacacatggacaaggcctactgctctgaatcgccttcctggcctctatcaaggcacagttctgccttgataagggcctgtcgccagctaagctgcagcatagcagcgggcttgaagagcttggctgaaaaaaatcagttgtccagatttcagtttcacttactagctgtgttgtcttgggcaagttactgtacctctctgttcagttttgacatctgtgaaataaggatgacaataataatttttcctgatagggtatgttgggaggataaaatgctactgtaaactatagttccagcacttaacacacagaggctaggcgcagtggctcacgcctgtaatcccagtactttgggaggccaaggcgggtgaatcacctgaggtcaggagttcaagaccagcctggccaacatggtgaaacccttctctactaaaaatataaaaaattagccgggcgttgtggtggacacctgtaatcccacctactcgagagattgaggcaagagaattgcttgaacctggaaggtggagtttgcagtgagctgatatcatgccattttactccagcctgggcaacgagagcaaaactccatcaaaaaaaaaaaagaaagaaagaaaaagaaagaaagagaaaaagagagaaagaaggaatcacaaatttattattatgatcatattttcctgtctccaggaccccttgtattcttgtttttcttgaaggatctgactgtttcacagcaccttaaatcttactttgctattgatagagaatctgcgaattatattgtctgaggcatcataatgacttgtcctgggttccctgtatctgcatggctccaggtttctgtcttatgctttatgcattcagtacattcaataaattgtaatctggcacctcacatgaggtctctgttaatgatatcaggctcatcaacagcctcttcctccctccccactccccccaatattctgtcttttctcctgtgctgatattattgcaccaacttagaatgcccattttcttcctctttgctgggccattctttacagtccagagttctgcctatctcccagattctgggctcaaattggcttttccattttatgaactattacaacactattcaaattatataatcatgttaattaccttttgttattccatgcaggtatctattgtctccctaactgaacagttgcttacacttctttatctacaatattatcagtgtctcccaaagttggcagaccatcagaattcccaggggaacttttacaaaatgtagattctgactcaggaaacagggttgagaccaaagtcctagaacacctagcctactgattgacatttaaataagcagtcagagatgctactggcagtgtatcagagaaacgttttgaaagcactgtgtccctaaatcccaaggttactaccagaattgttgcaacattattgtaacctttgagtaggctgcttttttatttgcatgtttgcttatgtatatacagtgtacatgacatatttatttaattacattttacagagacaagatgactactataatttttggctctctattttttttaacatcagttccagataaatactatataactttcaatgacctatttattaaacatgggatttaaagaacatgtaaaacacatttgttcttccctgtaaaatattaaggtgatgaagaatttttccatttctctgattttctcttgcagtgtagggtgtgcgatacatatttgctgactgaatgaatggttgaggtgtaaataggacaaccataattgtgtgttattacactgatggtaaacaatgtgatgtatacagaccttactgaacaaaccataaaatagaggaacacggcatttggggaaaattcttttaattacgcatttgaatattggtctttgggtcatttgagggacagtgactggtggcaggaaggtccacggtgacatgtggccttctagcttgattcttggccttctgcagcctctggtgccatccagaggactctctggaagcctcagagcagaggtccaagaggcctcatcaacagcaaccactggagactccagaagatgctacaggaatttcttccaattagagatgccacctgctttccaacaaagtggagaaaaccttccttcaatcaaaaaataaagaggtatttttatttctccacagtctggtcttcttgtgagtcagatgctccagtctctttggttcactggtatttcaagtaacaggtgagtcaaagcacagagactactgcagaaacatttgctcctggcttctgtggcttgtgttacaggaagagaagaggtgggacaggaaggggtggtaggttgagaatttgagattgtaccacaatcccaaactcaggaaacagggttggtccagagcgggtccaacaggctggtccagagctaatctaaggtaattccatgtctttgattcatgggtgtttatggaaacctgcagcaaatgcattatagttaagtccagtgtagcaggaaacttgatgttcacaacaggatcatatggaggctgaatgaggagaccaggaaaaggacaggtctctggaaatgagaccaaagaaatttaaataattatcatttccttaaaaaaataaaagaaagaaaaaaattgctcatcatatctacaccctgaggcgcagcataatcttttctttctagatttcgaatattctgccattcaggctttttgtaggacactcaactacccactttttgggagagggatagcatcagattatttttgtttttccagcaggtagcatagggaattgactccataacagttcgtaaacatttttcagcagtcctgacttctgctttgcaggcaaggccacatcatcaccacctagcagttaataatggaaatgttacacatcctgaaataagttatgtcttgttaggacatttctgtcctggaggaaatgaaaatccttttgtgaactcttttgtaactccattgtcatacctgtgtcctactgccaacacaatttccttcatgcctgaaaatttaatacatacttaaaatttaatatatgattatgtaaagaaaagttaagctttatagtcttccatttttccctagtgttctatttccttcaaaaatatctttatagggatcttaccttaaggactcgggtcaaatgcagcgtttgtaaaaactccatatgttcctaggtggctaaagaacagaaacacaaggatggcaacaatatactgcttagttctcgacaacacagtccaacacatagtatttccagaaaccacaaattaccatccacccttggaattctgctttagaaaggaaagaaaaataaatgccaaagaaatattcgatatcccacttaccagctctgggtaatttgcattgcattttgcacccacactaagttattgttcatgctttatgtactgaatacctgttataccctctaagttgctgcaacctcttctaggtgacaagaggtagttacaaaattcttggcattaacacttgataatctaacgatagttttcaaagggtgcaatatgacccctaggggtgttttttgatttttataaccaagagttcttccgatattgagtgggtatggggcaagggtgctggatgtctacgacaatagagttcatataaggatttccatgtcctccaggacggaaatgtctttaaaagatatccagcacccctgcctcctgcccactcaatgtcagtagaactcttgttcattacaaaaataaaaaaatacccttgggggcatactgtccctttttgaaaactattgctagattataaatagcaaggggtacaggacacaaaagaattgtccaacatcccacataactttggaatatctgctcgatattcatacaggttaaaaatctctgagcctggaactcaagcactttacatgtaaatattaagcatttttttgcatctttaaaatgcaattgccatatgaatcaaaggacaattatcacaggttttcagactctttaccggagttgttcaccatgttgaaaaattaggctggtgttggccacagttctaatgctctttgagtcactaatacaacattcccccatcagtccacctgcgtgggcgttgctttcctagtgattctgtggaaggtgcacgcttctgatgacctcattgcatctactggcacagcgcctaagtttttgcatcttgtttttattataaattacttttcattttattcctactttatattttaattagaatatttgttatctgtgtattttacttcagagtagaaaagaagacattgcaaaagacattgtaaaaaggaggcaggcattgcatgtaatcattctgacatattacagtgaattataaagttaaggtagcaaaatttactcaatcataaaacatttctaccttacctgtgaggattcaaggggcatttcccatcatctaaaatcagcaagaagacaagaatgaatgattaaaaaaaaaaaacaagatgaaagagagggtcattaaggatagaaattactggggaaaaccagtagactgattttcaggagggctcattataaggggaatattgggaacagtttctccctgaaaggtagaaagtgttttaggctaaattaaacattcgacaatatttaactccagagtcctgtcactttcttcctccttcctttcagtaaatacataaatcaatttcttttgagggcatcttgtgtcacttgccctcagcccttagctgagcaagctaatcacatacatgaatccaaaccaacagaacagtggatgtttttcctccctggtagcatatttttatccaaataacagactctcatagttgaattttcagctatggctgcagcattttcctcttatttggccatagaaaacttcaaagcctaaaatcaaattgggagaagctgaggaaaaaagctcccatccccaacaaatgaatgtatttattattaaaaatattggggcatgagtggccatttgtccttctccactgttagagggtcctctggaaatgtctcaaagtcaaagaaaggacttgggggaaacatcaagattagagtgattcctacatgatcatagagattaaggtctaggagctcttgcctctgccttctgggtttggttgagcaagcacacattttgcatggagggattcactgtagctctcagtacatctctttggtattgaagcagagtattgacctttgtctattgtcttagccactcacaggagagtatatgaaggaaatttggaaaaacagcctcaatgttttggtagcattgtaaatggagaaagaataagagtaaggaacacgtggttttgcctctgagcagttaagaataggtgttgagacctatgtcaacaatagagaaattcaatgagatctctttcagatattttaacatagccactttccattaccttgatttgagcaattaatggtctctctgatgcccccagttactttctatgaggagtgatgaagaagagccccattaggttataaacaaaactttatgaacttataggcaggctaagtgtctggagaagattgagaaaggatgttttaaaccttaagagatgggatgttcccatctttaattcctagactaaagttctttttctgatgaacagtctgatgaacacagtttcccttacagagagttttcatctatttggtcttctctgtttaaatcctgcatcaactttacaaattttcaggagaaaaagcaaatctcttagcttatcacaccaggtcaccaatacaggggcagcttcttctgcccctaacttcatctcctgcctcctccataatccccttttgattcagatgcactgaactgcgaaacataccatcttctcattgattttacactttcatgtctttctacatgccattttctctgatggaactctatttccattttccccttggctaaatgcctctcattcttcaaagctaagcttgaaaaaggctttctgacctgccagtctggtttaggcatccctagtctatgttctaataatacctaggttgtatttgtgtcctaacacacttactacacttcactaccggcactgatttcacctgtctcccctactggatttttccttccttaatatcagaaaccatcattatgagtctcacactctaacagagttgatgaataaatgactgctacatgaagaaatgagtgaagtcaggaagcataacacctttctaattagctttagtgatagcctagggtacttagaccagaggccccaaatgcaaaactgcaaagtagcctcatttgaattttgggagagagcttttgaaaaattcagatttccacacccactaccaagtctccccatagaaggatctatatttttaggaagttccctaggtgattctaatggacaatcagttctcaagatcacttatcttggctttattttcttttaatgcaaatgttttccaacatgaactactgaagttgtggtttttgcctccccaccctaaattacataaatcaatttcttttgatttatgtaaccaagatgcaaagagaagactctttcctatttacctttttgtctgaaacgctttcttagcaaagccaggagcgtcccacccattatcagacctatcgtagaagccaccgctccaccaaagtaagtcagggcttcctggatagtcaatggtcctgctacaaaacaaacacacacacatgcaagacataagaagtgtattatgcaaaagactagtctttctctcccagaaagttttcaagaactctaagatgtgcgatcaagtaggatcaccaaaggtcctgggaatgctgacaagctaacatgaaagaagatctggaattcataaatccactgcaacagaatgggaagtggggccttattttattcctaaggcttaaatatagactgtaatttccaaaggaatcagggtgaggacccaataaaagaaattaaattgtagacacaagaagcctatacatgtaagtatgggcaaataaaataaaagtggggccttaatttattcctaagacttaaatataaactgtaatttccaaaagaattagggtaaggtcccaataaaagaaattaaattgtagacataagaagcctatacatgtaagtttaggcaaataaaataaactgtgcataattttttggcaaagattcagttatgtaacaaaaggcagtcaggacaagctatgaggggaaaaaatagggggctgaaatataccttgcaaacagatggaatttaattaaggaagatctgctaggaggtttttagagttaggtggtaagcaaaggtcttctgagataataaattagaaatctgcatgaaataactcccagtttaaaacattttgaaacttcaaggtctgttaaacagagattataacgaagcaaaaggtttcatttcacaaactgaacactgaagaggaggggtgattacctacacagtcactgggtttaatttccactactttataaggcaaggagattctgcctgattcattgtgaaacacttattaagcagggggaaacccggggatggaaagcaagaccactatgagaaagacacagggaagaaacactgattttgttattttccacatcaaagtgacttcttaacccacatgaaaattgtaccttggcaggttggcacggtagttgaccagtggccattctcttggcatgctgtttgtgcagagccattaagtaactggccctctagacaatggaaagagcagattgatccataactgaagtttccccagaggttggagcagttcatcgctattggcttattaacatgtagttctgagcatttcacagctgcagaaaagaaataatgcaagagaaacaacatgtggattggaggtgaaagagattatagtttcttttgtaacctaacattgccaataaatgaggcagaatgtaaaaggtcagaaaggatatgagccacttccaatattcacagtagctcttctaacagcacatatatgaaaatattctctcgaagggtgatatccaaagaaccaagatgcaaagatggacacatagtagcatccgacaaatacctgctaatgcattgataaatcttgcctccaaatatactatttacaaaattttggttcttaaaatactgttagtctaaatgttattactacatttgtgatcaactggcatgtcagtatgtgtttattgaaatacttaataagtgttcagcatatctggacactggaagtttgaaagaagtagactgtcatcctccttaaactacattttcagggaacttcagggttattctttctaatttatggataggaaattaaaggtcaagaaattagatttaattcaaataaatgttatttatcagtagtgacatttgcaaagcactgtgctatgttttgtgggggatacaaaaatgaaagaaacataggtctcaatgctttatgtgtagggcgatagctcttcaggaaatatcatgtatggcttaactttttatttaggttcaaattattatgaaaatatggaatgtttatactgtcacataatatgcaacttctagtttaccaatttctatagcaggttttacatttaatatgtctatttttctaacacatcttggacatctgcaaatgtttcttcctttaagtctctgagtacttgtgtattagctttagcttgtgacatgaggaaggacagaagtgaaatgcctgtgacacattacttctaatgggattggtgtggatttcataagggagatgacacttggagtagtggttgtggttgggtgagacttcaacatacaggcacaatggctagcttgagtacttgcaggaaggcaggttcagaactgcctgctccttttcaccttacctctgcatgctggagttactgctgtccattgtcctgaaggtctgcagctgagagtgctgtctcctatgagtgtgaatccagcgttgcagccaaagtaacaagtggtattaaaaccaaaggttcccggatgatgcctacagtacatggttccctgcccaggagtggtgagggctggacattgcacccctggagtaggaagtgatgctatgcctgttgtgagaaaatgtttccattcagagacctcccaattaaaagaagcgttaacagagttaaggctaatctggaataactgcttttcactcccttcataacaagggaggctcctgcaagagctatttaaggaagttaagaaaaactatcagtgtcagagatagaaaaccagatgaggaaaattattaaaaatcatccttgaggagatgattctcctggccaagagaagaaatcagaggagtcattgttgttgctattttaaaaagaagcaagaaatggtacagaaatataagaaattcagcagaaagccaaatatacatgggccaactgcctgcccaaccctgcctta

SEQ ID NO: 1080 - DNA, 25069 bp, Homo sapiens
catttgagctccagccccactcatcctctcggatgttctgcaggcccagcaaactcatcatgtccaaagtgaaactttttctctttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaataagtgtggcttctttctttctgacaatctttttagagcagcgctgtctaatggaattttctgtgatgatggaaatgtattatatctgtgttgtccagtacagtacagtagccactagcagcttgtgactattgagcactggaatatgattgaagaacagaattttaaatgttatttaatttcaactaatttatacatagttagccaatgtggctagtggctaccacattagagtgtgcaattttagagaaatacttcagtgtcatttctaagaacatggacactaagaaaaacagtctaagtttgtctttatcccagctttcctaatcttatccttgtgaccttagactagttatttcacccatgcctcagtttcctgacttctacctagcataagtttactgtgaggactaactttttaaagagtaaagccctgagaacccaacccatcatatgtgcttagtgactattattagctattattacactttgagcattccaaccttgcttctcctgggaagttccttctcccagttagaagatgaaggtgaagggttgaggcaagcaggggtgtgatggaactagctcttatcagcttgggagagccggcagggcacatctcttcccaactctacattcatcaacatcacactgataacttaaaattggccatggtgggaatatttaaaccatggtaatggcctaacttcagaacacattaatttgcagtgttgtcaatctataaaggagcttcactacatgggagtagcaaaatagatagtagaaagatcattaaagaagtcttcacttaaactggggtgaaatatgcatcctgaaacctctattccttagggccatgccaagcaagtctaagacctctgattaccctttagatgaagccatctgcccactgcaccatcaatgtattgacaaatacatgtattaaagggcagacatagccattgcttgggtgagtcacagagtgtacttctctaaaggataccaaagggaaaaatatagttgggggcacataccagagagaataccaacatttcttcttattatttttttagagacagggtctccctttgtcacctaggctggagtgcagcggagcgatcatggctcattgcagtctcgacctcccaggttcaaacgattctcccacctcagcctcccaagcagctgggaccacaaggcgtgcactaccacccctggctaatttatttattttgtaaagttgaggtttcaccatgctgtgcaggctggtctcaatctcctgagctcaactgattcacctgcctgggcctcccaaagtgctaggattacaggtgtgagccactgcacctggccaagaataacatttctgagggcagttggaggtccaagcttctggaccaaggcgtgcacaattgtggataacatccagtgcatgaaagtaaacagcccttctagaagctccctgcccctcctggcccagcattaattacattcacatcccagtctcaactgggccaggaggactcctctgtcgtagagaagtacaataggcagcacggctgtaagccatggtactgttttgctcactctggcagacactcagtcctcatttcccagtcctggcctccccagctcacgaagcttggtctgaaaacaatctggcccaagcacaatgctacagttccccagatgtctttaggagttgtgtttatttcccatggctgctggaacaaattaacacacacattttgtagcttaaaacaacacagatatatcatctttcagttctagaggtcagaagtccaaaatgggtgtcacggggctaacatcaaggcactagcagggctgtgttccttctgaaggctccaggagagcaagcgtcttcctctaaaatgcccacattccttggcagtggcccccagccagcaatcacatcactctgactctccttctgtcatcatgtctcctctgcccctcctgccttcctcttttactgataaggacccttgtgattccattggatccactaggatcatccagaataatctccctatctcaaggtccttaccttaatcacatctgcaaaatcccctttgtcatgtaaggtaacacataaacaggactgggaattaggacatggactgtttgggggacttcattctgcttaccacagcagtcttgctatcgagtcctcggacccgccatgcatccacagttgcaagcctctgagcagaagacctgggacttgaatcctgcagtccagacccctggagaatgaatattcctttccatacagctctttgatggccatgtccagtttgccttctttgtcttccctgttcaccaaggcagggttttaaaattctccctttgtaggtcacagccctttctcactgcttcccttctgctcatctgtgctgggcaggtgtggaatcgctttacagacccagcacctttctggggaatggccaagagctgggacagtgcaagggactacaatttgaggcagcagatagaattctagatatgtggtttgtgtccgtcagtggcacttatatttggccttggtggacactttccagccctttctctagggacactgctctgcaccaggaggctctgaggaggcggttcaggagaggctggtgcaggatggagcctgaacctgttacagcacagcatttcctgacacacagtcatggcccatgagtcaatggagtgccggtagagatttaaaaacaatgtgaacaagagccctgatctgtagcatttgccgatttccttggtgtaaacactcccgcgaaggccgatgtcaaatgctaagctgtatgctgaatcggcacctgggactaggtggctccaaccatactgcttgtgactgaagccaggcaattggacccttgttaggcaaccctttcccttctgaactggaggaggaggagtccttgctgttctctaggaatgcaagctttgtttgtgaccatggaggtgctgacaatcatactctctgccatgtggagaggccccggagaccacagcttatattgatggagaaatattgagttgttatgcagctttggatccgtctgtcccttctagttctatgagctagtgaaccatgttccccctgccccatttttatttttgacctaacccatttgggtggatttctttcacttgcaactgaaggagttcccattgtgctggtttttctccatttctcccacaggccttctccactcttctctgccctgctttgtgtcagaaaggctgacttcttctttctcatttaaccaataagaagcaccagcaggagactggaatgcagaaagacacccccgacaactgcccagccagcggtccagctcccattgggtggttgtcctacggctctaggtctccctgggctccggtaacgctgtcccctgcattgtctcttcaggtctacaggtggtggtggcttcctgcattgccggctaggcgcctcagctacctaatgggttccctttactctaaccacatctttgtaaatagtccttttgttaccagtggcaaatccgaatgggtccacagcagtgtgattcttgcctcccgagaggaaagcattcgtctgaggggcataagtcagagtgaaagactgaggcaagttttagagcaggaacgaaaggtaaagtacatttggaagaggaccaagcgggggacttgagagatccaagtgccctgtttgacctttgatctggggttttatatgttggcatgctcctgggtttttgtgtctctcctcccctgatttttctttggggcaggctgtccgcatgtgcagtggcctgccagcacttgggcggggctgcacgcgcagtgtgtttactggagttgcgcacatgctcatctgaggtgtttttttcctcactagttgaaggttcctagaggaaggtcatgtattagttaagctccgccattttgtctcttaatgaacatgcttgaacccacttgcccaaatcctgagctcttattgggaagctgctgaccaccatcttaagggattttctatctattgggagactgcttttccctggcgctggctgtgaccaattattattttagagagacagtttaacaactacctgaccatcacctgatgattgcctgacattccttggtggggggccctctcctgccctgctcatgtctacctagctacctactctaacactttcattaaattctcacagtgtgcgttagttcctgctgatacatcttaactgatacatcttgctaacgcacatcccaggtctagtaactagagcccgtggattctaattcctaaatatgcttaaaccttttgctatgttccgtcctcatgggcacggctttggttgaggcccccagcatctcttgcctggaccattgcctctctctattcagctttggttcttttcactggtccttgacactgtggccagaaaaattttttttacaaaccatttagtatcatgttactcttagagcttaaaacccctcaatgattctctactgtcttcaggatcaaattcagactcattgctagagtcataggatactcatggtagagattctgttccttctctgcctcctcttctgccaagccccatttatacacatctccctgtgaagcaaatacccttagatgctttcataccgcctctgagatgttttttctaggcaccacccctatccggtctgcagcaggggctggagctagtacccacctgcatcacagtggatgacactgtcacgcttatggtcccactgacagtgagtcacccggggatcactgtatcctcagggcttagcactgcccagccctgctttggctgaaagaggctaggctatgtggagaagatgcatttaattccacatctccatgtttttctagtaaaacatgctacaaaatcatgggatggtcaacatgcctctggtgtatacagaaaaagtgctctgaagataaagcatggactaagttaggcagcacccccgccccttcccctgcccaccaatcactgtacttactctaatggcagtgagttttaaaaaaaaaggaaataaaaggctacttttgtgtggacatagatatccaaactggctctttgcaaattaatggtctgtcaccgggaaacagcactttctgttggtgggatgcccacaggacaggcagagaggaggcgtggagggtcccgaagtgcgggaggggtcaaggtaaaaatagcccacaccatcaacagctgtttattccatttatttaagcaggcttccggcccaaagttctctgggcacctgtacaaaatctaaattcaacatataaaattaattctccttttcaggaaaaagcacaaacaatcccctcaaaaacccatagatgttctcaggggaagaacccctttagcggggagactgggaattttgtcagatccctggaagctttgctgagaagaccttgtctgcattactttcttctcccatgactccagagtcaaagcacctcagtgccactgtctgtcggcttggtgggccagagcaaacctcttttcctccctgagcctctgcatctgttctcagaggttcacttctctgggcaccacagcttctgctaacaatctcagtatcaaacccaactgacatcccctgaggaatctgagaatggaaataatgacatgttttatttggatggcatttggcttgcatcatttcatgggctccttacaaaagccacgagggaagggattgtcttacccattttacaggagagaaagctgaggtccacagttgtagattagttaactagaaccatgtcttcatgcccaatatttttactttgtcatctgcctttaaaaaaatttattgctcataaaaaataatagtttcacaaaatgagttctttgcagaagattcaaacgatataaataatgcaaaaagctctcgacctcccaccagttctgttcccagaggtaatggctattatttggtgttctggataatgatgtccaactattagattttttttctatgagttcacatacatagatgtatcaacataattttgtttcatgttttaacaacatttatttgaatatagtatactgtcaatattatttctaaaacttagtttttaaaagaaacgctttgtcttagagatacttctatgtcagtacatacagatctacttcattggtttactctattgtaggttatgacagagtatggctgtaccacagttaatcgaaccctgtttttactgaggagcatttgtttccagtttttggcgattacatcctttattcgcttcttgtgcatgtgtgtaaactctccttaagggagacacaacagtggctttgctaggttttagggacttcacattgaaaatattaatggatgctgtcaaagttgctccatatggggttcaccactttatatatatatatatatatatttttttttaattttatttatttttttgagacagagtcttgctctgttgctgagcctgaagtgcaatggcgtgatctcggctcactgcaaccttcgcctcccgggttcaagcaattctcctacctcagcatcccgagcagctggaattacaggtgcccgccaccatgcccagctaatttttgtattttcagtagaggtgaggtttcaccatattggccaggctggtctcttggccaggctggtctcgaactcctggcctcaggtgatctgcctgcctcggcctcccaaagtgctgggattacaggcatcagccaccaatcccagcccaccactttatatctttaccaccaaaggcagagctcatcacatccttataaaccccaggtgttatcaaccttttaattttttactagtttgattttttaaatggtacctcatcttgtatccctcctccctggttactacaagactaaacgtattttatattgtgagatgtctgttaatgtccttaactcacctttccattgacttgttgattttctttttgatttggggaatatttttatatctattaacctttgttatgtaagccacacctttttttgaaactatgtttatggtgccttttttatataaaactttaagtttttgaggtagtcaaatttattaatcttttcctagatggtttttgcataaaaaatctggtataaaaaagtcttctataattggaagctatctacagtcatatctatctctaacatttcatatttatttagcttgttatttatttatttttattattttttttttgagatggaatctcgctctgtctcctaggctggagtgcagtggtgccatcttggctcactgcaatctccacctcctaggttcaagcaattcttctgcctcagcctcccgagtagctgggattacaggcacccaccatcatgcctggctaattttttgtatttttagtagagacagggtttcaccatgttggtcaggctggtttcaaactcctgacctcaagtgatccacctgccttggcctcccaaagtgctgggattacaggcttgagccactgcgcctggcctatttagctttttagttcatctggagtttacttttgtgaatggcatatcatagtgtgctgttgttttcttgctccctgtaactcccaactctgacttcttactgaagtaatatcattctctaaaggcagactgaaactgtttccttcagtctgccttagttctccaaataatggatctgtttcttcctcaaggctgagaagaagtctcaggtgagagaaggagaacaaatatatggagaaaataatagtgcgaggcaggaggaacggcattgcaaagactggtccagataaaacggcagagagagggagagagcactttcagcggagcagtttgggaagacatctcacagcaggtggtgcttgaattgtgaggggagtggaaggttgtttagttcgattagaatgtatattacaggctaaaagaggttggacaggctatgactgtaggagtcagcatcctttcagttcacaggccaaatctggctgccacctgtttctatacaaggtacaaactaataatggtttccacatgttcaaatggtggaacaaattaaaagaagagtaatagtttatgatgtacaagttatatgaaattcaaatttcagtgctggtagagttttgttggaacacagccacaccatttggatgtggctgcttttgcactgcaatggcagaaataagtatttgtgacagagaccaaatggcccgcagagctgagaaaatgtattctctggatctttacagaaaaagtttgctgacccatgatataggggcttggatgccagatttaggagtgtgactgttacgtgctggacaatgaggtaggatgcattatggttggtggcctgtttaaggaggaggacgctgttgtgggctggagagttgcaggtgagagtggggcagggaggtgctacaggtggcctgggaaacaatccaagtaacaagtaatagtttcaactctagaagtgggaagagaagagggggaatgtgaatgattcagtcattcatcaaggcttacagttctgggtgccgaacggtcttgtgaaggtagaaatggcagctctgaggggtatgagtactgttattaatttgctaggactgccattgtaccacaaactgggaggcttaaacaacagaaatgtattatctcacaattctggaggccattaacctaagatcaaggtgacagcagggccatgccccctctggaggagttagggaaggatctggtccaggactctctctcagcttcgaacagttccttgatttgtggcagcatagctctagtcttcacatggacactccccatgtgcatgtctctgtgtccaagtttcccccttttataaggacgccagacatagtggattaggggcccacctatggtcatttgcaatgaccttatttccaaatgaagtcacattacaagataccgggggctagaacttcaacatataaattttgggggaatgcaactcaacccctaacagtttggcataaagtagtgttgaagggactcctccccttcctctaccttctgcccctgcccatagcatggagggaacttccactgagcctcctctgtccacttctggcgcctctcactaagccctttgctcagcctcccacaggaggaaaagtttattgggcgggtcagtgtcgacctttctgcacctgtctgctggtgggctggtactgtggctgtgcttgtgggtatagctctccttttctgcccagtcttcctgctccctgtccccacagagagcaccctcaaggccagcccactgcacatcctctggctccagctccttgcccgtgtgcctgactgggaaagggcattccagggccttcctgcagatctagccacacctggctttcctggcagaacacctgggtgtgcagcatgggttttgtgttcagggaattactcttcggatttgacctggtagtgtggatcatgtggattatcaacatttacgaaagtatatttacgagaatatggtgagcaatagcaccatcaatgaaaaggcattgagaagacatttttttttaaaacaaagttcactttattacattaattttacacactaaaataatatgaaatgcagacttgtttaaattctcttgctgattctcttgaagacaatgtcacccaatgtcatggtctgaaagccagaaaagaaattatgaagtgttcatctgatgttgtattgtaaaaaacaaaattaagcataaaaaacaaaattaagcttaaaaaacagcaccaaatatgttggcatatgaaacaattcaaaaattcgtctggtttcctgtaggaccggaggaaaggttggcaatgttttccaaaatcctatgccaagtctttgtcacttctcctcctcacctggaaagtcctcctgcctttgactgaattcttttctacatcaatgactgttatagcaagaccatccaaaccagcccaatctaatttctcaaaatttcattgagtacctactatgcaccaaatacatgttgagcaccaaggatacatgtacatggacacaactaggcacacagcctggaaggcagtgggtagtgcataattgtcctcctatagctgtgaagcatataaaaacagtggatgcatcagcttttgagtttttaaggatgtttcctccacccctgccagttctcttgaataagactgctggaatgacataccatgtcatcagggtgaaaaggagcccctcagtttcagcagcaatgcaatagttgctgcttgatgggtttgagccctggatttaacatttattagctgatgacttggacaggtcaacctgtctattgaatccctcatccagcctccctcgaaggagacaggaggattaggtgagatggaacctatcaaagggcgttggccaggacttactgcaggatagctcatctcctgctcccctgctctcctgggaatgtgctggggcggaggtggaaactgcacattgggtggttgatgctcacactctctctagtttaagaatttttccatttgaatagagtgatgacagcgccctgaggcagtgttctgttgtctgtgactccctaaagcatattctgggggcaaagaagagtcagggggacatacctgcaggagaaacactgcaccattcacccccaaatagggtacaggatgtggctggcagccaggcaccaaggctgactgcataactggactgtgccaggcttgtaagctgccataatatgaccatgaatgggattctctttataaacgctaaatgggcaaaggcatttatgaagcaccctgggcatgcagggcaggtggaggcctctgtggctggttggttgcgctgagcagaaaggattagtgataatgtgtgtaaactgcctgggacatgatggatcctcagtaagtgctggcagatactgaccacaggaaagaagtttgggggttggagggtggaggggtggcattagggtatgtgagccgctccccatgcttcacctcccctctcccctcaagcactgggagccacacgctcagagcaccaccaacttacattggtgattatgtcgccgttgagttcggtcacagacttgatgtttttgaaagttgtcaccagtttattgtcaccttccaactgaaccactgtctgcagggaacagagaggtgacctgtgaggaaggggtggtggggggcaagagccttgctaatgaagttgcttcctttgcacaggtctcagctcataacaaccaaaatgctctggttcctatgatcccaagcctctagttctctggctccaaatagaagtgaggtgcatttaagaactaaataaaatgtcacgacttcttttgtcagaactttaattcatggcatgtgatctagaaatgagcatggaacacctaagtggccccaaatacaaatgctaaaatcaaatcaagtaaaatctcaattctcccaagctaatggagggaggtagtggcaaaattcaaatattgaccagtagagaatacatattttgctttggtatgtattcttcttttttttttttttttaattgagatgaggtcttgctatgttgcccaggctggtcttgaactcctaggctcaaacagtcctttcacttcagcctcccaaagtgctgggattgtaggcatgagccacccgcccaaccaggtatgtattattcttcccagagcgttaacttttcatattgtggcctccttccaagcccttatacatcctggaagagatgacaggaacccagcagggagccaaagaccctgggcaacattaaacattttgcctccaaaaagaaaatttggaaaaggcccatagttaaatcccttgaccatgagcacatcaagaatattatcctcctaaaatcatcctgacctgtaatgttctaattggagaggcagaaataaagagtgaccagaagagataaaaagcaaacacgcccagcccaatgaacagagctgtccacggggaggagagaagagggctgctagagcatggagtgtttcagagggaggaggagacgggcacccccattgccaggatccccctgccaccatctgccaaccactcacacagcccacaccccagctgtcattgcacaccatgagttgtgcccagcagaagtgatgctgccctgcactgccttcagtctagggaggttgactgttcttattttacagatggggtggctgaagccagagactttgtgaccacccctgaaggcagggtctgagcacctgtctggggccctggtattctggtattgctagcacctccttcaagaagtctctccctatcaccaccagctctaggttcagtgaaggccagttgactttgggctcagttaagggtttttcacaaactcccacttgccccactcctgggccctgcttagaggactcttagtgctaggagcactgggcctgggagaacctgagacttagaatcctgctgtatgcctggttctcccatatcctccatatgggagagctcagactttaggggctggaacaccccccagacagtccctgggaagaggagagcagcttctctataagattcttccctaagagctgcctttgtctctctgcttctcccacatgggaggtgggttcagagatggtatctgtgggtggaattgtgaggtttgagccttgaggaatgaggtcccagggccaggttccaaggaaagttctgacagcagaagggatgccctcctaccttgactttctcccctgtcattgtctccagctcacattcctcccccaccgtgaattcgttttggatcactttggacccagcggtgatggtgaacttgaagtgcttcccattctgcacgatttccgacacccccttgatatccttccccttctggatgagctcttccggcagacctggtggaaaccgtctgaggtttagatatgggcagaggtgggagtttcatgaccgtggtaggtaggtgagagaaacgacatgacatggagggacagagaagggcactgtgtctcccaaggggccacagaaactcactgggggcttgtcagcagcatcggctgtggcctcagaaaggaagggacagtgacctggcctggcctgctgctatcttgccagtcaatttataaaaaggacactcttctggcctgaagaaccgttcctcttgtaagcaccctggttcttgctcactctccttcctcattccctcctcctttgatgactttgctcttggagtgtgagcatttcattccccatacccctggtgaccagagagttgatcttccaagctaggtccctcctgcaagtgaaaggggagctgctgataatcatgccaggccaacatacacaaagcggcactgtgccaggcaagcctgtgtccacctctgcagtcaaggctctggaggaagacataccagcaatcccttgccctgggatagagctttaccagtttcagaacttgtctatgctgttatacaaattgaggttcacaaaaattttgtgggtggacagtgagcacagagggtcctgttgcatgagggagagatgagagacacagaggtggtatggcttgcctgcagaagatccttctctggcagcactgaaggtccttctctccctgcccctgctgtcttcagcacccttctcattcttggcaccctcccttgccatgccacaccctttgcttatagggctccctctgcctggagcatgctccctgcccccagttccctagacacctgtcttccaaagctcagcctgagccttctctttacctccactgagccatccccccatgctctctgtgagccacatcctcctgtacatgaccctaggaggcacaggggttaaagcagggtctctgagaaccagtgcctgcttccaatcctaacttaaacacttcctacttgcatgaccttgcttgtgattactaaacctttctgggcttcagttgcattaactgtaaagtgggaaaataatggtacccagcttagttttttggcaaggaatagatggggtattgcatatcccatggtcagcacagtcgcctggcacagtcagcgctccatacacctgagggaatgccttattacctttatttcttctcttctcttccctgataagaaaatgccttattgcctttatcatctgtctccctggtatctatccagcacagtgctcagtgtgtggttggccttgaatcactgtttgtttgaagaatgaataaatgcaggaataggatcacacaacgaagtgccaatgacatggccatcaatccagaccacaccctagttcagtgctctttccacttgcctatggggtggccttgtgcagtgaggacttgctgcaaataactccagaagtcagtaaaatgccccctagtttgtgtatatagcctgaatctctccccccatctcaacatttggaccctaaatagccactgctggtagagctagaccctcactgatgtgacccacagctttgcctttcagtccagcactcaccgattgccttcatgaaggcttcaaagttttcctggctctgcagttggtacttgccggagaaactcatggtggcaatagagctccctcttcacgactgacctgcggctctgccgaccagactgtccactgtaggctgttttatagggggctcccttcccttcgaatagcggccagaggtcagcagctgttgattcctttatggccaggttcaaacattaactcctgagagcaatggtcaatgataaagaacaggatgggcacagcaaaggtttgctgtaattcagcaaacattaatgaatatcagtcaagcaggaagccttatggccctgcagcctttaagtgactctccgcaccccacgaaatgtgtgtatatgcaggtatgtgtatatgtgcacacacatgtgtatgtatatagatgtgtgcgtatgtgtttgtacatcggtgtttatatatacatatatgtattttgtacataaagatgtatgaatgtgcatatatgtaatgcatatatacacattatatgcatgtgtttatatatgtctgtacacatatacacacaagtgtgtgggtgcatgtgtacacacacagaaaaataccagagaattcctttgaactcaaaacctcaccttatttacataaccttatgatctcttctcacccccattattacacaaacttattttttagagttgttatcagccgctagtgttattttgtattctgggaattcctccttgatgattataggctcctccacaggcctttttgaggtgttaaagcagtccatgctaaatggcaggtgtaaaacattgagacgcattttattaggcagagacaaggcaggagaaagtggcacctgctgacttgctccagccccactgagaagacaggacaagggatctggggttatgtgtaggaaactggtcttgtagggttatgtgtaggaaactggtcttgtagggttatgtgtacagcactggccttggggagatggcccagcagggcttccagtggccttgggatgtgccagtttgttgtgaagcacagagaggcgtggtgcccaatgggtgcacgtcccagttcctgcctctgaggcagctccttacaagcaccccctcacccctagattctctcccttctttgtctggactttggcgtcaaccttttcacctgcagcctccagccttcatcctctgggcctcctctactctgtggttagacagatcatcctgaagcataggctgagtcgggccactgctccaggcatgagcctcagtggttcccatcacttcagaggccacaggtcctggatggcctagtgtcacgtgacgggtcatgatggccacccccaataacacttccatgtccctatcatgagttctaatttttggcttggaaaatgactcccattgcctaaacttctagcagggctgccagccctcaaaaggcaactccagtctacctttccatcctttttccttccttctcctcaagccacagttccagccacagggccaagtggacacatcgggggcgtccatgccactctctctgccctccgtggtctccagcatttggacatgttgatccagcaaagcacttcagaagttctctcctccacccacagtcccagtgccagggtccttctacagcatccctgacaggtggtgttaaggtgtaccctgccacagggaggtcctcacctttggagcagtgtgggcagagaacactcactaatggagtgtcctgccatgcagattctggcaccagcagacctttccctccagcacagaggggtgctctggccctccctgcttggccctcctctgacagtgtctaggacacaaggtgcctcccaggccatgaattggggctgtccctgcagcaagcgaagtgggcctgcatgctgagaacttatggctttttataatcaccacgactacctgaacagcgggcaggaaggggcgaggtggctcaaagaagtatgggcacacccacagtccttctctcatcttgctctgagctttgattatacatcttttaacatgtctattgtactaaaggggtccatattagaccctggtctccagatgggatgctgatttttcatttttgtatatgtaaggaagtaaaaaatccattgtcttaagaactggcatgagaattcctagtgtgtgtgtgtgtgtgtgtgtgtgtgtgtgtgtgtgtgtgtaaatgactggattagctgcctgggagacagagtgtgtgagaccccagacctcagacccgtgtgtcagcgagagccaagctggtgaagagaagggcagctccctcatgcaggagaccaggagaggctgggtgtgtcttcctgtccctcccccagactgcagaaaggagagagaggaatgtggcaggcaggcaggagagaggccaccaagagggcatggggtgatgggtcactgagatacccccagtgaccgcaaggcaagaagagctccaggatggcattggctttgaagctgctcatttgctgcagtgaatccccatccatctttctttaatttccaccccaactatttcaaaagcttcagtaaaatatagtgcctgaatcaatatgtgagcaagtggaaaatgatgcaaggctgagctttatttctggatggatgtgatgaggctgagatggcacatgcagaagcagtaccaggaagtggagtgtctgtggggatgcattccctacagggttccccaggtccctagacatcctaggaagggctttggaggaattcaaggtcattttatttagatcccatctgggttacatgtgacacctaaagcctgcaccaatagctggcatatgtctgtctaatgaccatgtgaaggttcagcccagggctaaattcagctctatacctgagatcctattcactacctacctaaagagctcttctagcatttgtcaaggaaggaatacgtaaacacttgcttagatggggagcttaggagttttgcagcctaaaatcaatgaaataatcaccgaggaaaatgaccgtgatagagtcattaccatgcccaactcccatcacacccatcagttgcttcgtttgggagaatctgctccaagtgcccatgttatctcatgcccccagctgcctgcctgacatcccgctcagataaagggatgtctggcttatacattccacaactaggccctctccccttgatcgcaaatgtcaagtatcatgccccacactgctgctttctgggatctacggaggggagtgggaaggagcgtcatgaaagcttctccatagagcaagtcagcaccaaccccggaggcctcaggtgaagtagggaccaggtgcacctttcctggtgtctgaggaacagcaggacccatgagctgtctccttgtggaccactctgcctcaccctgcacttcctgcctaccctgtccaggcaacgcctgcagactcagaacagcattgggaatgcagctgacccagaggttggtcaagggcctggcacaaccagtgaagccttgacagtttccctggcagatgggcagcctgacaagtaaattgagctgatcaacgccaggccaggactccccctctcccccaggtctgagatatggccattcttaggcaacccccgatgacttccctttgtcttttttttttgtgtgtgtgtgaatcttgagggcacagagatcagtagccatttcaaaaactaatactcatgagttttccataaagttaggagagggtaatgacatcttccacccactagctgagcaaacacaagaagagataagcttaattgcaatgacaaagttcaagtggctttcaagaaagaaaaaaagagactcccactctgtgggcacagctttggagtgtccaaagattctggccctgctcactccacactagacatcccctcttctcacatccctactcagacgggcagcgtgcaggtgtgggaaaggaggggagtcacctcttggtggccaggatatgacaggtgttcattttagaacaagcgcctttgacctcagtgcctgcaatgccagcctgcccatttcctgggtgttttgaacataggaggtggcccgaggagcccataattctgctacaggcagggctgcagagggaaaggacttgggtttgggcccagctcttctttatacctgatgtggagccttggtgagcctctacttgcttatctgttaaatggtcacaacattttttgccttgtgaaataattgcgtaaacgaatcacaaccacaatgagatactatcacacaccagtcagaatggctactattaaaagtcaaaaaataacatgctggcaaggttgcagagaaaaggaacatttcagactactggtgagagtgtgaattaattcagccattgtggaaagcagtgtggtgattcctcaaagaacttaaaacagaattaccatttgacccagcagtcccactactgggtatatgcccaaaagaatataaattgttctaccataaggacgcatgcatgagtatgttcattgcagcattattcacaatagcaaagacatggaatcaacctaatgcccaccaacagtagactgaataaagaaagcgtggtatacatacaccatggaatatgatgcagccataaaaaagcatgagatcatgtcctttgcagcaacgtggatggagctagaggccattatcctaagcaaacgaacacaggaacagaaaattaaatactgtgtgttctcacttataagtgggagctaaacaatgagaacacatggatactagtaggggaacaacagacactggggcgtagttgagggtgagggtgagaggagggagaggatcagaaaaaatacctattgggtcctatgcttactacctgggtgatgaaattatctgtaaaccaaacccctgttacatgcagtttacctaaataacaaacctgcacatgtacccctgcatctaaaataaaagttaaaatttttttaaaaaactttaagtggttattgtaaaaataaaaaaatttaaaaagaattgtgtaaactgtcaagtccttcagaaatgtgacactcatatgacaggggatcggagcactttgcatttgcatctgtcagatgtcccagaggtatgaccagcgaggaccaatttttcaatctcctggcttggggacgagcttccttcccatctctctgggccagtgggtagtgcctccattccccggtttcctgaaggtgcagctgtgtcttgtgcagtgctgaggcttcatctcctgctccagatggcaaaacccaagctcctggccatctgagtaattttcaattctggcaaccacctcaggtgccccagactcagctcactgcttactgctctgacttttaattccttctgtgttcctagcatctgggattttccttttttcttgtgacctcagctgaaaaattattatgcttcaacctggacactctagccatgctgcgggaagagtttgcatcagcttcattggccatgtcgttggtcctgaaagtcttgtgtttttactatgtgctgttttcaatccttttggtagaatttcaggatgtgcaaaccgcaacaaaaaactatttaaggatatttctaagacttattttatatacaccaattttgtttcttcaatcatggtaagttctttaaagaattcccctgtaacagctgtacagtatttggaatgagacctgctctaaggaaccattcaatatccttagcatttttagaggcttccctgctaaaagaacccatggggaggagcaaaaataaaaatatgctaaacaaaaattgtgggtggtggtttgcactgttgaattatactacacagaaaagtgtattgaatgaacaatcttttcctttacatgataacttgttaggaatgtccttgttgtatgacatgaggccttcccatgatttaccttaggactcccaccaagctctcctttacatggtagagggtagagcccgtggatggcgtggcaggcagtggcaatcatgtgtcagctgatgtaatcaagacagaacccaaaacttacctgcaagcctggttcattaggttcctattttggctgtaagagctaatactgtttatttgtcccatgtcccttgtccctgagggttgaatgtccagttggtggtttaatgtcagcctgacactttaaagagaaatatctcccaagcaatcctggaccaatttatcaccccagtcctgcaaccctgcaacctctctgctttaaagccatgggtaatcaacccttcagagccacggcagcactgccctggcctccttcaaaactcagagctttggttcctctccatgaagccctcctgaggtctctgccttctctgcacccctagaccaacatccccaaagcaatttctattctattctaatacactaataatgataacagctttcattaatttaacacttggtgctttctctgtactatctcattgaattctcaaaataatactttaagacaagcaatatgttcccatttttcagttgagaaaactaaggtatacagaggtccataactgcctccatttgcccagattggaagttgccaagtagaaacacaaatccagcctgctggactccaaagcttgtgtttttgacttttattatttccatattataatttttaaagatatagcttgtcttctcgcttaaaaattcttctaggctggagcttagcactacacttttcatggagtatatgactagaaaatgttgacaggacaatagtctagccaccactgatttcttgagtcattcattgatgggttactgttggttcagaaatgtctttttattccagaacaaagagcctcacagtccatgtgcatgaagagagatctcaagaaattaaagatcctggggtggctgctggactcttgtgtttatcagaggttcagtgtaaagcatatatactgaatcccaattcttcaaagcaaggatttacagttcttccaatactgtatttactggaattaccccatctgggtcatgctgtaattatgtatcttgtgtttcatcataatcacaagcatcatcctattccctccccttgggtttccttcttcaacttcagatcctgctgaagccacaagacatcagatgacttatccactgcttaattattcactcatcaagcatcctctgacctattatgtgagatttgtgcggggctaacattttgaatgtatgaaaaacttgctatctagtaggaaacataaagggagttaaagctgccttttgagtaggatgaagtttgaataaaacttcaaaatctagataatatttgaattaagagcaagaagaaattttctggtcagggaagaagtcaagatgctttcatggagaaagagcgaagcatgcaaaagcacaaaaattgctgcagaagcaaggccttgattcaggacaggacagagaggagcatgggagagtctgagtggggagatggatgtgggcgctggagaggggaccacactagctagtgagagggaggtggactggaccatgctttcccagagtgggcatatatcagcaattgagatggttttagatggtacgtggatgaatatttttaatattaataattaagcatttagtccaatatgtgttagaagaatatagaccaacttatgatctcatggatattattgcttagaatatggtcaagcatttttagggaatcattgagagaaaaatagtgcataaaatagtacaagagcgttatcagtcagagtccaatatggaaggcagatattaacctaggcatttcaaatgagggaatttaatacatgagattggttacctggagtggaaagagctgggagagcagaggaagaaggattcaaagctgctaatgcctgggctggaacccaagtatctacaactgcttctacagtgtcttcagttctggattcaataaagtggcgtcacctccaccagggtttgaaccatgaaaaaggtgcttcctctgctcgggctgctgggagctagacccactgcatggctgcagccacaatagcaaccactagaatttccagcaaagctgcagaaggaagattgtctcttacttctgacttctaattcccactgagcaggtgattggcatattctagtcctagcagagacacagctagcaaagaagtctggaaaatacaatgtgtagacaccatgatccccaaatacagaatagagtgatgaagtgagggttaggagctgagacatgcaggtaaacaactggcacaaggacacacaaagataagacaaaaactaaaatagtgaatctgatatgctagtgacaaaattttggatttgctgcagtaggtaatgaaaagtcagcaaaagttctcacgcagaagagtgacatggccagatctgtgatttttgaagattacttccaaggcagcaggaaagatgggatggggggagacctggaggtacagaaatgggttaggaaactctggcaaaagttatggcaagagaggatgaggacctgaatttgggagtaggcaggagggtatgaattggagggacattctgtaactgtaacagagagcatttgggggtccatcataggtgggcatgagggaagagcagaagctgaagatacccctggaagcccaccttgggtgaccatgggcatgttaatggcacccactaaggagagcaatgtagggagaaaagtcatccttgcccctccttttgcccccttctcctagctagaagcatttctcttcactctgaactgtcctgctctagatcactgggcctcttattttttagaccactgtatcttacaacctcacctaggttatgccttcctttcctctggacactaaggtgctcggtggcagggtacagggattcattttgtctcccctactggtctttcctggtccttggcacagacaggctcaatacatgtctggtgaattaagcaatggctgtaatattgggacaatggccatttgtgtgtttgcacactacgcctccccctctcctccagttccagtagatcgtctgtccattgccacgtgtccttaaagttctgagagcaaaacccaacatctgtgttgacagctcaacagaaatagctaaagccagatgaaagttgtttagcagaattcattcaggctgctgatccctgcaccaggctccccttacccaatgggatttcctggtttctgaagctcaggacaaaatatacacagtatgggctcagtaaaaatttattaagctacagtgaatcagtctctgcttgaaaatgtagcatcttctcatttaaacaattgcttgaagggtctgtgacctggaataaccaagaagtttgaacttatttggattcatgaagaaataggttggggggcagataaccaaaatatctatcacgttttttcacttgttttttagagacggggtcttgctctgttatccaggctggctggtagcagttttgattacagatcaattacctagattatagaccatctgtgatttgaatggctaccgtgtagccattaccaaggatgaatgagttctgttggtaatgacttggaaatattttccaaaaatgtactgttaaggtaacaaaaggtagttacagaaaaatatgtagaatgattttatttcagttaacaacccagtaaccaaaattacgtatgccatacacccatacacatccacaaagtccggaagggcacatcccagactgtgaatagtggttacctctgaagagagcagtgggaagggaaggggaatataaagatactttttacttgttttatttgattttttcacaatatcttcacatatttcttatatgattacttttttttttaatgaggcagtcattgctttgtgagaaatattcagtccactctctccctcttcctgagaaggatgagtgctagttcccaactgtagagatgagaaaagccgctgcccagcctccttccagacctggaccacagtcgcttgtctcactaggactcagaggtgcactgctgtagagtcaccgcattcctccagccggtccttggctgttacagccacacacacagctaatac

SEQ ID NO: 1081 - DNA, 23936 bp, Homo sapiens
tagagatgggatttcaccatgttggccaggctggtctcgaactcctgacctcacatgatcctcccaccttggcctcccaaagtactgggtttatatgcatgagccaccatgcccagccaataaaaacatacttataatagagacggggttttatcacgttgcccaggctagccttgaactcctggactcaagggatctgcccacctcagccttccaaagtgctgggattacaggcgtgagccaccgtgcccagccaaccactctactttactttttaaatagactattctttagagcagttttaggttaacagcaaagctgagtggaaagtataaagagttcctatatacccgctccccccacacactcacagcctccactgtcatcgacatcctgcaccagagtggttcatttgattttgatgagctgacattgacgcatcattagtacctgaagtccatagttcacactggtcttcactcttggtgttatacactatgggtttgacaatatatgatgacacgtattcaccattatggtaccatagacaaagtttcactgccataaaaatcccttgtgctctggcatgtcctccctctcaccaaacccctggatatcattatcttttgtttgtttgggagttttttgtttgttttgttttatttcatgttttagattcatagtctcactctgttgcccaggcagtggcacaatcatagttcactgtagcctcaaactcctgggctcaagcattctcctacctccttctcctgggtaactgagactacaggtgtgcaccgtcattcgtgggtaactttaaaatatttattattattttttgagacagggtcttactatttcacccaggctgaagtgcggtggtgtgatcatgcctcactgcagccccaacatctcaggctctgatgatcctcccacctcagcttcctgagtagctggaagtcaggagtttgagacccacctggccaatatggtgaaaccccctgtctctactaaaatttaaaaaattagctgtgcatggtggcacatgcctgtaatcccagctactcgggaggctgaggcaggagaatcacttgaacccaagaggcggaggttgcagtgagctgagatcacgccactacactccagcctggggaacacattgagactctgtctcaaaaaaaaaaaaaaaaaaaaaaaaactaccagactgttttcctcattggctttctttacatgcccactagaaatgtgtgggtggtatagtttctctggttttacatcataatttggtgttgttccttatttattatttttgttttaatcattctaatatggttatagtattatctatatgtgtatagtattaaaccattgtggttttaatgtgcatttccctaatgactaatgatgctgaatattttctcatgggcttatgtactatctgtatatcctctgataaaaatttgatatcttttccccattttctaattggactgtttgttttttttaatgttgaattttgagagttccttatatattctacatactagtcctttgtggaatataaagtttgcaaatatttgctccagtttttagcttgtttttattcttttccccgggtcattcatagagtgaaagtttttaattttgaaggagtctagtttatcaatatttccctttactagttatacttttggtgttgagtttaataactcttttcctagtcctagttcccaaagattatcccccatgtttctttcctaaaagttttatagttttctgttttttaaagtaagtcagtgatctattttgagttcatttttttaaataaggtgtgagcctaggccaggtgcagtggctgacgcctgcaatcccagcactttgggaggctgagatgggcagatcacctgaggtcaggagttcgagaccagcctggcccacatggcaaaaccccatctctactaaaaatacaaaaattggccaggtgtggtggcgcatgcttgtagtctcagctactcagaaggcttaggtgggaggattgcttgagcctgagagattgacgtttatgtgagccaagattgtgccactgcactccagcctgggtgacagagcaagaccctgtctcaaacaaaaaaaaaaaaaaaagaaagaaataaaaagaaaaaaacccctttgtcttttctagaaagtgtatgcatacagtgctagttcctttacttacctgtatcccacacgttttgatatgatttctatttctattttatttctggagtctcactctgttgcccagcctggagtacagcggcataatcatagctcattgctactttgaaatcctaggctcaagcaaacctcttgtctcaacctcccaaagtgctggaattatagacatgagccactgtgccctgccaattcaatgtaatttttatttcccttaagactaccattttgaccctctttgacctcttagattctaacaacacagttctaagtggagattttcctgttacctttctgttattgatttctagtttgattccactgtggtcagaaaacacattatattatttcaattcttttaaagttgttgaagtttcttttatggcccaggatgttgtcctgatcttggtatacgttctgtggtatcttgatgagaatgtgtattctgctgttgttgaatggagtgttctattaattttgattaaatcttgttagttgatagtgttactgatgtcttctgtatacttaccaattctctgtttaattgttctttaaatttttgagagaggggtgtggaggtctcaaactacaaatttggttttgtttattactttcggttctaccagttcttactatacatattttgcagctcttataattggttgaaacacttttagaattgctatgtcttcttgttccctttaatatcctttttgtcattatgccactctgtggtaattttctctgctcttcagtctatcttatattaatatagctatttctggttcactttgattaatgtttttgtaatgtatctttcttcattgttttactttcaaaatgcctatgtcgttatatttgtagggagcttttgttgacagcatgtagttaggtcatgcttttttgttcactctgccaatgtcttttaattggtgtatttagaccatttacatttaacgtgattattaatatgtcagggcttatgtatgccattttatttttcgctttatgttctctgtgtttttgtttctattttattttcctgctttcctgtggtttacttgagcagtttttgaaattctgttctggtttatctatagtgtttttgagtatatcttctttttagcttttttagtgattgctgtaggtattctattatgtatacataacttttttacaatctatcgcgtcattttactagtttgagtgaaatatggaaaacttacctccctttctatccctttactctcccacatttataatatagtggccttagatacttcctttacaaaattttaatcccatcagacagcttaaactgtcaaacataacttagaaaatgcaagagaagaaaaatctactgtgttttcccatatttttgcttaccatgttctttcttctttatcttccacaatctctccctactttttataaatcatttccttactgtttacagaacttcctttagccattcttgtaggataggcgtactgatgacaaattttgttttccttcaactgatgatgtcttgattttcccattattcttgaagtattaatttgctgggatgggattctgggttttcaactcttttctttcagcacatgaaaaacaatgtgccacttacttctgttttccatggtttctgataagaaatccactgtcatttgagttgttttcccctgtagatattacaccatttttctgtagctacttaaacaaaaaaaattttttttttttttttttttttgcgacagggtgtttctctgtttcacaggctggtgtgcagtggtacgatcacagttcattgcagcctcagcctcccaggctcaagcagtcctcccaactcagcctcctgcgtagctgggactacaagtgtgaaccaccatgcctagctaatttaaaaaaaaaaaatttagaaacgggttctccctatgttgcccaggctgttctcaaactcctgggctcaagtgatcttcccaccttggcaacattttttgtttgtttgttttcagaatttaattgtgctttgtcttagcatggatttctctgagttcaccctatttggtgttatttcaccttcttcaatctgtagatttatgtcttttgccaaatttgacggctttcaatcactatttcttcaaacttaccccttcttctctctttctaggactccagtgacacaacgttagatcttttgttatagtcccacaaggccttgaggctttatttttcttctaatcactattttctatgttgtttagattgggtagtttctattatcctctttcagttcactgatttttttctcttctcctccattctgcagttcagcccaaccactgagcttttttcttcagctattatagttttagttctaaaattttcatttggttcttctttttcatcttctttttctttgttgaagtttttttattctttgctgaggatttctatttctttcatttgttccaagcacattcctaactccgttttcatggacgccttaaaatttttatgatattaacttaacatctctgtctttttgatattgtcacctatagtttgtctcttttcattccattttgaattttcctatttcttggtgtgactcgtgatttttggtttaagtctggacatttattcattgggagactctgaatcttatttaaatttactttcaacaggcttcttatgactctactccagcaggagatggggagggggtgtgccacctcgttacttctatagcagttcaggttccctacttggcccccagggtggacttaccatgactactgggcaagggtgggagttccaactccccatatggacaccactagcacagggaagaggagggaagggcttcattaccagctatcaggagtgaaagtcaaagtccaagctccttccttggcattctctgatactacacacttggggtataggaggcctcgttatagcctcatgaggatgttaatctcaactccaactcagcctttgctgtcatgagtgagggtggggccacagctttttttttttttttcttttctgtgatgtttggctgaagtttgtgtttgtgtaaaagttttctgcttttcttggctgcccctgtcctggccctttatttatttattttatttatttatttatttattttttcctgatcatattttttgttgggatttttttggtataggtggttccagcttcttcacctccaggttgtggaatatatgaggcaaaaattaaccaaacaaacataaaacccagggaaataaccagcatgttgttcctcagttcctgaagttcctagctttctttccacctttcaagtcttctgctgtttgttttatatgtaatgttcaaaatctttagttgtactgatcaggaggaacagagaaaaacacgtctactccaactttctggaagcagtaagaagtgaattatcgaagcaatcaattaaatatttgtttccttttttatctctacatgttttgaattttctaaaatagaccaattaatttggcagtaagcaaatatacctagttttaaaattatttaaattcaaaattgtatatgctacgttatatccttcctggctatcatcaacacttttcataaggttagtgaagtctcaaggaggtgaccccagcgcattacactgacatagtgttgtaagttgtgttctttgtgaagcggattttgagacagagttttgtgggaaggatgtttgttaaggagtgctcttaggaccagcacctgtggaagggaaaagggtggaagtaggagtacacagggaaggaaggtgaattttgatgcaggctcctcaggaagctctggaactagaatagcccttcagacttggtctgtattgggctgacagccagactttcatactctgcatcactcagttcttgatgtgggctctggaaagagcatcacattgggtgaaagaaatctctgcaactggcacaatttccaaactcactgccagctgaaacttgtctgccggcagcattctcagcaactgaggacacaagtccttcattgaaggagggtcttgatagtgcatcaccacgtataccccacatggatatttctttttttttttttttctttgagacagagtaccgctctgccacccaggctggagtgcaatggccgatcttggtcactgcaacctccacctcccaggttcaagagattctactgcctcagcctcctgagtagctgggattacaggcatgcaccacctgcctggctaatttttgtatttttagtagagacagtgtttcaccatgttggccaggctggtctcgaactccttacctcaggtgatccgccagcctcagcctccgaaagtgctgggattacagccatgagccacagcacccagccatcacatggacatttctaatgggaacatgtctttcaaaacatctcctgtaatctcattttatagatcctgcagcaaaagacaggaattacataaggacacatattaacaactaccttcccaaatatttttttctcacagcaactacagtgacctttacaaaatacaaatctgatcaagtcactcctcaacttaaaatgtttcagtggcttctcattactaaggacagaagtcaaagtagcatatgcgaacctcaaagccttgcacagtctgtcccctgctgctccctctagcatctcgccttccgttcttgccctgccagccatgatggcatttgacattttgaggcaccttgcttcttctcaccatagaccagtttcctctgcttcaaagactccaccctaacatgacaactgcatgagtgatcttatactgcttttggcaaaatatcgctttgtcatctttgttcttatgtgtgtaatgccagactttaagtttggaacattggttagtaatcgaccatccactgtctcattgcacttgcagcagcagaattgttaccatggtgacaaatattgccgttaaaaatattggcttttatctgataggggtattgacttgatgccccaattgataactccctctgaggaagaggcctgttgctttgaaatacataggtatttatgcatctatctcttgatgaagtatcaagatagaaaaggaaatgcagagaaagtgcatggcacagcacgctgtggtgggcaagtccccatctctactttacttaaattgcatttgggtggataaactatattcatgctgaagaagccctcagacaggggagggtgtataaaacaagactagaagaaagacaaaagataaagccatagtctacacaattatgagattaaaccgtttgtagctaggataattcagactctggcatagctgtaaacctggaactccagaccaaaggctttgaaaggagtttccttttatctctctcctctaccccacctgccaacctttcacattcccgggtggctttcccaaaggccctctcagactttagagtatgtgcctctctctctttctctctccttctacctgtacccactgtttcaagagtcaactcccagaacatcttaatctcagcctctatggtatttatcaaaaatcacaagatgagattttccagccacccactagagcaactgagaagggattcccctgatactgacaagccaccgctcctcccagaatacgtcgcttctcacctcctccatcttggctacacatatttggtgttcagaaaaggtccctaagttttgccggaaacccaacttctgtcctccaaggtactgctgctgcagagaatgagcaaagacttgcaaggctgggcaggtgctcccctcctggacttacatggctcccagaatcatttttctcaaatccaaattttattatttggtgttaataatttaatgttttccatggactcattttacaggttttttaaaaacggaaagacaatttttttttacagtaaaggtttttaaaatttataatcccatttctaatgtagtgtgatttttttattctgggaattaacttgcacacgaacacataatttacatcatgttagtacacagcattttggactattttacttcttaatatatttaaacatttttccgtgtttctgaatactttttatgtcacttagaatttttatttcatgcttattgaaagatctttcagacttagatattctgtcataaatctgtcatgtgtatgtgtaaaaaggaaaacattggtgaaataaattgattagggcatttctaaggcagtgatagtgacatgcaattgacaccttgctgacagatttaaaaacaatcctgatttcagagatattaaaataaagatacagtaacaacaccccatgaatacaacctcttctttaagaaatagaataatcactattctgttgaaactccttgtgtgtgcccctcagatcagacatctctccctttatcctatagatagtcactatccttaattttgtgattatcatttccttgtttttctctatacttttagcaaatatatatcccattgttgaatcttatttttgagctgttctacaaattgaactatatcatatatatttttgtgacttgcttttagtatcccacattatgtaagatttatccatgccagccacacatggtggctcatgcctgtgatcccagcactttgggaggccgaggaggacggattgcttgaggtcaagaattcgagaccagcctggccaacatggcaaaaccttgtctctagtaaaaatacaaaaatttagctgggcatggtggtgcatgcctgtaatcccagctactccggaggttgaggcatgagaattactggagcctgggcagccaaggttgcagtgagccaagattatcccactgcactccagcctgggcaacaaactgagactctgtctcaaaaaaataaaaaataaacatttatcaatgctaacatgtatagctgctattcattttcactattgtagattatgcactgtagtccattccacaatttattaactctcctgtttgatgaacatttgggcaatttccagggttttgctattacaacttgttttactgtaaacattctcctagttgtctactggtaagcatatgtgagaatttctccactgtctacaccttggaggaagacttgttaagattagatcaagagtcagcacacattttcttaaaggcccagataatattttagattctgtgggccatatggtctccattgccactactcagagctgtcatttttagcgtgaaagcagccataggcaatatgcaaaggaaagtctgtgactatgttccaataaaactttatttacaaatccaggcagctggtaagatttggacctcagaacatgatttgccaattcctgatctagaagaatagatttcctattctaattgcctacaaatactgctgtattgctccttcctaccctgaatatcccctgaggggatgtgaatcctgtctctgcataggctaagaactggactgaatgtccatgttcaggggcattcagggaaaagaggagaatgggcgaggggacatggtggtggccatgcatcccagctcttagtctgtggctttgacagtctcggggaagcaaaagggattgaggcaaagctgaacactcacgttggctctgctggccgtgggcgggtggtggagctctacttgcctggaggctggggtctccagctgtagcatagccaccatcacagaagccactgtgaggtcaccaccaggctatgggcagaaaaattcaagcaggagattgtatttcttttggagttgtacgatttcctttattatttgaactgcagtaaagaaagctgggatgggctcctctagggatacttccagatccctgggcggttgtagccctggctcctctttaaatggatttggtttcaaagacgatcatctccgtcttctcggatgtcatagtgccactgatcatctccagctcctggccaccctgggctttctccactttggcctctatgttttgcttctccaccatcttagccacgatatctacctctctgtcatgtgatgtgacccttgtttttgaaccaggagtggccctgaggctccttaaaaaagagctgatcttactggctttcttttgtaaagctcctgtgctagatgcagattggttcttccccagttcctgagttgttctcgactcctttttggtggagctgtgggtggagctcttgcgagaggagccatgtcgcttgccccttacgttgctgtaccctttttcttttttgtcatctctcgtgtttttatggccagatgcggaccggtgggaagacgctttctgattcttgtcccccgctctcctgcggtgactttcacctgccttgcggtgatgagaacttttcctactgggatgtctgtccttcttttctcttctttccttgttttcattccagacttcagcactgggctgggaaactttctggcttccatctcgttcactcatgtagccttcgctttgcaaggtggagatgaggggtcccactgctggtccttcagttctttctgctgcacacttgctggtcgtaatactgcctgcaaacgccgcactcaagctgctgtcttgggagagactggcggcccccgccatcgaggtggaagtaccttccaaggaggtgcttgcagcacccaccaaggccaagctaataccctctgaggatatgttggcagcacctgccatggacttgctggattcattttctcctggatttttgatagctgctcccgccagcgctgtggtcacttgacctgggcctgcagatttggttgttgctatgctcatagcacctgttgcaggactcattgctgcccctgctattgccacatctgttctaggtcctgttgctgttcctgccactgccatgccacctgctgtccttgctgctcctccttcagcagcccctggagtgctcgtggatggagaagccgcactagccgttccgtgggaggcatgttggattccctctcccccagcataagcagaagaggtggctgcagatacatcacaaggcttgtagagcccagtctcactctgatccccttctctgtggagctctgcagcctataccaaggggaagagaaacagatgagattgagatgactgaaagggagatcagaactttctactcctctcttatcctggagttaattcaagggcttataattagaagaacctgggtcgggtgtggtggctcacgcctgtaatcccaacactttgggaggccaaggagggcagatcgcttgaggccaggagttcaagaccagccttgccaacatagcaaaaccccgactctactaaaaatacaaaaaattagctggacaggatggcgcatgcctgtaatcccagctactcagtaggctgaggtaggagtatcgcttgaactcagaaggcagaggctgcagtgagccaagactgcgccactccactgcactccagcctaggcaacagagtgagacactgtttaaaaaaaagaaagaaagaaagaaagaaaaaagaaaaaaggaaggagaaggagaacctctaaaatcattaagtctaagtcttttgtctttttttttttttttttttttgagacagagtcttgctctgtcgcccaggctagagtgcagtggcacgatcttggctcactgcaatctccgcctcccaggttcaagggattctcctgccttagcctcttgaatagctgggactacaggcgcccaccaccatacctggctaatttttttgtatatttagtagagatgaggtttcaccatgttggccaggctggtgtcgatctcctgacctctggtgagccgccttccttggcctctcaaagtgctgggttaacaagcatgagccaccgcacccggcctaagcctaagtcttgctctcatttcttgccaagttccatctacagcaccccttcaatggtcactcagttttggttgagcaattccagtaccagagaaagtactgatacaattcctcatccttggacattgtattttacacacttatttttacgtgctctgcaggacagatttccagaagtgggattgcacagtcaagggatacactcactttacattttggtgactactacgattgtgcacgtgcatacacacacacagggtgtgctgattgacacagaaatcagtgcctggtagtcacagggagacagactgtgactcaaatcgaagaaagacttcttcattgttaaaaatatggcacagcactttagtggatgatagtgaaacctcatctccactaaaaaaaaaaaaattataaaaattagttggacgtggtggcaggtgcctgtaatcccagctactcagaggctgaggcaggagaatctcttgaacccaggaggcagaggttgcattgagccgagatcgtgccattgcactccagcctgggagataagagcgaaactctgtctcaaaaaaaaattgcacaaaaatctgtacagtctccagttgcacattggagactcagaagggttggagggggtgagggatgggaaattacttagtgggtacaatgtatattattcagatgatggttacactaaaagcccagacttcaccagtatgcaatatagtcacacacacaaagctacacctacaccccttaaatttatacaaataaaagttccacaacaaatcagaccacctgggttggggtattaagtgttcaagaaaagactgacgatcaggatggtgtagaaaggatttcaaccctgggtgtgagaccagagtagctgatacctaaggtctctgaaattcagccttatgggacacacaagccctcccacctcccagtgtggtaagtcccctagtagtggctcatttggtcctgagcccttgcacatgcaatactttttccaggtgggcctcagaaggcaccaaaggctttgtaggactggctttgaactgctcccccaaagaacctgccccatgttctcgagcctttgagaggcttaccactaggcttttgttgtcttcgggtggtgcgtccccagatagaagtgttggggtactgcagtaactctctactggtggcctcaggagatagacaagtttttcccaatagcaaaagagatcttcccgtgtgtcagaagagggacacaactgcagataaaaagtacggccagtggcgagtttcaggcgcagctgctgtttctcatgatcgtggatggagatcttcacaaatttcaagggaagcagtctcgtgagctctagagtcttgacgggcctgcgacctctccccttggcaaaccggccccatctgacatgctgttcacagattttagttggttgggccagaaccatgacgtcaggcagtgggaggatggggctggtgcagacgatgcccactgtcaccattcggacacggttgtgtacatcaatcacctctccctttttgtttatctgaataaaattactctcgaacattggtgcatacttgaaaatgttgtactctcctctgttgtacaattgtcgttgcaggtcccccatggaggttttgaacgcactcattgaagagtagctgtgggctgtgtaataaggtaaacaagattcattgctcatggttctcttcgtttaagacagctccaccagccacaaatagagtccccgagagagagacggagagaaggtaactgcccatctccctacaggacttctgcctaaatctcctggcaccaccacatttatcccctgcagtcctttgtgacctgtgcgcatctcacacccctttgtcctagcctccatgtagctatcccctctggtcagtgtcaccagcctcccccacaaaacaaatcaatgcctccacaggggagaggctgaccctgcctggggtgtaggtgtgggtaggctgggtgttcttttcaatcaaaatgctgggacacataatttatgaaccattctgcttttataaatatctgggttgtttccagttttgctgttgttacagttaccccttcaaggatcatcttcttgcaaaaatttttttgcttgggctgaattacttcctgggggtaaaatcctgggtgtgtatggtgtgcttgctaagggcaggggtgctgtctagatgctgatctctgtgtctccagtgtgtaggtagcacagtgccagcaggcactcagggataggtgttgaatgaatggtctgaagggactcctgctccccatcagaactacagaaccagggttccatctgtgtgctgattttcaggatatggaggattttctcacctagtctctcatttgaagcagttaattttttttttttaatggagtttcactcttgtcacccaggctggagtgcagtggtgcaatctctgctcactgcaacctctgccatccaggtttaagtgatcctcctgcctcaccctcccaagtagctgggattacaggtgcccaccaccacacccagccaatttttgtatttttagtagagtcaagggtttttcaccatgttagccaggctagtctcgaactcccgacctcaggtgatccaccctcctcagcctctcaaagtgctgggattacaggtgtgagctaccccacccggccggaagcaggtttattttttaaaacatcattttaaagtgagaaaaccaaggctcaggattgtcttacttgaggtcagagtccaaagctggattctaggtcagagctttttctcttcctcaagctgcatggctcactgataatctcattctgcatcagagctagtgtcattggtagttagtgatgtgtgtggggatttactgggaaccacaggaattcttggaggtcttgaatcaccgtaggatttcccacactgatatgtctgctgcttcagtcttgatgcctgcttgataaaccactgacgttccgtttctttttaaagctcttctgagaaatggtggcaaagacatctttctggagtttttgttttgttttgttttactttgctcaaggtgaagaatccaaattccccctcccccagctagagaaatacttctgaaataaacatacattccgccaaactcaatcattaccatgtggaggtcttgaaataaacttcaaccacaaaatgttatttttgtatcccccagtgccaactgcagtgcctggcacattgcagcttcgcagtaaatataaacttgcttgtgcccattgagattcattcttccatttatttattcaaaaaagtttaatgagcaagtattttgtttgggaccagctagaaagtggaaatgcaaagataaagtttcctatctctgaaaagctgaaatattttttctaaagatattgaatgactttttggggaaaaaaaagaaaaaacaaagtggcatatattctgttataagggaatcataactaaaagtcaacacaattatgttaaaaagtaagaagttggagctatatatagatgtagccatatattcttctcatatgttcatttctgatgaataattaataatgacagaactataattgtatgattgagaacctgctataagccaggcatgctgttgccaccatacattcttctaaacattttaattctggctgggtgcgttggctcacatctgtaatctcagcactttcagaggccaaggcaggaggatcacttgagaccacgagggagagatcaatctgggtaaaacatcacaagaccttcagctctacaaaaaataaaaaatattagctatacatggtggcatgtactcaagaggctgagacctgtctctaaaaaaataaataaataaaaattttgatccttacaacaagcctaaaatgtataggtctctccgcattgcgcccccagccctcttttttttgagagtctcgctgtgtagcccaggctggagtgcagtggcagcatctcagctcactgcagcctccacctcccaggctcaagcgatactcccacctcagccttcccagtagctgggaccagaagcacagcaccaccacatgcctggcttttttgtagagatagggtctcaccatgttggccaggctggttttttaacttctggcctcaagtgatctgcctacctcagcattccagaatgctgggattacatgcgtaagccaccacaccaggtcaggtttctattttatagagggaaaatgaaggctcaaaaaaattacaggcagattggacacagtggctcactcctctaattgcagcattttgggaggccaaggtgggaggattgcttgagctcaggcgctcaagaccagcctggccaacatggcaaaatcccatctctactaaaaatacaacaaaaaaaattagctggacatgatggcacatgcctgtagtcccagctacttgggggagctgaggcaggaggatcgcttgagccccagaggtggaggctgcagtgagccaaaactgcaccactgcactccagcctaggtgacaaagtgagaccctgtctcaaaaacaacaacaaaaaaagaagttacaagaaatttcagcaaggtcacataagaccaaaagcacaccgacatcccaaaatatggcaatggttaaactatactagactgactagactggtgacactaataggacagatagaatacaaacatacaaatgcaaagcagcataaatttatccattcactccattaatataattaattgtttactttgtgccagaccctgttttaggtgcaggaatatagcaatggacaaaatagacaaatgttcttggtctcatggagctggtatacagacagtaaacaagtaatttttttcctggtacctgtgtgctcaatgataaaccaataaattgaatggcatctccaatgctggtaagtgctgcagaaaagtaggcaagcaggatgagagtgtgtgtaggggaggggaaggtggtggttaaagaatgctcaatgagaaaggtgttgctgttgttgtttttgttgtttaagagatggggtcttgctctgtcatgttgcgggaagtcagggaccccgaacggagggaccggctgaagccatggcagaagaacataaattgtgatgatttcatggacatttattagttccccaaattaatacttttataatttcttatgcctgtctttactgcagtcgctgaacataaattgtgaagatttcatggacacttatcacttccccaatcaatacccttgtgatttcctgtgcctgtctttactttaatctctgaatcccgtcatctttgtaagctgaggaggaggtatgttgcctcaggaccctgtgatgattgtgttaactgcacaaattgtttgtagagcatgtgtgtttgaacaatacgaaatctgggcaccttgaaaaaagaacaggataacggcaatgttcagggaacaagagagataaccttaaactctgactgccggtgagccaggcggaacagagccatatttctcttctttcaaaagcaaatgggagaaatagggctgaattctttttctcagcaaggaacatccctgagaaagagaatgtgtccctgagggtaggcctctgaaagagccgctttgggggtggctgtcttttacagtcgcagctgtagggatgaaataagccccagtctcccgtagcacccccaggcttattgggacgaggaaattcctgcctaataaattttggtcagaccggttgtctgctctcaaaccctgtctcctgataagatgttatcaatgacaatgcgtgcccgaaacttcattagcaattttaatttcgccctggtcctgtggtcctgtgatctcaccctgcctccatttaccttgtgatatcttattaccttgtgaagcatgtgatctctatgacccacaccctattcatacactccctccccttttgaaaatcactaataaaaacttgctggttttatggctcagggatgtcacggaacctgccaacatgtgatgtctcccccggacacccagctttaaaatttctctcttttgtactctgtccctttatttctcagactggccaacacttagggaaaatagaaaagaacctatgtgactatcgggggcaggttcccccaacactgtcacccaggctagagtgcagtgatgtggtcacagctcattgcagactcaaaactcttgggctcaagtgatcctcctgcctcatcctcccaagtggctggaactacaggtgcaccacaccataccctgttagtttttaaatttttctgcagaggcagggtcttgctatgttgcctaggctagtctcaacctcctggcctcaagcgatcctcccacctcaaatcttccaaagcattggaattacaggagtgagccactgtgattggcccagaagtgacctttgagcaaagacataaaggagatcagagaagaagccatgaagatgtctggggaaagagcttctcagtcagaggaagcagcaagggccaagaccctgatatgagagcatgcctggtatgtttaaggagctccaagcaagctacagtgatgaaagtagagtgaattaggaggagggtcgttggagatgaggctgagaggcaactggggtggtggtggatgagcagatcatgttggatagaccttgtagcgctctgagaggtctttggctttgctctgaatggtggatgatccaaaccataaatatagaagatgattctggtcaccatattaaaaagagattgtagaagtgcagggaagacagtagtagagacggggcaactcctgcaagagatgatttggggtaagacgtgtgtgatagcagtgagagtaatgagaagtgctcagccaccatgcatactttgaggcaactattaggtatgctgatttgaacaatttccaataaatattagcaagtaaaaaagcaagttgcttggcctgagatactgggcacacaaaaaagtatgtcgcaaaatagcatatgtggtacatcatatgttatttaatgagaaatttaaagtgtgcgtatgtgtgcgtatgagtgtgtgtgtgtgtgtgtgtgtgtgtttgaaaggaactggtagtaggagctaccttgggtcaacttgctctctcagggaagtagcaagatggagacttcatttctaggacattcccttcacagagtaagactttcatcagtcatggatagccttcttagggtgttgaaaatgttctaaaaattaaattgagagggctgtacaactctgtgaatatataccaaacattaccaaactatacactttcaatggatgaattttatggtcaatgaaacatatctcaataaagttattgaagataatagcaacacgtcagtcttgacttatagatccaatcccattgtcttccatcattctcttagataattaaataatccctgggcaggcatgttaaacaaggctttaatatgacatcagaagtacatattgcctgctttacttgatttttatttacaagttttgggtaatgtttcttgatgaggaatgtggtagagcatggataagctagaatccaaattttagagagcttacaatcagtagaacacacactgaaaaaacagaagaaaacaggagggcaagtaaatacacagtagagtgataacaaattggttgaatgaacggtgactctaataccctttaccattatattcaaaaccaacaataattgtttcttaagaagaaaaacaatcaaaatcacaattctaaggatagttttgcatacattttaagtgagcctaaggttgaagagctgtgaagagtgataacacaaaacagtatatacaaggcacagtatatgcagacatacaagattatagaaggctgaagtctaaacgtgcattgtgggaagtggtttcaagtcaataacttttattcttcatctatgattttgaaaagcaagggaagtagacagctatatatagccttttcaatgagtgtgcagcccaggggagcattgtgagctaggcaggatgtgagggtggggagatttccataccatacacagcatgtacaggctgggtaaatcccctggcctaaaatacaatccacagtgcttttatgtcaatgttgctcagcagaggtggcgtgggctgagctgcggtcagcctggggcacctaggacttcaggaagccaacctgatttctgccttatcttctggctctgaaaagactacagtcacctaactcttcccctgaggaccatatgcaaatcagcctgcctctctgccttgggttgaaaaggaaaatgaactggtatacatacaaaaaagaagtcagacaggggatcaaaataattttatttctcaacatgatgatccaactagcaccgcctgtcttccccctcctatctctcatcctgtcttgcttctttcctgctccctgctcagcatatttggccccactaccaagcggaatccttccctgctcacacaggcttaggacaacttcactgtctccactccctgttttgctctgtttacaaatcatgagatgtcctgcctccgtttacatattatttatttaatgttacattgaagaaacttgcagctaaattcacacacacagacacactcgcaccataataaaacacttaacattaaaaataaagatcaggctgggcgcggtcactgacacctgtaatcccagcactttgggaggcggagccgggtggatcacttgaggccaggagttcgagaccaacgagggcaacatggtgaaactccatctctaataaaaatacaaaaattagctgggtgtggtggtgcgcacctgtaatcccagctatctgggggccaaggcacgataatcacttgaacctgggaggcggaggttgcagtgagccgagatcacgccactgcactccagcctgggtgacagatcgagactctgtctcaaaaaaaaaagatcagaaactgtctacaggtagaaggaggtaactgatccagtagctgggataaaatgattattctaagtaaatattaaatttaactctgaaaaaatactggaagaatgtaaaataaatattaacattgattatttctgaaggatgagattagatgtaatttttatttatttgctggtctgctctttccaccaagaatatattttacttttgttaccagaaatatatatttcaaaaaattagctctaagtttactagccatttcagtcattattgtcttctacgaatcaaaccaatgatttttgacaaatgacatatttttcttttattttaaattggaaagtaaaaaatccttccattttaacatcttttaaattatgtaaattaaaaagcaaaacatttctttacctttccagttttatatgctggaattttgatatacaaacttcctgctatcaccatgtacatttaaacatacattaatataaacacaaaatatacctggaaaaggtatagaacaatatgtatggcttgtatgtaaaaacaaaacataaaaacatacaagccaaacatattgttctgcaccttttccatgttaacaatatatcctgaagttttttaggttgatacattatgaatatacattattggtttccataaccttgtagtgttccattgtaaggatgcaccatagattattttacttgtctctcattgatgcacagagaagtagtttccattacaaaaaaatactgcaatagccaggcgcggtggctcacccctgtaatcccagcacttcgggaggccgaggcaggcggatcacgaggtcatgagatcaaaaccatcctggctaaagcggtgaaaccccgtctctactaaaaatacaaaaaattagctgggcatgatggcacatgcctgtaatcccagctactcaggaggctgaggcaggagaatcacttgaatctgggaggcggaggttgcagtgagccacgatcacaccactgcactccagcctggcgacagagcaagactccgtctcaaaaaaagaaaaaaaaaaaacactgcaataaatatcttgtacagatacctctctgtgctcacgctatttttcccccttagaattgatagctctagcaaacgtaaggtgttgttgttgttgttgttttcagaagaaagaagttatgtaggtgccaaaatattctggatatgattcttaaatggatattaataaacctaattaagtttggatgggaaccacaaggaaattaaagggcttcaaagccacatccaaagaggacaattgaaggatgtctttggcctggacacaagagggccctggagttatccaaagggcaagtcctcggactagagaaggttggagttgtaggacttcaaaagataaagcaacaaagatgggttttaggtaacagtaagagagcaatcatttatctgatccagcagccattcccctacctctagtggcaacactctagtgttcctcagagaaccatccctcccccatctgtggatgggtaggtccatgtggctgggtagggctgactccaccccactcccagatccaggagtgtgtccaggcctggaaagggtcaaatgaatattccattgtcttggctctaatgattgaggtacctgcgagcatatcatgtgagctaggccaatgactcaaaattctgggacttttactagaactataaggaaagagatctagctccactggtaagatgttagcccagcagccattttgctgccatggaggacagcttgcccatgcatgaaaccagctcagaactaaagaatgaaaaccaaaacctctgatgtcgtcgttaaataccagcggacccagcagtgccaggttgaattgatttttcctttgttatagaaattgggttaaattaggttttttccaacccagtttcagttgcggccccaaagccctatattaatgtgataaagggaatgaagtacctccatccacacttgacgcattaagaggcaaaacagattctgccagtaatagcgttcgcccaccttcagcctttagaaaacaaggcatgaaaatgcaagagagagaatgttgggggctctgtgtttcctctcaccactagcccacaggggaaggtgggtgggtgcttatctaccagaagccaaccaaaagggactttaagagactcttcagggagcttggtgtgagtcccagagttttgcagctataaggactagtgtctaaatcccactggagaaacataatggtggaagtttgtggaagagctacttattcggtgtcagagggaaagggggctctacttggggcaaatggtatatccatcattggctgggacaggaggcccgagtcttccagtagaaccatgggagggaataagtggtatgtggttctgtttcttttttcttcatttgagacggggtctcattctgtcccccaggctggattgcagtggcatgatttcagcttactgcaacctccacctcccaggttcaagcaattctcctgcctcagcctcccaagtatctgggactacaggcgaatgctaccacacccaactaatttttgtatttttagtagagacaggatttcaccatgttggccaggctggtcttgaactcctgacctcaagtgatcagcccacctcagcctgctaaagtgctgggattacaggcatgagccaccttgcctggctcttttttctctttatttaatagaaatgagatttccctgtgttgcccaagctggtcttgaactcctgggtttaagggatcctcccacctcagtctcccaaagtgctgagattaccag

SEQ ID NO: 1082 - DNA, 84852 bp, Homo sapiens
gggccctcaggtaagcccattgcattactactggaggcataaacctgagtgacagtggactgaatttggaccctaagcctggggctctttgctatgtaggttgccttcctcatactttgcccattgcggttgtgctgaggaactatgtgtgtctttaatgggtatgctttactagacccttggccattggtctccttttttaaaaaaaatggagtataatttacatgtaattaaatttaaatttacctttttcaaatgtgcagttcaatgtgttttgcatacagtcatgtgaccaccatctcaatcaagatacagaatgtttcctttgcccccagaaggtcccttgtgcccctttgcaatcaatcccatcctcacaccactcagcccttggcaactgctaatctgttttatctgtctccagttttgtcttttctagaatgtcatataaaaccgttacatatgtagccctttgtgtctggtttctttcacttaacataatcatcctttttatattcctccatgttgttacatgtatctgtaattggttctttttattgctgagtagtatctattgcgtggatgaaccataatttgtttatccattcattagttgatagtctttgaggttgcttcaaatttttagttattatggcttatgttattttaatgtaaatttctggtaaacaatttagaaactacctcttctttcttcctttaaaactcacttctaactgctgctaatcagagtatgttatgagggcaacttgaatctgtgcttcccagtggccattcgcaagttttgggctcaaatatactctatatttaattataaaaaaattactattatgaataaagctgctataaatactcatgtacaggtctttgtgtagacctatgtttttatttctcttgagtaaatacctagaggtgaaatgatgaggttgtatgggaaatgtgtgctaacttttggcaaattattttccaaagtggccgttccttgttggattcctaatgtataacagttacagttgctccatatcttcaccaatacttaatattgtggtcttttaaattttagcccttctaataggtgtgaagtggcatctcattacggttttaatttgcatttccccaatggctagtgatgttttgcacctctttacgtgcttattggcctaaggaagtacttgttcaaatattttgcctcttaaaattcagtcatctacttcttttgatataggttttttattgggaaataattgtagattacaggaagactcaaaggcacaggagggaggtccaggtccagagcactcttcagctgggcttcccagtgttaacatcttgcataactgtagtacattattgaaaccaggaaattgacattagcacaatccatagagctgattcagatttcattagttatacagatactcatttgtgtgtgtgtgtttgtgtatagctgtatgcaatgttatcatgagtagctttgtatacaccaccaccacaatctagatgcctaactgtaccgtcacctcaagactccttatgctacccctttatagatacccactcccttcagtcccccacatccctaaccttccccagaagccacgaatctgttcatctctataattttattcatgaaattaataataataattcaataaattgaattatgccatatgtatcttttggggattggcttctttcactcagtataatttccttgatgttcatctaagttgttgcatttatcaatagtttttttctttttattgctgagtagggttccatggtactgatgtttaacccttcagtcactgaaagaaatgtgcagtttccggatttagttattacaaataaagtactataaatatttgtacaagtgttcctgcatgaaaatcagttttaatttctctgggatatatgcccaggagcacaattgctgaattgtatggtgatatggtttgactcagatctcatcttgaatttccacatgttgtgggagggacccggtgggaggtgactgatttgtgggggcatgtctttcctgcgctgttctcgtgatggtgaataagtctcacgagatctgatggttttaaaaaggggtgtctccctgcacaaactcattctctgtttgcctaccgccatccgcttaagatgtgacctgctcctccttgccttccgccgcgattgtgaggcctcctcagctatgtggaactgtaaatcgaattaaacctctttcttttgtaaattgcccagtctctggtatgtctggtatgtctttatcagcagcgcgaaaacagactagtacgtatggtaagcccattattcgttttaaaaggaacttctaaaccattttccagagtgactaccattttgctactccagcaacaatgtatgagtgatctatttcctctgcaactttgccagcctttggtgttaccactatttgtggtgtttgtttgtttgttttttgagacacagtctcactctgtcacccaggctggagtgcagtggcaccatctcagctcactgcaacccctgcctcctgggttcaagcgattctcctgtctcagcctctcgagtagctgggactacaggtgcatgccaccacgcctagctgatttttgtacttttagtagagagggggctttgccatgttggtcaggctggtcttgaacttctgacctaggtgatccttcctgacactatttgttattttaaccatttatcagatcctgtgttttgttagatttatacttaagtatttaattttctttggagcaattataaatggtattttttattccagtttctgtgtgtccattggtagtatatagaaatataactgatttgtgtattttaatcttgtatcctgtgacctttctgtactcgataattctaggagtttttggttagatttcttgagattttctatttagacaaccatgttgtctgcaaatagagatagatgcatttcttcttttccagtgtctatctcttttctttctttctttcttttttgtcatattgcaatggttcaaatttccagtttaaaaaaagtggtgagagtgaacatcctagtccagtccctgatcttgtagggaaagcattcagtctttcactttaagtatgatgtaagtagtataatttttatagaagttcccctctatttctgtactgagatatttaaaaatcatgaatgagtactgaattttgtcaaatgctttttctgtatctgatatgatcgtatagtttttcttttttcaccttttgatatggtggattccattgattgatttttgaatattgaactggccttgcttacttggaataaatcctacttgatcattgtatactattctttatattgttagattgcctttcatttttcactcaccctgatatttactctgacagatgtagaatccagaatggtgcctttttagaaatgagcaaagccatatgcataacttctatttttggcataagggtacttttgccccaggctggatttccggctgctctggtgctacagaaaggctgcgtgggtttctttaggacagagtttctttacctcactattactgccatttggggctgcagaattcttgttgaggggcttttctgtgcattctaggatgtttagcagcatcctgggcctctgcccactagatgtcagttgcaccctgcaagttgtgacaactaaaaatgtctccagaattgccaaatatccccttggctggagtgggggatggggtggaaattgcccacctcagctgccaggaaccaatgcctgagaacatttggtgcccacctacctttagctggggggatgtcctttttttttttttctttttttttgagacgaagtcttgctctaatcccccaggctggagtacaatggtgcaatcttggctcactgcaacctccacctcctgggttcaagcgattctctgcctcagcctcctaagtagctgggattacaggcgcctgccaccacgcccgactaatttttgtatttttagtagagacggggtttcaccatgttggccaggctggtctcgaactcctgacctcaggtgatccacccacctcggcctcccaaagtgctgggattacaggtgtgagccactgcgcacggccaggggggtgggaatgtccttttattatggccatggaacaaaggaaagtgtgtcaatatggatactacacaatgagctgctttttcagtagtaatggtaaaatatctctaacatctcctgaacattcagtatacaaactatgctaagcactttatgtatattgtctcctttaatactcaaatccagtgaaggaaagtactggtaatatccccactttgcaaactaggcataaaaggttaaatgacttgcccaagatcacgtttccaaagcggtgaagccaggtctgtctgacatcaaacctcacgtccttgctgctgcaatcttctcccctgccagttgattccttcattcctcacctccttcactgagcacggcacatttccaagcctgtcttttgactccagcctgctttgcaccctgccctccataagtcactcccagctgtcagaactacccaccattgcccaaatacttaaaatctctaggccttccctttgggattttcccttagcctagctgaccctcctttctgtgctaaattggaagctctgctttaagacccagctcagatggctgggcccctgtggacccatcctggccagttcagtcagaactttacagctccctcctcagcaatgctgtcacctccctcctctggttatcctcatacctgcctgcgctggagacgtggctgctcggccactttccccagattgtgagctgcctgagggcactgatcaatcagatgaaatctactcccactctgcccttgggggctaattacgtatctgaaatctttggttactaaattcagtgtagtctccttctgtagtgaatagtgccctggcctggtaaggaggtgacatcactatattgtcagctttgtatcaatctaaccaggcacctttcttggttggacactttggattcattgaggaattttgagaaaagttttaaaattgtctttttgcagctggatgcctgagaaagttcctgcttttcattcagtgaaacagctggtgcccctcttctagaagcagtcagaggctgcccgagggtttccaaagcctgtccttagacaccgcaccacaggtgatggaccagcacctgggtctggcaccctagcaggctggcattgcaccagtgtttcaagtcgtgcaaagaggttgggttgactcttctatactggaccagctgcgagccctgggcgcgtcactccatgccttaaaactctacctgctgggtcttttttgccctctagctcttttagaatcttcatacataatcttcagtccaacagatgtcgttttccccccaaggcctttggctctgcctttgcttatccccagatgctcactttttgagggttctagcccagtcctcatgcctgcctcggagatcccatgtgcctccctccagagcactgccctgatgcctggaaaacatatgtgtccttcctgtaaaggcttgaaaaccacccctgtaacaacaactgtgcaagccctccctcatccgccagcccctgaaggaagtcgtttcccaattctcctgtttcccaattcttacaccgtttgtcctggcaaatcccagctgcgtttccttctccaatagcaaggccttgtctggctcctgaaaccactcctcacagcagggcagcaagtccccaccctgcccctcccttctggcctgctcctctagcgatgctcaaagttgctgtgccactcttaaggtccagccccaaaagtggatgtagggcttcgggagaggcctggggttgagtcctaagttgagcagacccccacctccccaaatctgggccccctggctctgtgccacctagaaattagcatggccttctcttggcttgttctgaactcagcctgttccgttgcacttgctgctgctcatcagtcccctgtatttgtaatttatttcgcgaacccaaacgtaaggcgcacctcccgagtcaggccgacctggactggaatcctggtcctgtcactcatgaactctgtgacttaccttatttaagttactaacataaattaggggtccctcagtttatctgtgcctcggtttctccatttgtaaatgatgatagtacctacctcattagggttttgttgttgttgttgttgttttgagacggaatctcgttctgtcacccaggctggagtgcagtggcatgatctcggctcactgcaaactccgtctcctgggttcaagtgattctcttgcctcagcctcctgagtagctgggattacaggcacacgccaccatgcccagctagtttttgtatttttagtagagacggggtttcaccatgttggccaggttggtctcgaactcctgacctcaggtgatccaaccacctcggcctcccaaagtgctgggattacaggtgggagccactgtgcctggcccctcattaggtttttgtgagaattaaatgagataagacgctgagtgcttgcacagcacctggcatagcaaatgctcagtaaaaggaggcagtagaggtggtggctgatggtagtgacggtcacgatggtgaactgcaagtctgcctgagccccagtggtttaggatgccgggatttacctgaaaacctttaggcctccccgcaggcccagtaaactggtccttgatcccagagagccctctggtggctaatctgtgaaggcgcaggctgcggaagaaaaggagaaggcggggcctggtggggagaggatggaggtgggctggttaagaaggcgttccccatccaggagaatgggaggcagggaggtgctgtgtggacatccccagactgggtgtcggacctgccttggggtcttgcccctggaattccggctgtgagacctcagacaaaccctttctctatgggccttagcatgtgaaacatcaggaatgaggaggaccaggtcattgtttcccaaagacgaagagggggcccctgacagtcattttttaatctgaatggttacatattttcatggtatcataattagtgtgcgacagagctgggcttggaatcaaacctgttcaacctcagagccactgcctgcgtggtgtctcccacgggtgtgccttctttgcccagctggattgggaacttgaaggcagggactgggctttcctgtctcggtgtcatcatggttgcctggtgaagtcacatttagctggcgactaagggtgcgctgtggagtagcagccagaggctgactctgggtcccaggagggaccaggctggttttgaactcctgacctcaggtgatctgcccaccttggcctcccaaagtgctgggattacaggtgtgagccacacacccggcctggtattattttctgtcatactggccaccatttattgtttatgctttaataaactttccatttacatgtatttctcatgacaatatgagatagctattattcctatattatttactatcttcattttactgaggaatgagaggcctaactgaactttgacaaaggagcaaaggcaccacaatggagcgaacagccttttcagcaaatggtgctggacagctggacagccacatgcaaacaaaatgaatctagatcttacatccttcacaaaaagtaacttaaagtggaccatagacctaaatgtaaaatgcaaaactataaaactcctagatgataacataggagaaaacctggagaccttgggtttagcaatgagtttttaaataaaacaccgagggcattctgtataaaagaaataagccagacttccttaaaattaaaaacgagtagggcaggtgcggtggctcatgcctgtaatctcagcactttgggatgcggaggcgggtggatcacctgaggtcaggagttcaagaccagcctggccaacatggcgaaaccctgtctctactaaaaatacaagaattagctgggtgtggtggtgggcacctgtaatcccagctactcaggaggctgaggtgggagaattgcttgaacccaggaggtagaggttgcagtaagtcgagactgtgccactgcacttcagcctgggcaacagagtgagactctgtcaaaaaaaaaaaaagttaaaaacctatgctttgtaaaagacagtgtcaagaagacaaggcacagactgagaaaatattttcaaaggcatatctgataaaatactgttttctaaaatatacaaagaactcttaatactcaacattgagaaaacaaaccagtttaaaaatgagccaaacatcttaacagccacgtcactaaagcagatctatagatgtcaaaaaaaaagcacatgaaaagatgctccacatcatatgtcatcagggaaatgcaaaattaagacaacagtgagataccgcaccgcacacccattagaaaggtggaaacccagaacacagacaccaccaaatgctggtgagaatgtggagcaaaaggagttctcattcactgctggtgggaacgtggaatggttcagccactctggaagactgtttgccagtatttacccagagctaacctatatctacataaaacctgcacacagatgtttatagcagttgtattcatagttgccaaaacttggaagcaaccaagatgtccttgagaaggtgaatgggtaaataaactgtagtacatccagacagtggagtattattcggcactacaaagaaatgatcaagccctgaaaagatatggaggaatcttaaatgcatattactaagtaaaagaagcaagtttgaaaaagctacgtatcatatgattccaactatatgacatgctggaaaactatggagacagcaataagtttcgtggttgccaggggttagggggcaggagggaagagtaggaagagcacagaggatttttagggcagtgaaaccatctgcaagagcctgtaatgctggatacatattatacatttgtccaaacccatagaatgtgcaacaccaagagtgaaccctaatgtaaactatggactgtaggtgataatgacccatcaatggagagttgtcagttgcaacaactataccattctggtggggaatgttaataatgagggaggctatgtatgggagggaaggcatatcgctgtaccttccattcagtgtttctgtgagccataaaactgctctaaaaaaattctctttgaaaaatgagaggccaagtcatatctgctcaaggccacataattagtgtgcgacagagctgggcttggaatcaaacctgttcaacctcagagccactgcctgcgtggtgtctcccacgggtgtgccttctttgcccagctggattgggaacttgaaggcagggactgggctttcctgtctcggtgtcatcatggttgcctggtgaagtcacatttagctggcgactaagggtgcgctgtggagtagcagccagaggctgactctgggtcccaggagggccagcttcccaagacttctgatagttaagtcccttctccgtaactaatgccatgcagtgcaaagagtgctggcaagggcaggaagccccaggtcttgtcctgggctttagctagcctgctagttagtggactcatcactcagagcctcagagccccagagccccatctaaatggaggggcttgaaccactgcagacagttgtatcagaggcagagggttttttccaaatagtttcctgggccccacccccagaagttctggttttgtgtctgggataggtaatgttgccaggttgggaatctctgttgcttgacaatctctaggatcccttccagctcccaaaatccatgaatcttggaacggcctgtggacccttgcatcgttcccctgaccccaaacaggctaaaggacacagaaaataacagtaaaaaaagatactttattgttaaaaaaaaaatgaccaatgaaactatgtatctgtcactcacactcacagtcacacacacagccacaaaccactcacacaaattggctctcgcccacacatctccctctcgcatgaagcagcagccctgtgggcaaggctccactgctcttccttttgacttctgtctccagaaacaacacatatgaaaaggcagtggaccagagggagggactgggtgggagggagtggtgaggtcaccaaaggccacagaggcttctggtccccaccactcctggctacatacactctacacatgtgtacacacgtactatccatgggcacccacatgtgtagacatgtgcccacattgaccctccatgcatagggttgagtcgccgcaggtaatacttgatgggcaggcgtctgcaatggagaggaggcaatggcaggtgtccagcctggacactgcggtccagctccctgcttccaaccggccctaaataggagttcagacttccttgtgtctagggaagaaaaatcccattgaggaaactcatccagacagcaaggtcaaaaagtgcctaagaatttttaaaatgaagaattagttccttccttcctttggccaaaagtgcctgggaaacttgggatgaagaacccagagttccatgaggtctgaattctttaacaaagaaggttcagagctgtgtagactcctggcaggccctgactggcagccagtggtgtgactctgaggtgggcccgttcctctgcgtgtaggctgaggagtgggacctctggggcccgaggcctggtggtgctcctcggagtccttgttgccctccatcaccattttctccccggtgcaaagcacagtgcctgacgtggagcagacacttgacaaagacacagtgagtgctcgactgaggcaggggcagaggggactgtgcccgctcccctgctgctcacctctcagcccctaggaggatgccacgcagccctctagagctcctctgtacggcccgcgtagtggttgtctgtcaggcaccaacctgcctgcctccaaaatggagctgtgggcaggtatgagaatgcatcttggtgaagttgagccagcacagtcaatcaggctctgccccggggactgagagccggcagatcagggagccctcctgtctctcgcccaccccgggagtcaattgttcctggttttccagggtcactgctctagaaatgcccctctcctgggaccctagtgctgtttctggagctctatcctcagcttccctccaccctcagggactaggtgggggattggaagagcacatttcaagggacaacagcctgggctgagggcttccctcccactctcccagccacactcaactcaccccctacgagacaggaagaaataagccaagtccagtccttggcctcccgcctgccttgctctgggaatgggaagctagaacatgacctcctcacagctgccataatcactctccaccatgtcagagccctcatagttggggggcacccggggctggccctggcctgcaagaggtgccccctccacctcacagacagcataagagggcccagctcggctgaggcgcatacccacccccttgtagcccccgtctgccaggcagggccctccccctccctgccggaactgcgagtggtagtagctgatggccgtgtactcattgagacagggggcaaccaggcgctcccggggactagggggccgagagggcatcagatcttccaggttctggttgctgtaacggggtgggagaggtgcccgcttgttttccatctccagggggaaggggaagcccccatagaggccattaggctctggcatcacgactggggttgagtggcggtgagccgagggcggcagagggccctgagtcacttcggagtgggggtattcccagcgttcgttcctggagtaagtagggggccagaccatggctccgccagggtacactgaaagggaacagcaagatagggtgagctcattttctccccggaaggtttcagctggctctatagcaactatatataacctagcgagtggtggagatgggagtgggtgggcataggcccatctgtgcaggttgtctctgttggcttacgttgataacatagaatccaatgggacaagctcaaggctagaggtttgacctaaggccagcccatcttgcaaatccctgccactaatctgagggtcagtgaacaagggaaggatttggatgtctccatgcaacccacccccacagctggatacagtaactccatcccaagtcctactggtgagtttcatccccttaactgaaggaaacacacacacagtttggactcactcacaggtgtgatggagtctatcatggagagtgatgaaatgagatgtggctcggaaatcaggagaccaggagcccttggtcctagccctgcctctgctactgaatagttgggttagttagaacaagtcactgcatcttgatgggcctcggtttccgtatttgacacatagtgaaaatacctatcataactgctaatgattatgccaaaacatgaagtgctttactaatgcacccccttttgagccaaagatgagaagaaggtgatattccccctctaggtcagccaggtctggcccaaggctgctgcacttccacactgggcaaccagaagcttagaccacttctcctttcccttcccagaaaagcacaaatgtgcagaagcccccttctcactccaagggttctacccaaccctatccagggtctacacatttctgtcatgaacctcaatcccatggagtgacttggaatttaaaggagtgcaatagaatgagcctcagaaacctggtatctgctccagcatccgtgccctgtaatcttgaacacatctcatcatgtcccatcccaaagggttggatgcgtggtagctaaaaatgcctgtgcctcagataacggagtgtttagaaccaccacccacttccatcaatcccagaggctaagcgtctctggctatactgacccatctcctcgctggaccaggttctcttaatgacaggctcattgtcagagtgggaagggaccgcagctggcgggagtctggggggcacactgcagaccactggccgttgcttagaattgggtccaaatgtgacgagttcatttggaacagaggccttgctgggttccggttggttgaggttgttgcaggagctggcactcaatgggttgagctcgatggcaggcatggcttgggtgtcaacaccaacactcctggccaggaggtctgggtcctccatggccacaggcttgtgagacttgcaacggcggcagtagaagagaagcccgacagtgcttatgataatgaacgccacggccactgtgatgatcagtaactcctgctgcccccagtcccccctttggatctcgggagtgactaggcagtgtccttctgaacaacccctcgcctccatttcacacctgcggagacagagtagtcagggggccaagtcatgaaattgccctttccatgtcccctcttacagagatctatgggatagagactgctccccccaaaacctaccatctcccgtttttcaccccccaaaaaagtaactatcaagcatatcaacatcagaactttccaccttccaccagtaaagtatgggtctcagctacatcctcatttgtgaccattaggatctgggaatgtctattatttttccagcaatgagatctaggcactgtatacactctctatcatgaggtcggatttcctcccatatcactgcagtagagacatcgactctctagcaatgatgtcagggttccagatacaagtcagcattgcccagttatagcagccaggcaccaatgttccctgctgtgcttcaccaggaggtcacaggagccaacgtggtcctgcacagatcagccaccttacaatgggcaacttgctcagagaaagcatgcgaactctcagggtacctctagcttggcattccatggtgtgaagctccagggaaacttctgtggccagctttatccacttttgagggctattgggaaagtttgccccatcccatttgagtccaaaacatttctcagtgcccgaaatgtcactaccagttgtttgttattttgggttaaatgttgttttccccaaggtcctcttttaaaatgcagacaccactttcagctgtgaaatgtcctcccaacacatctcgtgaacgaatagcattcccgactgcaaagcagggcaggacacaccagttgctgagaaaaaggactgaagtcgactgggcgcagtggctcatgcctgtaatcccagcactttgggcagccgagtcagcgggatcacttgaggtcaggaattcaagaccagactggccagtatggtgaaaccccgtatctactaaaaatacaaaaattagccaggtgttatggcacatgcctgtaatcccagctacttggcaggctgaggcaggggaatggcttgaacctaggagtcagaggttgcagtgagccgagattgtgccattgcactgcagcctgggcgacagagtgaaactccttctcaaaaaaaaaaaaaaaggactggggtcatcagcatacccagagtaatcatgggaaagccctttccctgcctgggcctcagttactgcagctgtaaaatgagtgggtgaactacatcactggctcttatacacaggctaatagcaaagggatccactgagagcttgttaaaaatagaagctaggcccattcttggagattctgattcagttggtctaggctggatcttggaatctatatttttcatgtctctttcatgattctttaaaggctcccaagtttgggagccctaaaaccagataattgtcaaagtctctttctctctaggattctaggaatgacagtttcccttgcaactgccacagccccacacagtatgaggcacagacagctggcagtggggttccaggcacagcagcacctgcccaagtggaaccattttccccaggtcactgggaagttcaggtccagagtgagagaataagcacttcagccattttcagactgcagcaaggaccagaactacctgaggagctggttaaatgtacagattgctaagccccagcttgtgattctgagacagtatgttcagaatagggctggggaaatctctaataagcagcttcctcctccagaagtgttgtaatgcaggtggttagagagagacaccctaacacaatggtccacaacccctgggtcacggacccatactggtcggtggcctgttaggagccgagctgcacagcaggaaatgagccatgggtgagcaagcattaccacctgagctccgccttctgtcagatcactgggggcattagattctcactggagcacaaaccctgttgtgaactgtgcatgtaagggatctagtttgcatgctccttataaggagcatatatctaatgcccgatctgtcactgtctcccatcacctccagatgggactgtctagttgcaggaaaacaagctcagggctcccaactgattctacgttatggtgagttgtataattacttcattatatattacaatgtaataataatagaaataaagtgtgcaataaatgtcatgtgcttgaatcatcctgaaaccatctcccgtttctcctgcctggtccgtggaaaaagtgtcttccatgaaaccggtccctggtgccaaaaaggttggggaccactgccctaacagatggaaaaggcctagaagccaggtccctgcagcactctcccctggcctcccattggactttctagaggtcagagtacagagcgcattccctaacaaggagcccatggcaggtggcctctcctgggattacctgtctcctgtgtaaggatgagggcagttacaggaagctcctttgggggagaggatgcaagttccaccttccaggcagggtgcaaaagtacagttctcccttccttgttcacagtgcttcccagagaactgtgggggacatttgcagacatagcctaggagaaaaagaagggaggtgagagaccgcactggcctagcagttaaaggagacctggcattggcagactggtgtgtttgtgcagccgttcagttaccatttatttatttggttgctcccctctgtgcccaataccgtgctgggcattggtgccctgctgaaccaagagcactttggtccctgccctcaaacagcttacagcccaccagagacaacagtcacctaaagaacagtaataaacaggataacaaccatagacactaacttagtgctagtcactgttccaaggatcttcctgtgttggctcatttgatcctcacgatgaccctgaggttggtgactgtcatcatcctcatcaggggacaggtacaaagggatggcagatgaggaaaggaggcacagagaatggacagaatttgctcaagccagtaaatggcaaagctggggttcaaacctagacagctagctataatatcagtatctcagtaattataataaaattaattttattgaagggaaatgctgggaggggtgggggatgaggctagcttactctagggatctgggagctatttcatttgagatctgaaggatgagtagaaattagctaggcaagaagctagagggcaaagagaaaggtgtttcaggcggaagagaagagtgcgtgcaaaggctagggaagggtgtggcatggtcaaggaactcaaaccacaccagggtgggccagcctggtgagggacagggagagtttgaactatggcctgggaggtgcaggagccacatgcagggattgggactctatcctagcagcatggcggccactgagcagttctcagcagaagagtgccatgcacaggtctgtgctggataaagatcaccccggctcctgctggaaggtggaaggccgggatagaagctggagaacagggaggaggctggtgccagggtgagaggtgatgggggcttgggacagagggacagcaatggggaaagagagaagtgatggattccttggatattttgcaggtagaaatgacatgattagccagacaaaaatcagaaaaaggggtaatgcgaagtgttgacaggcatgtcacatgttgacaggcatgtgggtacataggaacctctcatgttgtgtgtgatgtatagaatagatggctgagaggcatgtgggtacacaggaaccgctcatgttgcatgtgatgtatagaatagccatgctgagagcaatgtatccctatttagtcaaaataattatttgcatactgtgagcctgtgacttccacccctgggtgtcgggtgtgtgtgtgtgaaggaaactctcacacagcttcacaaggagacatataggagaatgctccctgcagcattgatgatggagatgggtgtttggagtgcgagggtggagagggaaaatgtgagtgcgtgtacatcatggagtactgagccacagttagaagcaattaatgagaattgctcatggcagcattgacagatcttaaaaatatggtgctgagcgaaagcgtaaacaacatataccacttatataaattggaaattcaagcatatgaaaaacaacatgtattttgcaagaactcattcaaaaactgtaaatgtttgcctctagtgttagggaaggggaagggagtggaatataagttaaaggggaatgagaaggagactgtgcatagaccagtgatgacactaaggtatgtgattaattcaaccctctgcccctgaggtccccattcatatcctccctcatccccccagaagtagaaagatagtttttgttgagagggaaggaagactcctggcttcccctagtctagatattgcagattccaacctgttactcacaagttaggggaagagagagaaatttggaaccaggaggctctgagatctccaccctgacatgcttttcccacctgaagagccttctgggataaaccctgggttcagcctggcaccccagccctcacctgccccatgggtccatgagcacttcccaccattgaggcatgtgttctggctgcagtagtcactgtggaggcagcactgggtgagggcttgtgtctccagcaagcctgccaccgtcttgccaggggccagcagatctagagcctcttcgttgaccacgacagcatccaggcagccttcaaagccctgggagacattcgaggaagaatgcaacagaatgaggccgcccagcaagaggtgcctttcgggcctcagaccacggcagttctctgggaccacaagggaggtgttgcccatgctgtcaaccatcaggcgaatggaagcgtccatctcctccaccaggatggagtgccactcgtggtcattcacatggcgctgggaggaaaggtttccatagaaaccacccagacagtggtattccagctggggcactccactggccagctgcaaaggaaatccaaacagccatcagcaaagccaaggagtccttgtaaacctgctaagaggctgccagttcaaagaatgttgtttgtatttttatgggtaggaggggggtgtttggctgttttagacatggcatttgcagagcataaaaaccctcaaagtgcttttgtgttgatggtctcctttgttctcaccacaccccatgggatggtctgggtagggggtgacatctccattcacagatgaggaaactgaggccgagagatgctttgctgatcaagaccctgtattttggatgcttcttcacaggcctgtccagagttccacacttgtgaatattggccttcagcgatttgaaaaacctgtctcccactcccacttccttattcaacagcttagcagttctcaaagtaggtccccaagaccttttcagggaagccacaagggcaaagtatttttatagtaatcctaagagttgatttgcctttgttttctcacaagtatacaacagagttttggagacacatgttgtcacaactgatgaatgcagaagtaaatatgagaagccagctatcttctattaagccaggcaaaagagaggcttgcaaaaatgtaaaacaatgccactcttcctttttctttcggaaagtaattatttttcataaaaatatataaagacatacactcatatgttgattgcagcacttttcacaatagcaaagacatggaatcaacctagatgctcaacaacagtgggctggataaagaaaatatggtacagatacaccatggacaaccattcagccataaaaaagaatgagattatgtcctttgcagcaacatggatggagttggcggccattatcctaagcaaactaacacaggaacaggaaatcaaataccacatgttctcacttacaagtgggaactaaatgctgagtacacagggacgcaaagaagggaacaatagacatcagggcctacttgagggcagagggtgggagaaggttaaggacaaaaaactacctatcaggaactatgcttattccttgggtgatgaagtaatatgtacaccaatcccctatgatacatcggttacccgtataacaaacctgcatatgtacccccgaaactaaactaaaaattggaagaaaaaaattatttaattaattaaggtatttatgttgacatgtgagtttattatttctaaataaattaatacatttttaaatatctcagttttaatgtctaatactgaatatgttgatagttataacccacataaccaaaacttccctggaatcctcaataattttcaagagtgtaaaaagtcctgaagtcaaaaagtctgagaaccactgggttaaaacattttaattcacttcattcccaagaggtaggactgcctgtgaccaaatacttttctggtcactttgggctaggtagagttttctctgttgaaatttgaagatctaacccagtgtttcttatacattggctatctgtagaccacctctcagatttttgccccagttgaatactacctatacctttatttacttaaaaaggagacactattattagggtaaatagaaaaccaacacacttgcctttaagaaagggggataacaaaaatgaatgcaactcaagtaaaacattgcaatgaaatcatttctttttatctgtctgggaccacaaatctgttgatcccaccgtcttttcattgtctcccacctctgtaatgtcctcgttcctctccttatccagtttaagttccatagtcaatcatcctaactactcccttcacatactcttgacctatctctttcttacttcgtagaactctcttggtaaacccacaactatggaaaaagctaactctccacctgctctatacagacatggagcagaacatggctggagaaaaacgtgcagctttgctcacgagcctctctttaatttcatgaccatggctctcaaatgagcctttaatgctgcccagcaatcacactcccttcctgagtccatccgttcttccagatgactgttttcactacgtctctctcctgagatccctaatgcctccctcctcattcccactctcagctgatcatctcacatcctactgaaatcatcagatgggggaacctgcaggcactttcaccatcacatctatccaccttagctaaagccaatctctccatttatgcactagattctacctcctcacctcctcaagggtctactgattctccttcctctttcttacatctttgttcgttcaccactatatcattccacagcatacacacatggtgttattgctctaatctttattttcaaaaatataccttctttacagatgataatctttatttttttaaaaaaggttgtcttcacctcagttttccagccagatattttccttctttcctgtcccttttccgcaaaatttcaccccaacccaccatacacggaaaccattggtgtcaggggattcaatgatctctgtgttgccaaatcacttcccatcttactggcctctcagcagcagatcacccaacagatcactccttccttcttgatacgtgttcttcacttggcttcctgcatacaatactccctgggttttcctccagcatcaccggttactcatgttcagtctcctttgttgaatcccctcttcccccagacctgctaatgttggagggtctcaaggagtaatccttggcctactctctcttcaatctacattgcttggtgatctcccatctcatggctttcagtaccacgtatgcgctgaagactcccagatctccatctccagcatagacccctcacaacattaggcttgtcttaccagatccacttggaggtctaatgggcatctgaaacttacacatccgaaactgcactctgatctcccctccccaaaccttgtatccacccatacccttccccaggcctgctggcacaaactccattcttccagttgcccaggccaaaatctcactacttgccttctctcccacccttcattcaattcactgggaaatcctgttggctttgccttcaaaatctttgtagaatctatcttctttccaattcctctgtcatcaccctggtctaaaccaccatcctctcttatccaaattattgcagtggcctcctgactgggtctctctgctcctatctttgtttctctaaagtcgattctcaacaaagaagccatgatgacccttttaaaatagatcattgcaattatctgctcaaaaccttctaatgcctccattttgctcagaataaaagccaaagtccttacaatgtcctacaagaccttcatagatatgccccatcccattacgtctctgaccaactcctcctcctactgttccctttacccacttcactggagccaggtagaactccaacccattgcttaaacatgctaagcattctcctgccaaaaggctttcacattgctattccctctatctagaatgttgttccttccagatgtccatagagctaactttctcaccctctccaaattattgctcaattattatctcaatgaaagcttccctggccaccttatttaaaattgtaaaattgtaactccggctgggcatgtgtttcatgcctataatcccagcactttgggaggccaaggtgggtggatcgcttgaggccaggagttcaagaccagcctggccaacatggtgaaacctcgtctctgctaaagacgcaaaagaaaaaaattagtgagcgtggttgcacacacctgtaattccagctactccagagactgagacacaagaatcacctgaacccaggaggcagaggttgcagtgagctgagatcatgccactgccctccagcctgggcgacagagtgagactctgtctcaataaataaataaataaaaattgcaactctcctcacccctgatgcccctccattttttcctttttgctcataatacttatcacatttgaacaaattctataattttctgagctattatgtttatgtttattgtcagtctctcccccatagaacaaaagctttaaaagggatttctgtctttttcactgatgagacccaagcacctaggacagtgcctgtcacatagtagatgctcaataaatctgttttgaatgaattaaaatctagtggccaaagttggctttctctttgttgaaatggtaggttggggctgagggcagtggttcatgcctgtaatcctagcactttgggatgccgaggcaggcggatcacctgaggtcaggagttcgagaccagcctggccaacatggcaaaaccccatctctacttaaaaaatacaaaaaatagccaggcatggtggtgtgtgcctgtaatcccaactactcgggaagctgaggcaggagaatcgcttgaacctgggagacagaggttgcagtgatctgaaatcacaccactgcactccagcctcggtgacagagagagactccatctcaaaaaaaaaaaaaagaaaaaagaaatggtagattggcatatgtgatagaggtgttaaaatcacaggcagactgtgaccttccacatgacataatccaaataactgaatgattattacaaaggaaatttatttttcttccatgtgattccatggggtttgagcacccccagtggtaagcaatccccccatccctgggaaacactggcctattactcagcaaaaatgataacggcaccagggctagttgacctcatccatctccatttctatcttaccccacagagtaagcagccccacttgtgaccgtccttggacgtatatctccaggttgggtggctgtggccatccaggacaggataatcatgtggcccaacagtcacacccagaatccctgaaaactgtgcagggatttctttggcagaaatgggcttcctgacattcctcatgcctcaccccctacctccccagcctgggacacccacatgaaatctctcaggctggcagtgccttaccttcagggagacggacgctgtttcattggtgaatagaagaatggcctgtggctggagtgttttcagatagaaatggatgtgccagttccgagccgctggggccctgtaccgcacatagctctgaccactgaaccttgtagcagtacctgagaaagcaaccaaagctgtcacctctacttgaagtggtccccattgagcccttggactgactttgtcttatttaatccttgggtggcagacagaatcattgctcatattttatacatgaagaaactaggctgggtgtggggtgtgccatacctttctagcctcacacgtagagccagacaggagccttcaccctaccttttgttgactgcagggacccctgccttaggtcccaggctgggtcaagaaatatgaatttaaaccattaagaaagcaaaagtcatccaggtgaggtggctcatgcctataatcccagcactttgggaggctgtggcgggaggatcacctgaacccagaagttcgagaccagcctgggcaacagagcaagacctcatctctaaaacataaaataaaaataaaaatagccaggcatggtgcctcatgcctgtaactccagttacttggaattacatcctctcagctgaggcaggagtatcacttgagcccaggaagtcaaggctgcagtgaaccatgatcttgccactctattccagcctgggtgacagagagagaccatgtctctaataataataataataataataataatttttaaaagaaagtaaaaatcaggccagaaatgtaatgaatcaagtgtgtgaaaatcaaaatttttattctacatagtttccatgttatttctggtgttgggaatctacactgggaatgtagatactgcatgtgtgtgtgattttagacccacaagggtttttgcctcaggatagttccttgtatgagcaggagttaatcatttaggtaaacaataaaatgcggctgagaggtcaagagccactctatgataaagagagaggggcagtgatagactgtatggccaaaacttttgtaaagtctggcatcctccatcccgccttagcaatggctaatgcacagttgcatagtatggagtaaacttgagtttcttaagcatctttgactgtgggacactcttatgtggaccactcttgggaatagcattctgttgaaccccctttgggaagcactgccctccccagattttaaaaaatatccaccctccccagaagtgagtccagctatgaaatccccaaaaccccagtgtaaataagcttgtcagttgtcaggggagaggatgagcggtccagcctctagatacctagcaaagaggaattgttgaagagagagaacaaaagccaaaaggaggagaagaaagaaccagaaaagatgaggcacaagggattataacatccacacattccagctggacgcagtggctcacacctgtaatcccagaactttggaaggccaagacaggcagatcacctgaggtcaggagttcgagaccagcctggtcaacgtggtgaaaccccgtctctactaaaaatacaaaaattacctgggcatggtggcactcgcctgtaattccagctactcacgaggctgaggcagcagacttgcttgaacctgggaggtggaagttgcagtgagccaagatcgtgccactgcactccagcctgagtgacagagcgagacttcatctcaaaaacaaaaacaaaaatccaaacaagtccaaaattccctgacactggcaattccattgtagtaggtacttattggatgggatattgaagatgatctagatcagaaattcccaccccggctggatatcaggatcagctggagaatctttatgacacagaatcctaagttctctcggagaatctgattcagtagttctgggtggcacgtggaaatatgtattttaaaaatcttaccatcatgggtgtaacaactggaaggggggcccaagggaggcttctgagatggtggtcatattctttccttgatctgggcgttggctacacagatatatttgctttataaaaattatttgaggtgtgtacttatgatacatgaattggtttcctgtatgttttatatttcactaaaatgttaaaaaataaaaaacctcttttcaactgattctggtgatccatgagtttatctagtatttcttcaatgcaagcccttgcacctgctgcttcagaattaaatgccaattctaggactcactcagaaccttctaaattaaaacctctggaggtgacacccaggagcatgtctctttaaaatcacgctctccagtagactttgcaaaatcttgaattttagaacccctgctgtctgatgccaggtggctgagagagacccttcagccttcttggctttccctgaagcaggccctggggcaagaaacacagagaaggaaatcctctccccaacagagagaagcccacccagcctaaatcgagtggtccctggacaaagtccacaaatcttctgagaaatgatatcccgaatgccaggcagctggacccataaagggcaggtcaggccaggccaggcaggagcgctggtgagctgaaggtcatgtcactttcctttagccaaggctcctgagctgctcccttggccttaatgccagggatgctgggtgagtcttggagtgcctgaggagcttagtgaagagttcaggctttagagtgggacacacagatatttgaataacgaggccttcattggaagctgtacaatttcaggcaaactaaatctcatatctcagttccaactgcagatggggctaatgaccctgcttggtagggctgtggtgccgattagtttaggtgacatctacacagagtgtggcgtacagcaggctccctatagcaactgctaccacgggaatgacagtcaccgttgatctggggcttattgtgggccagccatgggttaagtgcttttataactcttacgtaatttcccccccgaacccaactccaggaggcagatgtatttattttgactattttatagatgggaaactaaaaagctcagagggttttaacaatacacccaaagttacacagctagtgactgatggagctagggtttgaacctgagctgtctgagtctaagccttgagcttataaccaccagactatggtaataatagtagcagtattagtaactcacatgtattgaccactttctatatgtcaggcactgttctaagcaagcacttgatacatagtactgatgtaattcctacagcagcccagctcaaaggcacagagaggttaattttcctaaagtcgcctggttagtaaggggtagagctgggattttaacccatgaagactgaagccacagcctatgctcttagccatgatgttaaaccacatattgtagtcttactgttattttctaaatctcgaaagggagctgagaattgggtattattccataactagattttgtgaggccactagccgtcttatggtgattggtggcctttgggcttattaaaacttccctgaactctcccacagagcctcagtggaatctccatgcttagagtcaggcgggctgagcccagcagtgctgctcgtccctagggaagatgtagtacttaccattgcaggagcagctcctctgcaggtggtgccgcggggttaggatgctgagcctggcggtgctgtacgtgggcccaaccttggggtccagatgcactgtgttatggcagatttgaccctggcaggttggcccctggcagggcaccatgggcatagctgaccgcatctgaacccccactgaatgctccatctccttggctgagtgagtgatgatggatgctagctcctgaaactcgtagaaggttccagaatgcccctcaaagaccaggagcacatccacaccagccacggcctctgcaggctggaggctggccaagtgaatgttagcccgtttgatgtccagcttatggctgaggaacctctgcaggttccgccagtggtcactcaccagctcctcgggggtgagctggtagaagcccatccacatggcctgctgcagagcctcctgccccacatgccacacgtacacatggaccccagcagtcgtggtgaaggtcccatcgctgaccgtgacgttgaacgagtagtggccacgaggcaggccctgggcggcgataatcttgccatcaggcgcacccactgagaagtgcctgcccagggtctcctcttctgccaggctataggtcagcgtgtcctgggggtctcggtctgtggcatggatcttacccaccatgccaccctggaactcatcctctccaacagtgatgaagatctccagtgggagagcagaaggtgcatagtggctctgctctgtgacatggacacggacagacgtcaaagacgagaggggagggatgccactgtctgacgcctgtgggcaaaacaaacactgctgtcacccaacagaactgcagtgctcttgcgcccgactgaggctgggcctccttgtggagctacgtttctctgccccacgcccaacttgagggctggctcagcgcattgttgcatttagaaaaaaaaaacctaactccaaaagcactgacagaaaagaaagattttctgaaggttttgtagagattgaaggagggagttacatcctataccatgcagtaaaacaatgcagtttcctcatgtgacatctctctgagcctcttcctaaatctctccagccatagacttgggctaacttcctcatgaagtttctcattctgtccctgtcctcaagggcgccctcagatgtctcagcaattctgatgcaccatgcaccctgctcagcctacgaaaattccccttgggattcccttttgctatgcgattggagtgggagtcgggatttgtccttctagtcagtcaacgaagtcttctgctgtggccaggagaaaagagacaataaataagttaccaaataacttggataaaatgctgggaaggaaataaacagagacctaactttgatcaggtagaagagaaggagtctctgtggagtgacatttgagtcctgagggatgagaagaagaggcgacagacagagggagcagcaagtgtaaggtcctggggtaggaatgaaggcggtgtgttcaacagcacagacggggtcactggtgctggagcaagtgggcagggaagcaggcctgacctcactgatgggctggcacgcgcagggttgcagttaatgtcagaactgtgaaaagccgtgagggtgacaggacctcacttaagtagggaaaagaatgtaaatcataaacgcattttcctttcatgtttcaccacacatccctgcaacttcctgcctgacttagaaaggacaggcttgccttcttctcctcagtgatgttatcacttcctcagctgtcaacgagggtctccacaattttccctgtagtaatatcttgttcacctgcactccaacacttttaatgtacaagaaagttgataagattacacctactgctggaagtcatgcataacaccgaagagatattaatagcaacaataataattaacactactgttaattataatgtatagctaacattagttacaacaatactactactaccgattatatataatacatagctaacattaactgagtacaatgctagtcattatcatagataaactatgataatgctgtaaatacattatcctagtttatccttcttatgagataggtactatcaagtcacccatcctacaaaaaatataactgaggctcaaagaggtgaagtaacttgcccaaggtcatacagcagcagataaggcctgagcagaatctgaatacctatctgtgtctatagcctgtgtttttctttgctggcctatggtgcctcccagtgcatggaagtggaagtacgggaccaatgcaattgatggtgatgatgccagtcattactaagctcctgtctaggcaggacgtgtgcctgggtctgagaatacagaggtcaggaagccattctctctcatctctccctaggcaatcacatccatgctcttggctttgagggccatctaccaatcctctgagctgccaactccaattcccagctacccactggacacctctgcttggatgtctcacaaacaactgggaaataatgtgcaaaacagagcttcggtttagcccataaacctgtcctgccttcccgtctgggcctttccagtctcataaatgcactaccaccgaagtcttcatgggagccaacaatttagaaatcacccctgaatcgtctctgttctttctaactgcacatccactccaccaactcctatcaatttacatacaaaatatgtccgaaatctctccgcttcctgcatcttctccatcactccgtggtctcagccccactatctccagcttggatgacttctcactggtctccctcacccactctatagagcttgaaaaatgagcttcctgagacacaaagaggatcccttttccgtctgaaaccctccaaccacctctcattgtacttagattagaatctaaaagtgttaccaaggcttatacttagaagattggatgccctggtttgtcaaggacagtcttgatttttacctgttgtaaatcagctactaccaagtattatttttagtgcctgttttggactctatgtttgtgtcccctcaaaattcatatgttaaaatctaatccccagtgtaacagtatttggaggtggagcccttgtgaatgggattagggcccttatgagaagggccatgtgatacaatgagaagccgacagtctgccattcagaagagggcactcaccagaacctggccatgctggcaccccgatctgggacttccagcctccagaactgtgggaaatacatttctgtcctttaagccacccagcctatggtgttctgttgtagcagcccaaatggactaagtcagtgcttctctcactctcaaagatcacagtttggacctcagataatacagtcatccaagccacaaggcccacatgatctacccagcctatctcctcagcctcattcccacccctgctcatgatgttctcagtacctcagccatacctcaagccacttcaggctctttcccaactcatgttgctcttcctgcctggaagactctcctgcccacttttcacatggttggcagcttggctctctgctcagatgtcacctcctgggggcagcctccctctgaatgtgtgtccccctgtcttatgagtctctcatcactttacttccttatcatcatttgtaaagatgttatttctttctttatctgtttattgtttatctccatgattacaatggaaagcccctggagacaggaatcattccctccttaccctctgctatgttcctagcagcttgcaaatggcctcgcatgtagtagatgctcaataaatacttgtcgagagatggactgactgactgaaagaatgaatacatcattcccagcccataagtttacagaatagtagggtccactggacttgagatttaggaaagagatttggagaaataaagtgagggagagatatcagaccaccatcttggccactgttctttagcaattcctatgaaacccataacaccaccaccagaatcccctacacacatgtgcatacaatatctcacttgagccccaagccagttctctgaggtaggttgttttagctcctgaggttcagagagctgttctggctaagctctaggagctacagccagagggtgttttgcccaggcacagagcagggattaagaatttggagtctggggtcagagtgcttgggtttgaagcaacccacctttgccacttattaccagtattactttaagccagtcacttaaatcccctgtgttcctcagtttcctcatctgtaaagcggggtggtaactatacctgccctgagtgttatgaggctttagtcctgagaaggacctagcccagtgcctgatgcatcctaagtgctttgtacattttttccctaatgacagaagcactggtggggcttttgccagcatctttactgtccccatggtcaccaccagaagcctagcacagctctcacctggatctgaagctgataccattcctgagccctcctgcttaggccctcagcagtcaccagccatccatccggggtcactcggaaggcagagccgttgttccccttggtgattcgaaacgagtagggggggccattctctggagaatctgggtcactcaggatcagctgcaggactttgctgccaatgggggagttctcctgagaccgagagtgacaaagaaggcaaagagcagaatgagtcccggtccttcctttcgcacgtgtctgggtatgtcatctggaatgagtcctcagcactctgactgcttgtagatggtgcctggacatcaagctgctgctcattcattctgcctgcctttgaggtagttgttgactttgctgtctagaccaggagctccccaagggcaatgttgggtcttagaaacacagcccattggggcaggaaggatccttagagaacaaaggttaaaccctttattctgtagagagatgacttgctcaagatcacacactgctgaatcatgtatttaaattagttattacctggattacataagggaatgttgcgatttgcaaagccaattgaacacttataaatgatttcttccttagaggacctgcatgcaatatgtatctgataagcacacttaaagatgactaggaatttaataagaaaaaccagattccctgagtatcattttagcctttgttgtataacatgggcatttagtatactataacacaatggttgctaactatttagcatcacaaacagaatctaatgggcagaaactgatcgttgcctatccaacagacattctctgttcctttcttataaaatcctgctttggttcagatgtggactggcgatattctcagaaaagatatttttagtcaggtaacttattatttgcagccaaagcatcctaacccatacccataatatataaaacaggtaaaagtggaacagccctaggtaatgcatagtaggacccagaactctgcctttttattcactccctcacctcccttcaccacttacagccctgaaaattactcatagaatcccaaggccctctccaaatcctatttgcaaaccattagtagggaatagcttgggttctggaaacaaacaaaaaaatccctggggttcaatcccaagtttgccacattccaggtatggcatgttttcatacctcaatcttctaaatctgtaaaatgggtactacctacttcatatggctgttatgagtctcaaatgaggtaatggatatgaaagtgcctaacacagtgcctgattcccttcaattctataatgccctccagcagtctgtgttgcctttggggacatcagtggcaaagtcacagtcattgttcatgtggactaatgccactgaggggcatcttctgctagaagggaaatgaagggaggaagggctcagggtgccttggaggctcaagcttacctggacagtggtgctgtagttgagctggaagaatctcggtgggttatcattgacatcagccacttggatagcgatgtctgtgtcctcatgcagtggaggctgcccactgtctgtggctcggagcttcagggaataactagaggcctattgcaaaatgtccagtggaggttagcaatgaggtagctgtccctcacttctgccccctgagtcatcactaatattttcaaaaaaaataagaaggagacactttcctatgcccacccccactgcccacccgtagcattttagggcttaggttctggagtcagacagaaataggtgtgattccctactcaatcatttgctggcaatgagaccttgggaaagtgaatgaatttatgtgaggataatgtcaggatgcacttccttaaattattttgaggatcaaatggcataaatccttataaaacatttaggaaagtgtctggcacacagtgggtgctcaaaaaatgtggctattttataatgatctaatgatccctactcaattgtgagaagccacctgaggtcctctagggaaggttacggggtcactcagtccctctcctgcctctggcctcacagtccacagaggccccacagagaaaacaagtgagagacattctgggaaggtctgaggaagtttcaggatggggtcttgacagcgattcatcttctggacctgcagtgggactgtgtctctgctctaatgagctcagggtgcgcccctcccacatgactcacctgttcccggtccagggccttggccacctgtagctccccctttttggggtgaatggtgaagtgcccaagctggttccctcctatgaggctataggtaatgtcactatttaggggtccatcttcatcagtcgctgatacctgcggtggggtagggggattgtgaatggagggacaggaatcttgacccctgggagtacagggggaaacagatatgtccctgccccagtgactgcctttgggctagcagtgcctggatcacagttgtccctgccaaagtaatctcttcacttacatcctcgtgtggacttcagcatgccatggtttattcattcactcaccattcactcttgctaacagcatgctaggccctgtcctagaatgtgaggaatgtgctaaaatgaatatgcctgcaggaagtttaatgtctaattttatgggtaattctaatttggagtaaagtatgatcagccttataagagcacacagtgatatattacactggggagattagaaaaggactcatgaagccctgaaggatcaggaggttctttcggggctggagcaggcaatccaggagaggaaatactgtgagcccagagtgtggaagtgcagacgatgttttggggaaaggtagatattcctgtgtggttggagcatagggtgcaccatagcagggagtggagggagagactggaaggtgggatgaagagtgtgggagtatgggtggacagaactgggtttcactccattgaatgagggagttattgcatatttaaatgcaaagaggtattatttggtgtcccctcagtccctgccccacaactgtcattccacgtcacccgctatgaccaggcccttcccaggcttgagagcctctggcagtcctctggggtctgtctctttttctctcttctcctaacaaacctcgcctatcccatgccccattccattgtctctgatcttatcatatggctctgagacattctctcaggagagatagtttggccgagcattgtttggccatactcaaatctcacataaacctctgacaagtcagagtcaagtctacagtgtattaacttaataaactaatccatgctcatagatggctgggtgtgggggtgagataagaacccatcccagagttcttgtcccacaaagagcaaggtggcagatccttaccgtgaggatgacgtcacccacaagggcattctctaagacccttgtgctatatggatcttgggggaattggggccggtgttcattgacatcagtgatgttgaccatgactgtggtcacgtcactgagggaagaggagctcttccggctgcactcaatggacaggaagtacttggggcttgtctcaaagtccaggcttgcgttgacatacaggatccctgaagaagcaagaggtgacagcagcaatgaggcagttgggccctcaaaggcgcaggactgagggtctgagcccagccctaggagaggcagctcaacagggctaggcaaggtaagtgtcctctgtcatctccccatccatctccctttgctatccccttgacccccttccccatcatctccctcatttttctttattattattcacaacagctatgtttccctcacttacttctgtaatatttgatttaaatctcatttaaatgtgtgatgctaaatttatctcattgagatctataaaaaccctgtggagcagggacaattatgattcccattttctaggtcagtccattgacctagatgctctaataggcaagtgacttgtccaacctcacccagctagtaaatgacagacctcagggcataaaatgagattcattaatactcaaagttgcccacaaattgttagggcataggttattattctgaaaactggaaaaaagaaataaaagaacaaggatttatcctgcctttcccggctaaccaaatagttaatggtggacactctgctttttgttttattttatttttctttcaacagcatcacatgccaatgaacatctttttataattcagtcagaaaataatgaggagtaataggattagaaaatcaccattttacagcccttaatgaaaaggtatatctatctaggaaatgattagcaaagcctgctaaaaccattagaagaaaggctgatgaagaagtctataatggccttatatacccaaattataactatatattcatatataatggatcaggttgacaacacctgaacttaccatctatcttaacaccagaaaaaaaaaaaaaagccagttagctcttatgtgcgtccagacatgatgcaaacagcatagcatcatctgtgaggcactgtgttgatcaagcactgtcaactaaacctgatcaaggcctttgatccaaatgtcattcctaggaaatacaaggacctgagggatatgctatatgacactataaagagccaaccaatccaaacgatggaaaattctattagacacatgactcaactgtttcattaaataaatggcagggggaaataaagaggaagaagaaaatgttagagattaaaggacacttaaaatcttgcatatcaaccaaattcagtatgtagatgttttggggatactaacaaaccagtttcgaaaagacatttatgagaatctgaaaaatggcctggtgatattaagaaattgttatcttttaggtgtgataaggtattgtggttttgtttagaaaaggagttcttattatacagagatacacactgatgtccttacaagtgaaatgacacagtgtctgcggttggatggatgtaggggccaaagggtaaagaggaaaccaggctggtctctgcagatgattactgaagctgggtggtgggaacacagggctcattgtactattctattttttaatatgttcaaaatctccatggtaaattttaaaaaatattgctcaatgataaggcagctgtttggggaggtagagagcaccattccaggggagccatggggaggaatctgtgtgagacacaggctgacctgggtggcctctgaggcccttcggtgagtttctgtgaacctgactttgagtcttctgtggctagtaggaaagaagtgagacggtttcctagttctctctctcttcaagagaataagggaaaattaaggggtgccaggatgtttggagtggatgtggggactccaggagggaagcaggcagccttgtccagggttgcttaagccccagattccagcaagggctccctgcctctgcagccaagccgtttctgcctcctgcgctgggcctgagctgagaccatgaagccgctaactgtgtgggaggagagtggatcactgagggtcctggacacagagacctggctgcggacgtgggagggtcccgtttaagggaggctcccacataagctggccccagggtggaaggagggacctggtactcggagagaagcagaagagaatggagaaacgaccagaggaggtctgctctgggaggcgctgcacagggtagatacccacacaggggaggaacccagcgctcccagaaaccctgtacgcgatgctttggggcttggtggatcaggctctcacctgtgcgagcatccaggcggaacctgccttgctcgttcccgctgaccacgcggtagccggtcttctctgcgcccgggcgagtgagggtggccagctgcagcacctccgtgccaggtggggcgtcctcgggcacctgcacgctgtgctcggtgttcaggaacacgggcaggtagtcttctaggcccaccaccgagactgtgacggtgcccagcgtggacagcggtattggggtgcccaggtcagaggcacggaccgtgagctccagtggtgcctggggcctgacctgcagcggcttttccaggcggatcacccccgtggtggcgtcgatggaaaagtggccttcggctgaatccggcagagagtaaaccacctgggcattggcgcctggcagggagaccaagggtgtgatccacactgagggcgcctcctctggacctgcctgcagcaaaccctgcagccacaggaggggctggggaggggctcccatgaaggcggacaagctggcttgggtatatgaagagtgagggtctctccagcggggtgtcttgactggggcagggagacccaaggcctcactaaaatgcttttgggggaacctaatctgcaaatctatcaaactatccgaaaatattatgtggggattagggtctaatatcagtttattaatgaaaaatatgcagataaaaccacccatagagagttccttgactgagatagaacagctctgtatcttgattgtggtgttggttacaagaatctaaacatggaataatattgcatagaactaagtgtgcgtgtacaaacacacacacacacacacacacacacacacgcaaatgagtgcatacagaaactggtgaaatctgagtagcaaggctgtagtctagttaccaacaatggaccaatgtcagttttccagttttgatattatcctactgctatgtaagatgctcccattagggaagctgcatgaagagggcacacagtccccaccagtcctatttttgcaacttcctatggagtctataattacgtcaacataaaaagttaagaaaacacccatggaagttcttagtaaatcaaaacacacagtgtttctccagctttgtctccaattctgttattttctttggttaagtaccagatgaagcagttggccatagtgtaggaaaaacaccaacatttaaggctcggctgtgaggtcctcccccagtgagatgaacacacgccctgagcctaagggtctcacgtctcccacacacgtggaacacaaacttctctggtggaatggtgacaggagtagcctctgagaagagttgaatttatatccattaaatgcacatgccatgcaacttccccatattggcacttatatgaagaaaccataatttttctagagacagagagatgctggtcaaaccacacctggattatttagttgaaatatttgggttggaataaccattttggaaagattaatggtaagttgatataaggccactctaggagctatctaggagatctgtgtgattgtagagggcaggaccaggaatgacagatgtcccacttgataatggcctgaggaaccatagaaggaaggggctgcttaggaagtagggagcatcctgtccctggaggtgtgtaagcagtggctaatggagcacttacagagccttgcagccattagatggagacgtaaataagatggcttatgggtcactccagctctgatgtattccagatctctcctatcaaacccatttctgtatctcaagcaagtctattccacttgcacttgttatctccaacacacacacacacacacacacacacacacacacacacacacacgctttccaggtccagccaccctgcctttgtgttgactgtttgccctccctagaacccctacatccctcgaatatctcacctccttcaatgccaagctaaaactcactttctctaggaaatcttaattttaccctgctggtgtcaaacagagcagggtgttttgatcccacttttatcatcatcattttcctgtgttgacctggctattctgatgctgagagcattttttttaccctatctgaattataaaatttgactcaggaaaattggacaggttatatacatatatatatacatacacacatacatatatatatgtgatatatatatatcacattaatgagttatatatatgtatgtatacatgcaggtatgtatatacaatcagaatagaacactttgtggtagcataagctataattggtacaatatggaacaaatatgtttgaatgaatgcaatttaccttgtaaattttaaaagaaaaagaattaactccaatgaaaatatggagttaaaatgtaaaatattgaaaagggttcaacttcactcttcagaaaattgatcaaggaatttaatgggcttactggggttggtacccaaaattcctttcttgaggcaaatcaatcagaattgaagaagtctgattggtatatttctgattaaatgtttgtacttaaaaatgcctttgtggttaaatggcagtattgaaaagtccccaggtctaagtggaaggggagaaacaataaggctgaaatacctttttcctgcttcaaaacattgctaaaatcatttgtcatatagcacttaggtgtgcagtttgaggataaatactttttacttttaagtgtccccagactcaacaaggaggcaccgcccttaccagtcctagagagacacaaaggggaccaaacccttgcccaaggtgacccaggagatcattggaaatggcctcaatccttctcagactcaccttggtcgggatcccgggcaaatactacagccacaggggtcttcactgtggtgttgtcgaagacagccacagcacagtggctggggaagaaccgcggggcattgtcattcacatcctccacatggagggtgatgtctgcctggcacgatcggccacctccatccgtcgccttggcaacaaggttgaacacatccttcctttctcggtctagggcagtgagtgtggtcagctcccctggtcggagaaatgacaaaagttgagctttctctggggaaatattacccaagcatgtgccctctatatatctacaggagacaaacccagccacacagagttttgttcacagcaaggaggggtcaatacagtcaggaaagcagctaagcctgtatccccccatacccattctcctccctgattctcccaaacacacttcatcacattgccagtttaagatcatcatcaacaagctaaaaataggtatattcttaatggccaattaggcaatttctaacaatatataaaatgcatttatcctttggttcgtaattccacttctaggaaaatatatatatatatatatatatatatgtatacattttctatagaaaaatcaacccaaagataaaaatctatgtataaggatattctctgcagcactgtttataatagcaactattgaaatcatcctatatgtctttcaaaaagggactggttaagtatattatgatttagccacacagtaaaacaccatgtgtggtgttataagtgtatcttggttttcatgcatggctcctgcccgtaactcccacagcccttgttacacactcttttgttataatgttgggtgtgttatgttaggcctcaggaagcacaatctctttgaccttctcctgctctcctttcacctgccccaaagcaagattcccatctttccccccttttctaattgtgggttttaagaccctccccagagagtctcctgccttataccctgggggaaataatgctgacatcatgaggctcccataacaacccaagatgactgggttccgagagcttccatatagctgaacacagggcggttcctggagggtggtgcgcccagggaggacatgggagcccctttcctcatgcctcgccctacacctctcttcacctgtatcctttgcagtatcctttataataaaccagtaaacacaagtgtttttctgagttctgtgagctgtcccaacaaattaatcgaacccaaagaaggagtcgtgggagccccaacttgaagctggttggtcagacattctggaggcctggacttgcaactggtgtctgggtaagggggtagagtcttgtggacagagccctaaacccatgggatctgacactatctccaggtagatagtgttggaattgaattagaggacacctgaggggtctccgctgcttgttgtatggggaaaacccacacacatttggtcacagaagtcttctttgctgatgattggtgtggtgtgagagcagaggaaaaacctggtttgagagaggtttttccgaaacaccatataaccaaaaatgaattatgatagagctttgagatactgctgagtgaagaaaagcaagttacaaatagtattctactttcatgaagtaattatatagagattttggagatgcatggaaaaccagtcagatagaatatataccaagagtccttatctgtggaggaaggggttatcatgcagatgttccagtttctgcataatacatacctacattgcttcaattttataccatgaacatgtattatttccatattcagaaaaaaaaacgccattttttaaagtccttactgatcatcctgaagctgaacaaagagcagcagagagaggttaaataacctgcctgggtccctctgcctgtccctgctggggttaggaaggacagcattgtcccctatctacccagacagcttcctgcgacacccttctcccctgccaccccctgctcaggtatctccaagtcatcctgtgagctactgggcccaagccaaatgtcagcagctggcccttgtgacctgggccttctgtgctgcccatctccacaccctcccctgcagcagcagggcaggaatccctcctaggtgggctgctcttccaaaggaagtccactccaccagactctcacagcccagcctctcctggctactcctggcctaccctgcaggaatctctgcttcccactctgctctatctcttggctagtaacaatgataatggcaacccatccactgagccagacctgggctaggcttccatatgctttctcacctgtgttataacaattctatgaggtgttatccctggtttgcagcatagataccttgagatcatgttcttggccatgacactcacctgcctaaatcctccagtggctctaaaggtgggatttggctctgcccaccctggggcctcattctttgtcctctctcctccctctctgggcaccagtttctggccttctgtcaggtcctcagtgtgtgtactatttccccaaagaaggtctttgtataaattctcctgccttgagtgccctttcccccactctcttacccctggctaacacttctgtgtccacaagtctcacataaagtggcatttcctcagtgatcttttacttaagatcctccgtagccaaagtcaagttctgctgtcaaatattcccatagctagcaaaaagacagaaagacagaaagaaaaagagggagagaaatacagaaagaaagaagagagagagagagaaagaagaagaggaagaagaagaggaggaggaggaagaagaagaaaaaggagaataataagaagacgatggtggtggtggaggaggaggaggaggagggagagagggaagaaaaagaaagagaaaaaaagaaagaaaagaaaagaaaagaaaaaagaaggaaggaaggaaagaaacaacgaacaacgaaaggaaaggaaagggagaaaggaaaaggaaaaaaggaaaggagaggaaaggagaggggaggggaggggagggaaggaaaggagaaaccaagatgtcagctgtgctaaaataaattttaaaagaataaaataaatccccttagcattctgcactttttcttaatttagcacatttaaaaccactgattcaatgaccccctttcccactagattataaaggcccaaatcttgtcttatcaatctatttattatgtccccagtacaatgcttggcacatagggccaatatatgtttgctgatagatgagtgaattcctgtttcttctccaaggagaataccatggcactgggcacttggtattcagtaaagaagttcttgttttgatcctgcagctcaggaaacccacctgtatgaggatccagcttgaattcatgcgccccagggccatgcagagaatatgtgatctgagcattggtatcagtgtccaagtctgtggcagaaaccttcaaaatgaagtgtcctggaaatacatcttcatgaaccttgccagtatagagaagctagagatggaaagacaaagaagagggagactgtggggactgcattcagatccagagagaagcagagtgactgactgagggaggcagaagcagaaagagagacactaagagggcagagacgaagagagacagaaaaaagaacagagacagagagagagaaagagaagcagagagagggagggaggggaacagaggaggtagaataagatgaaacatgcaaggaaaactgaggtttaaaacaggaagaggatgacaagagaacgagtcagaaaagagagaatggagaagttctgtcatccaaaagcccacaggcagggctagaagggactgctacaatttcttccacccagtcctttgaggcttttggagaaggaaggcaagatgggcctgatataggcattctggaaggtgtcaggtcaacctcccctgcctctgtggcgaggccatgctattaagctcatctccctgaccgtatccccaggacagacccttgacctttgagtcaggtctggactccagtggccccatcgcttggcccaccctccctttgctgcaggtaccgtcatggcatctgagggagtggcagaggggaaaggctggagctccctgagaattcaatttttcttcagtggctggcagtgagccagcctgcaagcatcatggtttccaccactgttgagtgtgggcaagcatggacccctacatgccctggatggaagctttatttattttcttgttttctcttttttgagacagagtctcactctgttgcccaggcttgagtgcagtggcacgatcttggctcactgcaacctcctcctcccaaattcaaaccatctcctgcctcagcctcctaggtagctgggagtacaggtgcgtgccaccacacctggctaattttttttttttttgtatttttagtagagacggggtttcaccatgttggccaggctggtctcgaacccctgacatcaggtgatccgcctgcctcggcctcccaaagtgcttggattacagacgtggatggaagttttatgtgtggagatggttccccaggcctcttttttctgttctagtgatgctgtgaaccatctccgggagggccagggtgagcctgatctcagcctctccaagcatggggaggacagaagttggttgtaatgatggctgagggaaaagagaaggaaggtgaccaccattctccccaaaaaagcctcccttctgagactaccccaaatatggtcatcttggatcctgaaaagacattttgcatgcataccaataaccagactctctttttctacagtgcttttatgtgactggcatgtagaagagtggaggaagaaaaggtgaggagatatatgtatttatgtgtgttgcaaggtatgtgtctatacattcatatgtgtgtgcaagcaagtcgaagtttgtatatatgcaaatgcatatgtaagtatgttcatgtgaatttgttacgtatagttgcatgtgtgggtgagtatatggttgattgtgctaggtatataggtatatgcttatatgtttatgtgtatatatgcataggtatttgcctgtgtgtatagggttgtagatgatcctttgtgtatatgtgtgggtatgtataactgtgcatttttatatatatactgaatggctggattatgataatttgagatgttataaaattaaaatgttagcagtttaactttatctataaactttgaaagaatgtaaatcctcccaaagttaaaaactacttactgtgttttaaaaaatatgtttaaaagcaaagctccatgacagcaattgttggtttatgcctctaggaacacagctcctctcctgacaaacacacatacacaccccactcaacatttgttcctgctggaaatttagagttgaattacatgagatccttaggaaagtatccctcaccaaatgaaattgccctgtctcgtgtttgtgtctctgtacaagtgaagaagggcatctcagtggactaaattaccccagcagatgtgaggaggtgcatatatgggcatggggtgaggggtttgtctggggtcaggtctctgttggtgtatttgataatagtgagccatgtcaacaagttgagcagtgccaggggtttgcccattgggcatggctggctgtatttggagaatgcttatgttactttccttctggatatgttctgcagagaaatagacctttgttgggaatgtagggggagagatgtgggccatgagtcttgaacagcttggtatatccctatgggggccaaggaattacctagaatggtccctgcccctgggagctagtctgaggcttgctggggagaagcaagagaggtgaggtcagtgatggccagcctcagagatgggtccctcggtcctcctttctcctgcccctcactctctgttctcctgcccctcaatctcccttctcctgcccctcactctctgttctcctgcccctcaatctcccttctcctgcccctcactctctgttctcctgcccctcaatctcccttctcctgctcctcactctctgttctcccacccctcactcttatcttccttgccttcactacccactccacccctcgccaggctctcacctgtgaacactgtgggctgttatcattgacgtccaggacaaagatctccacagtgaccgaagcctggaacttgccatcagatgctgtgactctgagcaagtacttggctgtatgctcgcggtccagggtcttccttgaggaaatcctccactcatctccaacttggctgatgccaaactggcccagggggtctccctctaaacagatggggcagagctttcagaagccaagcaataggaatgaactaggctttgtgtcacaggtggctgcccattggatgcattttttagaattgttgggaaagcaaacatttccttccttaactaggaacccacgattctacactgagtccactttttggtgttatgaagctacttctacttcaaatgcctcctgttgaatgaaattgtcaatgcaagaagcatcacttcaaaatatgtggctgaaggcagggttttttgttttgtggcccagaaggcatgggaggaagttaaagggaaacaaatttcaattctatataaatgtctaagatgcatagctatacaacagtggagagataggaagcaatcaaaaacactaaacactccaaggttttattttataactaaggacccaccctaagtggaggttctgtaggagcactagggtttgcttgtaagtcatctttctttccttgacactaatcactgacaagaatgtgggaatatggatttctcactctgagatcctaagattccagagttctaagatccaactactccaagaattgataacatgttgacatttattactctattatcctgagattttaagacttctgtgtttttaggagtctgatattttaagatgataagattctgtttttctacaactctgtatttcaaacagctttgatcctatgtcttcgggagtctgtggttcttggttggaatttcaggctcatgggcttttcactggacagctgtgatagcagaaggagccatgttcatgggaatggggggacatggcacctggggatgagaaaaaaaggccacaggagtgaagaaactctctcatggccactggttagctggcttagccactggattggggatagggtaatttagttttacagtaggtatccactaatgaaagcagcttatagggtagggttttaatcccagccctgaagcaagcacaagagtgtgaccttggttgaacttctccatctgggccttggtttccacatacgtgaaatgaaggaattatatctaaggaagtgctgtcattcttacacttaggacctgtgattgactaagaagcattttctatcattcacaactttacctgggtaggacactctccataaagacagtcgcttgacagaattttcaaggatcatgcaacattcttggtgcctcctccatctttcaaaagacaactgacagcagttagagtatgactcatgtaaaataatgagacatactttttgcaaagcactttctaatgtataggtgctttctagaaattacagatcttaccagcatgcctgtgaggtgaatgagaacatgcatgccaagtctataggtggagaaactgaggtcctagggggttaagtgtgcccaaggtcacactgctaataagtggcaaatccaggacatgaacccattttagggcacctcttcctggatgtttttcgatacattccagagcctgcagtccatgacaggtgttcttacctgtgatgtagcaggtgacctgcctgttctgctcagaaatgtcagcatccagggtctttagagtcgccaccagttcgccaggctcactgttctcaaccacagatcctctgtactcttcagaagcaaatcggggagcattgtcattctcatctgtaatggagacctgaaccagggcctgagaggatagctggatggtctgtccgtggtcataggccaccacatgaaaatgataagtctggcaggtctcacagtcaagttcctggagtgtggtgatccaaccactctcactgtcaatggcaaagagctcatggacattgctaccagggtctgcagacagcctgtagctcacctggccatctctcccagtgtccttgtcaatggcagtcacttgaatgactgaggtccccactggcatattctcagtgaggacagccttatatggatcagcctcaaatacaggcctattgtcattgacgtctcccacttggatgttgacagagaccaaggacaccacatcagtgttctgaaggcaatgtgccatcacatcaatctggtacaatttggtggattcgtggtccatgggcttcctcacctttatgacccctgtgtctgggtctagggagaagacaccatccttgttgctctcaggtgtagtgccccgcactagactgtagatgactggatcttgagctgccactgctttaacaatcccaatttcagacccctctggaaggtcttcaggtgcagagaaagtatacaaaggttcagaaaatttcggtaaggatacttttttaggaaccacctgaagtcgtactggcaccagagagttccagtgaggagggcctccatcttgggctttgatgaagaagtcaagggtctgattttccaatcccaccaggctgtctttcaccttgaccacaccagtgactgggttaatttcaatgacatctttaactaggtcctctgggttcactgagtaggtgacatctgcgttctgaccttcatctgcatcataggccaacacctggataaccggagagtctttactgacattggattgaatggatactgtgtactcagatgctttgaactgtggggggttgtcattttcatctgtgaggatgatcttcaccgtgcagaaggctactcttcctcctccatcccgagccatgaccttaatagcaatgactctctctgttgaattttcccgatccagtttctgcagagtggcaatctggccattggggtttatggagaacttctcacttgctagtttattgatgatagtataatctatagtgccatagggaccactatctttgtctatggctagcaaatcaatcaccttggttccaaccattgcattctctgctaattctgcctcataaaggtgctgctggaactctgggctgtacttgttggcatttgtagtgttgatgtacacaggcacagttgctcggaagactccatcagaagcacctaccctcaaattgtaagaagagtccaggtgctttttgcaaaggttgaacatagaaattattcccgatgagctgttaatgaagaagtgcctgtcctgattgccagaaagaatcaggtactccaggcgggaggtgtctctgctgtcagggtcaatagcctggactttaagaaccaggtgtccacaggttgccagttcactgacattggcttcatattgaggttgtctgaactctggggggttgtcattgatatcagacacattgacaaccacaagggtttcaccagtgagtgggggatctcctttatccatggccctgactttcacatgaaagtgttgttgggcttcataatccagttcttgaactgtggacatctcccctgtgctcccattgatctggaagaacttggaaacatctgagccatcctccacaatctgataagagacgtcacggttccgccctgagtcctggtcagaagccaacagttggatcacaggggtctgagcaggcaagccttctgagatggaagtggtatagaccaattgggaaaaagtgggagggttatcattgacatcctccactaggacttccactgtggcttcagaaaatgaccccagagctgtatccgtggctctgactgtgaacacatgtttggtcttggactcatagtccaaaggccctgttactgttaggacaccagtcttgaagtcagtggtgaacagcatcaagggttcttcctccacaatgttgtagatgagccggagtccctctggactccgggcctgggtgtggagaattggggtatagagggtgatattttcaggtactctgactttgtaataaggactctgaaacagtgggttggatttatttctcacagtgacaagtacctcttcctcactctggagggatggcgttcctccatcccgagcaatgactttgaggtgatatttatttaaagcttgataatcaaagggtttcttgagtgatatgtccccaagataggggtcaattcggaaatatgtgtaatcttctgcaaattcatatgtaacagccccatttgtccccaagtcctcatcagtggcagatacctgaaagaggacatcccctggctctgtgccatcttggatgattgtgtaatagggcagatgcttaaatttggggggattgtcattgacatcctcaatagagactctgaccaaaccctgagccacccgctgaggtgtccgattgtccctcacttccactgccaactcatgagtgtcctgctgctcccggtcaaacgccacacctcttgtctgcaacacacctgctgactggaccatatgaaacatatctgtgccattcaagagaaagtaggaaagggtgtcattcaaatgattgccctgggcaccaagaatcaccagtgcctttctgtcctgcaagttctccttcacagctgcccagtagacatcctgatcaaactgcaagcttttgtcaagcacttgggtcaaagaaatttttaccagcgcagtgtcttgatacaagccatcagaagccctgatggtgagcttccgagagagtcccaggaaagcaggattcagcacagatatgctaccagtgacaggatggatggtaacagcttcatcagcattgccagttttgatgctataattgacttctgagtcttcatcgctggcccgcaccatgagaagctccatgcctggatggataggcccgactattgctacctcatatatctgttctgagaatctgggaggggaatcattcacatctctgacatgaatgatgacttgggcaggtctgggtgcaaataatacagggcttccttggtcatggacatagacacagaattggaaagagggcatgctctcataatccatctctgatacaatggttagggttcccatgctgggatcaattttgaaaaacttcaaggcctccggctccaaaattttatagaccaacaaggaattagcttctttgtcactgtcagaggcatgaatcacaaaggggttgttgtttttatccatgatcatgctatacagtggagctgcttcactaatttggcccacaaaagttgactttaagaacataggagcattgtcattttcatcaattatgtcaaccaccaccatgacatcagtaaatgcacctgccatattgctgcctcggattttcagctggtaagacgagattttctcatggtccaatttcttctgggtggaaataaggccagaatatgagttcatagagaagactccatccttatttccctctcttaactcataggtaacttcagaggggctcatagcagagacaaggaggattggggaaccaacagggattgattcagggatctctacaaagtactcagattttgaaaagatgggggcactcctatctgagggatagacatgaatgatcactgtagccaggtcatgccattgtggggagccttgatcttctgccttcactgtcagagtatgtggggcatgatttgcctgatcaagcttttgagctagagtaatgatgcctagcagggcattgatgttgaagaaaccttcgctgttccctgaaacagaagacaagacaaacaagtttgccacaccctcgacaggtatcagctaggctttctagatcagtaaagggtctatcacacaaaacctggacagagcaaaatctgcatatagtgtatacccaccctggatatagtgtatagagtagatactttataaaatctctaacatggtgtgcatagtaggtgcttcatatcaccatcaattatcactaagtttctgggacacaacttaagctacaaaccaaagctatagcaggtctttgaaaccaaaaaaggagactccataggaaaacacactccaccctgaatttcagtgatgccttttgtaggaaaagcttcagtttgcatcatacagaatttttaaccatcttttgtataactttttttttttttagagtcagggtctttcctgtcacccaggctggaatgtagtgatgtgagcatggctcactgcagcctcaaactcctgggctcaagcggtcctccagcctcagcctctggtgggattacaggtgtgagccaccgtgcctggctacatttttaatataatttttaatagctttggttatatagaacacccatatctcaaggctcctgagcaaatatctttgccccatgtgtgtatttcctaaactctaggcattctcacatcacctttataattttttcaatatccatccattgcctatgttatgttacactattatttaattgatgttttcctttaaattaactcactcaaattttgataaatatttttaaaggtaacattatgttgcttctttaaataaaaacaccatattgcttaccataaatcagaagttaccataaaaagaagtcaaagaaaaaataccgtattaaaattgagataaaatctactgcttgccaaaaggtctgagcctgtgagctatcctctttctttggtaaacaaagagtggcaggtgttagagaagactaaaagacattctagaacccaacagaggctttgttcttcattctatcagggagcttgaataatttaaagaggagtgctttctccatgcccaataatcttttaatgccattaaatgagtaatacttgaattgttttgctcaccaccacagatacaggccttacacttgagaaaatactgcactttacatgtcttattccctctatcacgtgagagcatattttattatttcagtggcaaggcaaatggctaagttttgtcataaaactttcaatctgattcttccacctttgaagcccttctccagctgactggttaggtgatttgtcatataaccgctaaattcagtcaaagaacatggttttaatgagtagccgttttaaagtgattccattaaaagcagctaagtcaacaacctacatgtgattccgattataatttattatataatatcacactgctgaaagaaagaaatcagggcacaaaattgtatattcattatgatctcaatattacaaaaatatgcataggggaagataagagggaaagacagaaaatcattcttttggggtgatgaaaatgatggttatgtgttgtgttctttatacattcctgtatttttcgtgttttcaaaaatgagcatgtgttacttctataatcagaagaatattttaaaactaatctaatctggaaaataaagtcattatctccatcaatgaggttgtcaatgagataaaagatgtgatttcatttcataaatcacaaaaagcaagcaatgcattataatccatattcttcttcagcggtgaatagacttctgttatatggcaactgtttcttccaaaaagaaaaggtaaagctactggctttatacagtaccagtagctactgtataagctactgacatgcaataaatgaacattaggtcttgtgagggcagacagcaaattattttcttcttggtttctcatagcaactagctctatgaagtattattattaaatataattattactattaaatatcattaattatgtattataattattacaaattatcattaataattagttggatactggatattatcgcttttgttatagtaattgcttataattaacacttatcaatgatagtaatagcccctggcatttgtataatatttcaatttacaacatgtattaacatacattttcttttttgagatggagtcttgctgtgtcgcccaggctggagtgcaatggtgcaatctcagctcactgcaacctctgcctcccaggttcaagcgattctcctccctcagcctcccgagtagctgggattacaggtgcatgtcaccatgccaggctaatttttgtatttttagtagagacggagtttcaccatgttggctaggcgggtctcgaactcccaacctcaggtgatccgcccgcctcggcctcccaaagtgctaggattacaggcgtgagccaccgcatctggccaacatacattttctcttttaatctttgcaatgactttctggcacaggtaagattattcccgtttttgagatgaagaaacccataaaatagataaacccataaaatagatactaaatcactgtggagccttatcagaaaataaaaattacttctaaaactatgccatacacttcataaagtgttctaagatacatgcatgaagttattacatttttaaatgttgcatggacttcataaatatcttctacatgtttggtcactggtgggtttatataatatatatgcaaattctcccacagcatgagtggtccttactcatattgtagtaattatgttattactacctttggaagtgcattaatttaggtagtcccagggaatgctctagaattattgtttgccaaggcttaatgagcttggtacttgattaatttgcgaattcatgcctctagtgctttcctttatttctaaagcatcttgacccatcctctgagctcatggccaggcctctcacctttcaggagggagtagtggacctcagcattgactccccggtcagcatccatggctcggacctgcagcagctctgtgccgggggctatggtgtcaggaacacttgcctcataatggagctgagtgaagcggggtgggtggaggtttccatcctccacatgaatggtcacccacacgaagttcctcttgataggtatttcctggtctcggacctatgggcccaaagggggtaattgggtaagcagcaaatggaataggaggaggcagggttagggtaaggttaatgaactagaatgccaatttaaaatatgcccaattgtaactaactccccatattcttttaaatgttgttctaatctatatgctctttttcttcatttatgtaaatggatcagtcaatgattcctaggctcagctgttttaatggataattctattttaggagaaagacagaaataggcagagaagcagtgttttccaaattacatctcagagaatactcattcttcaagatgttaacatgtcatgcaggaaaaaaaaattatatggtcacataaatttggggagcactgaattaaatgcagtcaaacagttttctttgttgcaggacttctcagagccttgaatacgtattatatgcccagaggatgataaattagcacataagaaccctgatctttaagacaggaggccaggctccgattctggttccatcataaataactgtatgacagtgaggaagtctgtctttctctgtgggtctcaggtgtaagatgagacaaatgggcagggtcagggatagaactagggggaagcaagtgaggcaagtagggtgcaaaatttaaagaggctctgactcttggggtcataaaaatgcaggcacatggcccagagagtgagccctccttacattttgtgtcctgcatgccttgctggcctgaccctagtccttgctctcagtgggagaggctctgtgtcccttccagctctgacattacatgaatccacattgtgtcatgaagtcactgagcagggagagagctcttgggaaatatctggggtgagtccagagaaagctgaggttgacaggagtttccttggcagccgtcccatctctaccttcacttccaggcatcccttatggaaggtgcccttagccagctgtgaaatgtcacaactctgtctcgtgcatggtccttatgaggggaagggggaccttcagcatgtctccaagcatgtccacccctacacatctacatgcaaacgtattctcaccagatttttccatttactcaccatgactgtcagtgtgtgctgggagggccccgagccgaggtccaattttcccaccgttaccaggacaccactgcttgggtccagctggaagaggctggcacttcctgggtcttggctgccatgtatggtatagatgaggcttttgcccttgtcttgatctatggcctggactcgcaggagctctacccctggcacggtgtcctggggaactctgacttcataacgagtttccagaaactggggccgatggtggttaatgttggcaatcatgaagatgtggacctagggagggagatgagggagaaggtgcactgcaagccccaggggaacagggactgggtctgtctggacctccctgtatcacccaggcctagcacagtgcctggcactcagcaatcacttgataaatatttgttgaatgaatgacagtatttcaaaatcaaaagaccttcagatgctgcacagtctagtgtttttcaaaaacaaaaattttctggaagggcctttccatcaagtgaaatgttgtgtgaaatccaaatgtaagaaacagataaaacactggctgaagctagaatagaaattcagagccccacttacccaaccatcatccccctatacccatagtagccccattgtactctatctttaattaaaactgctcatttaaacaagcttccaattatagacagatccagagtgggagaaagaattctcccaggatcacagaagtagagagtgtattagacaagaactttgattctaaattcagtgttccttgaggaacaccacatccacagaaaacctctgtagcctcatcccaaccaagaaggccttccatctcctctcaatacaggggtccccagccgaggcctctaacctgtgtggcaatggtgcgggacccatctgtcacctcaacagtcaagttatagttcgaccttctcctggtatcaagaggcctggcaatgacgatgctgcctgtggtcttctcaatgtcaaagtccatgtccttatccccacctagagtgggagtggggagaaagcacacacaacctcagtgatttaggcagcatagcataagataggctttggttgtcaggctcagaggacacggtggtaaattccacagtacaagatctgagtgacaggttgtagtttattctcccagggagtcccaaaactgtaatttattctgtcaagttgttgtcaagttatttttatttgaattttattaataaatcaaattgattaataaactataagaatccaaatgtaacaacatatttttaaatgtctagtatatagaaatatgtttagtgacatggaaatatgttcatgatatattacatttaaaaatattataaaacaatactttaatataaccctaagggtgtgtgtgtgtgtgtgtgtgtgtgtgtgtgtgtgtgtaaaggaaaaatgacaaaaaggaaacacatcaacattataacagtggattatcttctgattggtggaactttaggtgatttttattttcttctctgcattcatttgtgtgtgcttatttacttatttatagacaggctctcactctgtcacccaggctggagtgtatggtgcaatcatagttcactgtaaccttggactcggcctcaagtgatcctcctacttcagcctctcaagcagctgggattacaggtgcgagccactgtgcccagcccatatgtgtttttgaaatgttttagagggtacatgcattaatttggtattaaagaaaaaaagtcaaacaaaacagccgtaagccagaactggaagtaagttcaggaggttcaaagagcttgggtcaagggcatatatcctatcctactcttagccaggacagaaaactgtaccaggactccatgttcatgtgggtgctgaaactcctagagatttttaacctggaatccctggatgggtttcaaagggcctatacatcctctaaattgtatgcagatttacatttgtgtgtgtttgtgcacacaactttctgggaagaggacctaagcgttcgtcagattcctgaagggttctgtgacccccagatgttgaaacaaaaccttgatttagagacagagaggaatttcagagaaggccatcagagcccggatccaagtgcctcgtagaatgagaatgggcactttcccctgatctcaagggtgaaacctggagccaaaacattgagcatggccccagggtatagcttatggcaggctcacggtcaactatgattttcacattgaggtaggaaaggaaacacaaagcatttctgctctgggtcttcctgaaccattttaggtctcctaggcccttggggtaactgaggcactgccaactctggctggggttagagatcgtggctggagtgaaaggaaagcttggcagacgtggcattcttactgcctgtgctcccagagaaccagggaagaggcagtccccactccgggctgaaagaggggctgccgaggagcccgaccttgagaagagtcagaaggactgtagcaggaaaactagagctggtgtataaggatgggaggggttggcccttgttgggccctaggccttgcctcacctgagatgttgaaccagaagagtccgggtctgccctctacgctgatgacccccaccatgtggttcacagggtccgtctccatgaccgtaaagctgtagtaggtctcatcaaaggccagagggatggaggacggccggggccaagggatccactcaatgtgtagccggacactggctgagagtggtggctgcccactgtctgttgccttgatctgaaaggaggccaacaccaaaactgaggtttggggccaagagacaggaagacccaagcagccaggacaggaaccagagcgtcctgtgattctgaccaagcaggcctctcatccagtcattcattcatctgatgcatacttgaaggcttgctgtaaacaggcaccctgccagttgctgcaggcacggtggtgaacaaaacgtataacctgtgctcaagaacctcatggttagtataaaaataataaatgccactgttaactgaagacttactgtgtgctacttcctaaattgaactttacatacatatgccctttgcttttcccaactaccataaacctaacaagctagaatttattgagcactcactattatcaggccttgttctaagagctttgtgcgcaatatctgatttaatcctcacaataaccttggaagaggtcctgttatcatctgtcttttacaagaataaactaaggctcagtgtggtcgattcacctgccagatgaaatgcttggctagcaatgagactggggttgaattcaggctgactgatgtaagcacccatgcgctagctacctgatatattggcttctcacaagaaagacgttcttatctccattttacaaatgataaaggttaaacgacttgtccaacatcacacaggtgtaaaatggcagtactagggttggaacccaggcttattggttccaaagcccctgttactctcactaaatccttctctctaagaatagaggggatttcccaggcaaagaccttattgccttcaaagagaaggacccagaatttgatcctttggctgaagctgagactcccagtttctctgggagaaggccaggaaggagagtaccatttcccttatgctggtgggctgtctccctcctcctgaattctcaaagaaggccactaaccagcatgccactcctccctccgtggcttccttctgtctgctcaccgttaggatgttgtactctccagctgtaaaagtgctgctggatgaaaccacacctgtgaccaggtcgatactgaaggcctcctcatcgctgtcctcgatactgtaggtgactctgccattaagaccctcatccaggtctgaagccaccagcctgtacacaggcccaggggacacagggctcagcctctctggaaggcggacattgaagagcttgtgggagaatataggtggattgtcattgacgtccaagatgcctaccaccaccctggaggtggacttcagtgagggttccccattgtccagcacagtcacctgggagcagaattgagcatgagcacctgagctgacaattgcaaattagtgactatgctttaacaacctggaaatagtagtcactttgttctttggtatgagcttgtactttttattatcataacttcacctacttggaactcagctctctggcaactttgcccctgggaaagccagtgagaacagagaaaggaagcagaaagaactggaagaagacagagtcagagtctctagacaaaagctggtgctgtttatgtgggacaacccctgggccatttctcagagactacctactttttacttgcttgtgtttttcataattttagttctctggtttccttaagttgctcgattagagaaaataaatgagaaaatgttgatgagggaatgagtggtactttttgagtcagacatgtgcacgtggcctgatgcatgcaatgaaatccagagtgagaaaaggccccaaaaccatttcagaaccagtagctatttaatgcagaggcaaataatcacatgcatcaatagccccaagggcatcacatcagacaggagatttccacctgaaatggttctgaattttaaaaaacactttggtgtttaaaggtaaatatctgttactgaactgtggagaatgctttcagtccctaggaattctagaaggccatttagctacttcttactaataatatatttctttttttttttttttttttttgagactgagtctcgctctatcgcccaggctggagttcagtggcacgatctcagctcactgcaacctccgtctcccaggttcaagtgcttctccgcctcagcctccccggtagctgggattacaagcacccgccaccacacctggctaatttttgtatttttagtacagatggggtttcatcatgttggccaggctggtcttgaactcctaaccccaagtgatctgcccgcctcagcctcccaaagtgctgggattacaggcatgagccaccgtgcctggctaataacacctgtttcttaccaaaggaaaaagaatgtgcagagcctggaagtatcaaaggcaaaatttgtttcctgctgaggaatatgtattcccccctcctgatacttttaaaactagaagagatcatcagtgaaggacagctcaggaggggaaatagttagatttccacctgatctgcttctcttctgatttcattccctctaggtcactaaccaaagcctttcattgaaacaggcaccaggaatgcctatgtgattttagaggcatcctagaaagagcacagatctagaagacaaaggtctggttttcatcctggctctgctactgacctagtgtttgaccgagaatgattctgtctgcctgagccaggagggatggactggactcggtaagtacatagcacacatgtactgctcccctctccttcactccctgcaggcatcactaatcaatcaatggtgcctacccagcctgggcacagtttcagactccttcccttctcagtgctgaggagctagcaaagatccaaggatcatccagcaaggttcagctcacgtatatcttcctccctgaacccagaccctcctcagccacagtgctagacatgcacgtggctccaaggcctaacatggctccacaaatcaccacaaatggattcaccaccattacttacctccaggatgtgttcatccttgttctctctgtccagctgctgggctgtagataggagacctgagagagagatgataagggagagacatgagcagaagactttcagggccactttactgaggcaacttcaagaattacattcaaatctcagataagaattcttctgatctttgaagaacatgtaaagaccatccctgacttaggatagttcaacttaaatttcctactttatcatggtgtggaagtgatacacattcagtacaaaccatacttcaagtacccatacattctgttttttactttcacttcagtattcaaatactgaagtattgagtacaaatactgaagtgttgaaatattcaatactttattttaaaataggctttatgtgagatgattttgccccctgtaggctaatgcaagtgttctgagcgcatacgaggtaggcaaggctaaggtatcatgttctgtaggttcggtgtttaaacacagtttagacttacagcattttcaacttatgatggatctattggaatatgacctcactgtaggctgaggagcatcagaacactaaggggaaatgaaactcgggggaaagcaagggggaagtgaggagctgggagagaacagcagagataatgtgtcaggtgaagttcccagctacttcctgctttctctattaggcaggggtgatacatcaaaacttcagcaatcggcccaccacgagcagcctcccgtcaggatggttgccagctggaagcaaccagtagggttactggtgcacaagggtcaatgtcagcactgctgtgatgcagttttggttcctcgtcactaaaatctatggaacatgtttgcatctggatgtcttctgctcatcattcattccctcttctttcaataaacaaaccccagttctcctgaggggaaaccaggagaattaggttctaattaggaattagaaccattcctagctttagtccttcattatctggggtgaggctgacccgcctggggagaagtttatagcccaaggatagccagtcagcacagactatccccctggcccttgcaactggctctgcaatagacaagggacccgtctgtctgatgagaatccattctgggacttttgcaagagctctagaaagagacttttttctgctgctgtgctgagagaacagaaggaagcctgacagcaacaagaagagggactcctgaggctagacccactcagagaaaatgaggccaagagataagcagaggcagcgccttcattacattattccaacactggctacagctgtgcctgcagccatactatgtttggaattttctgtaaagtaagaaaacaaatgtcttttattgcctcagccaacctgcattgggtttctatctttacatctgaaaaagtcctgacaaccaattcaattctgagaattcatatgttgggataggaatgggttaggggtcatggtgaggctgggaaagcattcagggtctttgggattgggaggcctccaggaaggacgctacctcctgcctcagcctctcccttcccctcctatggccctgccaacccccagctccagcctcaggttccttacaggggacccactaatcccctctgtgcctcgccttgactccaggaagctcctgcttatttctcccaaccttatttcaaccccagcctcctctgcaaaaggagttgaattcggtgacctttaacatctttctggcttaagttctgaacttctcatgccactttaaggaatgtattctaaggaaatcagtgcatacatctgggaagatgagttcacacggtgttcacctgagtcacgttttaaaaagccaataattggacacaatccatataagggaagagttgtatacattttacataaaaaggaatcttaagcaactattcaaaatacattctgtagatggggaaatgctgcacacaatatattgttgagtaaaaaaggcagcttgtcgcctgggcacggtggctcacacctgtaatgccagcactttgggaggccgaagcgggcggatcacctgaggtaaggagttcgagaccagcctgaccaatatggtgaaacttcatctctactaaaaatacaaaaaaaattagctggatgttgtggcgtgtgcctgtagtcccagctactaggagacaggagaattgcttgaacccaggaggcagaggttgcagtgagccaagatctcaccactgcactccagcctgggcaacagagcgagactcctttaaaaaaaaaaaagcagcttgtcaggagctacagcagaaataacaactattgccttccgtttcagagaaaccatgaagtgacagcattttccccatttattattattattattcactagggtcctagtactggctcttcccatgacaggctggtgcagataaatagagagggggctcctctgggctcctctcagttcatccgtaattgaagaagttgggtagagaaggcgctagctctctgcaagattcagggaagttgaggtggaggttttcaggggcccagaaggtcatccaaagccatggcctaagaggccgtggctggtgtggacggtctcttgtaaatgaaagcagagctactggtcgaggttaatggaacatctgaacactttcactttcttgatcttgtttaggtgatgaagtgattgagataatggaattaagtgtagaaaaagaagctcagtgaagagcccagagtttccctggggggctcagtgacagagctgggagctcagcgaggggaacagggattcagttctgggccagagcctccagtcatggcaatgggagtgtggtgtgaggatgtgggctctgtcgggggcgtgttctcgccttgtgcagttgaacgcaagtcattccggctttttcttccctaactgaagtttggcgtgcaagggattggagaaggctcctgagaagctccacactcaggcgcccttccagtcaaagaaggaggacaagtggaaggaaagacacactcctgtaggacaggagggtctggatactgtcccagcttggccccaagctgaggggcctcatggggaagggcctagggcctggggtcccccaggaagagcacaaggactagggggtcttggcaggtaagccttctatctggctccatcccttcctttcctccctgcccttctctcctctccctttgctctcttttctgtgtttctccttcaccatcctcctcctctcttccagctcttcctctctctcttctccccctgtgcctctgaatctcagcctctctctctgtgtgtgtgtgtctgtctctctctccctctctcccccaaccccatttggtttttcttttctacttctgcctctcaccactgcctcccctgaccttctaaggtcctgtgcctctggaatcaatgccccgaggtatcctgcccagttgcccctattctcatcctcatcctcctctctgaagtcagtatcagggttcccaggaagtgcctgaatagaatggggacatagcagaaccacctccatagggctgtgtgcatgttcactaaggtgcatagaaaacccctctcacccttcctggatgaggtggcgctcagtggacttcactcttaccatttttctcctccaaacaaatgtttccccaacaccctatctcagacccatatatgacctttcatcttccctcatccaacagttttccaactgttgttgattccacctgtgatagattcctgatctttaactcctcttaccctgagtcaccacaatctaggtcttgcccaagctgcctttccatcttcatcttcctcttcttccctcctgcagcatcaaagaaccaacccttttggagctctcacatgcacaggcattcagctaagctctttctatagctttgtatattaactcatttaattctcacaacagcccaggtggtctctattataatctccatttcactggtgagaaaactcaagcatagagcaggtaactcactttcccaagatgtcattatttataagcggtggaactgagataaaccttgagaaagtccatctacttgcattgtcttcaacaagatcagggtcttcctccctctcagatagcacctgtgtcgtcaccctcgcccatttgctctcccggactgctgcctctcaaaatcctcccaccctccagctcagcataaccacccctgttccatgaagcccttgcagatccaccacccagagcagcttcctccttcttctgagtggccagggcactgtatctacacatagtttacgatgttatgccctttcaaactggttctattgtgtttatatccaaatcttcatgctcctaatggactgaatttctcaagacctgaaactgtgttttatttatcttcatataactccacagcacattgtttagaagcctagtaaggtcagacacctttaaacatttgctgagtacgtgaatgaatcttgggcttaacaaaacattgtggatgctggcagagattcattcatccatttagcaattatttgttgagctcctactgtgtgacaggtactgaagaaattatggtgggcaccaacagttagggtcccttttctcagggaacgttgaagtctagtgagggacacagatgattaatgggataactttgaagtctagtgagggacacagatgattaatgggataatcacacaagtgaatataacgtcctgtatgataaatgtcgcaaaaaggagtaggtggtgctggaaagtgtgttagggtatcaggaaaaacttctctaaggaaagaacagctaggctggaatctgaaagaagagcgggaattgaccagacaaaaggagagaagagtcccctgttaaacagaatggcacatgcaaagtcctgcgtggaggggcccggactgaggcaggccatgtgactggaacatggggaggggcagcaggagaggggcaagatgaggccagagaggtcagcaaggacagaccaggcatgactttgtaggacacagcagaatctgactttctctctcttttttttttctttctgagacaggctcttgttctgtcacccaggctggagaccagtgatgcgatcatgggtcactgtagcctcaacctcccaggctcaagccatcttgctacctcagccttctgaatagctgagacttcaggtgcacaccatcacaccaggctaatttttgtatgttttgtacggatgggatttcgccatgttgcccaagcagctcttaaactcctgggctcaagcgatcctcctacctcggcctccccaagtgctgggatcgcaggtgtgagccactgtgtctggcttactgactttagcttaagagcacagggaagccatacaaggcatccaagtagggaagtgggacaaagtaatggtggtgatgagaaaggtgggctgggggcgcattggtgatttgttctacttttgaaagtgttcatgcttataaagatttcttcctttcaactgcaggaaggctaagaacatctctgccctctagggcattttgccagacctgctgtcagggaactgttgatagtaaacagaacaatgatttggaagaagctgagaagttaatgccttaggtgagagatctcttcccactcctgaagagggagggacagggagggacagggtaggcccaggtagagagccagcttcagcctgttttccaggagaaaagcatcctcctcctagaactacttcacaccctgaggtcaaaggttaacaggaaaggttgacaataaatgttaccaggcaaataggcacttacatctcacccacccctctgtctgctccaggagtcccagcgtcatcctcctcctggttaccttttgtcttaagaataaagggactgcccgctcgcattcttcctttcctccaatctcaccaggttccatccttctccgacaagagtaaattgttggagacggaaaacaggatgttgggttcagtggggaatatgtcagccttctctacaataggattgttgttcctcccccaagaggaagatgaggctttaagaagtgtctgcagcaatgggacccagctctcacactgcagcaccaaggaaagccaggcaggtggtgtcaatgagggacgcaggctgggagtaacacaacaggggatggcaggacctgcagggatcagagcttctgtgccaggtctacaaagggagcagctgttggctccgggccactgtggcccagcgggactgtgaagacaatgtggccagatccttccatttttaaaaaacaaccagaaacctggaatgttttgtggaattttctaattttatgtgttggctgcaacttaaaaaataattgtttaaagcttaagcaaatcaaacaaaacacctctaagagcaatgtctgactcactgctgccagctgccaacatctggatttctcccaaccatccaccatccttgtcccagaaggctttgggcaggtgctcctgagatggttgacaacataagtggattcacattgccagcactctgggcggggttgagatcagtctggaactagggttaagggattcaacctgtggctcatgactcaggagagagtcaggttgggaccacttggaggtctaactagtctcaggttgaccaatgggcaacctgcttagtttccttgggccccaaggaaagaaacatgaagacagatccttttcattttcacatagagatggactttgtagaacagcattgtcaaatgttagtacacatttgaaacacatcagaatcacctgcatgtcttgtgaaaacacggattgctgggcctcaccctcgaaattttgattcagtggatttagggtggggccagagaatttgaatttccaagttcacagtaatgctgatggtgccgatttgggcccacaatttgagaaccaccattgtagagatccctgttcacccagctttttggatccttacctgtaacagggtgaatcataaagaatcccatgtagttcccactggtgatgttgaaggtcagcttccctttggagctggagtctgggtcccaggcatccagttgaagcacagaggtgcccacgggagcatcctcctggatggaggggtagaacacagcttgggacatctggggtgggttgtcattggcatccgtaacctcgatgtagacttcagttacagaagagaggggcacagaacccctgtccactgctaataccgtcaaccagtagtaagatgcaaattctcggtccaggggtgccagagtctgaatcattcctagggacagtaagtcagcaaacccaaaatactttagagctcaaagtggctttagaaatcacccttacccaccattccccaaaccgcactgtggaaagggtattaataagtagattttctatgaaaagaaggaactgcttctaccagtataatgtgggagatgctgagttgaacacaggggaattaatatccttattctagaacctctcagagccttcctctgctaaaatggacgcatgcctttagcatgtgagcatatttagggttttcagaagacagtggtagtttatctactttctcttggctacttaaacccaaattccattgatctatttcacattctgtaagtgaggttttcttatagttgtccttaaactgtttccttcacactttatgtcctggtagataatcaatttcagggttaggaatttgaagaataaattgccattcccttctccatcattttcatgattttaaggggctgagcttcattttttagttcattccctccacaaattgcttacgatgggctagcactgttctagaagttgagggtccaagaatgagtaaaagaagcttacacctgaagttctcatggatcatgctgtactggcagggcctgtgtgagagggcgtggcccatgctcacagccatagcataacagagacgaccgctggggaaactgaggctcagagagggagcacgacttgaccaagatcatgtagcaagtatgtggaagaactgggtctgggattgactcttaatctaatgctctttctaattaaacagcttaattaaattaagctgttttctttcagtggctggcattaagagacaaaggttgctgaaagccaacattgagaacaagttattacaacttggttttggtggaaataaatcacctaccaaattgcaaactccttgaaggcagtgatctgcctttattcacgtgggatctcccccaggtacctatcttagggccttaccagtagtgggcactcgaacagtgctgacttacacttactttccttgaaacttaaaaaaaggaatgtggttgtgtcacctttttggagagcaatttggaaatacttattaacacagaagatgcacattatcctctgacctagaaacttcatttttaagaatttttcggccgggcatggtggctcatgcctgtagtcctagcactttgggaggccaagacgggtggatcacctgaggtcaggaggttgagaccagcctggccgacatggcaaaaacccgtttctactaaaaatacaaaagttagccgggcatggtggtgggtgcctgtaattccagctactttcgggagcctaaggcaggagaatcgcttgaactcgggggacggaggttgcaatgagccgagatcgaaccacttcactccagcctgggtgacagagcaagactccatctcaaaaaaagaaaagaatttttttctgtagagacccaggcatataagtaaaagtatataaataagaatattacacctacatggtagaataatatgtggccaattaaaacaaatgaactgacaaataaaatgtcttgatattatatgacatgaaaaaagtaaattttagaatagtgtctattatactgtattttcataataataaaatgaacaatatatgatatataagatacaaagaaagaaactttagaagattatagaccaaattgttaataaagattatatctggggtgatggaacatgggggagcattcgtttttaaattttatataaaaaatttataatcagatgtattacttttataaacagaatatgtaatatatgtgcatatatgtgtatgtgtatatgcacatatatagacatatattcccagtaaaaacaaattaaaaataaaatacacaggaaaaagaatccctatttattgcctttcatttcagcctgcaggctgactcctttttccttcagcccgcaggctgacttctttttccttcagcccatctacctctggccctggcaccccaccctaccccacccccagtacctgtatcttggttgatgctgaaggctgcgagtccagtgccagcacgcaggaagtactggagctccccatccaagccactgtcatcgtcctgggcagccactacaatcacctgagttcccgaggggctgttctcctgcacctggccctggtgcacgaaggaggcaaagtggggagggtggagattctcattcacatccaggacgatcacctccacatggcagagagtcctgcgggctaggggcctcccaccatcactggcccacaggctcagattgtacccagctcgcctctcaaagtccagctctctctccagaatgagcgcccctgtcatcaggtccacccggaaggtcccatgggcgccatccatcagaacatatcgcacttcacctgcggggcccaggtcaggatcagaggcatccagaaatgtcaagacagtcccggggggcaggtcctctggaaccttcagcctgttgtgttctgtgatgcactggggagagttgtcgttgacatcctccaatgtgattatcaggtcagtgacagagaagagctggtggcctttgctgggctgatccctggcctccaccttgagtatgtaccgaggctctgattcgcggtccaggtgtcctgtaacaaccagttccccagtgagagggtggagggagaacttctctgtgggacttagcagggtgtagcgaaccctgccattgtcttccgagtcagcatctttggttgtcagctctgcaattgtggttccaacttctgtgtcctccgagatggttaactggtacccaccgggaggaaatctgggtgcgttgtcattccagtctttcacattcactgtcagcagcttccaggaggacttctggggtgtgcccaggtcatatactgttacattgaggatgtagaaattggtggcttcatagtccaagggagcagctacagtgagcagccctgtctccagctctatgtcaaagcagccctcctcattgccatctgcaatcacatagaccagtttgccattaaaaccagcatcagggtcagtggctgctaggcgggccaagggggtgttgatagggacactctcaaggacatcaatggattgggggaagtggtcctcaaactgtggggtgtaatgattaatctgatatgtgcttaaagaagtgaattcctcatcactggactcctggttctgaagcccaataaagtggaggatagtctttgtgaattgtgtcaatacccctgttttatcacatgttacaggaacttcaaaatgagggtccttcaccacagtaatattcaaagttgtgggtgaggcatagtttttgccatctgaggctgtaatcttcagggaataactggtgggttgaccagcagtaagattgataaaagggcgtttgagggatatcactccggagaaatgatttagatcaaaatactctagttcattgcctgatacaatctcgtattttaggttctgaagctcatccacatctatggctgacatagtcattatcgatttccctactggccagtcttggcggatagaccctgtacagttgacttcttcaaacataggctggttgtcattcaagttcctgagctgaagaaaaatggacacttccttctcccggcgaaaaggggatccccagtctgatgctcttacccggaaggtataaattcttttcatgagttcatagtccatgggtttggaggtggagatgatccccaggtaggggtcaatagaaaatggcaaagcttttggtccagcaatggaataggtgacatatccattttccccatgatcccggtcagtggcagtcacagccaaaacactggtgcctggagggatgttctcatccaaggtaccatcataggaagacctgttgaagaggggggcatggttgttgcagtccacaatgtcaatgaccaccacggtggaggcctggcccggtgaggttctgatgtgtagctgatagtgggctctgtcgtggaagtccatgagctttgtggtggtgatcaacccagttcgagcattaagtttaaatcctacattctctgaagatggctttagaacatactgcaggttggggaaggctggggtgactctcaccatcaccacgcggctgccaggaggggaaaactcactaagctgcactctgtaaacagccttctcgaatttgagggaagacagtttggaaggtggtaggtgaaagcccctgatctgggaataaaaataagggccgctcccactcctggcctggaggctgaggttgaacccatgaaggtactccatccagttgatgtctttgacagacaccaaactgaactcattgctccgggcataagacttgatggctttgaagtgctttccagggtcaccaccaacaacttccactgactccacttcagctcctgagctatttgcatcgaccagtacagtggcataggtggtaccatcattgctgtctggtggagtcaccaccaccgaagcaatggctgggggcttcctgagggcaggctccacatgaaccacaagtgcagccaggctgccaaacccattgccctcagagattttccgcatgcggtccacagctagcacctggagctcatgctttcctcgccaggtgacgttaagcttcccagccacagtgaccacaccgctggtgggatggatggcaaacatctctgaccttgtgttaaaggcataatagaactcagcattctggcctagatcagcatctgtggcagtcaccttgcagatggggctcttcaggggcatgtcctcagagatggtgactctgtacgaaggtggagagaagagaggcttcaggtcattctggtccaggatgtggaccaccacacgggtcaaagcttccaactccaaggtcttctctgtggcttggatgatgagggtgtagctgtctcgcacctctctgttcagaagagctgtgttgctgctctttgtccttattcttaggaagcagaagttgcccaccacatactcctcagttttaaatacattggccacatccccagagatgatccggtacctcactgcccactgtggctccgcgaggtagatgcccattttctcgaagctctccacataggtcttgggagaagaattttcatagatggtggcattgtaatgggagtgtgtgaagtgccaagcagaggaggagagaatcccttctagaggcttctcacaggtcgcacaatggagcaagaatatggcaaaacccagcagggcaatagtcatggtggaaaactcccgaaaccctgggcagaaaataaaagacagggtgcaagttagggggaaaaaatggtttctactgctgtgattcttaactggaggtgattttgaccctcaagggacacttggcaatgtctgaagatacttttggctgacccagcttgggagtggtggtgctaatggcatctggcaggtagaggctggggatactgctaaacaacctacaatgcataggacagtgcctttgtgtgagtcagttctcacactgagaataaagacatacctgagactgggtaatttataaaggaatgaggtttaatggactcaccgttccacatgactggggaggccccataatcatggcagaaggcaaaggaaaagcaaagtcatatcttacttggcagcaggcaagagcgcgtaggcaggggaactcccctttgtaaaaccatcagatctcatgagacttattcactatcacgagaacagcatgagaaaaacacacccccatgattcaattacctcccactggatccctcccatgatacagggggattatgggagccacaattcaagatgagatttgggtgggaacacagccaaaccatatcagccctgcaacagaattatccagccccaatgtcaatagtgccatggttgagaaaccccgtggctgaagaatagcagactagttcaaaatgctctctcaaagacactcagcagctagaacacagtcctgaactcttactcttttttcccaaaaactttctgtgactccttgggcgatggtgagatagtcccaactcttagccaggaaccaagtttagctatctggttctaaactactattctctctccttcctacaaggcctttccactggggctgagctctagccaaactgagctgtttccgcacatgcagaggctgcaggaaagcaaagtgaccaagatcccaggcgtggcatcaggctgcctggctgtcagccctgcctctgtcatttgctaggtaggtgacttttagagcaagttatttaacctcatgagccttcatttcaccttctgtagaataaggataagaaaatcatcaatctcttaggattgttgtgaaaattcagtgaaataataaaggtaaatgacttatcagagtgcctagtttattgtcagttctaatttaatgtcagccattattgataataggaaactaaggttcataaaaggaagggagctgcccagggccttatagctagtgggagctccttgcacagaccagggttgcctccttgccccagtcctatttatacctgtttcaccacatgtcccttatagacagggcatgactctgactcatcatgtaacctggaacatgaaaactcccaggctcctggaatgtctgagttgaaatggacattagagatgatgggcttctgtccctgcttttcatcatagatgagtatagatggggaaatagagccccagagtcgagatcagtcaagctccaagtcacacagtgtgtggccgggtaagaactagtccctgggagttagttcttgttgaactgatcatgaataaatgcttcgcctctcttagacccttgctgtttcccacagagcccatccccgaactccagcctgggtgaaaatgtgagactcaccagggccaaggatggggcaaggggcaggaggagcggggcagggtttggcagggccatgtgtaggtctggtgcaccaggctgatgcctggcttgcccctgggagccttgattcctaggagcttcatggctgccagccagatgcgctggagcattcttggatgaaactggccagacctgattttccagttgccttgctcttcaaagccaaggaagagttaaacttccaaggcaaagggggaaggagaggcttggagccccgtcttgccagagtcctgtgtgaactgggcacagggttccccaagatcatgctgacagcattccgagataagaggcaggaatagaaaagtctgcctaaatcggggtctgaaggcctgtgacagaaaataatttcaatatgtcccacccttcgagcttccctaccacccgcctcccaactcctgagattctgttggtggtgccctaagcttaggcacctcagaaaagagagggcaggaaggtggcagattcttcattcgaggtctgaaagttagtggcagaaagagctgctgtacgtttcccgccctgcctgcccactactgtccttccatgcttagagctgcagcccatagtggggccagccccaggcaaaagccacactcaccctacccctgacccagcccccacaagcagaaggggacgcctgagtcattcagcccccaacccatgcaggatggcattgcttttgaagttgaaaccccaagggaaagtgagtcctcaccccagtcccaggtccactggctccacagctctgtgagcccagggtgcacgcagcctcccagccctgcctgccctgctgtgtggagagcttcctgttcaccaggtcagcacccgtgttgggcaggccccagcaagatactctgctcgatggctgcaccggtgccttgcaatgcaggcgccgttaagatgagctgtagggaaggggaaggggagggatctccctggaggaggataaaatgcagagagaatgcacccttggatggtggcttggtgcccatgacctgcccaggctgtaggacctgcacacctggggagtagtttgctgagggagggaacagtgtctgcacagctgtttcctggccccaggtttagatgagtgaacaagcttgcagggcgcagaagcatgttaggctccttgtactaccttcctagttcacaacacccagggaccactattttaaaacatcttgtgtaaacgtacatcaattcatatgacttccctgcttaacactttccagtggcttcccatagcacttagattaaaatagaaactccttgccctggcctagaaggctctgcacctcctgggcccatgctacttctccagttcacaagctgcagccacacaaaacccagacctgcctcggggcctttgcacttactgcttcccttaagattctcacatgaataattccttcttgtcattcagttttcagcttaaatgtcacctcctgagctcctgtttggagtagacttcctgtcaattcccctctttatcactttgccctattttcttcatgacatatatcactacccaatattttcttgtttatttgtttaatgactgtcttcttggactccatgaagagaggagctctgtgtatcttattcacagatgaattccctagtgcctagaacagtgcctggtatagaaccaggctcaatcaatactagttgagaaatggaagaatctagacttaggaaacacaatgacagaatgaacgctgaaagagcctttcatgatcattccttccttttggaagctggaaaataaagtcccaaagaaagaaagagacttgcccaaagtcacagggtgagaattagagccaggttctttcctcctgactgtgcttctggaaagagctgtggtcacttatgaatctgactgtttgatttcaaatcacagctctaccacttgctacctgttcaaccttagaaagttactcaatattcctgaacctcagctttttcatctgtgagagagggctcttaagagtactgcattcatattcatagggttttatggagactacataagatcgtgcacgttaatgtactcagcacagtgcctggtatgtagacaaaactcaagacatattcgttattagattttaatgccaaggcagaatcaaagcctgggctgggttgagggtggggtccgctgaagcctctggagaaggtccagcctgtgccccaacacagcaggaagccactggtctctggtcgagtctaagcttgctggcctagccacagactgttccgggaagctgcgagcaggcacttgtctggggtggggcctcatgctccttggctcctcaggcccagaaagagacctgcatctgagtgaatgtgcacatttacaagagggcacacatgcatactcagtagtcaattttttgaataattgtgtgggtacattagttctgtgtctacctggccatgaatggacccttttaggatatatgtatgaaccaactctgcctccatgtaactcccagccccatttcaaagatgtggaaggcaggagaaggtggctaacaacacacaggctctggctgtgtgaccttgggcaaatggcttgccttctctgatccttagtttccctacttctgcaggtcgtttcaagaatgaaagttagttaatgcacataagtgccgagcacaatacgtgatatagttttcaacaaatattacctagtaatacaactgtttagtacctggcttatactattaactgttgagtttgtggataataaaaactttcaggccaggcgcagtggctcatgcctgtgatctcaggactttgggaggccaagcggggcagatcacaaggtcgggagatgaagaccatcctggccaacatggtgaaactccgtctctactaaaaatacaaaaattagctgggcgcagtggcatgtgcctataatcctagctactcgggaggctgaggcaggagaatcgcttgaaccagggagttggaggttgcagtgagccgagatcgcgccactgcactccagcctggcaacagagcaggactccatctcaaaataaaacaaaacaaaaaagactttcagacaaattattccgtcatccctgatctatgcttgtgcaggctaattttctgcaacttagtgctgtagggctttatagaggctgtgattcagttcaccctgtgtttcagctctctactccagcttctcaggatcttgattccgacattcagaaacctgatagttgtaacattcatgtctttgtccaactcattgataaaagtttgaacgtggagggctcctcatcactgggggaatccaagcagaatctgggtggccacctgaggagcatattctactgtaggaggatatttgtccttgggggagataagaagcattctgaagtcccttccaactcatacgggcatggttctttggcctgtgcatgcctatggtctctatcagaccctaaacgagccccccaatggcagcgaagggatttcctctctgtggatcagggttatacacctgccaatgcttgtttgagagtcagtgtaataagctgatccctgacctgggttctgggaggctgagacctaaagtcactcattctctgtctgttcttggtcaagtaagtcacctaagccccgtggaccttttttctcatctgtaaataatgtgtgtgcatatagagggaaggactgtaatggatgggtgattccaaacccctctaattgtcccacccctctgccccaggtgttcagtgctaagactggctcttgtggctctcaagaaagaatcctaaacatattctgtttatgaaaaaccttaaagaggtgagataaataaattaagagggactgtgctttgaaccagaataaaaattgtaaatgaaagaatggtgacattctaggtatctgctagtcaagtcttagccactgaaataatttctcttcttagtagtagggagtgattgatggtttttgagaagaagcagaaccaggacagggctacatcattgggatgagtaatctaacattagaccaaaaaagggattttcgcattcaagtctcccactctggtgtggatagggcttgaacaccagctctattggtttaagacaactggaattcactgagggtagagagacttaatctacttccaagaaacttggatgaacatgtgagtcatttgttagtttgtaggcagccactgtcagattctcatataacaaaacaactggatgtggccaggagaggagccagtggcttgagccattgatgggtcctgtgacttgagaatgccacacaatctctcctgggcctcaacttgcctgtctgtaaaatggagataataatagctactcctacctacttcccaggactgcagggaaaacagataatttgacaggtgaaagcacagggaggaaagatgcagagtaacaccttattagaaccaataatggctcagtaaatggcagtctgaagtgtcagctggcagagaggccatcttaggggatttgactgtaaaagtcaggcctgtcctagtctggagttagaaatgactaaaaaggaaatccttatctaggacatggatgaaagagagctgggacatgaggtcccattatttattagtattctttttattattgatgacaaaaattattctgtcttacatctgtatgataatctatacattttcaaataagcatttgcatgtgttatctcacttggtctttgggtagagtatgcagtactggacagaattaaaagttaagaaagcgggctctggaatcagacagacctagtttcaaatgccagctctcagtttatcaactgtgtggccatgggtagttatttaaccttgctgatttcagccaaagggagaagataatggtactcacctcctggagttgttgagaaggctgaatgaggtaaagtacggcaaatacctagcactggaacacactcagtaccagttagtgatgtaccatcatcatctgtcctatgacattcattactctgaatctgtaactgtgaaattgaggcttggataatttgaagactgtgcccaggttcactcgtctagtaggtgatggatgcaagcaccagcacagaataaggatccatattctaggaagagagacatcccagaggcctggagtagctggagttcactctagagctgcgctttccagcagaactttctgcagtgatgaagtgttctgtctctgtgctgtccagggtgggagccatgagccatgcatggctggctattgagcacttgaaatgcggctagtacaattgaggagttgagtttttcattttatcttattttaattcatttaaattttaaaagacacatgtgacttgtgtctaccacatcggacagcccagctctaaagagcacggcataggaaccacaggattcatgagattcagagaagaatgctgggtccactcatctgtaaggcagagtgggcacacccaggacccaggactacacatactattaaagcagaatgaaaagggagaatctcttaagaaaaattgagatcttaatatgtgggctagaaagatatggaagggaaaaagctaaaattcacgtatacttagcagtatggtataggaacaagggggtatttttaaaatggttagcttttggaatgaatatgtcctcaaattatgtcttagagaaggaagggaatgatctgagggagcaaactgggatatattatctggaacagtggcctcaactattcgtgcatattagaattaccaggagaacatttaaaaacagcttttcactcacccctagtttaaatcaattaagttatactataggtttttgggtttttaaacatcttttcaggaatgaggactactgtagaaagttactatggtcaataaattattgagaatttccttttaaatttgaaaattgaatcaataataaatgttttagtttattttaaatacgaaagaaagaaaaacttttaggttgaagagtttggatatatataataacacaggtatgtctcacttaacgatgggaatacattctgagaaatgtgtcattatttgaaccagaatgaaaactgtaagtgaaagaatggtgacattctaggtacctgctagtcaagtcttagccactgaaataatttctctccttagtagtagggagtcattcatggtttttgagaagtttgcacaagtttgttattgtgcaaacatcatggagtgcacttacacaaacctaggtggtgacgcttactacacacctaggctatgtggtacagcctattgctcctaggatacaaacctgtacggtatcctactctactgaatactgtaggtgattgtaacacaatggtaagtatttgtgtatctaaacatagaaaaggtacagtaaaagtatggtattataattttatgagaccactctcatatatgcagtcccacactgaccaaaatgtcatgatgtgctacatgactgtatacgcatctttataccaatgccgtcatagaacataatttttaatttatgacttcataattatcacttataattgtttcatggaagaaggggcccacaaagactagaatgcttagagccctcaaaagtcatagtatgaccctggagaaatgaatatttgaaggaagaaaagggcttccagtggcctgggctttggggaagaaaaggaacaaagttggggatgtgaagaaagtgttttattattgagcttcctctgccaaaggcattcattcatttaatactcactgagggcctgccctgtgccaggcatctagagcagagaacaagagagatgaggtttctgctcttgtgggtactgtattctagtagcagagagagacaataaacaagaaaatattgactgtgtcaggtgatgaaaagcgatataaagaaacgttatgtggggcaaggggtagagcatggaggggagatgctattttttaaaggggagtcagggaagtcctatatgacaaggtgacatttgggcagggaggtgaacagagtgaggaagagagccagagagctatcttcaggaagagagttccagacagaacaggcaacgcaaaggccctgagatgggcagcaaggaaacgctgctgtgggttttcaagtttgcagatcctgatacgcaatgaggcccaaagagaggaagaggcgtgtctggggtctcttcctcttagggttgtctgtacggatctatgagctttgcatttgcagctgaaaaatccctaagccagagggaacctcagaactggagggcctggggtggcagggagggaagggaggaatcctgaggggtcaacaactctagccccacttcttctggggctctctggtaggaggagtttgttagatgaaaaccattaaaatccatgaaaagggaaaggcaaaaaaaaaaaaaaagatcaaagccaactccagcttagcagaatactgcctggtatttattcattagaagctctaaacgcagaacaggggaacgggggaacctcccctaggttctaggtgaggaaggttgtgccctgatagactctccaggaggactagaaagcttctttcagatggagaagagaacaaaatgcaaaggccagaatgtccctgctgaatgggcctcgttttgtggggttgcttactatcctgtggttcttgccacttcgatccaatggaatcctttgcaaaaggatgagttttcaaacacagacctcaagtcccaactggggcaaccttgaataacttgatctctgagcctatgtttttcttcacctttgaaagggagatacttaaagccacaattagattatgttgggatgactattatcaaaaagacaagagataacagctgttgaagaggatgtggagaaaagggaaccatcagacactgtcagtggaaatgcaaattagtacagccattacggaaaacagtatggtggttccccaaaaaataaaaaaaagaactaccatatgctccagcaatcccaccactgggtatatatccaaacgaaatgaaatcagtatgtcaaagagatacctgcacgcccatctttactgcattattcacaatagccaagatatggaattaccgtaaatgtccatcagtagatgaatgaataaagaaaatatggcctatatacacaagagaatgtcattcagccttaaaaggtgggtaaattttgtcagttgtgacagcgcatatgaacccggagggcattatgttaagggaaataaaccaagtacataagggcaaatactgcaaatacttttttagaatccacatatactcactctgtgtgaactctaaaaaggttaaactca

SEQ ID NO: 1083 - DNA, 21559 bp, Homo sapiens
gggaagggacaaaagagggcgagggtgcagggcgggctctgattccttgtcttccccaatccagtgccccgatggacaccaacctcttgagcaatatccagaagctattctctgaacgtattgatgtgttcagccctgtggagttcaacaaggtccgacttccaacgtgactcagacttccagggatcccggggagggttggctggagcagccccacacctgcccaaggagccccaggactctgtgaccaactgggggtgaccctgaccctccagtctctgtctctagggctgtttttaggtagtacagagtgccctgcctccaaatcccacagcccttgtcccagtcttggtgtatgcccagcctgagtctgggtgctgacctgggattactgtttgcccttgtccttatccccacagtagtcttgggtcctccccagggttttctgttcacccatggtccctgccccgcctcactccaagctcagggatgcctctgattgctgggccctacctgtcccctgccctccagatgacggcgctaatattgtatccctcccttcttatctggccccggagactttctgcctcatcccagctacttccatcgtatgtctcccgggcccctgcttggaacttgggtgtcccccacacacacctgcagtccccaagctgcatccctgtgtccctgcctgcaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggtaatggggcagagagatgggacctggggcaaaggctaagcgaaggagagctggagcgggtgaactaagagcgggggcgagatctgaggatggaaggctttgggggtgtcggaggcagagggacccgggggtttgcagcgaagggtgtctggagagggagagctgaggaggggccggttctgggggctgcagaacggggatttatggtgtcgactgggagcaggaggagggtcttcgaggggcctgggggcgggggactaagatggacgcctgggaagggaactgggaggcagcggggtgcctgggggccgagggctgaggacggggtgcggaggcgcactctgggaatgccgagagggtcccgcagagacgtcagggcgcccgtgcgggccggcggggagctggggggctaggggcggacgcccgacgtgatggcccttcccgcaggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtgcgggccccgctcgcggacgctcgggggagggaagcgaatgggctcggcgagggaaaggacgccccgggccttatcagagcccccttggacccgcaggtggccgaggggcaggaattgaaggacaagagtcgcctgcgctatcctattaacggtgcctaggggacgggccctcgcgctggagttaagcggccgggggtggagctccaggcctagcggggaggtccacggagattggcccccaccccaggctcctttgtgtgcctctgttacgcccaggacagacgccgggggctctccctatgcccctcgtccccacagccttaccccatttactgctactccgtgcaccacagcagtggctggggtgatcctctgaaggccagggtggcagcctaatgcttggggcagggtctgtggcccccctgagttttgggctctgcgtgtgtttgcggggtggggatgtggaggcgcgcagccccagggctcactgtgcgctgtggttcaggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggtgagaggggtcctggggtggagacggaggcagattggggcgtctgcctgtacattcactctccaatattctccaggcaatccgatttacgacttttttctgggacgagagctcaaccctcgtatctgtttcttcgacttcaaatatttctgtgaactgcgacccggcctcatcggctgggtatgttgggcttgactgagctggcctcaggccagggggagggttagggtgggtgagcagcgcttgggcagggcagggccaaaactgtgcagatgcgagtcattaaccattcatattccacaaacatttgttcaatccacctgtgcctaggtactgggagacaaaaataaagttagaggcaaaaaagcatctttgctgcagagagcctacattctggtgggaaagacagaaaaaaataagtaaaatatatacagcatgtcagggatgacgttaggagagcacgtgcaattctcaacagcagtcaagcacagaatctatttccagggagtgaccgcatgctgcttgatggtcaaggcagtgcagaacctgaaattgatcgctggggttagcaacctacccgtcactagtggccttgacaacattccaactgtgatctctggttctgtggccaagattacccaaagaaactcttgggcaaggcctctcctgttgccctggaaattatcttacccgaggcaggagtgccaggtgcccaccctgggtctgggtcctggcctgatgacaggcacatctgaggacacttcctcatctttgagatgtgataaaattaaagctttctcctaagattactgggaagattagaagaggtaatctttatgatagaacagagctcagtgtcaaatgcaggcgcccagcacaggcttgctccggctagccacactgagcacgtaccacttgccagggacgctatggagggcttcaaacacgatgatgccattgagtcatgacaggcccatgattatccccatttttcacacaggggtgggggaaagtaggctgtggagagggcaagcaacctgcccaagtgatgatgctgagatctgaaaacaggtctgtttgagcactgaagccttagcccgaaagggcttaggacagacaaggcaagaagaaacaggctgcgggcacctccctgtccacagtctctgtccttgggtctagggcctggatccacttaagagctggagtgtaactgacagttgagaagggcagaggctggccactgctctgcccaaggctgccacttctgtggagactattgccttgttccctctccccaggtcctcatcaacctggccctgttgatgaaggaggcagagcttcgaggcagtccctcactggccatgtggctggtcaatggcttccagttgctctacgtgggtgatgccctctggcacgaggtgaggctggactggacgagggtgggtgtctgagggccgcatagggactaagccagtgtgtctgggtcttgtccctgcaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatggtcagtcaggaaggggcagcaggctgggcccatcttccccctatccctttgattcatgctctgtttacacgcaccaccacataggtgctaacccccagggttctctaaagccagggcagggtcctgggggtccaggcagagtctgggctgcagacaagttgggcagatgttcggggtcaggcaggaggctgcaacccttgaccttgaccaccggttcacactctctcaccagctactggttactacatcttccgtggggcgaattcccagaaaaacactttccgaaagaatccttctgaccccagagtggctggtgagctggttctctagggccatgggtgaggtggggcagctgggcttcctgggaactctccaccctgctgtctttccccagggcttgagaccatctctacagccacagggcggaaactgctggtgtctgggtggtggggtatggtccgccatcccaactatcttggagacctcatcatggctctggcttggtccttgccctgcggtgagtggcccatgtggatatgggtagggacatgtgaggggaagaggtggctcagcgaccacaggatgcctactttgggtatgcaccagtgagagtagtcagagagctgggggtggacccagtgtgtggctggggcacacctctgtgccaacctagtaccgtgtgctttgctgcagaccctggcgcttttgctgctgagccccgatgcccacatgagccatgaggtgtggaaacgtttgtgaactgcggggtggaggggccggcagggtggtcacagagcctccttctctacaggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcggagatgctcttcctcctttggataaacactgggaacccttggtgcacttctctcccctaggactggctgggtcagcactgatcagggagaagctgagcagtggcttgtgggcccaggaatctggggtctggtgggacaatagctatccctcagaaacaagcaacagggctgaccagtcacagctttattaatgaccagggtaacccgttcagctagggagctcctcaatgagagttcttggggcaggtggcacggggcctccccaaagccgctccagctccccagtgagggcggccacctcctcggctaccacagcatgggcttggtgagccctggcgcagtctagggccaggggtgtgagggccgcctcattttcgttggtccaggccaggaggaactggcactttttccgggcccggtaaagatgatctcgctcttctctagccacggcctgtttccgggcacggcccagggtctgtgccaggtcccccagtgctgccagcgtgtagcctttctggttggtcgggccctcgcccagcaggatgcgggcgacctcgtgcatagcccctcgtgtgcccaggggccccggcgggtgctcgcctgcttccagcacgtgggctgccgcctgcagggcttcttccgcagaggcgaagacttgctgggcacccagggctccggaaacgccgagcagtgtggcacagaagtcagagagcagcgcgtcgtcaccgccgtgatacagggcgagagtatgcgcgtaggcgaacagcacattgggcagctggaagcgcacgagcggcgagactgggccgcggctcaggctgactatcgcggggatgcgggtgggtacgacgggcgtgcaggcccccgggacatctccaagaacccgctcggcggccgcgggctccgcggcggaggcatctttcacagaatccggcggggtcctcgcaggggcgagctccagctccgcggcgtcactacccggggcattatccagctcctccagaagctgcggtccggctccgcggttccaccaccacggccgccatggaggcagcagccgcccggcctcaccgcggctcagcagccgctcgaaggcagctttttcgcccggcgccagccgctcccagagtcccgataggccgccgggcgccgggccggagctgaggcctgcttccccaggctcgtcctcggtctcgcgttgctgacgcagccggcgtagggcgcttgctaggcggctgggaggagcgctgcaaccgcggagctctcccagcacctggtcacggtagaagttttctgcgcaggtgccatgcgtccggtagcagcgcagcgagcagtagggcgcattacagcgagggcaggtgtaacgcgctggctggacctcccccgccgggcagaagccacagggcccggccggctccatggcaactggcaccgcgatctacctgcgaacgcacgccggtggtagttcgaaacttccggggcttcttcgattacttccggttcgcagcgcggccgacggcgcgctgtgttttcgcaaagcttccgaggattctcggcaatttccgcccacgcccgaaagccaagccccacccctttccctagtagggcgagagcaggcccagaagccgggcgtcaggtacgagccccgccctatgcgatgacgcaaggagcgaaaaaatgggtctggcgagcgcttcgccggtgccacgtctccccctagtggtcacaccaaaacgtggcccgatcatctaaagagaaaaccctctttttagcactacaatgtgctgtggcataaatccatctttactaggcacctactctgggccactaattgtgccaagcctacgggaggcgatgcatccctgcgctggacacagacaaataaaatgcactaggggacacagacaaataaaaggacagttagggccaggtacggtgggtcacgccggtaatcccagcattttgggaggccgaggcgggcagatgacctgaggtcaggagtttgagaccagcctgaccaacatggagaaaccccgtctctactaagaatacaaaattagccgggcgtgggggacgggtgcttgtagtcccagctactcctgaggctgaggcaggggaatcgcttgaacccgggaggtggaggctgcagttagccgagatcgcgccaccgctctccagcctgcgagcctgggccacagagagaaactccacctcaaaaagataaatagaaagcagcatttaagaaatatctgagctcctatgatttttttcctccaaaactgcctcttcttttcattaagtatcttctcattaaataccactattcatccatcttattaagtgcaggccccattctaggtgccaagaacacaatgcacatcaaagggagccgggggtccctgttctaatagagctcactcttgtggtggagtggggggtgtgatgaaccaaactgtgagtgttctttgcatccctgctactactggtggtctaagcttcctgacccctcatgtggatgacaacacattaagtgtttttcctaactttcttgccagccctccagaaaaacctgccagagaaattagatcacaagtcagatgagatccatctgttactcaaaacccttctgcgaccctccattgcacttggactcaaacccaaactcctctctatggctgacaaggccttgcaggatctgcccgcccccagccctagacatcacctcttccccatcttcacacagtcctctaggcttgaaatattcccctacctgatcacttgactggttcatctcaggtctcactcacgtcatttaaacaggacctctcggctgggcacagcggctgacacctgtaatctcagcactttgggaggccaaggtgggcggatcacttgagcccagttcaagaccagcctgggcaacatagcaaaaccctgtctctacaaaaaagtacaaaaaattagccaggtgtggcggtgcatgcctgtagtcctcagctactttggaggctgagtaggatcacctgggcccaggagttggcggctgcagtgagccatgattgtgcaactgcactccagcctggatgagagagaccttgtctcaaaaacaaaaaagaaaaggccgggcactgtggctcatggctgtaatcccagtactttgggaggccgaggtgggcgatcacgaggtcaagagatcgagaccatcctggccaacatggggaaaccccatgtctactaaaaatacaaaaattagctgggcgtggtggcacatgcctgtagtcccagctactcagggggctgaggcaggagaatggcgtgaacccgggaggctgaggttgcagtgagctcggattgtgccactgcactccagcctggcgacagtgcgagactctgtctcaataaaataaaataaagaaaaaagaaaaacaaaaaaagaggccctctctgggatgctattgtatctgtccacatcctccccctttctaaactgctggaaggcagaaaccatgtctttaacaccacagagacaaaaatagccaagattcacacactcactgtaagccagatgttgatttacatcctttaaccctcacagcagccctggagatggcagagattaaattagtagttagttcaaaggccagccacccagtaaatggagtaggaagaaaaagaaggtccaaactcaggcagtcaaagtccacagcccaagggctttaccctgttggatgctatttctcaagaactggcaggtccagaaactttagctgaatgagtaagtggggttcagaagtgctgggaggctcagttgccagaagagaaccctgaatcagccccagaggtaacccaacttttgggaacactgaaacctcactatatccaatcacagatgtgattaggttaccaagtccggccaggcagtcacagaggtacaaacgaggccatgctcccaacataatatttacttctaaaaccaaggcagaccagattcctgccctggactctaaggccacagctggtaccaagttcagggaacggccaggttcaccttctatacaaacctcttcccccacccatcccttctattgctgcctccataacaaacctctcaccacagtgattcctgctaccttctctgtttagaagatgaaaaagaatgacctggggggactgatcaagttacttaggatagggaataaccccaattttacatctgaagccccccaggatctgtagctgtttcttcacaggaaatttctcttgtagtttaccatttcttccccccataccaaaggcttctgccttttctgcctcactgttctcctaggggacataccaccaacccgagaagcacacctctccctgaggccttgcaagtaaagatgaaacaatgcgatgactgaactaagtggcttttttattagagaaagccagaattacaaaagacttaagagttggcattggggcccttcttcttgccaaaggtgggcacaacgttgacaaagcgccggttgtactgcatccgccgcttagcccgacctgtcttcttcttcttcttctcctgtttggccacctggagaagggaaggttaatcaggccctggttcctgtcttccacacctagcatcccttccctcaggctcatctccagggagggagaaggcaaaccgagtaagagcccagggacttggtttagctgtgaaaggaaaaaaagtcctaacaccatgaccactaatactctcactcaccttaggagtctgacctctcacttttccagcacgggccagggaaccatggactttacctgtagtgggaaaggaaggcaccagcaggtaagagcaagaaggtgccacccagcagaacccctcttttctcaattcaagcctttaaagagaagctgcgcccaataggtaatgagaacaaagttgcagatatttgaccttgaaatcttaagtttcatttcaggatcttccagcttctaattttatagagcactttgggggccctggtctgacctaattttagtgtggaagctgataaccagactaggatctcgtgatgtgactgaaatacaactacactctggctcagtctcccatggacgtctgtgttcaacatgagggatgtaaacaggaagaatcactctgaactgaagacagtgagaagtactctattaccataggtgtgacactcagctgtcaggactatgcaccccacactcactagacgcttaccggtacttcaaagaacattcctctctcactcacctccaagcatgcggcctgctacttccagggtagtcagggcctccaccccgcactggcccagagtggcctcatcctccaggggcgcgcctgccaggagcacgacttgatcttccggggcaatgccctccagtgaggctacatgagcctacagggaaagataaggctcgtaagcgttccctcgggccgcgagagtgaagagcacaagaaaatggaacccagggcgcaccaagcagccttaccttgatctgggcgaccgtttcctggccggtcacctcgaaggtgtgtagctcctgggcgcggacaaagagctgcatattggcgactgagtaaagaaaagacggcttgtaagagaagccaagaaatgctctgggataaaggagatttgggagtggaaagcggtccagaaacgatcgcgacgggatggtggtcgcggcggctcacgtggggaaggccaggcctcccaaggagttcggatagggactggagcagggccacggagcaggccccgttcttcggttccccccgcgccttctgaccccgcagccaacctgctacaagcccttcggatccagccaaggccccattcttacctgaacggcggtcccagctaccgcgaagatggagtcgagaaagaggaagaagcgagggcgcgtcagtacagaccgtgggctgcgtgtcacgtcactgctgagcgaccgcgcggttccctgctatttgtaccgcccaaggcagtcctagctccgcccctttacgctcgcaccggcgaacctgcctgggcaggcagctcgcgcaggacggggcgggaccagacagttgcgcgcacagaaggctggcgtagcaggtaaagatggcagctaccatgttccgggctacgctgcggggatggagaaccggtgtccagcggggctgcgggctacggctgttggtgagagcgctgagcgaggagctgagggcatcgcgtgggtgtgaggctcagtgttaatcattgttaaccccgaaaactaaggcattcctacttggggccttagttttgccgttttcgatcaggagaacttgtcccgagtgtacatatagaatcgagagggaaaatggtagactggggtgctctttgggagcacttaacacagtgcctggcagtgtctatataagccacaacgtttcaggtaaggggcggggtcctagcatatgagtgtgcgtggggaattatgattgccttaattctttttttttttttttttgagacggagtctcgctctgtcgcccaggctggagggcagtggcgcgatctcggcccactgcaagctccgcctcccagattcacgccatcctcctgcctcagcctcccgagtagctgggactacaggctcccgccaccatgcccggctaattttttgtatttttagtagagacggggtttcaccttgttagccaggatggactggatcttctgacctcgtgatccgcccgcctcggcctcccaaagtgctgggattacaggcatgagccgccgaacccgtctgattgccttaattcttaaggcaatcataagattaaacatcactatatcccgtcacagatgtgattaggttagcaaggccagccaggcaatcatggaggtacaaacaaggccacgctgccaatataataatatctatttctaaaaccgagacagaaagttaagccttaagtttctaaaggcttgattgacttttcagaagtgtacatatactcttttgcatcccacagaaatcctgagaggcagaccattcagagtacctgagcctcctttccatcccatctgtaccctgcaccatggaaaaccaaagactggtgctatcttatgtcaacctaaataacagactctaaaagaaaaggatatttattcgggaatgggtatagactatgtgcttatcagggaggtaaaagaagacaaaggtttttaacagaaaaatgggccaggcacggtggctcacgcctgtaatcccagcactttgggaggccaaggcgcgtagatcacctggagtcaggagtttgagacaagcctggccaacatggtgaaacccgtctctagaaaaaatacaaaaattagccgggtgtgatggcgtgtgcctgtagtcccagctacttgggaggctgaggtaggagacttgcttgaacttgggaggcggaggttgcagtgagccgagatcacaccactgcactccagcctaggtgacagagtgagactctatctaaaaaaataataaaaataaataaaggaaaggaaaaatgagtattacataattgttttgagacagttatccttggctacaaggatgaataacatgggtggtgccagttcaagattggacaggcagttgttggacagatggccatgcaggaatttgttttcttttgttttgtttgagagagtctcgtcgctctgtcaccgaggctggagtgcaatggtgcgatcttagctcactgcaacctccacctcctgggttcaagcaattctcctgcctcagcctcccaagtagctgggattacaggcatgcaccaccatgcccggctaatttttgtattttcagtagagatggggtttcgccatgttggccaggctggtgttgaactcctgaccttagatgatcctcctgcctcagcctccaaggtgctgggattacaggcgtgagccaccttgcccagccagaaatatttttttgtgtaaggttgaagtggcctttgtgcaaggctgtggtttttgcagtcttttgtggtagttcttgttattaagtatttgtgcccaagaactctctcttcgtggccctccctagctctatttgttgggatttttaacccaagtgactcactccattttgattctgatagctttcacaccgtcgcccagccttttatttatgtcattctctctgcctgtaatgtttccattctctacttactgaagttatgccatcctgtgttgggtaggctaatggagaaatgggatttttgttttgcttcagagccagacccagggccctccagattaccccaggtttgtggagtctgtggatgaatatcagtttgtggagcgcctgttaccggctaccaggatcccagatcccccaaagcatgaacattatcctacccctagtggctggcagcctcccagaggtgagctgggtggttagggatgatttgaaagcttcacggagcatcacctcctccccagaggttggcctcccccatgaggctctggactctccagtgggttcaggactcattttgcaatccctctgggttacatctgtctcatgcccaaggaagagccgaggagtggagccttctgttgttcactggtactcatccatccacactattgagatcaggtcttccccatatgggggaaagtaaacaacagagagaaaacccaagagcttggaccttctttccccccagcagactatgtactgtaattaagaacacagcttggagtcaggcagttctgggtttgaatttggctttatttactgttgatgttatcttgaattagtcacttagcttgacccaacctgttttagcaaaatggagataatctgctcagtacatagagcccttagtgcagagcccagcatatggtaggtgctcagtgcttgcaaatcccaatctctttgttccagagattgatttcggcctccctgacccagtggaggagggcaagggttggcctagagggggacccaaagatccagggaggcatgtccctgatttcattttttcttgagcacctacttagtgccaggccctgtgtggggccttagggtaccagggtgaacaatttggtcctgactccaagctgaaggaaagaggagaccccctgacctaaagtctggaggtggcttggtccagctgggtgcactggccctctgcagactgagagcaagggccttggctgaggtgggatggcacgtaggaagagttgatttaacagtgtctttccctgttgcagaccccccacccaacctgccttactttgtacgacgctctcggatgcacaacatccccgtctacaaggacatcacgcatggcaaccggcagatgactgtgatccggaaagtggaaggggacatctgggtaagtgggtgggtgggtctgggactgggcctgaccctttcagggctgaagggacaggagtctttttaagggaagggactcttggcctgacctgatttgtcatctttccccaggccctgcagaaagacgtggaagattttctgagcccgctgctggggaagacacctgtcacccaggtcaatgaggtgacaggtaccctacggatcaagggctactttgaccaggagcttaaagcctggctcttggagaaaggcttctgaggcccagccgagcagcctgcttgtcagcatgccctgtggatcaagtctagggggcctcaggaggagggaggtgggtgttggagcccctgagacaggggatacagaaactagggctaaaggactttggggtcaggccttgcttgcataaaggagaaaacaactctatgtacatgctgggggagagtgcctaatgtgggagaccaaatagggatcaccaggctaatggggggcgtcagcagctttctctccctcctatcttggcctgttcttttttgttttttgagacggagtctcactctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctgactcgaagtgatccgcccaccttggcctcccaaagcgttgggattataggcatgagccatgtgcctggtccaccttggcctgttttgtttttctttccttgggctcagcaattcaaattctagttgttatttggtggaagcagtagcccaaccccagtttaggggaaggtagcacagggcagagccactgggcactttgtttccttggccctccgaagctcactgttgcaaatacccccaagcctttgctctaggccagatcttgtttggtgcaggtgatggagaacacagatgactcgggcatgggtcttggagatcttctgttcaaagtacagtgctggcactggggcacagagtgcccacgttagccccgggctctgatagagaggtaggaggcacgttcttggtcactgttccattgcagaccagacttgctggcctgaccacaagggagtggctgggaactcacagccagcatagggacatccccctgcagccttctgacctgcaatcaaggctggggaggggtttgcaggcaggaatatgctgacctttcaccctgccatcccatcccaaccccagctcactagccttcatatatgccttatacttggagtcacaggggccaaaggcctgagaccccaccctgcccccaaactggctaagacagctttcagttcctgactccccaacttggtctctgccctgaagcagggcactgaactctgggctgcttctctgtgtgtaaaatgggcacatcttcctaatctgttaatggtcagtggtgtccccaaggatagtgctggcttccatggaaaccctcactcctggagattccattccattttcaagtgtacagccacagcaaggagcccgacactgatttgatcgattctgtgacacaaaccccaccaattgttaatgcaagtttttatttggctgtatatacaatttaagctattaaaatttgtacaatatttacaaattaaataatcatctgaaactgtctccaacaactcttgtaacacaaaaccaaggggaaaagacaggggcaggcaggtcccagctcctgtggtccctccttggcacagagccttttctaaactggaaagaccaggagtctggcactcctgttcctctttcccgggattaagcattcaacttcaaaagacaaaatttaagccaaaagacactagtaaggaagtaattccaattctaaacttcagaagttctgccagttgagaagtggccttccttgggcgctgggattgcagtggtcaggagcaggcgcactggcccttgcctggagtgcggctgggcagtggctgctgggtgagacaggtcagtctcacttgagaagctgcagaggaaaggggcctggggggaggggcggggcagggtccctcagtgctgcccgcctgcacccccactcccaggcattcctttccctgagttgtgtggttgccagtaagacgcagaaatgccacagggcatagggggcacagccaccaccacaagaggcttctggggagatcagggtaagaaaaggaaatgggtaccagtcttaggggtgggccagcgagcaagttcatagcttgcctccagcccctctggagtccacacttgggaacgggagctaatactgttcggcactgcagtgtgactccgcacatacaagtagggcttggaggggcagccccttctcctggaaaggggtgggggaagaagagggcttctcagaggctaaaccttctgccttcatggccccagcagaacacagggctgaagagttggagaggaaggctggaactgacccgagatccccatggctgcctgggactggagtcaaatgggaaccccagcctctttccacttggcctaggggatgccgcctctttctcagagctgggggtactactccctggtgcagacagagagggagctggcacttggtggcaggacatgttccagcgagggctgctcaaaagagcagaggctggggctgggctggggcagtgtcagtgggcaacaggagactccagcttctgcaggcggcgccggcggagctctgctgcatcgggctctccatcctcaggcatctcctctgtgcccactgactcaggagctggggacagagagactggaagtggaacctagagaagttccctgctcccccggctggaggccaatcacacctacctggaggcctttccatttcaggggctggtggggaggctcctggggttggggtcgtggcctctgagctagggatgctggtggaggaggcagcagcaacaactgtagtggcagtctcctcagtggagttgactgaagtggcaggccgggggggcctgggaagagaagggacgagaggcgggcctggccttggcatccaaggttgggcagattctcctgcccttggtgagccttgcagaacagagtatagaatgatgtgcccttgtggccccagtgcctggcaaacacaagtgaacatgctgaatgaactcagacagggtgactggactcaagggccaaatgattctatcccttagctgtaaggtgcttgcaggcagggactgttgacctgttcactcttaccctgcagtctccaccctggggagtcaggcaccttataggggactcactcaataagccacagtgctcgagccttggactcaagttcctctccaagcctgtgctgtcactgctagatgccaggcattatgtacatgtcacttttttaaaagacagcgtctcggctctgtcaccaaagctggaatttagtggcacaatcatagctcactgcaccctcaaattcctaggctcaaacaatcctcctgcctcagccttccaaagtgctgattataggtgtgtatctggcagtacacatcacttatgaatatgaattaagacccctttattcaaataatgagaggtcaaaaatgagtgatgggaccagcgcttgaacttgagccaggatggctccaagtgacttcctattattcgctccctcagtttgggggcagcaattgccaatctaagtgtcaccacatctcagaagaatatcatgtgatgaactaaagcactgcaaattctgaataatttgactttagaaaaatataaaggaataagatctaaagtcagctctcgaataaacatcactcctacttagatccagacatgctttctggagtgggaaataaaggcaccaggagttaccaagaactcctggagacccttggtgggcctgtagataggcagcctgaattggcaggtgtcaaaggccaagaaccactgctggggacctcttggcagctccactcctgacccaccaaacccactctgcttcccctgtacagacacaccccaaggaggccagcacggtgaggtactggttgatctgcagcatggcggcgtccagcagtgtgtggatgttacgcaggctctgcagccgggcctccaggtgctgccgctcatggccctccagagctcgtagctcctctggggtcagcccagcaaagcccgcagggggcacaggcattggggggaaggctggagagagagaggctcagtctgggctgctggggccagacaccaacctcacccccaagaagaacccagagagtggcccagcttaccaaagggtggaggcaggggcatacccatccagggaggagggaaggggaaaccaggggcagggccagcctctggggcagagccagagcctgggccagatgctgtggcagaagcagcagtagcactggtgccagcagctgtggttgtagctgctccactgggccgagaaagggctgctgaagagcaggaacgaagtcagtgagtgttccatccctgccgccccctggctgtcacagtacccaaaggctcacctgcactggtggatggaggagccacagcctctcctgagctggggggaggcgggacaggtggaaaggggcccatggggggccacagtgggaacatgcctggaggaaaaggaggcaggaggccctgggggactgcagagagaagacggaggtaaggaaagggccaaatggacacagacccaactcccaggcagggggcctggctattgagagctctgtcctattcccacaggccctcagcccagcactggtcacactgactgcaagcatctatttctcatcttttaatccctccctggcccagactgagattctggagggcagggactctccaatttcccagcatcttccacatccagcccagggcaagtatccagtggtatgccgggtggccagacaaggggatactcacagttggggggctgaggcaagagtggtggggggtggggggcagggggtggcccctgatccgcaggctccgggggtggtggtgactgcgctggcagcgatgcacgaaggacatccatacggcaggtggggcaggtctgctgccgctggaaccaggagcgcaggcagctgcgggtcaaggccaggcagaggtcagcaggtccctaggggcctgccttctggggcctgtgcctgctgtgcaggctccccagggcccctcccacctggtatggaaaatgtggttgcagggcagtctcttggcaccagtcaccatctcttctcggcagatgatgcagacattgtccattgcctggagctcctctggggtggcatctggatacctggttaggatgacaggggctgtatcaggtccagagctggaagcagagggacccaggaccgagcttgggacagcagccatgacaagcctacttacagggtgttcatgttgcggatggctcggcgagacatgatggcatctgtcacagctttcttgaactgtctgaaaggacagtcagtgaaagcaggagaagggacgggatcaggtcaggaggatcgggggacagggccgggctcacctcatggccaggtacatgggccggatggcaaagagtgggaaggtgtgcaccttgatcatgatggtcatgaaggccatgtacagcagaaccttgatgaagcctgaggggaggggatgcagaaagcagcaggtcacagggccaggaggcagagtggaggatgctggtccagatcaggagaggcccaggcccctctcacctgtaaacagctctgtgtagagcatgtacacagccttgttgtcccaggggttctcactctggaggtccacggagtgcagcacatacttgatgaagatggtgagcaccatcgtcatcaggatggcatactgaagggagagggggacgagggggatgtaaacacatagctcccccttgctgcacccacattgctccccaaggcctctgcacagcaggtgcagtggtacaatcacaggctctagacacacccagggtcctcctagcccctccacttactagctgtgacttttggcaactcagtgaacctcagtttacttatctataaaatgacataattaactgttcctttataacagtattgtcttgctgaataagagatgcaggtcaggagctcagcatagggcctggtgtgaaattcgcactcaacaaatatgagctgttgtcactgaacacattctctctctgccagggacacgcctccagttgtccatggaactaatcctctcctgtccattaccagctagctccggcacgagcctccaggaaccctctcctgagccccaggttggggctcctcctctgtcctagcctctttgtgcgtctccccagtcacctaggagtgagcgtgtggagggcaggagccatatctgatcactgccccttggtggccagcacaggttggccacatagcaggtgctgaggaagggtctgttgggttatt

SEQ ID NO: 1084 - DNA, 118296 bp, Homo sapiens
aaacaaacaaaaaacaaaagaaaagagctatcatgtcccagatcatagacacataattcctctccctcaagtctccagctgtactagtttgctcgggctgccataatgaaggaccacagactggatgattaaacaacagaaatgtattgtagaggccagaagtccaaaatcaatgggtcggcagggttggtttctcctgaggcctctctccttagtttgcagagggctgtctgtcttctccctggttatcacatggtctactctgggtgtgtgtgtgtctgtgtcccaaccccctcttcttataatcctcttcctattggattagggagggcccactcatatgacctctgcagagaccctacctccaaatacaggcacattctgaaggactagggttaggattttaacagacgaatttgcgggggacacagttcagctcctaacactaagcaatcatttggcagtgtgctgtgtgggcgcggtgtggtggtgagaaatggctcgggtcccaggcatgcctgggttgcatcctggccctgccatgggtcctcatgaagctgactggttcctttatgatcctgcctcccttgttgtgagacaggagagcatgtgtctctcacggctgactgtgtaagtaaaatgagaccaaaggcctggcacatgctggggcgaacgacacatggaaattaacatccttagataaaagtgcaagacgggcctccagcagggagctgggagggcagctggcttctgccaaatttcttttttttgttttgttttttttttgagatgcagtctcactctgtcatccaggctggagtgcaatgatgcaatctcggctcactgcaacctccgcctctccagttcaagtgattctcttgcctcagcctcccgagtagctgggaatacaggcacgcgccaacacgccaaaccaattttttgtatttttaatagagacagggtttcactatgttggtcaggctggtctcaaacccctgacctcgtgttctgcctgctttggcctcccaaagtggtgtgagtcacggtgcctggactaaattcttaaccctctttgaggtgtttggtataggaccactccctactgtccacccttcctgtggcggccccacccatctttcagcccctcctctgatcacccctatccccaacctctgctgagctacacccactatttgaacccaacatccttcctctagacctgtacacagcctgctcccttatctgggatgtttgtcaccctccccgaggccacttctcctggtcctgaacctctttaactcctactcatcctatagactgtgaaagtgccagtgttgggtcacctcctccaaaaagccttttttttttttttttttttgagacagaacctcactctgttgcccaagctggagtgcagtggcacgatctcggctcactgcaacctctgcctctcgggttcaagtgatcctcccacctcagcctcctgagtagctaggattacaggcgtgcgccaccatgctcagctaatatttttgtatttttaatagacacggggtttcaccatgttgtccaggctggtgtcaaactcctgacctcaagtgatccacccacctcagcctcccaaagtcctgggattacaggtgtgagccaccgtgcccggccaggaagccttctttgaccacttccttggtgcttcctcagcctccagggattcccccatcaccgcctggcctgaggacatggacatggggttgtcactgcaggaggagtcccatgaagacagtagaccgcattctggaatgcctttgtattagtccattttcataccacgataaagacatacccaagactgtaatttataaaggaaagaggtttaattgactcacagttctgcctgtctggggaggcctcaggaaacttacaaccatggtggaaggcaagagagaagacaggcaccttcttcacaaggctgcaggaaggagaagtgccaagtgaagcgggaagagcccctcccttataaaatcatcagatcttgccgggtgcggtggctcatgcctgtaatcccagcactttgggaggcagaggcaggtggatcacttgaggtcaagagttcgagaccagcctggccaacatggtgaaaccttgtctctactaaaaatacaaaaattagctgggtgtggtggctcgctcctgtaattccagctacttgggaggctgaggcatgagaattgcttgaacccgggaggcagaggctgtagtgagctgagatgcactccactgcactccagcctgggcgacagagcaacactccatctcaaaaaaaataaaataagtaaaaataaaaataaaaaataaaacaaaatgaaataatcagatcttatgagaactcactatcacgagaacagcagcagggatccactcccatgattcaattgcctccacctggtctcttcgtaaatccctgtgggtcacaattcaagatgaggtttgtgtggggacacaaatcctgaccatataagccttgaattgggtgttgtgctgtgtgggaggcatctactagaggcttggcagagcccgtggttctccaaattttatgtgtgtggaataacttgaaatctctaacttgttggcagcccacttaaaagcatggagctcttgttgcatttattgctcatcaagccattgccccgggaccttcccagtgaggaaaaaagcccctagtggaggagggactcagaaatggacccaggagtgactgggcgtggtggctcatgccagtattcccagcactttgggaggccgaggcaggcgaattacctgaggttgggagttcgagaccagcctgaccaacatggtgaaacctgtctctactacaaaaacacaaaattatccgggcatagtggcgcatgcctataatcccagctactcgggaggctgaggcaggagaagcacttgaacccggaaggcggaggttgcggtgaggcgagatcgcgcctttgcactccagcctgggtgacaaaagtgaaactctgtctcaaaaaaaaaaaaaagaaaagaaatggacccaggagtggaggtgtggaggtgggtggaccacagctcccatgctggcagagggcagtatctggaaagccacaccgggtacagggactctgccacctctctaagccagtctcctctgctgtaatatggagagaatggctatctcagcagtggctgtcatgttacacgtggctctgtctcaaaacgcacggcatcgccagctgctaggcattgccctctccattcatgcaccaacaaaaatgtactgagcatcagagatgtgctcaataacccagggcatagcagcaaacggggctgacactgtccctgccttcagggagcccatagactagtgggcagaagaaaaaaaatcaatacattaacaaagaaataaaggaatatgaagggggatatgtgtcataaagaggggggtgggtgtagggtaccaaggtgcagggacttggtcaggatgatgggcaggaaaggctctctgcagaggtggcatcttggctgagacttgaaggacaggaaggagcctggttgagcaaagatgcaaggaaggtgaggctgaggtgcacctggaggggtgggcagagaccagggcagctgctactctcaaaaagctaagagagggagcggacggggcgtagcagcagcaacaccacgtgcaaagaccgatgcagacttgtgttccagaggttgggcagcgtcaaagctgtctgtgtcctaattcagggaaaaacagtccacacatgccaataatgatctttcaaacatttggagggctgtttgttatcaggggagagtgacctgttgttccgctcctctgggatggaaaaaagctggactgtcacagcaggacataatgaatgacttcctgcttggagtagattctttggggtgtgtgtcatcttgcccaggacccagggatcaaagggtggggggcctccctggcccctacatcccctaatggaacttttccaaagacaagtttcattttttgcaaactacaagcaaatttgctgctcatcaagtctcttgactcttacataaagactgaggggagctgggcgaggtggctcacgcctgtaattccagcactttaggaggccgaagcaggtggatcgcctgagatcaggagttcaagaccagcctggccaacatggtgaaaccccctttctactaaaaatacaaaaatttgccgggcgtggtggcgcacacctgtaatcccagctactcaggaggctgaggcaggagaatcgcttgaacctaggaggtggaggttgcggtgagctgagattgcaccgttgcactccagcctggtaggcaagagcgaaactccatctcaaaaaaaaaaaaaagactcaggagaaaaatgatgataatttaatgccagaaacaaccatgtctctcctaatggtggactgtctttggtcaggaaacaagaacagtataatcataatttgatcataatttgaattttgctttggttgccaagaaactcggggtcaggttgaagtgcagtgactatatacgtctctaggtttttggcacaaatattcctccctgactcaactgtttcctgaaacaaaaaacaacaacaaaaatttttcactcgtcaaacacaccatccactttctttcagtttccttttagtctttagccacatgaatacagcttttacgtggtcctcgctccacactcacactcaatttggttttctattttttcacagaatattagttcacaaataccatatttctatttatgtatcctattctgtcttctcaacaatggcacagatattccactgaatcatgaaatattgatagggttgaatccaactgtacataccataaatgggctattgttgaactctgtatttttccctagattttcactgttttaaataattctattacaaaaataaacacttaaaggttatgaagggagccatccaaagagaaatagaaccagctaataagcatatgagaagggttcaacctctctgatgattaaaaacatactttgaaagaagataagagtttcttttccctgtggaaatagctcagattaaacaacgaggtgacacaatgctggctggaagtggagagactcacagctgctgtgtctctctctggattgtgaatttgtcagtttcttggtgcagcacttactcttctaggccattcctgctgggagccgcagaggtacagctgaacctggagcgcacaggtttcacggcagcatcatttctaacgctgcaaagtttaaatgacgaaaatgtcccctaataagagagtgagtggttaagtaaatgtgtatgcgacttctaaacatatccactcactggatatgtaatggagatttctaataagacagggaaatgttacaatgctataatttttattgaaaaacagaacccaagatacaaagggagtcagatgacctccattcaaatagaggcactgccaatctccagttctgagactcctgggtcagagacagggactttattagttgcagtaaaataatagctgcagtttaagcatggtgttcacatgagttccttgtgtcttccaagtcctagggtcggtgtggagtgggcgaggtcaagggcccatcatggatggtggatgcctgcacacacaatgggctgcattacacaggagaacactgagtttggggaatttaccgattttccggtaaacttgtccagagggagatggtacctcctcctttgaggttgctttttgcaaacacgaccctgagacacgggtacagagtgaccagggctttgcatttgtggcatactcagcaagaatgtgcaggaatgcccgtgcccatgatgggttcttctcccagcacctgggtgtggctcacctggactgcaagaatctcaggcctatgatcttccagtgggcctctggaagctggatgtgctgagaactagagaagggggccgagagtcagcctgggttttggggtctgaagcatgcttagaagcatcctggtccatctcctgcattttgcagatagggaaactgaggcccagaaagggacttgcccagagccagacagtgaatgaggagggggtcaggactggtgctcccctgtgtggtcctgaaggcacatcactgtcaccaccagcacagcagctgacagtgattacattacagagttttctctgtggggcttatgtgatgagagtcagcatctccttcaattctcacgaccgtgcaaagtgcaaagtcctaatccttgccccacgtgacagatgaggaaacaaggtaccaagaagtcaaatgctcaatgccacagagccagagagtagcgagcttggattggaacccaggtggtctggcctcagaccctgtcccaggctgtcaggacctctagcttgtcctgggggataggggtccatggtggtgcctacttccctgacacccagtgcctggctttccaagtcaccagccacagggacaagaggatgtggagaggccatggaggacaggcctgggatgaggactagagtgagtgcctaaaaagggggcgccttggctgggcgccacggctcacgcctgtaatcctagcactttgggaggctgaggcaggcggatcacaaggtcaggagttcgagaccagtttgaccaacacagtgaaaccccgtctctactaaaaatacaaaaaattagctgggtttgatggtgtgtgcctgtaatcccagctacccccgagcctgaggcaggacaattgcgtgaacccggcagacagaggttgcagtgagccaagatcgtggcattgcactccagcctgggtgacagtgtgagacttgcctcaaaaaaaaaaaaaaaaaaaaaaaatggtgggggctgtgcctcagaacaggagtaagctcttgaagcttcaggaaaggctgggagaggccaggtttccatgtcctctctcctggctctggcctccctccccagctgttgcaggcttggctcagccctcctcctcccagcagtccctctgcctgcctagggcagtgtcagtgcctagctgaatgtaggagtcacctcctcctactgtccctgtttcctcatccccacccccttctcagccacccacaacacagccactccctccccatccccagaaagggccccggtcacatcgccagcggccacctgctccatccccattgggacttctcagtcctggcttcactgagcactgggccacactgggcagtcccagccagaatcactttttttttgctatcacccaggctggagtgcagtggtacaatcttggctcactgcaacctccgccttcagggttcaagcaactctcctgcctcagtctcccaagtagctgggactacaggcatgcaccacgatgcccagctaatttttgtatttttagtggagatggggtttcatcatattggccaggttggtctcgaacccctgacctcaagtgatccacccacctcggcctcccatagtgttgggattacaggcatgagccaccacgccctgcccagaatcactttttgattccttcttggatattgccttctcctggtttccttctacccctctgcctgtttctacgtcttctttctgaatcccccaggtcccctggttcccccttcgccctccaccaccttcccttagtcatctagactccttccagggcaccccattctccgatggcttaaacgaattaagttaataccaaagtagtaatgagttcccaacctgttccaactcagaaatgcctccctcgggccatctgctgatgtgctgtttccgcaccccaccccatccaaagtcaaaacggaccaggatctctggtgcctccaaacttttgcagagacatcaggaaagctggcaccaccaaggaaacccttcccacctctgctcacctttcactggccagtcgcatgtcacctcttcctgaggggcctccttaacctcagaggcgtgagcatgctggtccccttggtaagctttcctgggctctctgcaaacttcaaacttataagacaccctgtggggagatgagttcttgtccttttgtttttcattttaaaatttaacatgtgaccgggcacggtgactcacgcctgtaatctcagcactttgggaggacaaggcgggtggatcacctgatgtcgggagttcaagaccagcctgaccaacacggagaaaccccgtctctactaaaaatacaaaatttgccaggcgtggtggtgcatgcctgtagtcccagctactcaggaggctgaggcaggagaatcgcttgaacccgggaggtggaggttgcagtgggctgagattgcgccactgcactccagcctgggcaacaaaagcaaaacaccatctcaaaaaaacagaaagaaacaacatgtattcagaaaagggcacgtaccataaatgaacagctcaataaattctcacaaactgagcccaaccttgtaaccaatacccagagtaagaaagctgaacctaaccagcccccgaaagcccagcacgctcccactccaggatcaccactctcctgacctctgaactgttcttgcctttttttttttttttttttttttttgagacggagtctcactccgccgcccaggctggagtgcagtggtgagatctcggctcactgcaacctccgtctcccgggttcaggcgattctcctgcctcagcctcccgagtagctgggactacaggtgtgcaccaccatgcctggctaatttatttttatttttatttttagtagagacagggtttcaccatgttggccaggctggtttcgaactcctgacctcaggcaatccgcccacttcatcctcccaaagtgctgggattacaggtgtgagccaccgccaccggcctgttcttgccttttatgtaaatggaatcatgcagcgagtgttcctttgtggctgactctattactctgacttacgtctgtgagatttacccgttatgtgagttgcggatcattcactcctgttccgtttgtcgtgctcctaagcccgaatactccacgatattcatctgccttgatgacgctaggcttcccaattggaggaattatgaatgtgcggctacatgtctttctgtcttttggagcacatgttgtatgcgtttctgctgagtgtaaggctgggcggggcgtcggtggctcaaggggtccatggtgaactcacaggaacaccgctttgagctgcccagtggcgttcctatgcgtctcatccagttcctccgcatcttcacctgcaccattttattcttcttctttggaaaataaatctacttgtggttccaaagcctaactcatcctcagtaaccccggtagctatgaattcctatacaagaggctcccgcaggcccagcgccaaagctgcctcccctgcagcctcggtgacttcccgggtctctccctccggccctggtgtcccgggtgagcccagcacacgttgggattttggttgtttgttggcctggcccgactgtccctgtctctgagggcagagtcgggtcccatcccgggacacgcctggggttagccaccgacctgcagcctcccggccgagggtgcggggttggcggtaaggcctgccccagtgccccccagcagccgggcctccgactgcaggcccgggtccccgctcctccgcgcggagtcgggcggggataacctttgatcccgagccctcccctcgagagggggtggggggaggaggggatcgggtttcacggagtgttgggggataggactgggggcatccggcccgaaggcgccccctctgtgccccctccggggaagtctgggatccaggccctcgcccccagccgtgggcgcgcgcccctcgcagccggggtccggggagggagggtcccggcagggggcgccggggagggaggaccaggagacccgcggccccgcctccgccgcgccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggaggtaggggcgtcccgggtccgccgccccagcttagggtcccgaccccctcggcctcgcgctccctgcgagtttcggaaccacggggactcggagtccgtgcgttgccctgcgcggcgcccccggactgtcagcgccgaggcctcggcgacgcccccctcccccacggccagctccggtcctcatctcctccccggcctggggacttgtttcaaaaccggattcccccacccctcaaacacaccgtcctaccccagtcctagcaaatccagccggctccgggggccgcatcccgggccctgggggttcaggggcgctagctgggctgggggacgctggctgggggttaccgagcccagggcgccttgcacttgacgctggaagcgccctcggctatctttcctcaccgcttcccgcctccacccccaggtaggagctgttgtacccagcttgcggatgtgaaacttgagcctggagggtgggaagcagtcttttccccaggagacactagcggtcctgggataggggctggagaggaagaaatgagaaagccagggagcagcctggaggtttttggggcgtagctgggaggatggaggggatgcggacctggccacctcctccctgcctccctcccgggacagagggcccaaggcagtggttctgccgggctcggtgctcagcggggactggggactggtcacttccaccaacggcaagggggatggagttttccaagagcagatctgatcgatggcccagaccttaggccccaactctgggactgacagctccgggacagtgcccacccagcccgcgcttttctcccctctaaccctcaaggcctggtccctggggggactgccacgaggtcctctgatcagagcagctgctgggcggcagagctatgacctgtgacctctctgctgacccgtggcttctcagagccactagccaggcccggcactcctggcgtctttgtttctccagtggcccaggtccaggggagtgccctagaccaccctcagaatccgagtcttaatccctggtttagttgagttccttttaacctctggtgaccgcctttgttagtcaaaaggtcgcttgtcccaactaatgctcactgggggattccaggaagggggctgaagggggctggagggggaggggaggctgggagctgagctctacagagctttcttgactggctggctgcagcagagccctgtggagctctgattgttcaggcggtgctgggcacggcctgggcacctcgtggggttggagatggtgtggggaggcgcagagctcagtgttggcaccaggagccttcgcagcccctgggggctccctggaggctctttagaagagatggagcttgatgtaaggggagcgcgggaagagggcattccagcaagcagcaggccgggtggctgccagctggagggaaaaccccgaggggccctgggtgatgggtgggtgggacatccgagactcctgttagaaaaggaaggagcctcagaggccccgattgtgtcgatgaggaagctgagggcctgagagaaggcgtggtaaaactctccctggccccggagtctctgcgttccctctcactgttcttttctgtctgcggtttgcgaacaatttctccctatgtgtgtgtgactgaatgaacaccccaggacttgcgggcccagtgtggctcactgctgagccacagagaagtttgtaattggaagggtttaaaaaagcctcctaattgcacacttcgataaaagcagctggatgtcctgtgggccttttgtttcttttggggagaagtctctttgagtttcaacaggtttaatttggtacagtttgggaaggggcttttgaagactgcctggcccctatctgcagctgtgaggcccccgaagccctgtatgtaaggccacaagtggcaccgcccctgctctcagagagctgtggggccgcagatggtgagcctgttagctgatctgcagaaactcctttggcgacggccgcttaaatggagaagggcgctgatctttcttgccaaacggccgagaggagccgcctgtctgtcctgtgtctgtccgtcccgttgggctttactgagagctgggtgggagggagtggagaggaggaggtgttaggaaaagacgattgtgttttctccaaggctttcttggcctctggctgcagccgggcagcgtttccgactgattaaaagaaagttgggagggagaacaaaggccagggaggacttggcttgaaaacgtgtggtctgtgccgccactcctggaagtttcccagtcaggaggtgggggccagggcactgaatgcatgaagatgagactctgtgccatgggggtcagggctggggcctctcctgcagcacccacagctctggctcacgccccgctcctggccctgctgagtgccccccaactcagggctgcatttgccacccctgttaggtgtgtagggcaggagtaggggcacgcggctgactcatcttcaggtcctggagggctccacgggccttgtgagactagaaatcagtttgcatcagaaaaagccatgagatggtttggtggttttctcatttataaaatgaagggaacaaaaacctacttaggttgtcttgaggattaagagagagaacataggatagtgtctaccatggcagctatattattattattattattttattttatttttgagacggagtttcgctcttgtcgcccaggctggagtgcaatggcatgatctcgactcactgcaacctccgcctcccgagttgaagcgattctcctgcttcagcctccccagcagctgggattgcaggcgcccatcacgcccagctaatttttgtacttttagtagagatggggtttcaccatcttggccaggctagtctcgaactcctgacctcaggtgatccacctacctcggcctcccaaagtgctggaattacaggtgtgagccaccgtgccggctggcagccctgttattaatgttagctattattcctgttgtccccttctctaggaagtgttggcaccaggagccttcgcagcccttgggggctccctggcggctccttggaggagatgaggcttgatgtgaggggagcgcgggaagagcgcaattctgccaataccccagaattgttttccccaagatgcctctgcacattctactactactgaatttcccagccaggcgctgagcagaaggccccatggggctataggactggtagtcgtcagtgccaaacccgtgtcaggaaaggtggtgttcttagccattcagtcattcattcactaagggacagctcagtgccagacactgctctataacttgtggatgtggcaggaaaggagagagacccagtttttccccctcatgcaactaggagatccagaaaaatgaactgagccctactggcagagtcagggaagacttcccggaggaagcggcatgcaaactgggaacctaaggaggaaaaggcagtggctaagtctgtgggtagggctgggaggatgggggaaagggtgttcctggcaggggaaatggcagggccaaatacctggaaggaagagaaaacacgagacttccagggaaaccccctccttctacccacttccagttccttccagttccaccccctcctcaccactgggggagactgtgctgtctagagacttctccagcagcttccctgacctggtgagactttaagcccgggctctgagcactgggcacctggtcagggccgccttccaggtgaagtttattagaacagttctaagagggcatgtagttattttgccagcatattttatacaacaagattttccttttgcagaatagcaaatcataacaatttgatgaatgaatcctttcgtaggccccatatggttccagtttccttgtgatgatctcacatgtggccctataagtaaacagggtgggaggggggaaccactgtgtcaacttccctgggataggagaccccctcaggctggaggggagctcaggactggctaagtcatctgccacaagtcacccagcgaggagcggggctggggctgggcctagagctgggctgggccccacctcctttaaccccacagtggtcctaactagaggctggggtgggagggagcgaggcaccagtcgccatagcttcctacaggttatttgcgggttactacactgtgcggagccaacatgagaagggggttaggaagctgtgtgttggtcccaattctgaaagtgtctggagagatcttgatgacacccacaaactctctgcctctgtttccttcactataagatgtgagtgtcctctgggtaattattataggtgaaatgctttacatttagtaaccaatgtcgtcatctcagcagccctacgaaataggtgatccagtgttgttttgaacctatttttattttttattattatttttgagacggggtctcactctgccggccaggctggagggcagtagtgtgatctcggctcactgtaacctccacctcctgtattcaaaccattctcctgcctcagtctcctgagtagctgcgactacaggcatgcgccaccacacctggctaatttttgtatttttagtagagatgtagtttcaccatgttggccagactggtcttgaactcctgacctcaagtgatccacctgtctcggcctcccaaagtgttgggattacaggcgtgagccactgcgcctggccctgtttttcattttggatcctgttacccactggagtgaaaaggtcctgtgagttttgctacctaggtatgaagcccggcttcttgttttggcctagaactcctctatggacctgcacagtgccatttctgagagtcactgatgcgtgtgataggttgaggatggaaatccaacacctgtgcacccagcatggtctccccacagcacggggactcgagcaccttcctgccccacccctgccccagttcacctgtgttacctagctataccctcaccctagccctgcaaaggaggtgctgtcattgtccccctcatcaatgaggggacatggaggcccagagagtccaggtagcaagactgtgggtgcatagctgctaagtgacagcagcaggacttgagcttgggcagcttggccctgacgtcatacccctcaccagcacactggacagcctcgcgtatctttttttttgagacggagtcttgcactgtctggggtgtgatcttggctcactgcaacctctgcctcccaggttcaagcaatcctcctgcctcagcctcccaagtagctgggattacaggtgcccgccaccacgcctggctaattttttgtattcttagtagagacggggtttcactatgttggccagagtggtctctaactcctgacctcgtgatctgctcaccttggcctcccaaagtgctggaattacaggcgtgagccaccgcgcccagccagcctcacgcacctttagaagacttgaatctttaagtctagttcagggggggatgcctgtttcctttggagtgtgatggtggggtgtgtatgagctttacagtcagagctggatctgaagcctgcctctgcagaggctgcatggcctcgggcaacttggtgattctctctttgcccccactttatagaatacctaggatcatgtgagatcatttgtgcgttcattcattcacggacatttattgaatgactgcttagggcaggcatgggggcaggaggcagaatgagacagtgtctggctcagactcatggcactaagtacagagttaattatttgtgctaagtgctgggaagctcagagtacaaagagaccatgcaagaaagaaaacatatttgtcccatgtgcatgcgtgtatatgtgcatatgtgtgtgcattggcggtagttagggaggacttcctggaggaagggacctttgagctggtgtggcatgaacaagctggcctgaggagagcaagcgtcctgggaccctccagcctttgaagctccaggttccaaatgccaggtgcagaggatgcatgacaggtggccagaggggtgagaggaacaccaggggagatgcgtcctggaagcccaggaggcccttggagcagggtgggatgttgcagaaggatgaggatgcccctctgtgcactgggctgatgtaggaagttgctgccggggccagagctgcctggagggaactgtggggagaatgcttctcgccttcccagagaggtaccttctgctccttctctcttgctgcctcctcccggctggttcaccatccaagacccctgtcatctccatgacagatgctgggaacaggctcagcagtggacacagtcaggtcttgtgttggggatggggccaggagccctaagagcaggctccagttcgccctgcttcctcctgcagaggccaggtggtcttgaagaggggacacgagtctgtcctcatcctggaactgtaagggatgcagggacataggccaatctggctggacccctggtggcttcccagacaacatagtaaaactccgtctctactaaaaatacaaaaaattagccaggcgtggtggtaggcgcctgtaatcccagctactcaggaggggcagggtgcaggtgggggttgggtggagtcgcccagtcctgtttggttggaactttccatcagggtctctgtggttgacatcttgttgcatttcaggcttttcggttccttggttctggacaccacggaggccactccaactctttgctgtagctttagacaatgctgtggggcaggtggggtgggggcatgatccttttgtgtggtgagtccgggaggcacacaggatgaagcctcaagctcccattcacttttaaaaactcctgacgccctcagctgcctctgagtttttgagcttgagcagaggaaatcaaggaaattgaggctggcttctgatcacatgcctttacttcatccccagctattcacggagctttgccaacttaaaatatcctcatttgcccgatgaggatattaaaataaaaaacagacacccattcaaccaccatctcatatcgtcaccacttcacagaggtaggggacattttaatgccccggattttggaaggacgcggtctcacaataaaagacagtattgtagatggaatcgggccggctttgtagaggtccctggatcctgctttgctttcaccctattttgttgcaacccagtggaaattttgccagagcaatgcccttacacagggtgggattggggaagcctgctcttaactgcaggccaaatcctccattcagtttataaatgaaaaaactgaggcccggacttgctccgggtgggaaaactctcaaccatgagatcagaagcagactccaggcctcccggttcccagcccccagtctcccctctgtgacagtctgcttgctcagcaacctgggaattaagatcctcgtggctcacaggctgctggggatgggatcaggcattgcccaaagcttctgcgatgtttacagctagcaggctgacattctggaagcttccacccaaggagtggtacagaatctctctgagcatctgtagtcttagaaagagcacgtggccatatccttcctgggtgtccagggcatggtccccgcaggccatgtgacctgtgtttctctgcatgccttggaacatggggcatgccgctgatctacaccataatctttatggaggtttaactcacctggaaaaaatttagttttagcagctgtcccaggcaacaaacggtatctgaggcctgtgaactgagccagctccatccatctgcaccagttactccggcaggcatgtgtctctcctgaagagaggtggtggatgtggtggcgtgttggccatcgggcaccgtgtcagcctggaggagtgtgtggttcctttgaaaaagaatgttctcccaatcctggtgtgataacttttccttttgtttaattttgaagcttctgttttttcctgtggtcagtgtgctaatgtaagcacttttcctggattatctcatcaatcttcccccattttttttttttttgagacagagtttcgctcttgttgcccaggctagagtgcaatggcatgatctcagctcactgcaacctctgcctcctgggttcaagtgattctcctgcctcagcctcccgagtagctgggattacaggcatacgtcaccatgcctggttaattttgtatttttagtagagacgggctttctccatgttggtcaggctggtctcaaactcccaacctcaggtgatccacctgcctcggcctctcaaagtgctgggattacaggcatgagccaccatgcctggctttttttttttttttagacagtctcactctgtcacccaggatggagtacagtggcacgatcttggctcactgcaacctctgcctcccgggttcaagtgattctctcacctcagcctcctgagtagctgggatttcaggtgcccgccaccatgcccagctaatttttgtatttttagtggagactgggttttaccatgttggccaggctggtctcgaactcctggactgaagtgatgtctgcccacttcagcctcccaaagtgctgagattacacccatgagccactgctcccggcctcttcccccatttttacagatgaaggaagtgagcctccttgagtcttagtaagggagggagctggattcaaggctgagcagttttaacccgcagcgttgccttccctgggaacattcgagttgaaggttaacgagattttgcaagagtttgctcttggtttatatctaatattatgctttggatctaactcacatggtcagatgcaggggtcagattgagactggttgattgaaactcctccgaaacaacaggaaatgatctgggagagaagattccaggtcccctgaggccctgcttctctcttgatcccccacagcccagtgtcgagttaccagcgagtgcctgttctgcttgggtgggtgtccagtgtggtactggtcagaggtaatttttggatctcagagctgctcacagctgttggcggtctgggatggaagaagcaggcgtggcttcggttggcccacattatcctcctgactcacagtgttccagggctgctcagctgccctagggtttgtgtacaaatggccttgatttgacacccttctgaaggtggggggcctgactgatcaggcagttggttggatgctgttgacccccgcagaactcttggtacctatgaggcgtggagttggcgtgggggatctgttagccccagtcccctttttgcccccaccccagcctggccgagagtcctgggcaggcactgagaaggcaacacatggggtaggacttgatgagcaggtggataggacagtgaggtgggaggtgcctctgtgggcctcagatggtccccagcctgtgtgatggggcagcgaagctcaggacacctggtgtttggatatccacaggtgaccggatccccaggcaaatgagcagctggaagtccctgcagggatgcgggaggcacagccagggtggggctggaccccaggcccttccccactcccatcgccccaccctcacaggacacacgggggagctgtgatcctcagggtgttcttttgtttttagtttttttgttttgagacagggtctccccctgtcccccaggctggagtgtagtggtgcagtcgtggcccactgcaagcttgaactcctgggctcaagcgatcctcccacctctgccttccaaagtgctaggatcataggcttgagccaccatgcctggcctttttgttgttgttgttcttttgttgttgttaagtcatctttattttggttgcaaagttgcaatctattttttactgaacattttaagtctcatttgaagtttcatagcttgccgtgtaaaccattgcatacactgtcaaactgctgtacagaacattctgaaatacaatctactaaattaattcgcttgacactgttcagattactgcatgaaaacaacattgattgaagaaggcaagtaagtcaacgggcaaagcatcgattgctttcctactgtaggatgttataagatgaccaacaaacactaaattattttgcttaaaagatgtactttttattgtggtaaaatacgcatcacatgggatttgccattttaaccatttcctttttttttttttttgagatgtagtctcactctgtcacccaggctggaatgcagtggcataatccctgctcactacaacctttacctcccaggttctagtgattctcctgcctctcagcctcctgagtagctgggattgcaagctcaccccaccaaacccggctaattgtagctgggattacaggcgtgagccactgcgcccggcccattttaaccatttctaagtgtatggtccaatggtattaaatacagtcacattattgtacaatcatcaccacctccatctccagaacttttcatattcccaaactgttaaatactaactccccgtcctctcccccgaagcctgtggcacccacccatccttttccttcctgtctctgacaaattccctacaaatttaactcctctagggacctcataggtactcttatcctgggtcaccatacgtgccttactggcctttcttttcataaccagagtaaagcttgtttattttattttgagacggagtcttgctctgtcgcccaggctggagtgcagtggcgtgatcttggctcactgcaacctctgcctcccaggttcaagcgattcttctgcctcagcctcctgagtagctgggattacaggcatgcaccacacgcctggctaatttttgtatttttagtagagacggggtttcaccatgttggtcaggctggtctcgaactcctgacctcatgatccgcccacctcgacctgctgggattacaggcgtgagccaccgtacctggccaagcttgtttatttaaaaggggacagagacaactttttttcgtttctaatcggaatgtgtcttggaaaggatatgtctgaggggtgggagtggagttggttttgtgcttcagggaacctgttcctgccctgtcccaaggtaagcttgtaaagaggtcggtgcccttgttttggaacccaagttaatgacgcaccttttcttgtgtgggctacacacatctttaacctgctgcagatagtacttttgttggcatctggagccatgatgccaggcccctcttctccctgaagctcagttttcctctaatgggtgggaggtaaccagtgctgagtccactaggaagatcgaggcacatctccaaggctaagaaaccggcagttctgtagcctcagccactcccccacccctagctcatccctggcttttgccgaaattctaaccagccccgtattttgtgtgggtgggctccagcccctcgggattttcctgggggtcactgcctccaccccctgggacgatggaggaggaggaggcttgtttgtgggggcagaggatcttgccccagcagcctttgcatgtcaagagtggtcttgcagatcgggccccttgccctggctctgtttaactggtgcttactgagccgtgacgtttgtgctgggcatgggcaggtgcgacatggacagtgagaggaggaagacaccatccctggccccgaaggaggttttaattcaggaggagcaagaaagaacagtgttggaggctgccaggactgagcctgatgccagaactcagggcccaggagccgtgggtgagagcagtgggcaggagggcgtgggggcctccagtgtccactgagccctgtgaggagctggtcacacactggtttgctgtgggagcagggacaccttaacatgtatgttcatgtcactggtgacttgacgcttttcagcttcctctgttcttaattccatttggagcccaggcaggatgatagcagaatgaatggaaggggttgaggagtgagagccggtgaatgagaggggccttgtctgtaggcctttgtgggtcagggcccggcaattgattggtgagtgttacagtgaggatgatcgtccacctcttgggtcccctccccatgcctctgcctcgtcgccatccagcctggccatggtccctgcttggctctttgtggactccctgatggggctgtgcaggagctctcccttggctaatgacggggtgagctcagctcccctcgggcacagcccccagacagccctgctttgcagagttcagctctggggctgctcagaacatgggagctaccttctgagtttccggaagaccaaaggacttcacatttgattgtcctgctgagagtgaggttcacagtacccagactccccagcaggaagcatttccaaaccgtttctgcagctctgggtgcaaaattcccagggctacgggagcctgcccttccctgtgttttcctttctcagagtccgaaggaggctctggggccacagctcacctgcgggggattccgcacaccagcacccggctgtgtctcccccatttcttatgagcagcgataagtcaatccccttcgacggtttaatcctccagcgactgtttacagagaactttctgtgtgcttggaactttataaagtgcatccctcttctcagcaaccctgggaagacagtgcaagccccgttttcccactggggaagctgtgattcagagaggcggcgctgcctgcccagggttagagagcaagaaagtgctggagctgggattggaaccaaaggctgtttggctccaaagcttacactgtttctactcaactctgtagctgccacatgctggcatggatgtcgggggtatacaaggacaggagacagagcctgccctcaagacatttgtggctatgagggtaaggcaggcaggcagggctctggaggatggagagacatgcgccaggcacggggtgatatgggagcagaggggcacccgagctatgcagggtgggcaggcaggcggccaggagagggtgacagggcatgggaggtgggctaggataggagacgggctgtggaagacacgagggtgaaactgcaggtgggggctgagtgggcctggccagagaaggggtgaagggagtgtggggacagacatgggaaccggggttggctgcagaaagggtgaagggggtagggggacagatgggaactgggcttggctgcacaggggagagcagcctcgctgtcaggccacatggctggatcacatcctgttcatccaggagtgcaccacggcctgtctcgtctgtaacagataaggtccttggcttagtgagtacttttgcttttcttaatgaattagagcaagaatgaatgaatgagtgaatggggacattcaaggttatccccatgataacacggttgtcactcctgatgacttttcctctggtgctgggaggcaactccagacaacttgacattagctctgcctcctggtgaatctcacgttcaccgaagagcatcgctggagaggggacacctgaggtgggaggggggctgagtggtcaggctgctggaaactgttgggctttgctgtggcacgaaacttcacccttacccacgccactgcaggactcctcctgccagcctcggggagccgggtgagagtcagaagggtgggtctaccttgcactgcagaaagcagctctgagtttcctggaagccctggggaaaagggaaagcccagaagttgtcactgggggacatggttctaggtgagacccccctcctcctggccttgtggaatggcctggctgagccctagctcattcgtgcactgaccttatccattctggaatgtttctgcaagtttcccctcctcccctgctgagaacgggatggagcatctgaaggacgcatagtctagaagtgcttacagtggctgatgactgatagggtggtttagcaaggtgctgcctcacccagcagacagcagccgccctctgggccaccccgagggcccagcctggaagaagaatgtattcaggcagggcacccacagttgtgtgtgcggaaacgctgccaagcccagtgggatttaccctctaggggctggaaagccattaggaaggaaaagtggtgcttcttaaagcccagttttgtaacatcctgccgagaggtgaccttctgcccagcagctggggctgtcgtgctaatgctttctggcatttgagtcctttagaatgaggtccaagtatgtgggcacctggcacccggccgctcctcccttggggcacaatggggtcttctcccttccgtgagctgaggggctgggagggtgcccactggggctgtagcctgggctggggcatggggcacaagggcctgtgtgcccagctcatttgggccgtggcctggctctgagggtgtgggccggctgcttggagcgtgatcctttcatctgccctttttgcgagtgggagataagatggccaggctgcggttactcctgaacctgtgctctctgctttgccagtcctgtcctcaccagacttctcacaggtccccgtttctgtggaagaggggatcttgtggtaagtcaagggcagaaaccatcaccagcctcggtttcctcaatctgtagcttgaggcttatgtcccccctcctgcccctttgctcccaagattaaaggagaaaacacggatgtgggtcacagaagctggtctagaaatggtggtttttaggctgggtgcggtggcttatgcctgtaatcccagcactttgggaggccatggctggccaatcacgcaagttcaggagttccagaccagcctagccaacatggtgaaaccccatctctactaaaaatacaaaaaagtagccgggcgtagtggtgggcacctgtaatcccagctactcaggaggctgaggcaggagaatcactcgaacctgggaggtggaggttgcagtgagctcagatcgcgccattgcactccagcctgggcgacagagactctgtctcaaaaaaaaaaaaaaagaaaaaaaaagaaaatttttttttccttcttacttgactcagctcgttgcattttgaaccccctccctgtttgcagtctctcctctggaaagagtcatgtcggctgttccctgacctgctgggctgggctggccggcagcatggccgtgcctctgtcatcaggggctgtctttcttgcctactggactgtgaaggcagggaccctgtctggacagggaccgcatcagcatctccagcatgtggctggagcagggatccatgtgtgcttggatctcaggggctgagccgcagccctgtccaagctggattcagatgggggaggattcaggtctttcttctaggaaggagtggggtgtggactcgcagctggggtctggtggggttttcagtactggtttgcagagtgactaagggatgtgcccccagcctgatgctgtcgtcaagacagaaggacgtgcgtgtcctggtggtgcatctgggagggccctccacccgctgagtggtgagccacctctcagcttgttctcttccctgcacagtggacgcggatgtcctcctggaggcctgctgtgcggacggacaccggatggccactcatcagaaggactgctcgctgccatatgctacggaatccaaagaatgcaggtacgtttgccagtggccactgtttcactggaacaatgttcctttagagaaaagtgggggaggaagggacagtgtgtgccagacctctcgggagaggctggacacccaggcccggatccatccaggctgcgggtgctgcagtgggtgactcctgcctccctcctggcaccggcctggcaccgggccttggctcacccttcctgtgccactctgtgattgtcggggtatgtgtctctttcactgggctgggagcaagaagatctgggcttgcagctgtgggcaagtcagttttctcttttaaaaaaggggggacagttgtgggggagcaaaggagatgatgtgactaaagagctttgcgagtggaaacacggaccacctacagaccccaaaaatgccaatgagccggcgcagagtgaagcgttccaccagccggtttttcagcttctgcagcagccaacatctggatcgaccgtttttattcttctctccctacattgactccagctctctgaaaattctgagaccgtgtaagcttagaataaataatgagaagccgggcgcggtggctcacgcctgtaatcccagcactttgggaggccgaggtgggtggatcacctgagatcaggagttcgagaccagcctggccaacatggtgaaaccccgtctctactaaaaatacaaaaaaaattagctgggcgtggtggcatgcgcctgtaatcccagctacttgggaggctgaggccagagaattgcttgaacctgggaggcggaggctgcagtgagctgagatcgcgccactgcatttcagtctgggcaacaacagcgaaactctaactcaaaaaaaaaaaaaaaaaggaataaatgatgagattaggtcatgctgatcatcatcataaaaataatagtgaaaaccccagaatgcccgtgtggagcacctactttctgtgtaccgtctgcacggacagcagccagtctggccccgggaaggacaagggctggggaggtggaccaacctggttgggtttcaggctgggtgacctgagccagctcaaaggcaccatgatacctcctttctggggttgttataatgatcagagatcacccgggcgcggtggctcacccctgtaatcccagcactttgggagaccaaggcgggtggatcacctgatgtcaggagttccagaccagcctgaccaacgtggtgaaaccccgtctctactaaaaatataaaaattagctggttgtggtggcgggcgtctgtaatcccagctactcgggaggctgagacaagagaatcgcttgaacccgggaagcggaggttgcagtgagctgagaccgttcattgtactccagcctaggtgacagagtgagactccgtgcccccaccatcaaaagaaaaaaatcagagatcacctatgaaatcagcaccacaaagccagactgtggcaacgtattggttttctaggactgccagagcagagtataaggggcagggtggctcaaccaccggttcctcatagttccggaggccagaagtctgagaccgaggtgtcagcagggtgggctccttctgaggctcctctcctgggcctgtagatgccctcttctccctgtgtcctcacacggccctccctctgtatgtgtctgtgtcctgctcaccgcttcctcgaaggacaccagtcctttggattacagcctgccctaacaacctcatttaactatgtcacccatttaaagtcactgtctccaaatagagtcccattctgagatactgggggttaggacttcaccagatagattttgggaagacacaatttagcccataatagggagccactactattaatacttagtgaaataaaagaaagtgaggcatcagcccgtgtaacccctcaacgtgcaggcagaggaactgaggccgcagattcagcagcactctgggccttgcttgtgaatggggattttagtcactatcaaatgtattactgacttctactcactaatgtctttggtaaattttggagttatcttttttctttattttttgaaactgagtcttgctctgttgcccaggctggggtgcagtatgttgatcttggctcactgcaacctccgcctcctagattcaggcgattctcctgcctcagcctctcgagtacctgagattacaggcacacactaccacaccaggctaatttttgtatttttagtagagacagagtttcaccgtgttggccaggctggtctcgaactcctgacctcaggtgatcctcctgccttggcctcctaaagtgctgggattatgggcatgagccactgcgcccggccaattttggggttatctttaatctccattgagtcccagaggacaaacacattgccttcttagaaatttcagacatacattagatttcctggaatgtaagaaataccatcagaatggctgagagggcattccttctctctttaagtgcgggtgcaagtccagactcctgggtatcgtgagtttccatatgacagtgtccctgaaacacgtggctcaatgcccaggacaccactccagggtcaccagatgcaagtgactggcccattgtgtcacttaggccccaggaggcccattgactcatcccagtggacacacaggccaggggccacatacctgtcctaggctgcctctcaagtgagctactgagctgcccagctctgcctgcgtcactgccctgtggccccaggtgctgtccgctgccctccagcccttcctgtgtgcttcccctttaccctgttctcactggggtccaaaccccacgcagcctgtgccaatcagaggccaagcctgggctccaggtcacagtgagacggagcccacataagggttcaggaggcagtcactgatgtggctgtgggggtcctcgggtgagcaggaccccgccccagcctccccaacctggggaggtcagagctcctgtctggttgaggcaagggctgtggatgcggggtgtggccagcagtgcagtgatgctaatgaagggattttctaatgagttttgtatagattttcatttttaatgaaggcagggaagggatagggcagatcagaaatcaaatcttatttacaagaatcctcttaatagtgatatttaaaagatgcaaaaaacagggatcactgaccacctggtttgtctgttgtgttagccagctctttttttttttctttttgagatggagtctggccctgtcgcccaggctggagtgcaatggcgcaatctcagcttgctgcaacctccgcttcctgggttcaagcgattctcctgcctcagcctcctgagtagctaggagtacaggtgcctgtcaccatgcgtggctaattttggtatttttagtagagacgggagtttcaccatgttggccaggctggtctcgaactcctggcttcaagtgattggacgcctcagcctcccaacatgctgagattacaggcatgagccactgcacccagccaaattctcttcttttgaagtggctttctgtgaggctcaccagctgaagtaaaatcagtttttgttcattcaacaaatctttattggttcttgatgctcaggaagaggcaggatgaaagccatgagcaggcaggcaagcccaggccagccctcctggcagcagtcgagggtgtgaggccctgagggtccatagggcccaaaggagggggtatcagctccctgagtgggtgagaggctcagagaggactgcagggagaggccgacctctccgcaaccatgggctgtagccaagcaggggttaagcagcctgcagcttcaacaaggacgtgtttggggtggtcagaagatggcagctttgatgttttcccatcatgaatcatcttgactctaggtctccaccaaggcccgacattccttgggatccagatctaaatccacctaaaactttggattagattaaacccacatgtccttcagcgtcttttggaggaatctggacacatccagtgaaacctaaagcaagtcccaagctgacattttccagcccagcatttctctaaccccttctttattttgcaaatctcactgagagcctgctaggtgccaggctccgttctggtgagtggggatcaatcggtgaacgaaatatgcaagtcccctggcctcgtggaggcggcattctataggggatgcagaatgcaaagaaagtaataagtccgtctgatggtttgtaggaaggcaggatgtgccgtgggggaaacagggaggcataggggcttctgctcatggtgggtttataattttagagccgtggggttggcctcactgtgccaggacctgaatggggcgtgggcagtatggaaagtgggaagagcatcccaggccgagggaacagccagcgcaagagcccagaggagagggtgtgtacagcaaggcggccagggtggctggagtggagccagcaacggccagtcccagggaggaagcaccagatacaagggtaaccaggtggctgagggggccatgagatagaggctggggtgttgggggtgagcctgaggcagctggacaccctgaggtgcctgggacacttgattgcttccaccttttggatgttgtaaataatattgctgtgaggccgggcgcagtggctcacgcctataatcccaccacttcgggaggctgaggcgggcagatcacttgaggtcaggcgtttgagaccatcctggccaacatggcaagatctcatctctactaaaaatataaaaaattagctgggcatggtggcaggtgcctgtaatcccagctgccggtgaggctgaggcaggagaatcacttgaacccaggaagcggaggttgcagtgagccctgatcgcaacattgcactccagcctgggcgacagagcaagactccatctcaaaaacaaaacaaaacaaaacaaaaaacaacaacaaactgctgtgaacatgggtgtgcaagtatctgtttgaaaccatgcttcagttctttggatatttacccagaagtggaattgctgggtcctatgattattctatttttaattttgggaggaactgtgctccacggcagctgcacccttttccattcccaccagcaatgcacacgggttccagcatctccacatcctcaccaacacttgtgattttctggctagccaatagtttttgaatggatgcacgcatggctggtggctcgctctggcagtttagtgaaacgccgttatttgcaaatccaccgaaagcatgagtgaaatgtgtgctagctcagctcggtaattccatcctggagcctgaaggcagttttgagacacacgggcagccgggttcagacctccagtcccccagggaaggttgggggaaggtgcactggcagctgccatttttgtgcagaggtggcctggctggcagtgcagggaagctggggaggcccccaccctctctcctggaggcacgagttgggtggctcttcctgcccttgctggctttggctggagctggggttattttgggtctggtcaggggccacccgtgacacactcctctcctgctcattgcctttggagcccgcccacgccagcccctagctgtcacagcctcatggttgtgttggaggagctgattttggcaggtcgaggacctctccccagagccccggcagggctgggaggtgtgggctttgcagctaggtgccactgcagccaccatccctccctctggggccttgggcaggctacccaacaggactctcagaagctgtttgctctgagcctggaagatggaacgagcactgagaagagcttgacctgataaaggggtggaaggttgggcccagagtcagccccccgccgctttttggttttcaaatcagcaggaacattgtgcgggtgaagcctagtgctcagaggagtgacgcggccactctggtgacaaaactgggcctcctggctctgactccagacaccatactacattctgtctttctttttttaaaaaaagaggccaggcatggtagctcacgcctgtaatcccagcacttcgggaggctgaggcggggggatcacccgagctcaggagttccagaccagcctggccaacacagtgaaaccccgtctctacaaaaatagaaaagttagccaggtgtggtggcgcatgcctgtagtcccagctactggggaggctgaggcaggagaatcgcttgaacccgagacgcagaggctgcagtgagctgagatcacactactacactccagcctaactccatctcaaagaaagaaagaaagagagaaagagagaaagggaaagagagagagagagagaaagaaaaacagagagaaagaaagaaagaggaagagaaggaaagagagaaagggagaaagagagagagagagagaaagagagaaagaaagaaagagagaaaaagaaaagaaaagaaagaaagagggtcttaccatgttgcccagactggtctcgaattcctgggctcaactggtcttcccacctcatcctctcaatgtgctggcattactggtgtgaaccactgtgcccggccaagcctttctaactaaatgctaattgagctccttctgtatgccactggggcactgtgtatttctctctctgtgtctgtgggagcagggaaggggaggctcaaaggtgagagcacccccacccccgaggatctcgtgccctgggccccctgcgcacagagccttggcccagcccacccctcacccacaggatggtgcaggagcagtgctgccacagccagctggaggagctgcactgtgccacgggcatcagcctggccaacgagcaggaccgctgtgccacgccccacggtgacaacgccagcctggaggccacatttgtgaaggtgagagccaaagaccatgtggggtcgctgcccgtccccactagtcggcagacccaggccctcccagccaagcggcactgtctgtcagcgctccctgcctcaggccacctttctttgtgagcagctgggggttcctgggccaggagggaggtggaaaaccccactgtttctccccctccactgtagccgtaaaccccggaggacacctggggccgagtctcccacgaggccggggggtgaagtgagctggccttgccctgagaaccgcctgtctccaggcattgggcagatgcagaagtcaaagcagggctcctcctgggcttccagaatcttcttctcaattcagggtcggcaccctcaccctacccaggaggctctcaggcttctctacccacagactcgtcagggtccagaggtaaaaatgggccctcactaagacctctgataagatctgacctctataacgaccctaaaagaggaaactgaggttcagagaggcccagcctccaaaatggcctctctgcagtcctgtcagggacccagacgggatcctgccctgaaggtaagctgtgaataaatggcatagtcctcttccctgagtgctcctaggaccctacgtgctagcaggtcactcaggaccgctatggccgtggaagggctgtgtctttgcaagaggtggaaaggtgcctgacagcattgcctacaggcagtaaacccaaggtgtccaggccatccctcccttaccacccagccagcaaggaaaacaagcccggccaggaggaacttgggcctggaggagctcgggtttggaagctgggcttctgttggaggtgccagatgacgaaaatgcattccctggaagaagcttcccgttccttttaggaaggtgatggaataattttaagaaacaagaatctgaatgaagtctggattccaggagagggtgtgggagctcctttgtggggattctccacatagattgggctgtggagggactccgtgtggaggagttgggggtcccgagtcccctgcccaccttggcctgtgtgggctttcacagggcagggctctggcccaggagagagctgggtggggtgatggtgggggtgcctgggaaccaggactttgggcgtttcatgactgcccccgcaccctcccacccaacacccaatgcagggctgggccttgcagatgccgtcggtccggcacacagctgtgcccatgtccccagacttgagaggtgtggaaaaagcacagaacattctagcaggagtgggaacagatctctctggcagatgagcgacttgtgtttccaggaaggattactcacaccccaaaagatggatgaggtgactgatgctccctacactttctggcagcggagggcgtagaataagcagcctggaagacccatcagtgccacataactgaggcaaagctacacctcctggctcctgctggggactgtttagaaagttctgtgctcctcttaggataaccacttaataaagactgaagcagggcttttcgtgtgtcagggcaaatgttgcttctgggactcaggtgtgaggccacagggacttggaagtaactattgggacctgggcccaggtggcagacagccaccctgtcctttgaccttgcttgatgactcgtcttgaagttcctgtgctttcaaatgcacggtgcaattcctgctgccagaacccctctaactcaaaaacggagaggcagcatgcatgtgtgtcatttttccgggcatggtagagaaatctcagaccatgcaaaaggaacagaactttggagctggtgcatggtgctataagaagctccctcttcctggatgtgtgcgagcagagccgggtggtctctgggcggggcagggatgttgaggggtgcaattgcatgttggggtggggaggggaggtggatgccaggccctttaagcttcctttcaaaactgggacctagatgatttggagtagggggatggccttgctttgctatttgttgctgacatttagaagtggtatctaagccagacttgagtcatcactctacaggttgtgtggacagggggctcagagaggcctcccctgaggcctctcgtggaccccgctgggctgtctgcccgctcctccatctgggatctccacctgtgtttgcagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacgggtaactttcccccttccttccctaatgagcagtgtattaaggttctccgggatgtgtatatagagcgagagtggagagagagagattttaaggacttggctcatgtgatcgtggggctggcaagtccaaaatctgcagggcaggccttcaggctggagccccagggaaggaggggcattgcagctggagttcaaaggcagtgtgctggcagaacgccgcctttcccggggaggccagtcttttttctctgaaggccttctgctgattgagtgaggcccacccatggtatgaagatgatctgcttttctcagcatcaacagacttacatgttaatctctttttttttttgagacagaatctctctctgtcacccaggctggagtgcagtgcagtggtgtgatcttggctcacggcaacctccgcctcccgggttcaagtgattcttgtgcctcagcctcccgagtagctgggattacaggtgtacactaccacacctggctaatttttgtatttttagtagggatggggtttcaccatgttggccaggctgatctggaactcctgacctcaggtaatccacctgcctcagcttcccaaagtgctaggattacaggtgtgagccatcgtgcctggccaatattaatctctaaaatatagcttcacagcaacatccaggctagtgtttgactaaatatttgagtaccataccccagcccaattgacacttacgatgaaccattacaggtaacacgtgcatccgtgtcaccattgccttaactcagcacggactaactccggttgtcggagccattcatgtttgtgaccttatctgaaagccgctgtcctggagtgacgctgagtgcttggagtctgggatcggacaaatctgtgctcccatccgggtcctaatgtgtaccttggtcccctcatctgggaagtggggatagttgcagtcctacttcatcaggtgctgggaggatggagtgcgagattgggtgtcaagggttgggtagagcacctggccccataaatgtctgccctcaccatctgcccttgtcccttcagctgcccggggcagcatgggtggctggccttgctcccacttcttgggtgagggtctgatgctgaagatcgcacagccgacacgtggaggagggagagcctggccttccacctcctggccagtgccctctccatctggagctgacgatgtatgggcgagcagctgggggccatcgctggctaatagctggctatgctctgtcaaatcatagacacttactcagcaaaggggcatgtgaccccaagagcagcttcaagagcgctctcagctgtgtgcccccccgttctgtgtcctcgccctgcatttctgtgtggttcagttacagggttcaggagactttgtggctgtccagtagcctcttacacttaggccacggtttcttgtgctgtaacagaattaacctggaagaaggcaggactccgcctgggccaagcttgctgtgtagttttcggcctgttccctcctctctctgagctttgcccccactctcttaaaaaataaaagaggtgtgagctgggcacggtggctcacgcctgtaatcccagcactttgggaggccgaggcaggcggatcacctgaggtcaggagttcgagactagcctggccaacatggggaaaccctgtctctactaaaaatacaaaaattagctgggcgtggtggcgggcgcctgtaatcccagctacttgggaggctgaggcagggagaatcgcttgaacctgggaggcggaggttgcagtgagccgagatggcgccattgcattccagcctgggtgacagaacgagactcagtctcaaaaaaaataataaaataaataaagaggtggggaggtgccggaaggggcgaaagggaagaaccctcagacctgtagtctctaagtcaaggtaatggctgtagggtcctgggtgacacggaacctttcacttcttgttcttaggttttcaagtccaggctgtagggcccctggtcacagaggacccgggtcacccgggactcatctttcacttattgttcttagtttttcaagtccagggccccatggatgccactgagatgatttcagatgttacagtcatcaagagggattggggccgcattctgcctcattccttggcttttgaaatcagagacgacattttcactttaaacaaacccaaaccattcctgctggtggaggatttctcctgcatctcgggggtggattttcactgatttatgtctgcagcgtgagcagtctctgggcttttctgcagctccagatgttagatgttttatctctccgtcttttatctgcttcagtccttgccccagactatcctcgcatgctccctcctctgggagggcttcctgtcttcacagccgcaccttcctcccactgctaccagtgccatggacccactgtatgtttcctgggggccatgcagaaggtccccagaccagtgctggcctgcgacaaataagtacagaaatggagaataacccttttcaaacacataatagcatttgatagaatcaatcaggagactcaagtttttactgcgtgcattgctttagacttggagggcgtgtgttggttgttagcaaggctgtgactgcatttgctgagatggtcaagtaatttggactatgggaatatcacccagcatgaagtcaatgattacaggcctttgtgtctgtggtctttctgttataactgatcttttttttttgaaacggagtctcgctcttgttgcccaggctggagtgcaatggtgtgatcttgactcactgcaacctccgactcctgagttcaagcgattatcctgcctcaacttcctgagtacctgagattacaggtgcatgccgctacacctggctaatttttgtatttttagtagagacagcatttcaccgtgttggccaggatggtcttgaactcctgacctcaggtgatccgcctgcctcggcctcccaaagtgctgggattacaggtgcccgccaccacgcctggcctataattgatcagatatcaattatacattttcaagtgtaattctagcttaaagaggataaagttaatacttagctgtttatataagatgttcaaatgggcattactgcctgatagtgacaagaagagagaatgttgggagtttcttttaagataagatgggtgtttggataaatgtctgacttggtctttttcccccttagataagatcattgaggttgaggaggaacaagaggacccatatctgaatgaccgctgccgaggtgagactcgggcgtctcccatcagttggtatttaaacaaaccccaaggggccagcaaggtggctcaggcctgtaatcctagtactttgggaagccaaggcaggaggattccttgagcccaggaggttgtggctgcagtgagctatgactgcacctttgcactctagcctgggcaacagagctggaccccgtctcaaaaacaaaaaaacaaacaaacaaaaagcaaaaccaaggaatctcggtgctgatctcactggaagttggaatccaggttttgctttggtttaccctgcaaagtaccctttggctgggagccagccatgagccacttccaccctgaggagtcgtggactcccagctcctccttccctttccccttccagatctagggctggctggggaggggaagggtgggcttaccaaggaggggccctggtgaggccctgctggggagggtggcccaggcccagggccagagctggtgtggaaagcctgcacgttaccgagcccccaggccttgtgaaggtgacagaggcctccctcaggctctcaggggagaggagggggctcagcgttccctgcctttgtgcccctggagccccagccacggttctgtcaccattggtgatattcatttgcctcacagggagatgtctgcacatttaactaagggcctcgcaggtttgtttttcatatgataaaactgcttttctttcatggaacattctggcatgtctagacctgcagatctgcctcacaagctctttcagtggttccccctgtggttagggtgttaattaggggccagtttaattcttaaatgatgcagtcagtgtacagtgacagttggtccaggggcgctgtccaggggcctggtggagggaggaagggagtgacctagagccccagcaagcctcagggctatgggaggagctttctggggaggggagagctggtctgcaaggaggaggtgggattagctgggaaaataaccctgaaacggtcctcagggagacctgaagccttgtaaagggcacggacccactgtagcagggtactgggaggcagtgggctggggaaggaggtggggttacagggccagagagaggggccctagaagcaggcaggctggcagcagttagaagtgtatctcgtagaatctttccctggttgaggcttatcctgatgagatttgcactctgagcatcactctggccaccctgtaggaagaacaggttgtggggtgcttctgggctatgcagaaagaccaggtaggaggctgtggccacagccaggtgggcagctgcaggaactgaggccatggtagtgggcttggagcagtgggacagctcgagagttcagtgaggagcaggtacatgaggcctagttggggcctggccttccacgtggagcccacacccccatgtctgtgaccggcagtgagctcttctctgcttcgccccttccaggtccaccccagcctacaaagggcaccctgcacaccacctgattttccagacggggaggttgggacctgaagcagcagcccctggggggtgtccagagccagagcctgggggtctcccagtagggcagcaggtgggctccagccaggtcagcctgccttcctgggttcgtctgcccagagggcgttttctatgacccagcctgaacggagctagaaaccaggcggtgcctgggtgcgtccatccctggctcatgcacgctgtgcttccaggaggcgggccctgcaagcagcagtgccgagacacgggtgacgaggtggtctgctcctgcttcgtgggctaccagctgctgtctgatggtgtctcctgtgaaggtaatgtccctatcccaggtgccagcaggactggccggtcactgtgcttgggagctctgtgctggaggactgaccagggcctgccttctacaacccagaccccattcaggggtggagagcagcccaggacgcgctttctcgtgttcgctggagtttgcagcgcagaggcccctgccgagacttccctccaagacaatataagcactggggttgggaaagaggatggagttggggtctaaccaggttccggatccaggatctgctgagtggccttgggcacatccttcagcctctcctggcccccgcgtctgtgagatgggggagatggagaagatgctgcccctccgtggggttcttgaggaccacataactacagtctcagaaaaagcagtagatatgaacgttagcaggggagagaaatcactgctttcgactccgtgcagtccacagcccggatgtgcacatggtggacctgagctcagtttgcgagggtgcagggaagcacttccaccgtggctttggcacattcctttctaggatgtattaggatgggtcgttcttgctggtcacccccgcactgcctcggtctctcctagatgtcaatgaatgcatcacgggcagccacagctgccggcttggagaatcctgcatcaacacagtgggctctttccgctgccagcgggacagcagctgcgggactggctatgagctcacagaggacaatagctgcaaaggtacagcatgcgctccgagtctgcaaacctggtcttccaggcgtagatacggcgcggtgggaagggcagctctggggtctgggctcccgcagtcctgcgccctctgtggctgcctgggcgactgcctgctcatctgcaggagggaggtggttatacccaccagggtgtctggacaggtgggatggaaggtgaaagtgcttgccaataatgttcagaacattgaaaaagttgacagtagtgcaccggtgccagctagttcagctgttaggaaagatttacgttcttatggtgcagagtaaacgatggcagatttgggtttctaaaaaggctcagtgcatgactatttaaaatcaagaccagggatgaatttcaggttctcacatgtactttctacaaaaaaaaaaaaaaaaaaaaaaaaaaaagcaaaaacaaaaatcccacaactgtttttgcacaacagctgccttccatccaaatccaggcttccttgaagttcaaagcatatccccttccactgcataaacacatggcatttctggctgccagcctttccccgccaagccttaggtgttatttggcagatggggaggctctgatgaggatcgtttagaacacagttttgcagagggtttcaagcctttcagaaggacaaatccacttgtgtaaaaatgtcactcactgtatcatgagagtgacttcaaagcatggcacaccccttctgacatctgagggccacagagcaaattctgtcctccccacccccacacaccagctgggtggtttggacccctagagcccagtggccaagccagctgagtatacacatttgaccatttgacagccatgaacttcaagggaagggcagcccatcacatcccatcatgactgtaacccttgttaatatctggattattgtgaagacttcagaatggatatgtttatagagactgtgtttgttgccactaagataattgctttatgatctaaactaaacatacacttagcctgaatgaatactaatatatatatacctgccaggaaaatgccagggtgatttattataacagacagtttgcctcataagagccttgggaaaaaaagtcagctttttaagtctttagcaactggagcacgatttggctcagtgaagtcttttttgtgtatgatttctctattagaatgttttgggttatagtctgagtaatgcgcattagaaaaaagctttcttgtgattttaaagtgttgtaagatgcttctggcaggactcttgctaacaatttcctttttttatgatgtaccagatattgacgagtgtgagagtggtattcataactgcctccccgattttatctgtcagaatactctgggatccttccgctgccgacccaagctacagtgcaagagtggctttatacaagatgctctaggcaactgtattggtaagaggtgtgccgccaggattagcgggttattccaggaggggccagcgacctagccttggggcaggcctctagaatctgcggggccgcatggtatacagaacaggggttggcaaactttttgtgtaaagggctggacagcaaatagagcaaatactttagccgttgtgggccatatggtctctgtcataatagtcaactctgctgttatagtctaaagcggccaagggccatctgtaaacaaatgggtgtggctgtgttccaataaaactttatttacaaaaataggcagtaggctggatttggcccaaggaccacagtttgctgatctgggtttagattaaagagcttgggttttggagttagagtgacccaagaaaattacttctgagctttaattttttcctctataaaatgggagtaatcataatacctggcttagagacttgaggccaggattaggcgagtacttgcgaagtactggtacacaggaagcactcggtgagtggtgattccctgccacaggcatttagcctattaaaaaattattttaaaaaatacttggctgggcacagtgggtcacgcctgtaatcctagcactttgggaggccaaggcaggaggattgcttgagcccaggtttttgaggccagcctgggcaatatagcgagaccccatcactacaaaaaattagctgggtgtagtggcgcatgcctacagtcccagctacttgggaggctgaggtgggaggatcccttgagcagggaggtcgaggctgcagtgagctgtgatcgtgctactgcactccagtctgggcaacagagcaagaccctgtctcaaaaataaaataaaatataaaaataaaaaacagtctgtgttagtatttgaattcatagagacagaaagtagaatggaaggtgccggggctgggcagggtgggggatggggagtgagtgtttcctgggcgcagagtttcagtttgagaagatgaaaaagttctggagatggatgggggtgatggtggcacgacagtgtgaatgcagtaatgcccctgaaccgtctacttaaaatggttacgatggcagattttgtgttacataaaatttgtagttcacatgtagttcaccacaatgagaaaagaaactctggccaggcacggtggctcacacttgtaatcccagcactttgggaggccgaggagggtggatcacctgaggtcaggagtttgagaccagcctgaccaatatagtgaaaccccatctctactaaaaatacaaaaattagctgggcgtagtgatgggcgcctgtaatcccagctgcttaggaggctgaggcagcagaatcgcttgagcctgggaggcagaggttgcagtgagctgagatcacgccactgtactccagcctgggtgacagagtgagactccatctcaaaaaagaaaaaaaaaaagaaattgctgatatcagagaaatactaatatgaaaagagagaatcccatgtgaacttagtatgaatttaggaggcctgggcaagaccgctcacgctagaggagctgtgtggggtgcggccggggagctggccggcctgggttactggttctggaaagacaggaggtgagtcctgctttccccagccgttgtcaggttaactgcctggctaggccgctgcagtcagcgcttaagtcctgatccaccggctctccctcggcctctgcttggcagacgcccctgggtcctgcctttgaggtcagagagactttttaggagaagaggtgaggaatccgagctacagatcacactagtcagaacctccccacctggggtggccccatcacctctcccctgccatgagcaagggggtatacatttccatcttgcttcgatttcaacttttccttagcgaaatctgtattgatcatttatttgaaatagtggtttggagagagagctcttcccccactgcattatttttaaccactgagatatttaaagataagtggatgtggccgggcacagtgactcacgcctgtaattctggtactttgggaggccaaggcgggtggatcacttgaggtcaggagttcgagaccagcctgaccaatatggtgaaaccccgtctctactaaaaatacaaaaattagccgggtgtggtggtgggcaccttgtaatcccagctactcaagatgctgaggcaggagaatcgcttgaacccaggaggtggaggttgtagtgagccaagatcgtgccactgcactccagcctggacaacagagcaagactctgtgtcaaaaaaaaaaaaaaagataaaaagacaagtggaacagtgagcccttaggacaggggcctcgtctgaaacccgccccagccttcctctgttacagcttccctgtcatcccctgggggagacttctgagctggggcgctgtggctcagctgccagttggcccctcgccagtcccttgccagcagggaggggtggttttcgctcagcgcagggggtggtgagcagggaagccatgggctctccgggaccagcggggaggatagtcctgctcagacttgcagcctgctcaaaggggggtccggaggaggctggcgtcgactgaggatggaaaccctgactcatggcaaaatcagccccgatttccacaaagaggcaatgtttgcaagtctcaacctagccctgactttcctctctacagggtgcagcactgtgtatgggctgaggctcgggagccgtccccttactgtccttccaggactggcaagcaggctgtgggctgaaggccagcctggcggcactgagctgttccgtgccatctccctgggtcctcagtgacagcatcgaaagccaaatgttcagctccctcagggtccccttagcttgggatgctgggatgaggatggggttccccttttcatgtgctctcaatccttgcaatcaagctcaggaatcattgttttaaaagatctctatttatttcaaaaattatgtatgtcttgacttataaatcagcaaacaaaacctaagtgtaggaagtaaacgctcctcccctggccaatcctgcccgcctcttggcagggtccatgagcccttctgggctctgctcccttgagactttttgtttttttatgaaaatgggatcagactgttctgccacttgcttttcccccccacttgacagggtatttagaaatcatttcatgtcagcacctttatgttatctttttaaaaatgactgcatcagcagaaatacgtctttctaaggagaaaatacatcaagatagaaggtagtttcaggccgtctgggagagggctgaaaaggttctatgtcaggtcctggtcccccagcacgcaccctgggtcctctgctcccacacctctgcccatggtacccgctccctcacccaggaacagcatggtccgtggtgggaagcgttgatttccttgtgtagccagaatccatcttcctggagctcctagaaccatcctggggccccaagagcccatccgagcctcctgcctgtagcagaagagctcttcctgcagagctagtacaagggatgggtcagggtcccagaaagtggaggtctctgcccctatcatgcatggagaattttctagaaccttaaggttgggtcaccgagggctttgagaccagcatggctttgtcgggttttctttgctcttttcttcaaattccctcctcctgctgctgtattcctttctccttctcctcctcctcttccccctcccatcctccccctcccttctcctcttcccctccccctcccctcccacttccctcctccccctccttcccttccccttctctccctccccgcctccccctttccctccttcttttcttcttttttttttttttttgagacagtctcactgtcacccaggctggagtgcagtggtgcaatcttggctcactgcaacctccaccctgctgggttcaagcagttctcctgtctcagcctcccaagtagctgggattacaggtgcccacaaccatgcctggctaatttttgtattttcagtagagatggggttttgccgtgttggccaggttggtctcgagctcttgacctcaggtgatccacccctcggcttcccaaagtgctgggattgcaggcgtgagccaccacgcccagcctctgcctttcttcttgagtggggaggaaggaatgggccagggcttcccacgtgccctggctgaccttgcctggggatgtcggcaggtcctggggcaggaaggggttccactgaatctaggaagcactgggtgaagccaagtgaacggggaccttggtagcttgggcttttcccatgtgaatccctgagagggagagatcgggtgccctgttcccaaactcaccctatgctttacattgatttgctgtctgtttattcattcccattcattcattcattgatagccaggtcttacccctgtggagtgcacgatgttctgagggacactgttgttctgtggaacagagtttggggaatctagtctgagtgaggaacctgcagcgccagtgggaaggcagccaccgctctgctaaacgctgcatttattcgtgttacagggcaggggccacccagctgtttctctaaagggctagatggtaactaacaacttcagtctctgtggcaaccactcaactctgccttttgcagtgtaaaagcacccctgagcaatgcataacagagtgggcctggttgcacgctaataaaactttatttacaaaagcaggtgtaagccgggtttgaaccaagggccatcatttgctggccactgatttaagggagctggaaagcaggagaccctgattctagacctaggccctggttggcccctgacttcagccatgagcccagagtcattcagtctccggaccttggtttcctgtttataaagtgcaggcagtaatgatagtgataccggcctcacctcacttgcaggctggctgtggtgctcgagagcggtcatggatgtaaaagcttttgtaaactgtaaattgctgcacggtcagcgcgaagggctgactcatttgactgaggagggtggacttggctggcagggagaggggtacagctgtcctcctttctgacttacgctcaggggtcttccaccatcactccctctctttgttcccccataccagatgctttgtaagtgtctgagcaaggttctccaaggtgatgtttagatgcttaggtccttttccactccctctatcaggaagtgcaatctgtgtattcttcctccgaatttgagcagaaggagggtatccctgtgtagcatggccctcctggaccattcatgggttcacacttgctcattgtatgtcatcaaaggtaaatgccccacggtccccatgtcagagatgtgtccactcaaggaaggagactgccgtgcagtgagctcagggagccatggcacctcccgggtgggcctggctcagcataggccctgtgaagcccagtcatcggaggggcctagagccttgctgggagtcagagttgctggcaccacgtggacagtcacctgtctccttaataccgtgcccagtgtgtggagtagatgaatgcaggagaagccaggcaggcaggtcccgatttggcgcagcgaacgatggaggtgctggagatttagggacaggaagaagggccagagaggtggtgtttgaggcggtatgcagtgataaaatttgggagccagctgggaggcggctgtgtggtccagagtgagggggttgagcccctccatttgtggttttgcaaagaggtgggaaggggagtttctttggagatccagtttttgggttctgggacaccctccaggtttaaccacatggtctctgtcttttcccgctgtagatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttggttggtattaagaaaacaaatctgaaatccactttcctgtctgcttccagcatgcaccctgccttctctggaagcagaaagttgatccccaaagcaaagccatttctatcagcccatccatcccactgtcagttcccaagcatggggcttcattgtcttgcctggactggtgcaccagcccgtctactgcctcagccttgtctggcttgtcctgagcccaaagctctcgcaccccaccctgtttacagttccatcagctccccgttggtgacaaaggatggatgcctctgcttacagtccagtcccccagagctggcccaactccacaaaccttgtaattcaggcaatgtgggtctgccactccccacacaagcactgtcctttcctctctgtgtgggtgtttgctctcacgtcattccctctgcccacctgctcctacgttcctttggatccagggcacccagcctgcctagatcccgccagggaaggagccttcctcgcataacccccaggacacttcttcagtgtctccctgggttcctgggcacttcctaccttaatgagagtcattgctggcctgccagccaggtagggctgcctctgggtcagctatcttcccagtccagggcccggcactcagtaggtgctctgtgaagtcgtgttgaaatggaatgcctgtttccatgtccatgtgttcctttcttgctttcctttctgatcatcttggggggaaaaaacccaaactaaaggttttcatcatggctttctttctcctttgcaagatgtggacgagtgcgcgccacctgctgagccctgtgggaagggacatcgctgcgtgaactctcccggcagtttccgctgcgaatgcaagacgggttactattttgacggcatcagcaggatgtgtgtcggtgcgtggggggccccgcaggcctcgggggaacccagccacgtggcaccagggacacatttctgtggcacctcgagtgatgtggtctgatcctcatctcagataatcccaagtgcaggcagaccctgagagaagatcctgagtcaggagaccccattctagccccagctctgctactgcccagccaggcggccactggcaccacccccctgtgtgtgagcctgctccccatctgtggaaaggggttctgcttgacccaggacctccaagtgctgatgagccaggtctacacatgtgggcagcatcagcgatttcctggagattcaccgctgagctgtagatccccaggagctagagatgtgtgcctttagcccagggcagcgaggggaaaagttgaccaggagtggggtcaggtcttgtccagccagtgcctgctgtcaccaaacctaggtgctcagggaagcctggcagctgccaaccactcccccaaagtgggcactttgctagatcctggcagaccctccttgtgggtcctggggaggaggactggcaggagggcacaagttcagatgtgctgccgcagaaggagcacgaggctcgcccaccaggcaggcacagcgcggcagtcccggctctcccactgacttcccgcatgctcgggacaagtcactttgcattccttgtctgagaaatgaggctggaggccaggcgcgatggctcatgcctgtaatcccagcactttgggaggctaaggcaggtgaatcacttgaggtcaggagtttgagaccagcctggccaacatgacgaaacctcatctctacaaaaaatacaaaaattagccgggcgtggtggcacatgcctgtaatccctgttacttgggaggctgaggcaggagaatcacttgaactgggaggcggaggttgcagtgagctgagatcatgccactgcaatccagcctaggagacagagcgagactccatctcaaagatgaaggaaaaaaaagaaatgaggctggaggaggtggaggacaaaggacatgagctggccttactaggagggtggagtgtggtgccactgtgttggacattgccctgagtcagcccacccctcactttcagatgtcaacgagtgccagcgctaccccgggcgcctgtgtggccacaagtgcgagaacacgctgggctcctacctctgcagctgttccgtgggcttccggctctctgtggatggcaggtcatgtgaaggtgaggctggggccccgtccactcacctcccccaggtcaccttcctcctggggaagccacccttctgcagaccggtttgcagcagatccgcgatggtttccctgttaaatgacatgttagcaggggaagtgcctgtaaaatattgttcatcagagaggactgcccgcctgcccacccgatttctcctgatgacatccaccctccgaggccgtgtcggggttcataggctgcggcagaggccatgcgggatgtggctaggattatggggcttggagcatgacacccacgagtcacagggccttggttatgcccgacctctccctgcctccgtgtcctccccggggagaggggttgatgtgtgaaacagcagcgaaaactggacacttgttttgcacaaagacagtgtgtgggttttaatcagatgctgcctaggggagacaggcctctgtgtccattgatctcaagtcacccaaacaaaaggagggaggctttgtaaatgacgagctgtgagaggaagtactgaggcctttagggcgtgggtcactgtgcacctgcctctaacttctttttttttttttgagacggagtctcgctctgtcacccaggctggagtgcaatgctacgatctcggctcactgcaacctccgcctcccgggttcaagcgattcccctgcctcagcctcccgaatagctgggattacaggtgcacaccaccatgcccagctaatttttgtatttttagtagagacagggtttccccatgttggccaggctggtcttgaactcctgacctcagatgatccgcccacctcggcctcccaaagtgctggcattacaggcgtgagccaccgcgcccggcctgcctctaacttcgtgttggagttaggctttccccacccgcagagacagggagaagcaccctggccttccggatgacgacattccccaggcatgtccccagcccttgagaaagacactccttggttgcacatctcaaagggacagagaaaccgtttacatttgcaagtttttctaaagtagatgcttctaaggaacatggaggtcagcgcctgtagtcaggtttgggctggaaccaagagaaaattcttttggcagcattgatctttctcagacaggcatgtcaagggggctgggtctacatcctggatacctggtcttgggccaatggcagccacgctgaagttgggtcaggtctcttggtatgtgggggttggacagagttgttcctgccaacagtcttgtggttctcagataacaccaacctcctgggctgatgggaaggtcacatgaactgcatgtcagcccagggcctggcacatactaggtgcttggcagatgtcgtgtcttgtatacggattaggttctgagctgagcagacactgagagctttggatggccctccacaatcgtccacattgccgatgacaccctgtttggtgccgtgcactggctcacaggacggcttctgcagcctgactcaaacatggcaggtcctaacattttgccatgagaattttccttcctgatgagatggtcgcaggggttggatatgccacagtgagctgtggtgtgcatgattctcaaatcggaggacggacggtgtgaggggtcctgggcttagttcacaagaacgtgtatggacaaggaacaagattcacgagttgagtctctcaggcttgtgttcaaacctgacttctgccatttccatggccttgaagaagtaactcagtctttcctgggccatggtgtcctcatctgtaaaacgggcatagtaggaccaaccccatagggggttgtgaggatgaaacgagattaagcatgtgaagagcttatcacagggccaagcacaggatgaagagctggcggtgtggaggctgctggctttattattatttagtagaagtagtgggattcctggcttgtgcttcctctagtcattcataaattgctgaaaagtcggcattcatatccacattagtggacaatattgtggatatagaaccagagcctggccaaccttgctatgtgaccttactaaccatttgttagggtcctgccccgggtgtgtagcaagaactcggtcctgcactggggagtgtctctagcgggggatgagagaccacactggacaggtggaggccaggcctggtgtgtgggggccacagagatgaaacacggggtggaaggctattggacgttctgtgacagccacatagtatagatttaaggcttttccagccacaatctctgttgcaaccgctgaactctgctgtggtagcagagaagtggccagaggaccatggtaaaagaatgagtgtggcagggcacagtggctcacacctgtaatcccagcactttgggaggctgaggcaggtggattacttgaggtcaggagttcgagaccagtatggccaacatcgtgaaaccctgtgtctactaaaaatacaaaaattagccgggcatggtggtgcacacctgtaatcccccagctactcaggaggctgaggcaggagaactgcttgaattcatgtccacatttagtggacaatagcctcccggaggtggagattgcagtgagctgagattgagctacttgtactccagcctgggcgacagacaaagactttgtctcaaaaaaaaaaagagtgaatgtggctgtattctttattttattgttattattattttgagacggagtctcgctctgtcgcccaggctggagtgcagtggtgtgatcttggctcactgcaacctctgcctccttgttcaagcaattctcctgcttcagcctcccgagaagttgtgactacaggtgcgtgccaccatgcctggctaattcttgtatttttagtagagatgggtttcatcatgctggccaggctggtctcgaacccctgacctcgtgatccgcccacctcggcctcccgaagtgctggaattacaggcatgagccaccatgccttgccgggctgtgttctaataaaactttatttataaaaacaagtgttgggacaaatttggcccatagactatgatttgctgacctctgctttaggtaaaggggacagttgagcagtagttcagagttgctgagtggcccagtgagttctgtgcattggagtatgaggagtactggcgtatgggctgggtggccgaggacttccttgtgtgccgtcatctgtttaggatgccatcttggaggtgaagtggagagcacaggatcagatttccatttgagaactagaatggactctggcagccaggtcggggcagacttccaggggccaaggctggaggcgatcgctgccatcctggcaggagaagttgtggtcgaagcaggcaggagcagggatggagggtccggagccaccagcgatgacgcctctccctcggccacaccccccgggacctctgtctctccgagtgtgttaacctgagggaggtggagaggagattttctgttcactgaccctgagggctactgtggaggcagggacgtatgatgctctgagcggtgaccctcgttttgtatttcagacatcaatgagtgcagcagcagcccctgtagccaggagtgtgccaacgtctacggctcctaccagtgttactgccggcgaggctaccagctcagcgatgtggatggagtcacctgtgaaggtgcggacgcccctgcctgctgagggggaaagcaccccctggtcttgccatgacacagcagcacggcctctgactttcaaaatccacagggaagagcctgctgggatttcttcacctgacaaaccttccatgtccacccttggaggcaagcgggtggtttgctgttttccctccaactgaggtttttttttttttttttttttttttttgagacacggtcttgctctgttgcccaggctggagtgatatggtgcaatcactgctcactgcagcctcagcttcccaggctcaagtgatcctcccacctcagcctcccaagtagttgggaccataggtgtataccaccatgcctggctaattttttatttttaaaaaattagagacggggccttgctgtgttgcccaggctggtctcgaactccgtggctcaagtgatcctcttgcttcagcctcccaaattgctgggattacaggcatgagccaccgtgcctggcccccaactgaaattctaatatacttttcccatccttaagcgtgagggtgggaaggcagcaaaccactcctgacttgttctttaataaatgtgcacggcggtaattacaacatgcactgggaccttgggccgcatatctcaggtcttggtggtggtgcatggctgagaggtaaggagggggctcagggaccacctatatccctgactcagagctctaactcttcatctgtaacatgatgattaacttcagcctcaccagatcattggaggattaaactagatgacagcaattacaggcaattaagggcaattacgatgattaccattttcatgtaaggtgtgtgtgtattttgtttgcttgtttgtttttgagacagagacagctctgtcacccaggttggagggcagtggtacaaacacggctcactgcagcctccatctcctgggatctagcaattctcccacctctgcctccttgagtagctgggcccacaggcatgcaccagtatgcctgactaacttttttgattttttgtagacacagggtctcactttgttgccgaggctggtctcgaactcctgggctcaagtaaccctcctgcctcagcctcccatgcctgggattccaggcatgagccagtgcacccagctgaggtgtgtttcttattattgaactgtggtccatatttccccctgcccgccacatgcatacttcacaccatgaacttgctgtgtgaccctaggctagtcccatcgcctctctgagcacgatggtctctgaggcttcctgtgttcagcttgtcctgtgctgctgccctcccgggccccagtgcagcccccagggcgatgtagcatggccagcagccatggccaggtgccaggacactgaggctgaggtgggctttgccgttgcagacatcgacgagtgcgccctgcccaccgggggccacatctgctcctaccgctgcatcaacatccctggaagcttccagtgcagctgcccctcgtctggctacaggctggcccccaatggccgcaactgccaaggtgagcaggagggatgccctggggtccctcacgctctgcttggggccctgcaatgtcgtggggctgaggctgggctcgggggctgtgcttccccaacccaagggccacagcacagatggaatgcattcaggaaaaggaggcccaccccatccaaggggtgtcctggggtctgcagcaccctggtctcctacacccaggccccagcacacttgtcctctggattgtctgagcctgtggcggctgcatccggcaggaacacttcagccctcctcccctcccctcagcagccccgtaaaggctggaacagaggcctttaggaagatgcccgccagggaggaagcagtccaggccaggggatggcgtggcctggtgtgggatggcccagggatactcatggctatgggtcagctccagcatcggctaagtaatggtggccaatggcattggttctgcattcagcccccttttctacgaatgctctagggggcagtgtgtgtcccccagagccatctgataaccatccattcaatcactgacagcgggtgctgagtagatgtttgtgagcgcgtgatcctcagtgtacacactgcgcccagaagctgagtcatggaggtggggctgtccagccagttcctcgggagccccacacaggactgtggatcctggggctctggaagccccctgggtcccacagatgtagcttctggtcatgaggaaggtgactttgatgaaaggcaggcaggagctgcggtgtttcctgggaggccccctccgcttgccctgggctctggatggaaggctggttgtgtctgcatttctgacggagcaaatgacttttctcctggccaggctccctcaccacagcctggggtcccgcccagactcagcataaacacattcctgagccgggcctttgaggctggggagtgttgtttttgccaccgatgctcaggcatttggcacctcttaatggatgtctcccagggttggtgacagcccctgagccccactgtttggctgctccagagtctatgggagttgggctgctcccccatctccaggggcctctcagtgtggtgccccaggccccatcccaggagtcccagacctggtggttccagtccaccctgaacagccaccaaccccaacacacaggcaagacgtatgatccctcgaaggctgtttttctcattgttgtgtggagctagcagctcctgcccttttctcctaagaggttgagtcacacctagggtaagggtgctgagcctcgggagccacagagaggctctggttagttagtgtatggactctgatgccagcctgcccgggttcaaagctcagctctgacatttataaaatgtgtgacctcaggcaggtctcttaagctctgtgagctcctcataaaatgaggatcataacagtatctgcctcattgagttcttaggaggattcagtgacttatccttgcgaggtactcccaggacccatcatgtagtgtttacttttaccatcgtcacgctccctccagggattgcgaatgataagttaacactctataaatgtaaataccctataaatgtaagaactggcacaggacgctgctctgaagatcagccagtggagggcagggatggcctgatcgccacccctaaccctagttgatgggaggcctgggctcctccgtctccagatgggtatggctcctgcagcctctgccttcactgtgctgctgtggggtctcttgcagacattgatgagtgtgtgactggcatccacaactgctccatcaacgagacctgcttcaacatccagggcggcttccgctgcctggccttcgagtgccctgagaactaccgccgctccgcagccacgtaagtcccttggaccatgccatcgtcgtctgtctgtgttggccttcctggtgacccagttcccgggtgggtgggttatcaggctgtgacctcggtgtcctcccatgagggactcagggcactcaaagatcacctgatccctggccctcaagcccctaaatgctagtgacactggtctcggaaagtcaagggggtaactgcaaatgagtctggggtctatagtcatgttttcaggccaaggctgtgcacagaaccaggagaaaccacagccctcttttttcctagggtggaagccttgggcaagctctctgggcctcagtttcctcatctgtaacatgcagatgtcagaacgtgctctgactgagatgcataggtagcaatgtctccatgtcagcccaaagccagggagccgatgtgacctgttggacgttgttgttaggtgcccacctgaaagccagaattcgtccagcctggtgaccgtgtgggaacggcatcaaagattccagatcctaaacgtggggctgcgtgcccctatgtctttgtaagctcactcactcctaggccatcacggcgcccacttgagaccacggttcccacttcctatcccccttgcccctaattgtattcagaaagtctcatttagtgccacagtcagttgcttcaggaaaagctccatgctgggaccgatctcaggactgtggacttgtgacctctcccagcactctgagtgcacgatgcaggcagccagctgtttccgaggccttggccccttgaccttcagcctgccttgggctcttggccagctgcccccgcgacctgagggtcagtggtagtgtccacctcttgaccctaggggcagctgccctggcttgtggcatagcaaggcttctgggtacccgagcagccccgttgtccctggcagccctccatattcttcctggctttgcgattctcattggctggcccagccatttccctgtttcccagcacggatttctgtctgcttgaaaacccaacatcttgtttccttcctgagcttgggttaggaaaaagctgccccaaaactgggtttgcaagtctgtagcatcccgaagagctcatggttatgcaacagcctgccccaggcagtgacactgcttctctgagccattaagaaagttcgatggccttggctgcaggctgtgcagccgtctgtcattgtaagttcactctctccccagcctttgtcagcgcctgggcttgaggattccaggaggctggctgtggttgtgacctcgatttctaacttgcgcacagtcgtgaaaccacctttcgaagagggggaggctgccctgcacaggggccctggcgcctcctaagcctgagggtgggcgggttggccatgtgtgctgaggtcatggctgaaatcaggggaacccagctccacccctcatgttggctgtggaagcctctgccacccctcagtgctggagaaagtcgtttcttcctggacctactgcgtgcaggcacctgggtagacagcccacagagggctttgtccccgcacaggctccgccttcggcgtgtgtgctaggagggaggaggggaccccacctggctgggcgtgagggtgggcagggggctgtctggagtgggccatgcctgcatggaggtggaagggggagcgaattaggcagaagcggcgggagtatggacacatgtgcggtgaaatggggagttcagcctgaaacctgggccctgtgtgctgtgcagtaagggattgagctgctgggcgcctggcttgttccagcccttggactcccgggactgatagtgaggaggggccaccccctctcagcactgctaacccctcagactggagttttgtattttacagccccttttcctgctcatcaaaaatcgaagctgcttaacacgttttttcatctaagcttcagaaagcaatttttaaaatctaaaagagccatatttaggagggacccatggccggcgcttctgtggttaacaactcagcaagagcgcctccttcgggagccttgacagacaggactgcagagtccgctgctgtgcctttctctctctctccactcagacggcttccatctggggaacatcccggcggccgagggctggtaactggagcatgacccaggaagctgggccgcaaaccacagggctcggccttgtggacaggaccaggctgttacagtcctgcccacacaattcccttctgcccgcaggaggaagtgtgcaaagctgtcccacagccttcatggggccggacacatcctctttatcccctcagtggggccggcgcctgatgacctgtggtctagaaagctggagcaaagccgggtggccttggttgccgcttcccggggatgggacacgagtgaacagctgtgggcctgagggtgtaacacggtggacggtggcagagatagagccgtcgatggcccccctgccttggccagttcctggggcttgtctcccggacgacgagcgtgtgaaagtcaggaaaatgccggcagggatatccacaagcacctggggtggccagaactgccgtgcctcccaggagaaggagggggcctagagggccttttttctctggtgtgtggtggcttaggatcatttccatagagcttgaggtgttagggtcaaatgtgttgaactggcaagttggagcacattgtcctctaacgcatgacatggcccaggatgggtggcctgctgaggggacatgtctggaaaccagggcctgcgtggcagggggggacggggcgggctcgcctatgccctgctctgtaatacattcagtgatgacaacccgtccctgacctagacacactggctaaaagggatttttgggccgttcccagtctgacaggcagtttgccagacagttatgtttctggtgttttaaaaagtttgagtagagcgaagtacgatcattgaagccaggacttaccaggaaaatcaaggacatgtttatttttgtgcattagtcatttgcaaagcacatagcgggtgccccaggccctgctctttgtccagaaggagccagcccagaaactcctagtgtagagaaggttttggggtgctctgaggaatgactgtgtggggtcggagggggagcctccaggggaggagtgaccagtcgctgtgtgtgatgacggcgggagctgcaccagaacaccacgcacacctcccattgctttcctccgcttccctctggcaaaacaaattccatccctggttagtacccgccatgctgagagaagcgggaagccgaaatcccaccagggcgactctagcgccacctgctgaccagccccatccaggctggtcctgaagttgctggtgtgtgtgcgtgtgcgcgtgcttgtgtgtgtgcatacattgtgtgtgtaaaagctttgaagtaagacaggccgactttgaaagccaagcttgccccttacgacacaccacggagctatcagcaagttctgcatcctcaatgggcgtctgtcttccagccagtagagcgggaggacgatgggagacagtggagggagcgagtggaaggaaagtctgctgcttgcagcctgctccctgcacccggaagcgcagttcacctgcacccggaagcacagctcatgggtcccatgctcctcccccagttcacggacgctttggtcatagctcctcagaggcccccctgggggagagctctcagatcgcctggagcactcccgtttggcctggacctgggcatctctggggcaggccaccgccagcagcacccgtgcccaccttctttcctgcctctgttttgggcccctcccaggcaggactcccccgttcagtgcccctgactcccaggccagtcctttctaagagcttggaatgatcactagccaagtaaatgcaaggcctcctgtcagtcctgacaaacctggaaagaggaggtaaaaggagaccccagtctcgataaatgcctcaagcaagtccaagtaacccagcacgagacatggaaacttaaaaagccaaaagggagatgtgatagaaggccaggacgagaggatgctcctgacctcagaatccagacacagcccagatggcagggcttcctggagcacctgggccaggtcctctggggctccgcacctgggccctgcttcctcaggcagccaccttcagagtatgatgggccaggagttcagtacacaggagacgacccctgtcccatcttgtgacaagaaattagaacttgttactatcctgtagcggaagataataccgatctccatcctgtcacaggaggttagaatctgtaacaggaagttggaatctgtgctcatcctatacaggaagttaggacccgtccccgtctccaccacaggaagttaggacccgtccccgtctccaccgcaggaggttaggacccgtccccgtctccaccgcaggaggttaggacccgtccccgtctccaccgcaggaggttgggacccgtccccgtctccaccccaggaggttgggacccgtccgtgtctccaccgcaggaggttgggacccgtctctgtctccaccacaagaagtttggacctgtattagggttctctagagggacagaactaatggaatatacatatatatatatatataaaatggaatatatatatatatatataaaatggaatatatatatggaatatatatataaagtggagtttattaaggattaactcacatgatcacaaggccccacaataggccatctccaggctgaggaacaaggagagcagtctgagtcccaaaaatgaagaaaaaatgagtccaatgtttgagggcaggaagcatccagcacgggagaaagatgtaggctgggaggctaggccagtctctcttttcacgtttttctgcctgcttatgctgtagccgtgctggcagctgattagttggtgcccacccagattaaggatggatctgcctttcccagcccactgactcaaatgtgaatcttttttggcaacaccctcacagacacacccaggatcaatactttgtatccttcaatccaatcaagttgacactcagtattaaccatcacaagtccaccccttgtcaacttgaacccatgcacatctcctgagatcatacataatcttcaaataaagacaataataagatcataattacacctaacataactatacttcatacgaccagaaactcaccaatccccaacccaaatactattatataaagttaacgatacttaaatgctgatgtgaattcaataaatcttatgtcacttgataaaagagaaaggaaataaaatgaagtcatttttgttagtacaagtgtatacatgcacaaacatttttgattgttttttgtttgtgtgttttttaagacagagtctccctctgttgccgaggctgaagtgtggtggtgtgattttgtctcaccgcaacctccacgtcccgagttcaagtgattatcctgcctcagcctcctgagtagctgagattacaggtgtgcaccaccatacccagctaatttttctattttaagtagagatggggtttcaccatgtgggtcaggctggtcttgagctcctgacctcaagtgatcctcccgcctcggcctcccaaaatgctgggattacagtcgtgagccacagcacctggccatgtttttaaaagaaggaggaaatactcacgacaattacagtcctcgtttctgcaactggtcacatggctcgtagctggtattgatgactgccttcttctactacccattctgtattccctttgccttcagcaagcaccttggcagatcttgttttttttttttcctggtggagtgacccaaaccttcattcctgaagggtctgggtcatttgtagtcctgcctggattgggctgttgtagtttcccattgaccttaatcacagggcatggtaatactgagagatgccctaatggatctcctgtattccatgcatactctaacttatcttcattttggagtagtagactgatttcatcttgatagtctgggtcagccaccccagccaacactgtaactcccttcttagcctgttgacttaaaggtaggaggagcttcaagtgtccaggtggcaatcttaatttccagtttaatggaatccttgttctgtctcctggtggcggcgttcctccctctggaactaagacctctaggccagcagaacgtaatgttgcaggaacaggaagcaaaaattttgctagtggatcactaggggtgatggtgagtggtgccacttccatttccacccttggatgcctggacccgtgaatcctggctatgggagaaacagtgccataatattggaccctgattcagagcatacatggccttctgtagaactttgtcccagccctgcaaagtactgtcacctagttggcattgtaattgtgacttcaaaaggccattccactatcctatcaatctacctgcttcacgacgatggggaacatggtaaaaccagtgaattccatgagcatgagcccactgccacacctctttagcagtaaagtgagtgctttggtcagaggcaatgctgtgtggaataccatgagggtggataaggcattctgtgaacccacggatggtagtcttggcagaagcatcgtgtgcaggataggcaaacccatatccagagtaagtgtctattccggtgaggacaaacctctgccatttccatgatggaagaggtccagtataatcaacctgccaccaggtagctggctgatcaccccgaggcatggtgccacatcgagggctcagtgttggtctctgctactggcgaattgggtactcagcagtggccatatccaggtcagccttggtgagtggaagtccatgttgctgagcccatgtgtaacctccatccctgccaccatggccactttgttcatgggtccattgggcaatgacaggggtggctggggaaagaggccgagtggtgtccacagaatgaatcatcctatccacttgattattaaaatcctcctctgctgagctcttttatgtgatatggtgagcactctcatgtgatacaaatatcttcacagtttttgaccactcagagaggtctatccacatacctcttccccaaatttcattgtcatcaattttccaatcatgcttcttccaagtccctgaccatccagccaaaccattggccacagcccatgaatcagtatgtaatcgcacatctggtcatttctccttccatgcaaagtgcacaaccaggtgcattgcttgaagttctgcccactgggaagatttccctttgccactgtccttcagggatgtcctagaaaggggcagtagtgctgcagctgtccactttcgggtggtgcctgcatatcgtgcagaatgatctgtgaaccaggccctagtcttctcttcctctgtcagatgatcgtagggaactctgcatgaggccatcggtgcaggctggagaagagaaggcaagttggcaggagtggagaccacgggcatttgagccacttcctcatgtaacttaacttgtgccttcaggacctgctcaagcccgatcacgtatataccacttccatttgatgatggaatgctgctgttcatgaccaactttatggctagatgggtcagaaagcacccagttcatgataggcagttcaggtcatatggtgacttgatgacccagagtcaaacattcagtttccaccaaagcccagtaacaggccaagagctgtctctcaaaaggagagtagttatctgcagaagatggcagggccttgctccgaaagcctagagaccgccactgtgattcacctatgggggcctgccaaaggctgcagccagcatccttatctgccactgacacctcaagcaacattggatctgctgggtcatatggcccaagtggcagagcaacttgcacaacagcctggacctgtcatagagctttctcctgttctggaccccactcaaaactggcagcctttcaggtcactcgataaatgtgctggagtaacactcaaacgaggaatgtgttgcctccaaaatccaataggcccactaggcgttgtgtctctttcttggttgtaggtggggccaaatgcaggcaacttatccttcaccttggaatatctcgacaggccccaaaccactggacccctagaaattttactgaggtagaaggtccctgaattttattatcagatttattttccatcctctggcatgcaaatgtctcactaataagtccagtgtgtttgctacttctcacttactggatccaatcagcataatgtcaccaatttaatggaccagcgtgatatcttgcagaagcgaaatgcgatcaaggtctctccgaataagattatgacatgaataagattatgacacaaagccggagagttgatacacccctgaggtatgacagtgaaggtatattgctggccttgccagctgaagacaaattgcttctggtgggccttggaacaggaatggagaaaaaggcatttgtcaagtcagtggctacataccaggtaccaagagatatggtaatttgctcaagcaatgaaaccacatctggtacagcagctgcaaattggagtcaccacttggttaaacttacgataatccgctgccgttcaccaagatccatctgtcttctgcacaggccaaatgggagagttgaaccgggatgtggtgggaatcaccaccccgcgtctcaagtttttgatggtgacactaatctctgcaatccctccgggaatacgatattgtttttgatttactgtttttctaggtagaggcagctctcatggcttccatttggcctttccaaccataaaagccctcaccctaccagtcagggagccagtgtgggggttctgccagctgctaagtatgtctctgccaattctgcattctggcactgggaaaatgaccacaggatgagtccggggacccactggacccactgtaagtcagacctgagctaaaactccattaattacctgacctccttaagcccctatttaactggagggccacaatgacgttttgggtcccctggaatcaacctcagctcagaatcagtgtccaatagtccccaaaatgtctgatcatttccctttccccaatgcagttactctggtaaaaggccagaggtctctttggggaaggatgggagaaagattcactgcataaattgtcagtaatgtagtggggtccttcctcaagaggacccgcctccccttcattcaaggggttctgggtctgtaaactggttcaagtctggaaattgattgaggggccgtgattctctttttttgtaattcaaattagtcttttgtccacttgatctagaagttttcggcttatacaaatcaagtaggaatgcagtaggcttcctatcaatttcacttctaggaacactgtgattaattagccaatgccagagctctacacgagacagactattctgattgctgctttgcctctgctgtccattacagaagctacacccaccttgcctttgatggttgagtgctgtcacttggccactgccacctcaggatccaattatttccattgtatttaaattttgtagttgagtgactgtggttcccactgttagatctgacataccaagacgagcaattacagggctcttcaaagatgcaggtgctgccctcacaaatctgtttcgaaagacattggtcaagggtatatcttctgaatcctcccaacttggttgagtaggtctaaagtgactaatccactccaccatcccaatctccctaagtctttggattccttcctctacattaaaccaaggaagaccaagcatttccagcttgctcacagtgggccatctcttcatccgtatttcagctaaaccagcaaataaactattagaaccttttttaactccccgagttgcaacattaaatgcagagtccctgcttagtgggcctaaatctgtaaattcagcctaatccaacgctatgttccttccaccattctccgacacccttaatatccattctcatgcccgttctccagattagtttctataaattagaaaactcaagcagttcttttcgagtgtagctcacttcctcatgggtcacactctcaacctcatctctaggggcccgccaggactttagtctagttataggtctagaggcaaacaggggtgttaggggtggctcctgaggagaatcaacattatcttgcctggcaactgcctcacaggaggccatcactgttgcctcaggcagcgtggggtttatctccttagacaaaggtggaaaggctgatgggtcggggcggggatgttgccactactggggatggggaagctgttaagctgtttcttctggcaaaaaagattcatcagagtttataaactcagtgtccccagcttcatcaggctcctcccacatgtccccattccaagttgcagggtcccattctttttcaatcaatgccctcactttaacagcagacacctggcgaggctgtgcatgcatctttcattgcaggtcagccactcgcatgataagagcttgtgtctgtttttccacaatttcagctcttcctctacaggagataagactctcactcagggcaatcttagcagatttgaggctcagtatctgcttctgaagctgggagatggaatccctgagttcataattttctttcatcactttgtccactaaacttaggagcaaccaaccagcttcattatgttccttggttctccacatatgatcaaagatattatgtatagagtcactaaacttgcctcatgagcgatgaatcaggagtttcaaatgcgtttatttttcataactctctaaacagttcatgccaaggactatcagtgttctccatactattagaagtggagtccttagcatttttggatctaatcgttaaccagccaaccccagaaaccccaaaaccaatgaaagaactccatctttaatattctcttcctctagaaccactcctggtaccaaaatctgtagtagttagggttctctagagggacagaactaacggaatacatatgtataatggagagtttattaagcattaactcacacgatcacaaggtcccacaataggccatctgaaggctgaggagcaaggagagccagtccgagtcccaaaactgaagaacttggagtccgatgttcaagggcaggaagcatccagcacaggagaaagatgtaggctgggaggctaggccagtctctcctatcacatttttctgcctgcttatagtctagccgtgctggcagctgattagattgtgcccacccagattaagggtgggtctgcctttcccagcccactgactcaaatgtgactctcttttggcaacaccctcacagacacacccaggatcaatactttgtatccttcaatccaatcaagttgacactattaaccatcacaggacctgtccccgtctccactgcaggaagttaggacccatccctgtctccacccaggaagttaggacctgtctctgtttctatcacaggaagttgggatctggccctgtggacccagatgggttactgagcttggaacacgagggcttagtgacaaggaactgggaactgacctcaatggctgagtagcgatatggctccctcactcactctgtgaccttgggaagtgggaaggccacattctctctgagcctcagtgtcctcatgtgaaaaatatcaccgaagccactgtcatggggtggtggcagtgatcacactagagagtgcatggtgaggaagagctgagcacttggtaaacggcagcagctctgattgctagtggcagagatagtcatttcatgggtcacctccgagacacaaccaagagccctgcgtagccctggccactgtctgggcaagggcctgggaagggcagggtgtgcctggggagtgcccctggggtggggctctgccagtgagcaggggacgcacctcactccgggcacagcctttggcccccggccacccagcgcccgagatggtgttggaagaggctagtgcctgaatcagcagcctggaggtccacggcgcctcccgcaggtgagtgaggtgtgcccttcgtgttggctgaatcggccagaggggcggcgggaggccccgcctgccagccccgcatccccgcgctctgccgtttctccgcttgctggaccggccctaaccctcttcttgtctctctgcccacttttcttgcagccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtgagcctcgcgtgccttggttttatttggcatggttgggagtctgtgccgcttgttacccgggggtgagctgggcactggccaccgcctggtacccccgagggctgactgaggagcgctccccactagagggtgtgtgctcgggggtccctgttcacagagcccactgtctgtgccgacagggaggccaggccgggtacatcatttcacatgtgttaacttgtcttcatttgtgttgaacccaaagaataaaggtggtggtggagaagggccctcagattgctgagcacagtcccctctcgttttacagatgtggaaactgaggcccagagagaaggggaagggttggccagggtcgtctggcctgctgtggccatgccaggtcaaggaagcgggtctgctggcccctgcctggttctttgctgtatccccggaggtgagcatttcactgagacaagaaagctctctcctgagattcaagcctcctcttctgtttgtcttgatcagaagcccaaatctgtggtgcagaaacacgggatgcggttgcggctcctaggatgcagctcttgcctcagtgaagtcgttttgcccccactgaggatcctggccctgtgccggggggaggcaaaggaccacacaatacatgtgatactcacgggatccttcataggccttacaccagtcctgccaggcaggtggtcatcctcatgaagactcagagagggcaagtgatttgcccaagatcacacagctggtatccgagccctggtttactgactccacagatctggctgttgcgttctgccagaatacctccactgagggccttaaccccctgcctccctccatctcctccaccatggtccagccaagccagtcatctgtccccctctgctgctcccagcgtccattcacctcccctacagctcattctttgcttagcagctggagtgatcttttagcctctgcctaaaaccgttcctggcttccttaccatttgggttaaggcctccagatcctcaagatgtctgaaggccgtgcctaatttagtccttgcatgcaatttccagcctggcctcaacttgttctatccttgcccacttcccttgagccacgctgcaagctctgctgcctccggcccttggtacgtgctttgcacccttggcctgaatgttgcttaaactccagctcatgtgcctgcctcagagaggccttccctgccacccctggcttctgttttctctgtccgtccttctcatgacccctttccttcatggtgcttgtaacaggctgcggttcctgttgactcgcgtttcacatttgtcttccgcaccttccagaaggctctgtgaaggcagggaccaggtctatctcattcagtgcggtgttcccagctccttgcaagacatctcgcgtgcagaaggtgctctgtcaatgtctgttcagggaacagatgactctgccagccctggcttatgtcactagcatttctgtggctgtgacactgtgctgacactgtttccaggcagaaatccaagaagggaaggcagaacaccccagcgggatcaagtaaagaggactgcagggttcttccatggaagcaggggttggaggatacccaccttgatgcctagtgaggaagatggacctggacagacagtcagctccacaccttgcgctgagcagctgtgattgtgccacgggagcatgagcccttttccccacggcccttgccactgtctcctggccctctctctgatcatgccaggtttgcaccagcctcgagtctcccatgttgtagtacattctccaagatgcagcccaggagcctctctgaaggaccagtctggttacgatggtctgagcttccttagaaccttccatggttgtcttttcccagcagatgaagcatagcctccttggaatggcatgggaggcctggcctgatctggcctctgcccaccctttgagctgcacctgccccaccccagctcatccatgtgcttgtaccctggccccacggggaggcttgcccttccctgaatctgccttcttgtggctttagcatgtgccatgctgtccccctgcagactgccattctccttgcagacttggctcagaagtcacctcctcagtgcagttagcctgagctcccctggccccaggtgcctccatcagagcatttaccccattgtgttgtggctgttccttaacgtccccactagccaggctctttgagggcagggattgtgtctggttaatttctgtattctctgcaactttgcaatgtttggcttgaagaaggagctcagtaaacatctgaataaacatgcaggttgatggatggatggacagaccaatggatggatggatggatggatggatagcatttttaaggcttagttcaaatatcgtctcctcagccaggtgtggtggctcacgcctgtaatcccagcactttgggaggccgaagcaggcagatcagctgaggtcgggagtttgagaccagcctggccaacatggagaaaccccgtctctaccaaaaatacaaaaattagctgggtatggtggcaggcacctgtaatcccagctactcaggaggctgaggcaggagagtcgcttgagcccaggaggcagagattgcagtgagctgagatcggagtatggcacaccagcctgggcaagaagagtgagactctgtctcaaaaaaataagtaaaaattgtctcctctgtttagccagcaagccacagcaggggttcttgtcctattcaggcatccatttgtcaggggcgggattactcaggctggaaggaacacctgtgccttcatgtgcatagcaatgtgaagaggtgggggaaacctctcaggggctttggaggctacccagtgaccttccacagcttgccagaagctcctctgcaacattcccaccaagggactcttctttgcttgtggaactccctgcctcctgaggggtcccgttgcattttgggatcccatcgacgtttgcgtgtgtgcctgagtgcactgtgggagtgacagctgagtgacctgagtgctcacccctgtcccgcagctccttggggctccttagccatgttctcggctcatgctgctgacagaggacaccatgcaggaaaagcaaaataagagcaggaggttgaatttccttcttgccatttactagttctgtgaccctggatacatcgtcagcctttcagagcctcaaggcccaccttatggttgattttgaagatggcctgaaatagtccagcaggcagcgcctgatacagagtaaacactccataggtgtgagtgtgggtttcttcattcattggaaggtaactgggtgttcgtgtggcttttcattgaaatggggatgaagattcagagagtttggagggatccaaggtcatatgtggagctgacatcacttttgattcagaacctgtgctttcctggttgtgtcactagtaaatcaagctcccaaggagaaaagacagcaataagggtgatttttattgtaatgataataataacaactccaacagctaacacatagagtgctgaccatgagacaggcgctgttccaagcatgtaattcgtttactcttcacagcagcctagggaagcaagcagtgctaatatccccattccacagtgaggacagggaggcacagaaaggtgaaggaacttgcccaaagttccacagctggtttccagtggcactgggattcagacgcaggcagcctgggctgggatctgtgctctgatcccctgtcctccactgcagcaaatacgggggagaggcagcatccctgggatgaatgagactgttgctccagccccatctcacagagcccgctctgccattcccaaactcaaaacaggatatcttattagctaaaggaggaggcagtgtggtaaggaggaaagggctatgaggctggaatgaaataagatatgcaaaatgggccaggtgcggtggctcatgcctgtaatcccagcactttgggaggccaaggcaggcagaccactgaaggtcgggagttcaagaccagcctggccaacatgatgaaaccccgtctttaccaaaaatacaacaattagctggtcgtggtggtacacacctgtaatctcagctgctcaggaggctgaggcaggagaactgcttgaacctggaatacagagattccagtgagccaagattgtgccaccacactccagcctgggcgatagagtgagactttgtctcagaaaaaagatatgcaaaacgtgtagcgtagagactggaaaggcagatgcattatttctgaagctctctagatcccaaccaaaaaacacccagacaactagataggaaaaaaaatgtttccatggaaaacatttacaaacgaaacaaggtatggttgtctgcagttcaggcccacctgcatgactttggcatctgtgcaggaaaaaacagtggcagaaccccaaaataatcaacaggtatccccagaaagtgtactaggtgctttgggggaacagcagctgaaactgggaggcgttttcctcactccaggggccagagtgtgcacagagccagtgggagggaggaaggggctggcgcaggcttgctcttgggagcttttgaaacttagccaccacagctctccctaaggtcagagtctcacacgagggagagactgctggaaatggaacagaaattgtgtagaaaagagaccatagagactgtgggaagagaaggtccgggtaaatgtggaagaatgtcaggaggtgagctctgcaaagtcaggaagataactgtgaatgatactctttctcaaattccaggaaaactagtttcctttaaggatgatcaacccaaaagcatcaaggtcaaattccatggatgagtttctataacaaagtaccatagactgggtggcttaaaataatagaaatgtattacttcatggttctggaggccagaagtccaaaatcaaggtgtcagcagggctgcacttcctctgaaacctctaggggaatgcctcttctgtaggggagtgctctttctgtaggggagtgctccttctgtaggggagtgctccttctgtaggggagtgctccttctgtaggggaatgcctcttctgtaggggagtgctccttctgtaggggaatgcctcttctgtaggggaatgctccttctgtagggcatgctccttctgtaggagaatgctcctgtaggggaatgctccttctgtaagggaatgctcctcctgtaagggaatgcctcttctgtgggagaatgctccttctgtaggggaatgcctcttctgtaggggaatgctccttctgtaggggagtgctccttctgtaggagaatgctcctgtaggggacttctgtaggggagtgctccttctgtaagggaatgctcctcctgtaagggaatgcctcttctgtaggggaatgctcctcctgtaagggaatgcctcttctgtgggagaatgctccttctgtaggagcatgacttgtctcagcccctggtggtttgttggtgatcattggtgttccttggctcgcagctacatcgctgcaatctctgcctttgtcatcacatgatcttgtgtgtctttgtcgtcacatagccctcttcttataaggataacggtcatcttggatcagggcccaccctactccagtgtgacctcatcttaactgattacatctgcaatgaccgtagtttccagtgacgtcacattctgaggtactggggatggaactttgacatctttcttggaaggatgtaatgcaaaccatgacacccatagaaagtgttaggggctgaattgtgtccccccccaaattcatatgttgaattcctaatccctaatacctctaaagtccctatctccaaatgcagtcacattcaacgaggtaattaaggtaaaagtgagatcatatgaatgggccctaatccaatacagcaggagttcttataagaagggattagggaccaggtgtggtggctcacgcctgtaatcccagcactttgggaggccaaggtgggcagatcacaaggtcaagagttcgagaccagcctggtccacatggtgaaaccacacctctactaagaatacaaaaattagccgggtgtggtggcatgtgcctgtaatctcagcgacttgggaggctgaggcaggagaatcgcttgaacccaggaggcggaggttgcagtgagccgagatcatgccactgtactccagcctgggtgacagggcaagactctgtctcaaaaaagaagaagaagaagaagaagaagaagaagaagaagaagagattaggaaacagacatgcacagagggaagaccatgtgaggaggacacagggagaagtcagacttctacaagccaaagagagaggcctcagaaagaaccaaacctgccaacaccttgatcttggactttcagccttcagaaccatgagacaatccatttctcttggttaggccacccagtctgttgtatagcaaacaaatgcacagctattataagcaaaaaagagaataagagacagaatgatatccctctgggtaatgaaagcacaccagaaagacgtgcccagactaaatgaaaattctaatattctatcttgaaagaaaccaaaagtgttaagaaaataaacaaaacatagaagaaaaatggggccgggtgccctgtaatcccagcattttgggaggctgaggcaggtggatcacctgaggtcaggagttcgagaccaccctggccaacatggtgaaaccccatctctactaaaaatacaaaaattagccaggcatggtggcaggtgcctgtaatcccagctactcaggaggctgaggcaggagaatcacttgaaccagggaggcagaggttgcagtgagccaagattgtgccattgccctctggcctgggtgacagagcgagactctgtctcaaaaaaaaaaaaaaaaaaaagaaaagaaaagaaaagaaaaaaaaaagaaaaagaaaaaaagaaagaaagaaaggaaaatagaaaaatcgagtcagaattagaagaaaactgagaaatgaagtaatagaccaaagaaacaaaaagttaaaaatttcagatgtaaatactaaactagatggaacacaaaagtgaataaacagataaatagaagttgaaaagaacaacaagttttaaaaatcaagaaagaaataacaagagatgaaaggcttgaagaaaaagtgacaaatattcaaaatctgtaagaagatctgacatttagataataggactccctgcagaagaagccgaatacatgggggaaagtactatacatgatctcaagaaaactttccataaattaaaaaagagatttgaaattccacattgaaataacacatagcgtacctgagaatatcaacaagaacaaccaacaccaagacacataacacattcttgtgaaattattgtactttaaagaaaaggaggaaggccgggtgtggtggctcatacctgtaatcacagcactttaggggccaaggtggcagatcacaaggtcaggatttcaagaccagcttgaccaacatggtgaaaccccgtatctactaaaaatataaaaaattagcatggtggtgcacgtctgtaatctcagctgctcaggaggctgaggcaggagaatcgcttaaacttgggaggcggaggttgcagggagccgagatcatgccactgcattccagcctgggaaacaagagtctcaaaaaaaaaaaaaaaaaaaaaaaaagaaagaaagaaaaggagggaaaaacaaactatgaacatttaaacaaaaacagtaagtgatttataaaggaaaaaaaatgttctcatcagactctttgacagcaacactttatgctaaaagaaaataaataacatattaaggactctcaagaaaagttaagcccagaattttatacctagcaaaactgactttcatgtgcaaaaagcataaactattatgaccatgcaagcattaaacattcagttacttctaaaactacaactaaatgagtgttataaggaaaagagtatagtatgaattactggataggtcagacaatgtagacatagcacatttatttttaaactctgagccgaatagggagagcatatcaaaaattattttcaataattatgttagtcatggtaactttagaattgttatcctgaggctactgtgtaggtaatgtgggataatgatgggatactgcatgtccttgaggaccaggattctgatgtggaagaaagaatgtgcctttgtaatacagaagagattaattaaaaaaccatatggtccttcttttgaattggatatcagtatgaactcttggtgtatattagtttttaaatgttcactgaagaggcctagaaacaatgaccaaccccctagcactgagcctccctagtatccagactggtcttgataagccatttctcactaaaaaacaaaaacaggccaggcgcggtggctcacacctataatcccagcactatgggaggccaaggcaggcagatcacaatgtcaggagttcgagactagcctgaccaacatgatgaaaccccatctctactaaaaatacaaaaattagctggtcgtggtggtgcccgcctgtaatcccagctactcaggaggctgaggcaggagaatcacttgaacccgggaggtggaggttgcagtgagccgatatcgcaccacagcactccagcctgggtgacagagcgagactcatctcaaaaaatatataaaaataaaaataaatgaaaaacaaaaacagaaatacaaatccaagacttcttggagaaatggttgattccaggtcttgggcagtaaaagtgtaaaatgaggctggatcatctcgtcacatcagatagcaagaaagctgtgaaagacgacaagggctgggccaaaaggacccaggagccaacttcattttccctctggcaagagatgggaaaatttgagtttcaacaaaggataaaaattgcagaggatcaaacctcatcggagtggcttccatcatgggttcatactgatttttttttccccaaaaatcctttggagaatgatagcacactagttagcttattatcctgaaaattagaaaattcaaggaaacaaccaagtattgatctgctatttcctggtaattaaatcacaagagcacatgaagggaagcatctgtttacaggagtagtccagctaataaatggaagtgaagtggtagaaccagactatcggcattttgcaatccttgatgaatcagtgggcgtaggccttgagcatcagtagatgctgtcctcacagagacagccagtcactgtgtggctctcactgaagacacactaccacctaccatcttgccaaagggaccgggcctgcatgggatcaggcctctggatctggctgccaatgtccaagaaatccagtggacagaggaccatgctgaactgcaccgtgaggatgcaatcagcaaagtccagcctgtaggaaacacaacagctcaaattcttcaggttctttaatagataagttgtatggaaaataaaggaggccgggcacgttggctcacgcctgtaatcccaacactttgggaggccaaggtgggtgggtcacctgaggtcaggagttcaagaccagcccgaccaacatggtgaagccccatctctactaaatacaaaaaattagccaggcatgatggtgcatgcctgtaatcccagctacttgggaggctgaggcaggagaattgcttgaacccaggaggcggaggttgcagtgagctgagattgcgccattgtactccagcctgggtgacgagcaaaactccgtctcaaataaataaataaataaataaatagaaaagaaaataaaggaacagagaagaaacctgtagcttaaaatggacttaaaaggcagagcaaaaacttgttgatggacaagtctgaatgattgtgtctagagacgcacactgatgtgagaaaactatgaagaaacccaagtaggccgggctcggtggctcaggcctgtaatcccagcactttgggaggctgaggtgggcggatcacaaggtcagaagttcaagaccagcctgaccaacatggtaaaaccctgtctctactaaaaaaaaatacaaaaaaaattagccgggcatggtggcatgcgcctgtaatcccagctactcaggaggctgaggcaggagaatcgcttgaacctgggaggcggaggttgcagtgagctgagactgtgccactgtactccagtctgggtgacagagcgagactctgtctcaaaaaaaaaaaaaaaaaaaaacccaagtagagcactgccgtgggactcaggctaggggtcactgttgggttgcaggaggggttgagttctgtctggcagttgcggggcgtttggtggctggccaagttctctttcttgacctgggtggtgattataaaggcgtttgccttgtaataactcgttaaactatactttcattttgtgtaattttgtatccgtgttttattttatgatcaagaggttgtaaaaatctgtctagcacagtacctggaacccagacctctgagagactgtagcctcttctgcctccccgtcacctggtgatgtggaattgactgccctgtgctgggcaccgagcttggcgctttctatctgctccttcgtttattaccctgctgcccagcctcactgtgggctctgagaaggcgggaccatgtgtcccttgttcactttgctgtccctagcagccggcgcctggcactcaaaacatatttgttgggcaagtgaacctgtgactctattttgccattgtagctattgatgctcaattcgtgcagttgacaaatgtccaagctgtgcttatccgccagggcacatggaagctggagggtgttgctggcatttaggtcccggtccagtttgcaggaagggccatgaagcctccccacagagcagccaggctgcagagaccactgtcgttctctgatggagctgtctctgggacagatgcccctgccctggccacctgctcctcctccctagacctcggcccctgtgggagctgctgtcccagcttccccgtcagcctcgtgtgctgtggttcccctcaggctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaaggtgagtgggatgggtgtgggggtcccagggccccctagggcctccctcggcttcagctgagggcttggcctacaggagttgttccttgtaagatgtggcccaggctttgaaatgcagaactttcttttttttttttttttttttttgagacggagtctcgctctgtcgcccgggctggagtgcagtggtgccatctcggctcactgcaagctccacctcccgggttcacgccattctcctgcctcagccttccgagtagctgggactacaggcgcccgccaccacgcctggctaatctttttgtatttttagtaaagacggggtttcaccgtgttcgccaggatggtctcaatctcctgacctcatgatccacccgcctcagcctcccaaagtgctgggattacaggcgtgagccaccgcgcctggcaacttgacatgcagaactttctttgtgtctgtgtcccccccacacccacctggcacagcagcatttggcccattctcagctttccgttcaggtggtcttttcttatgggtaacggttgttctgcagagagccattaagcgctgattctgtgaccagcactggagaatcagggagggcctccgggaggaagtgatggctaggctgggtcctgagtggtgaggtatttgagtgaaagggggagaaggggaggagggtgcccagtggagcaggacatggccagaagggtctggaggtatgggggggcggtgtgggcgtttgagaaactgagccaaggttttctgctggagcgctagaggcttggcaagaggtgggctggaaggataaacaggaggctaaaactggagttgggccttcaacccccaggctttgggggaaccatcggaaggttgcagtggaggaggtttgcatatagaaacatcatcctgttgatccagggccaggtgaactggaggggccagacggggagcaggaagctcaggtgtaacccagtcagtgctcccacaccccagcctggctctctaggaagctcctggcatgcagtgtagtcatgttgtgtaacctgccatcactgcaccgtttctctggagcagggcctgggctgcgtgctcccaagcctggcagagggctatggatggagcattgtcctgttcacctcgcttcctggctgtgctgcccgtgtgcccggtccccaaccacccccgccctctagggagtccctatccctggcctgcggagaagcatgccatgatgagttcattcagcagccgtggacggagcccctctgtgtcaggctctagggacatggtgataagaaggggtcctcccaccctctcaggggaggcatgcaacggagccagccgcgaggacaccagtgtttacaccatgacacaaccatgcgggggggtggggggaggagaggctccctcagcacgtggttgcccaaggagccgtccccagtcccagtccccctaggtttgctcctcccgaaaaggaataacgctgaatcgtcacagggtggcacagacttgggtcagagaaaataactaactggtatttgccttttgcaaaatgatggggtttcaccaaaccacatacaaatccttcccaaatccccagtggctggttttgtggcctctccggccagccccgatctgagtgttggttatcgcagggagccgagtgccgttgggacacctgttagcatcttgggcccaggaaatccacaccctgaccttaagtgctgaaaggacctttagtgggtctccgccggcttccttcctcaccttacaggtgaggaaactgaggcccacagagaggactcccccaagacagcccagagctggggctgccctgcttcactgtctgatctgggagatggacacacaccccccagagaacccaggccaccgctcagggtggcccccctgacctgtggcactatagatgggagaggagcccacccctctggcctttctgctgtctccctctgtcccctcactcgctttcctcctctggtccccaccttcatgaatatgcacagtgactgatgacttctcaccagcccttcctctgattagctctgtgtccccgaggaagatccaaaatctctcctgacttcagtttcccctgctataaaacagggatgggctatgatataggaaggtccagacccctccaccctccccacacaggggatctctggcttcattgatgttgtctcatgaaagggccctgggttaggtcttcattccccaagggtgagttcctggggacgaggctgggactggggctggggccaggctgtgctgagcccttctccattctgtgcctctgcagagatcatcttcctccgggccatcacgccaccgcatcctgccagccaggctaacatcatcttcgacatcacggaagggaacctgcgggactcttttgacatcatcaagcgttacatggacggcatgaccgtgggtgagtggctgggaatatcagctctatccaggcacccctccccctccaccccgaaaccctctctggcccagcccaactcccatctgagtcccctccccaaattcaagcccacccaaccttcagggcccagcgccgaggccaccacagctcccaatcggtctcggccggaggaacagccagagtgggggatcctgcctgggatctgaccctagctgtgccacccactctctgggtgacccctctgggtctcggtctccctgcctataacatgggtgggttccagagagcgctgcgcctcacaaccatgaatttcaaatgataccacccaagtaaagtgcttgtcctgagggctggcacagtcccgcggtcggtgggagctaaggggattgttattcttggggtgcaatgggagggatagcaaagtaggaatcagagggcctgagctctggtctctcagccttggaactagctggattcgccatgtggccttgagcagtagtcgtcccctccctacgcatcagttggtaagaggaccaaggccactctgtgtgcacagcccatctgaatggggagctcactgctctttctccctggagatccggtgtttggggagcgtgaagggaggctggggcatgaggggactgtggaagtcctgttggtgggtgcaggctggggaagatgtttacaggcgggggcagggccctccctggctaggaacgggctttaatgacaacctactcgtgtgaaaaaatatccaggcccactccattccgcacgcttgtttctgtcattcacagcccctctcctgaactgtcacattttaaaagatttacagtcatgggaaatgaaaacggtggcatctgccattttggactcggatttatactctgaacactttcaaagcagctgagcaacggacggacagtccctgacctcccctgggcctcagtttccccattgtgaactgggaggagtgggcttcctagtcccttaggcgctggagtccgggaggtcctaaccagaacccacgagcgtgcagtgcgcacagagcagagcgttttggagcctggcctccaggtggcgctgttggaccttggacgctcagtctttgcgcctcaaacccgacggttgttaaaactggcagctggagaaagggaatcgttattcccgtcttgccaaagagccatttatagcacctttacaagcttttaaatgggtttgcatgttgtaaacatgactgagtcactggggggctccccaccccagcctcctcctgcgctagctggcagcaggaataattagttaattacaattaatggtgcattagccctcgcgtgattccaaggggaaggcgcatggtttggttgtcggcagttgtgaaacttgctgcttgcccttgagtcactccccactctgggcctcagtttcccccattgtgaaatgagagtttagatgaagacagccttgagggtccttcaggcccctgtgcaggagggcaggcagggagggggttgggtcagggctttgtcctgtcccactgggtgggtggggtatgcaccctgacactggcccacagccgccccccgccccaaaggggccagccctgtgcttgatgctgggcctgcagttgtggctgggacatggccctcaggtgatttctagatcttggaacatgggagtttggaatcctaggaccttctagttcactcactcattctttccgtttctgaacccttcttgagcctctacctgtgcctgaccctgggctaagccttgcagatacagagatggataaatgccacatagcccctgaggactttgcatctcagcagcagggagaagccaccccgtatcagatcatcaaaatatgatgccgaaataggcatgcacagagacaggccttgatggcctgtggaggctctcttaggggaagtctcctggcaggttttacgtctttagttcccacctacatccttcctggggtgacccaagccaagaggttgggcagctgctgggcctagaaccagcacccaccagcgcctttctctggctgcatctgctccagacagaaccaacctgggagtgtctgtttctcagcttcccatccactggggcagaaaatcctggcatgtcagagcctggaggctcctagagaccatcccttccttcttccgtaggaggggaaactgaggcccggaagggcgagggggcttgccagtcttcttacagtgaatcagggacacagtgggcaatggaaaggagtcccagggtatgagagatgatcacaggtgccgtcccggcagcgggcttctgggaacggaatgtggatgaggccacaaggacccagcggcttcccccggcacagttggtcacgggtgccctggtctttggaattctgggctggggctgcgtgggggagggccccagcctggcccttggaattgtcgtgcctgtagccctgtgtgctggggaggcccctgcctcttccacgcctcggtctgtgtgcaggatgccccacctggctgggctcctggagttgacctggtgcccatgtcatctcaggtggaagactgagaccagggaggcaagccctgcgtgttgggacctaggctgcattgctggctggctcctgtctctgtccccactgcgctgatcttatttctctgtctgagatctcctccttgggcttccatatccctacttccttctccctcctcttctgcccagaataacttccatacatcctgggagcttcctggtccctaggggcagccatcccggcacacggctcctggcctgtccacctggtaatagatggttccaccgttggactcgagcccagcctgaagcagccctgaaaacgtggggttgaacccttgccggctccttaccgttgctgggcaccttcacccccgcattccccagtcctcacagacactgccagcgacgggtcatgattgtctcccttgggcaaaggagggagctgagttaaatgaccgcctgagactgtgcaactgaaaaactgcagggcctgggatgttttccgacttgtttttagcagtgcagttctgatttcaagcagtgacttaggcagaaacccttcatggtggtggagaggaagaaagcggcttccagggctgctgctcctggtggggagcgtgggaggctcttgagcctcctgggcagccccgtgcagctctgtgctgcctgcagcacacggcagggaacgccgcctactcacggtgcttgctgaacacctgtctgctctaggccatgccctgtgtggacactgggcaccggatcaggagggcttcctggaggaggtgaggcccgagctgagtgtccttgcatgtgagggagtgacacttagtgagcacctgtgatgaccaggagccagggtttcatcatcgccaggaccctgtgacacggtgggattatctcctctaacaaaggagagagcgagagccagagagggcaagagatttgcccgaggccactcagagctggggccagagcgggcctggagcccggtcttccccagacaccacacccgcccagagccggagcccagggttgactgctgctgtggtgggctaagttgctgtgagtttggatgtcccagaaaaacaatcagcgcacaggccccggggctcgccgtgttcagtcctcccagagtaacagaagaagagggagaaatgccccgagtccactaagaacctgcaagggccgggtcgtcctctaatgtagccttgaaagacccgttcttagcggggatcgaggagcccgcagcagggcccgcgccgtcgtctttgtaaagcccccttgcattcctctttaaccggctgtcaaagaaaaatgaagaatgcgttttcgccctgtgcaaaaatgctccattaatgcccgagggattctcaggccactacaaagctttccttatctggctctggattcattctcagctctgcagcctgtaatccggggtgctctgggaagagatctttcaggtagtatatcctgagtgatgactaatgggggagccctggctgcagcaggggcgggctgtgtatcatcagcgtgcggaagagagagacagaaaggcaactcgaggccacccgggctccccgggcccctgggctatggctgctgtctgagcctcagacttcccctccagcctccagatcaccacttccttttaactctcaggccagccacatctgtgtctgtctggctccctccactcagcctcaagacccagcatgtgtgtgaccacttccaagaagcctcccctgactgctccagggtcatggctgtgtgataggagggcctggcctgcaaaaacgccctccctatttctccagggagggaaatctgtgtgctatgaggcttggttgtggccacatttctgttaaaaccctgccaatgccaacaggagctacagagcctgcaggtgaagtaattctttggcctacggacgaattttgcatgtggacctcctgacccttgggcctcccgggttgcagggagctacggagttgtctttgtagttttttgcaggccagcccctcctgtcgcacgggcatgaccatggggcagtcaggggaggcttcctggaagaggtcacacacattctgggtcttgaggctgaggggtgagccagacaagtgggacacccaaactcacagccacgtctgtggctggcccatgaacagcgcgatgagaggcagggagccaggaagggagggcacagcctgcggtttggggctgctggagcatccagggtgcagggagggtcgaggggaggccgaaaggggctgcagggccaggccttggtggatgctgtcctggggaccacgggagccacgggaggtctgtgctgcccatggagcttccagatcccgctgctttatttaacccactgggcctcctgcagcttgaggttgcggttgaggttgtacccactcagcaggtaagaagactgaggccggaagagccaagtccccaggatctcccagccaggaagtgttcgaggatagggcttagacctgaactgcccagatccgggactccccatccccatggcctatgttaagccctgattattttttctggtctatactagctggtatctacactggctggcatctgtcagccgtggttgagtctgagtcccagccgtagaggataaatagtgaagcacctcctttcacacagtcacagtgctcccggccatgggatcttgggtcctgggccagcccctgatgaggaaagacctccctgtatgtccaggcagtcaaaagatgaagttcagatgtcaccatgctgcggaatggcgaggtcctggagggtctctctccggctctttacctgccgagggcccactcatccttggtcacacaggcgacccatcatgctgctccctgggacccccagacctgcctcctttccaggacccctcccagcctcaatgattccccagtgacagccacagccgcacctggtgcagatagatgctggggctggctgcaatttagggaggatctttctaggctggggcaggagcttcacggctgggaatgggctttaatgacaacctacgcatcttagaagacattcagacccactccactctgcacagttgtttctgggcaagccctctgatatgatttagtgcacgtgtggctgggtgtggagtgtgtgcgtgtgtgtgggtgcgtgtgagtggtgagtgcgtatgcacagggtttgatctctgagatgttttatactctctggcttggagaagggacagtcctgtagtatcaagaccagaccttgtgtccccagcccaaggctgccctgggcctagggacagtatttggagacttcgctggcagttttgcgttggaatcacctggtgcctccctgtacgtccacccaccctgtgcccagatccccttcgcaagcaccatatgctgttagatcctcgagcagccttgtgggacagccaccctggggctggtatcaccatttatgtaagaaaaaaaaggaagtgctggcccagggtcccacagccagcaagttggagctgcactgcccaagcaggtcctttagtcagctctctgttgtcccccaagcccctcagccccccaggcagctctaagggctcagctgctgcaggattccttagagaagctgaagggtttgggtcctcagctcctggccggggcaagtctggccaagcagcatggcagcgatgaagtccacatgatcgaagggtggatgcttaccttagacagctgctcaccttagacatggtcacctatattacatttaggaaggaaacgccctaattggagactctgcatctcattaatggaatcagatgaaacgatgtatgtgaaagctcccagcagtgcctggcacacagtgggtgcacaggatgtaaatactgatggaaacctaaatgttctgtaaatatcagttcttcctaatttcgccttgccgtctctcttgagagtggctataccttctaggcctgatcaggaaggaagctgggttttggtgtgccagtcaggtgagacgcagagaagacagcacaatcaacacaggaagtaacagaagcagctagttactcacaggtcctagagaggtggggagcaccccttgcagggccaatgggaaggggaagcgcctgcagcatgagagagagagagaatgagagagagagacagagagagacctgtgggaccaaagcctttactggggtccagggtgttatccaggcaggtttcccgtgaggaattctaactggggggcttggagcaggcaggagttccctgaggtcatgcggtggcggatgggggtcacttctgcataggcctgcactatcgatgtaggtgtgagggtctttgggttgtatccagctgtcccataaggcaggggcccccaggaggtggtggtataaggcagtcctctgggtcaaccgccttaaggaactgggaggaggtggagaactggaacccgcagcaagggtgactgagccctgctctggtgtgggagttaaacgcacattcagaatgcgtgccgaggcaacataggatgagaagccggcacaacacccaggcttttccatgaaagtgaacttgacagccgctttcccacattgtctgtgctgagtcgtgggagcctctgagttttgccagtgtgtcaacgcgctcctgcagcactctcacccccacttaaagggaactaccacagtttatgttttgaaatcgcattttaaattccatctgtgggtgtataaggattattacccaatttcaagtttaccgtttgaaaaatagcaatggcgtgagtggccccttttaggcaaagtgtgattgggtctgtgtggccgcggcaaactgctctgggcttgcggctttgttctctgtttccagctgtgtgactttaggcaaatttcataacctgtctgagcctcagctttcttctcagtaaaattgccataataatatttgccctgcagggtaatagggactgaggtgtgtgcctgttttaacataagagtggtctagtctggaggataaatgagccgctgggaggaagaagtttggaaatggagggctggtgggagcccggagccttcttaggggacaacaggccagatcaaggatgatgggacagggccaggaccgtccagcccaaagtggctccaactgcccaggacctacttaataggcagatctcgcggcctgggctggtgaggccggcctggccggaagcaagtcagcaagcaggcctctcaagtcctatcatccttgaattatcttattcattcaacaagaacatcctggggtacttttctatgccaggccctgcactgggtactgcagaacaaatctacatccaagctacgcatcctgcttttaagaagctccccaccagcatccatagcatcctgccagagttcccacagctgaaagtgcttgtggtttaggggttggtgtcatcccagttcatgtctgagagagagagagaagtggcgtgtggcagggctgctatgtacagttggatgtgttgtgcactgcaaaatctaggcagcaccatccaccggtgagtctatttgcagtacacaacctgctcaactgtatgcagcagccccggtacaagggcttgtgaatggagatatctacctagctgtacctctccccctggccaggcaaggcctcagtcaaggcttgagaccgtccattgtcccagccagcagggcccagatcacctcgttaaaattattacctcttaaggggttaaatgtgcgccgctgaccgcgtcctgcagcccatgtggagagtttggcccgggatcagtacacattacaaatgagattcagaaattccacctaaaaacaacagcgcggccgtccctgcccaacgatgagtgattgccctgtcctggctttcacggcaaatcccagggatgacgcgctttctcttttctgggagacacagccctgtcaccccgggggccacaccctggctggcagccaagttctttcccagggtgctgggcccggcctcctctgggctgggatcagctgcggcctgactccatcttgagctgggggtgtcaccgagggttccaggaggtggagggcatggggacgagggtgtctcagagactgggagatggaaggagaacacacaccttttctgctccctatgtcgtgaccccatggggcagagatgggctctgaggcatcagagcctgtgccctgtgtgacggcgcgtagccccccgaaacagctgctgttatccctccttgaggttatcagcccccaattccccagataccaaaactctcagaagtcacccccgtcacaaagctggtgaccctccctgcagcagctcctgggctcaggccagacccctcagaaggcttggtagcattaatggggtacagtctctgcttttgagcctacttcagtgagacacacagggggccccagggaccagtcccggaaacctccctgctcagtgggtggcccctggacagcctgggctggacctgcagtaacgtggacagcattcattcggagctcaaggcctcagccccaggagacgccctgtccatgtgagtgccgcactgcacacccgagattggttttccagcccaggacctggctaggaagggtcggcggggtacagcccgctcagcaccccctgccgtggccgcctctgcaggaggagacagcatggtggggagaggggactgtcttgccctgctgaacccccaggggtcggctacacccctctctacaggcctttttggtgtagcgcaggtgagacaatgcagccagagaggttgggagattacacagctccacatctgcggtgtcaccgtggacgggaccgtcatggtcccagcgggagggtggaaggaagccaaacttgagacgtctgccttgcacaaaggcagtggtgctcgtcaaggtttgggctggaagacttagcacctggcgggcatctgaaaatttccatctcccgtgcctgcttggtccccacggacacatgcctgagccatcagggactgcaaatcacaggggtgggaagacagggacgcacactgagcaggtgaaaggtggtggggggtaagcaggtgtttcggaaggagtagaggagggcccggaatggggccacgtaggaaagggtcacatccattcaccctggagtcagcccgagggcccaggcagggtggggtcctagtgatgcctgtcggtgggtgacatcaggccatccacagcaccgggagccagcagaaagggctgggccaggccatgtggacagggtctacggacagtacagggccagaggtccctattctgggaccttgacatgctgccgttctcgtgagcttctgggggactcctgcgaggcatgtgggctgcttctcagacctgcgggtaccccacctcccagatgttgtcaatgggatgtgaggttcacgagcacgtcacggagcctctcccctcgtcatgtacgtgcgcatcatggcaaaatgtgcctggccactggttcctgacgctggaaggcacgaacccactccccacacccacagccggcgttgctgtgactgcagtgtctgtgttctaagccccacttttcacatccatccccgctgcccggccagagagacgtcctcagcccagagccccacttttcacatccatccccgctgcccggccagagacacgtcctcagcccagagccccacttttcacatccatccccgctgcccggccagagacacgtcctcagcccagagccccacttttcacatccatccccgctgcccggccagagagacatcctcagcccagagcttcctatctccctcgcctgctcctaccctccagaataaaatgtgtacgaggtagggaatctgtgcttgtctgccagttgtggtcactgctgtatctcttagagtggggcttacccctgggggcccagcgctcagggatgcgtgggctccaggctggagagaagcacccagatctaccaactggccttccggctctgcagagccgcttgcatcttactccttcctcttccctccgctctgcttcagccactccagcccatgcctcagaccccaaatattccatggcctctctcctctcctggactgtagccgtgacattcacttccttctccttttggtgaactcctattcatccctccaagccgatgtcagctgtcacctcctcttggatgccgtccacacgctccacatgcagagtgtgcagctccttcttttgtgctccagtggccccagatgagccccttttgcaactctcctcatactcattctcccaacgagtaatgtgtgtatccctgggggcaggtcctgctctgaggaatgcagcagtgactaaggcagacatgaacgcctctctcatacactttttatcccagagggtaggagtacacgagaaacaagcataatatatacacggtcagatggtagtgagggctgtgcagagcaggggaggggagtgggaggcggggtgcagcatggcggtacagctttaaatctggtggtcagtgacatttgtcaaagactcaggagctgaggaagtgacccacacagagatctggaggaagagggctccaggcagagggaatggcagagtgctggagtggccatgcctggggaactccttctggaaagtctgtcgtgaaccagagcagataaatgcttgtgctggggggaggggtgtcgtgaaaagggaaacaccaggagttgtggcattgggagtttcttcgcttgactttcaattccaccaaacaattcctagacagaagagcctccaggggtttattcgtgcaaggctaccctctgtcaccctgtttgtccttgcttcttatacacacacagaacagatgcacccactggggtcaccccaacccagcccccagcagttgcccataactggccgcaggatcccacacacctgctgacttccagagtcaccaaggggttaaaaggggctgggaacagcctcttagtctccagagcctcccgcaggaatgatttgtgaccctcttaggctgctggtctgcaccttctgaaaagcctttaatatcaccgggcacattcataaattattcttttttaaaaatgaaatgttttagccaaacagcagtagaggcatgttgtgcaaaattagcaaaaaaaaaaaaaaaggaatgacgatgatatgaatcttttggcggcctctcctaaccgtctttaaatctgcgaaaggatctcagtgcccgccattacctggccagcaccgggaggatgtcaggtgcttccaggcggactctgctaggaacattccatctgtggccaaggctatcacagtcctcaaattaacagcaaaccccgcgtggcccttgtggtgtgccaggcactcttctgggcatatatatgtattttttatatataaaaatattttttatatatataaaaaatatataaaaatatttttatatatataaaaaatatgtaaaaatatattttttatatataacttgctcctcatagcaaccctgtagatcattattcccattttccagatgaggaaactgaggcacacaggagcttccaggctcaggtgacatgaattaagaatgcacacatcatgctgggactctgtggggttcctgctgtcatgactttccccagcgaccttggggagggcagagttctactctttgaggcttgacccggtcctgaaatctcagttgtcacttctgcatcctgacaacatggagcacggtccatagcgtaggtgtatcgtaaatgttcagtccatggcagcgcagacagtcatctgcagattcgcgagcctctgggatgatggcctggaaaagggacattgaggacgtggccttgctccagcctgggggggctctgtgccatggccctgcagcagggggcccctttctgccctgaattggctcattcatggcgcctctcaggagtaaaggagaagaaagtgatggttctccaccaacttcacctgtcccctcctgctgaactccagcagcggctcccatggctccaggagagagaaggggcatgactggcctgccctctcatcagcctctcccctagccctccctcctttactctcatctgctcaggaaaactgagagcaccaagctgcctcatgtctccaccctccccgcagagcaccctccccgcagagcaccctcccatcgcccttttcttgttgggcacctcgttcttcaaagtcagttcaaggttaacccgttggggaagcttccatgacaccagttcccggtttggggtgtgtatttctccgaagctctcccaaaggagatttgcttacctttatcagcctctgctgccccaatcccctgtgcctgctctcccagtggctgagagccccatgaagagccagaccagggccaggtgatgttggtaaccccagcacccagcactgcagccacccacagcaagtgctctgtgcttgtcagatagagaagagagggctctgctctgacctgcaggcctggggctcaggaccccctctctgcactcaagggctgcccgccaggccagcctctcttcccccccatccctccagaccttcattgcatctgtagaaagaggcagagtagccttcactccggaaggcagagggcaggacttggcccctctggtgtgcccacgtctttgagtgaagttggcaagacttgaactcgtcctgcccttcgtggccccctcaccttgggggattgcaaggggttcagtgtggctggggcagtgtgctgagagctgggctggacggggccgtgggcctcagcaagatgcgtctcacctgctgtgagcccgggtgggggtagggtgagaagagccccctgcagagccacagtgggcccccacggttggatttacctcctggctctgagcacagtgggaagaggcatgggaggggtgaaaaggaaggtggtacatgtgttcaggtagatgcgacgaggccggaactgaggccaggtggggttgtggggagagaagggaggagagtctggagacctttaggaatagaatccattggcctcagtgatggtttaacctgagggatgggagtaaggggcctatcgagggcgactccaagttcctggcttgggggtacctgcctggagagtgaggggtaggggaggaagggaagtgggtttaagggaggagggtaggtcagtgtttggcgtgcttggatttgaattgtccatctgggaggggcgtctggagaaattggagtggactccgagtttgggtcgggggcccaggaggaccccacccagcaggtaggtgggtggaggctgaggtcggctcaggagacacacggagggaggggacatgatttcttatccctctagtctcagtcacaagttcacttctcctaaaaggaggtgcctcagacagcagatccttccagaactctcccagaccttgtcttcctttggcaaggccacagagcttggtggaaggggcagtggcccagggtctgggctccagttctggtttactgcttgctggccgtgtgattgtcagcaactcacgtaaccacacagagccaaattttctccccggtgagcccccactgcctgcgtttgcgatgagaggagagacagtcgatgtgagtgagctctgtgatgacgaagcactgcagaaatgttagttcccacgccacaggtgaaggctgaagggctttagtccaaagctgacatttcccttcatatttttccccaaggggaaaggtgcaccctgaaacgaagagctgtctctttcgttcagctaccttcagctgtcccctccaaactgtctgatttagctcacgggagacctgcggaaggagcacatttataaccatcaagaaatacggatgatgagttttgctgagacatgttgactgacacttagtattttaaatatgcagcccagacacctgtcccccttgcttcccggcttttatggcgtttctcagccaagcagagaagaccaggtttcgggagctcagtcccttcaactgcaccaccagcttctgatgcgattctctctaattgctttctgctgtttttgccgtgtgtttatgactcagctaagggcagtacagtcgggaagtgtcctgcgcgccattttgcagacaggagggaggaagtgtcctgcgcgccattttgcagacaggaggaaggaagtgtcctgcacgccattttgcagacaggagggaggaagtgtcctgcgcgccattttgcagacaggagggaggaagtgtcctgcgcgccattttgcagacaggagggaggaagtgtcctgcgcgccattttgcagacaggagggaggaagtgtcctgcgcgccattttgcagacaggaggaaggagatgtagtgggatgggaagatctgggctctgaggtcagtccccgctggacggaaacctgcggccctgttagctccgtgatctggaaggtgctactagtagcgcctcatttttctccccaggagaaggagggcgaccgtgtctcatccctaactgcgatgggggctgaatgcggctgtgggcacatagggtctctctgtctccacccatgtctcctgctgtgtggcctctttccagcccatccacactctagttggtggctttgtgagtgctgacaatacttccatgtgcttttttgttttttcttttttgagacagagtctcgctcagtcacccaggctggagtgtggtggcgtgatctcggctcactgcaacctctgcctcccatgttcaggtgattctccctgcctcagcctcccgagtagctgggattataggcgcctgccaccatgcccagctaatttttgtatttttagtagagacagggtttcgacatgttggccaggctggtctcgaactcctgacctcagatgatccacccaccttggcctcccaaagtgctgggatgacaggcgtgagtcaccacgcccggccgcacatattctcaacgtttcctctttgccattggtctgtgctgctcgtcctcgcctgcaggaactgtggagcctcttggggtgaatttactgaggcctggtgatggtttgcttcttcccagttgcctgcggtgcttgtgatgggcaagcctgtttgggtctcctctgagctcctggcctctctgtttcagcaccttgtccacacagccctacacttcccttcctttctgctcatggctggccccacatggtggccacagttaatttccactggtatgagatattgtgcagtctcttgattcatcatctggtttgctaaaatgctctttgacagccctgcacactccattacacgttgtcagctagaatcacaagcctcacgttggaggctgcactttagaagggaagatgacgtgcccaaggtcacacagctggtcgatgcagagccacctaggaactcgaggctgtaactctaggtctctttataaaccagtgtctagagtcagagacatgagactcaggcagagagaccccccccaccccccgccactgactttcatcatttgaaacaatggagagacaatcaagtgcaacatcaaatagcaggagctgaaagatggcttcgagatggggccgagaatgtggaccacagagcccaagaggcagcgaaggtctccccactgcacccgagcacttcgtgttcaggatcctggatccccagcacatcagctgcaacttacagagcagagccaagacatgaaagtgaagcgcccgaggggacctacatttttcaacagggagaaaaaaagtgcttaattatatctttaagaggcacagacacgccaagggataccagcagcgtctgagacctgaagcagaaatgccagggatgaggatttggaagattaacacaattgaactcagcactgtggccttttttttctttctggggcttcggaaaggtaggaggcaaacaccctggcaggtaagacagacaagccaggtgtgatggaaatgcacctctttgtcctgccttttactgctggggtggtccttccaaatgaaactgctctcacccggagccttcagtggctcccctttccttcaggacaaagtgttgtcttcgttcctagattgtgaggcttcagggactgattttccttcttccttctctccttccttcactctcttttcttcttcttctgccttcatcttacgacgtgttcatggcagaaggcctgccatgggcctgccagggcctgggttggggatggtggggcagaaatgagctgacactgtccctgaacaaggaggccgactgtgagcgtcccctgcaatgagcaggtgcagtgttgcagtggaaagagaccaggtgccaggtgacatagggggtccagggaagacttctgtgaagacttctatgaagcattccagctggtcccagtgtctggcacatgagacatggcaaatcagagtctgtaggatcaagtggatggatggaaccaggcccctggtggcagctctcatgtttgcgatgctgcatgtgggcagcgagtgttccttgctacttcttcctccttcccttgcctccctgtgttagagaagttggtggtggttctgaaagaacagtggtgtagaattcgtgatggggaggcagccaggaaatgacccagcttcttggttctctgagactgacgaagtgaggtcctggggcagtccccaccagatgaggcacgtggctcagcctcatctgcctgcctctccccaagattgacaccgttcccagaaccggcctgaaacttcatatttttgggctttgcacttgtccttcctgcttccttggctcatatttattcctcaaaacccaatttaaagcttcctgtttaaagctcctctgtgcagagtagcctctaatggatgggtgggtggattcatgggtgggtagcatctaatggatgggtgggtggatccatgggtgggtgtgtgggtggatggacagatgggttgattggtgggtgaatggatggatggttggatccatgggtaggtgagtggatggattggtggatagatggatggatggatggatggatggatggatggatagatggatgggtgagtggatagatggatggatggatgagcagatggttgggttgatgggtgggtgaatggatggatggttggatccatgggtaggtgagttgatggattgctgagtgggtgggtggatggatggatggacggatggatggatagatggattggtgagtggatggttgggttgatggatggttatgaagctatgaagaaaagtggtatcagaatcttgattctgcaggcatttatttggcatctattatgtgccaggaactgaggaccagctgaactgttaaggtcctctttcatgaagtcctccctagccactggcctgggttcagtcgaggtgagggcaaggaggtggaagtcatgcttgaactagcctggagatggaggaaacctgttccccaaaccagagcccaggaaaatgtggctaggctggaggagtgtgggcaggtccgctgacagggcatggcctgggaaagggggtcctgggttgagtggggttgtgcacagactgggagatgcagtgtggacttcaggtcagaggggagggatagagaagcggatttggaaggtcaggaaggggtgcacattccttgagcgcctgctgtgtgcagccgtacagtctgttgttcaaccctcgcagcatccctacttgttctaccttaataacttttcttgttaaatgcaaagaacctgagaaaatccaggccccgaatctgaccatcagtgattcagcctagcgcctcccttccccttcacagcacccttttccctagtgtggtccttcctttctagttgctcgtctcaccacgcagctgtttacaatcagcttggagctctggtcttcagccattgtagagaccaaacctcgtgaagtactctggtgcaatgtatttagggacaatcattttctatatgttcagggctttcctctctcataaatcagtccaagagaaatacttaacacctgctgtatgtttctaagaattcagccacgctttggctgggagtcagatcactttaaatattagaatgctttttgatagccagtggtcatttctcagtggaaagaaaaaggatgacatcgagtttgatttgtttctgattttgaaggttgctggggttttttttgttttatttttggttttgttttttgagacagagtcttgctctgtcgcccaggctagagtgcaatggcgcgatctcagctcactacaacctccgcctcctggattcaagtgattctcctgcctcagcctcctgagtagctgggactgcaggcgtgtcccaccacgctcggctaattttttgtatttttagtagagacggggtttcaccgtgttagccaggatggtcttgatctcctgaccttgtgatccgcccgcctcggcctcccaaagtgccgggatcacaggcgtgagccactacgcccggccaaaggttgctgtttttaatccctgttcatagaagaggaaattgagactcaggaaggtcaaataatccatctgggggtcctaccacggagccaggtcagttcgtatcctgcaggtctcaaagggcctacttagaacgtctgtggcaggtccctgtcccacatggagctcactgcatgagcactttcttctttctttctctgtccccagactgacccctgaggacagaccttcagtttctctacattcttatttagccagtgccaggcacacgtagcatgcgcagaccctctgtgcattggaactgttgataatattaatggtcccacatgcaccaggagtgtgtatttaaatatagacatttaagataaatatataaatatatcaacataagaatatgataattatatatacatatatcaacataagaatatgattactatatacatatatcaacataataatataattatatacatatatcaacataatataattatgtacatatagcaacataatatgataattatatatttatcatgtttatattttatatataaattttagagtaaatgtaaacattttatatgaacaaatatggatatttatatataattatatttacatataaatacacttatgtgtaaatataattatataataattatataaatttatatgtaaatttataaaatacactttaaactatttaaaatacagttatataaatttgacatactttataacatatatttttaatatattgttttatatgtataatagttatatatcatatatgaaactatataatatacagaaatataataataacagaaatagatctctttttttttgggacaggatcttgctctgtcacccaggctagaatgcagtggcacaatcttggctcattgcaaccttgaccttcccgggctcaaacaattctgccacctcagcctcctgagtagctgggactataagcacacaccaccatgcctggctaatttttgtattttttgtagagacagggttttgccacgttgcccacgctggtctcgaactcatgggcttgtgatctgcccgcctaagcctcccaaagtgctgggattacaagcgtgagccactgcacccagctgaaacaaagacatatctgactgttgcttgtggaggtgcctgccattcctccctacagtgattcacaggctcacccagcctctccttctccttcaagccccaaacctctgaatgccaggaagggtggtaagaagtgtctctgcgcctagtaccagtaaagttggcaggtcactgtggctagcgggggcaccattgttggcctcgggcctggggagagaaaaatatgacatacagggggcccacgggggtacgttaggttcagccctgtaagcccacactgaccctggtgggcagacccagcccagggaggggcaggcaggagtgaccccgtcatcaggttctgctggcgagcccagggtggtgacaggcgcacgtcttttgccgggagctgaagacgttcatgggctttcaagcaggacaaagcttcaatgtcatcaccaggtagcaggcagagcaagggtgctgacagcctgcagaagcctgtgcttatctctccatcggagctaaagcccatgtttgcttagggaacagcctgaaattccaccccagctgctgggcctttcacttttgaaacataagcccagagagcgaaaggggggaacgttgtgcccagattctctttctgagcgtgaacttgatgttcctgaccaggaaccagccactcgtaccgaaggccttcctgacccctcagttctcccctgagcctttgctgtgtcctgggcaccaagaggtggagataggctgtcaccgtgcacgtttcctaagcctgcagaggaactgttcacagaatccagcctggaatcagccgtttgtggcaaacagtcagtagctatttctcaacttgtggttgtgaagctgcaggctccatattcgctcttcacagagcatccaagcaggtgtctcagtgccagctcacaccgttcacactgctcacaccagctctggagagctgcttgtacacatctctccacaagtccactttcagtgttgccacgtggtaccggaaatttgccatagaaattggccgatggtacgaccagagagccacctgttagatagttaccccacatccccaccctcaacaccaccttagacaaatcctactgtcagaacatgtggaacggagaagggaccttggcggttcattcataaatgtcagcacccataggtctgtgcctgtttggccgcagacactggggagcagcctgtagccttggcttgtgcagcttcctctgcaggaggggtgcctcttccaagaaacctgtcctgactccccagccctccccacctccattctcgcccccgctggacaatgcacaccctccatcagagcgtggtgcatacctttcatcctagatctcccaccagctttgaaaccagcatcctgttcatgatgtctggaaccctgggaactgtcccagcacctgtttagcacatgtgtgcatgcgaaggggatctgctgagtgctctgctctggtgggaaggccgctctgcacagctggagctgatgccttggcagatgctgggcatctgaatcgtgcagtgcaggagcacaggggcatggcaccgtttgttgctggggaacctaggcctcaaaagggcctcagcctctccgcagtgcagtgaggactgtcccatactctcactgcgtacagagtatgggagagtctctgtgaggctttgggtgccctgcagagggaaggcagtgccagctgggcctggtcgggggccatggagatggcgggcccaggctggggaggacttgtggcacccactcccttacccgctaacccggatcccctggaatctgcagaatgcctggggttgctcctcttctaccctgccgtggctgagctttgtctgtgccctgtcctctggccacggtctttgcctgatccctaccctggtacaggcagagctccctgcaacccccagctgtttccccagaactgacaccagtctccctgcaccacccatcctccttttgactgccctggggacgccactgctgctctgatcctctgtcactccagccacctcttgcttccctgttatcacaaacactgaacagtgagctcaggtgtcagcctccacagaggcatgcacagcaaggggtccggaggcatgccccatggagaactgggggtgctctgcttgcaggaggatccagggcccattgcagtcctcagatgttctgggggagaggatacgcctgcttcatttcttctcaggggtcagaactgggcacagggggttggaaggagggagaaagatgtctatcaggtacccactgcatgccaggccctcttctaggctcccttaaaacctttcaggtaggccagtcacggtcgctcatgcctgtaatcccagcactttgggaggccaaagcgggtggatcacctgaggtcaggagtttgagactagcctgatcaacatggagaaaccccgtctctactaaaaatataaaatgagccaggcatggtggcacatgcctgtaatcccagctactcgggaggctgaggcaggagaatggcttgaacccgggaggtggacgttgcaatgagccgagatcacgccattgcactccagcctgggcaacaagagtgaaactccgtcgcaaaaacaaaagacaaacaaaaaacacctgtcaggtaaatggtggtagagcagaaaacctgggctcagaagctggcattgatcccagagccatccagtttcaaagcccacacccacaactttcctccaggttgggcagtgcatgatggaaaggctgtcccagcaagtagtgagttcactttcaccagtccctggaggcaggagcagagcctgagctgaccacttggaaggagatgttattcaggggactcgagcatctggcgtaggatgggactccatgaggtctatgcctccttctagctctgaaactcctcaagggaaaccatttcccagatctctacgttgctgcagtcccttctaacttccagcacaccttctgctctctccgcaggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttggccaatcagattttctatgttctaaggacatggctgctgtagaatagcacagacgtggatgataaattatccccagaagcagcatgacagaatgcctcggggagcacttggaagggaaattgcagttctgttgaaatagaggaaaatcccttggtaaagacacagcctgttaggctcgtgtgggcctccagtatgttcaccaggggaatggctgggatttctcggcactctgcatcatccatcttttcttataggtgggaaaataaacaactttgtgatcctcctgatggcctgtgcatgagagtctttcaagaagagggctctctgccagctcaggagtcttccgccagctaagggactggaaatctccccccgccgtccccctgcctcaccccacccaaggttgtctcagtgctcctcctgcccctcaaggttctggggcggggcccagcttgtgtattggaaaagcttcctacacacgtcgttttcaatgccatgcccaccctctgagaagtgtggctcgggtttgttccctgccccatgtccagtgctgctaggaaagcccagggctctggcttctgtgtgacttgcttccaatagcatccctcgtggcatcctgatcctctctagaaatccctgggggcaaataatgacccttccgcagccatgagtccctgccagacacaggcctgggccaggcatttgacatgaggtgcttcgctcattcctcctggtggcccagtgtggtgggtatgatcacacacaatcttgagatggacaaactgggctcagagagaggaacttggctgccaaaattcacacatttgagagacaaagagggaattcaaattccatttatctgaatttaagccctctctaaaccctgtgtcagcaatagatatggacagactgaatttgttgggggactgacaccccaattggcatcagtggcggggccaggggctccctgtgccccagggcccactccggcctccagggactcagcatccaggctctgtttccacacacgcctctcctccaaatccttccctaggttgatcccatcctcttaggtatggaccccatttgtggctcagaacctctctcatcctatgcctcatttcgcagcctggaccctagcactgggtgagatctcagccccacactcaagccaacaccactccaactctcaagaacatggtctccaccacctttaggaagacctttccaaggtcacttatttgggtcactggtccatcaaagccaagcctgggccagccaagtacaaggcctgctggagccttggccgctgtagctggtgggaaacaagaggccaggtgtggggctggacagtccaaggagccacatccggggacaaaacaagtgcaggggacatccatgcaggtcttgatgccagggagttagggaattggggtcctggcagggaagcagggctgggagctggctgcaagaatgaaaggaagactcagggggaggggcaggaaatagaaagggacatgtagggggagtgctgccgcccacttgcagcctgggggcaaatctgccagagccaggccgttctgggctcagcaaagctggtttctgggagccttcttcagtagggtggggtgggaagaccgaggtgcaggctgctttgggaaaagagtttcccatattcctaacgggagttagggcaggccaggtgcagtgcctcacacctgtaatcccagaactttggcaggccaaggcaggtagatcacttgaggtcaggcgttccagaccagcctggccaacatggtgaaacctcgtctctattaaaaatacaaaaattagctgggcatggtagcgggtgcctgtattcccagctattcgagatgctgaggcaggagaatcacatgaacccaggaggtggaggttgcattgagctgagatccactccagccggggcagaggaatgagactgtgtctcaaaaaaaaaaaaaaaaaaaaaaaaaaaaagggcagctaacatgggaagagtgaatacagagccaagccccctgctgctgattggcttttgaatgagcacatgatccaagctgtccaatcagagtcctgcctcagagagcctgccgtctggagcagaagagggcaggaggggcccgcaagtaagcggtgagggcgccaggttgaggagcccaggggaatagagggagtcctgaccctatctgattcagaatcagggaggcaaaggcagacctctctcggcagggctagcagggcgagtcactgccatcgtccgagcttcagtttccacatctgcaaagtggagattcccagatggcagtgaggagcgctggagagcatgagtgcaagagggctttgtgcattgcaaagtgctgcatccgtgtgtgacggcttattatcattaaccgttaaaagcagcgatgacggtgatgacgataatggttgccactgtcaatcgagccacatgaacgcgctctggaagcttggcatcttttcaatccggcatttccttttcttaatcatcctggagagacttggtagacagttgtgtaaattacccaccagcttaactcttcatatttcatatcatgctatgggttgggcacctgatggacccataagtatctcattatacttgcaaagtaattactgtcagagcctcgcatcagcggcattaagggaccagctaatgggagctggaggtgcctctgagttcctccacaacagtgattccttcttaattgtagccttagaacaagataactgagggacattgctaaaggcaaagcagtttataagcagcatgagacagcaaaacacacagagacaccaagttgaatccttcttgttgatctggtagaagaaacttggagggaaggtcccagaaggtgtcatagagtggtattcgaccagaaagctgcctgttttttttttttattcctaagggacatctattctactgtacagaggaagtctgtggcatgtgtcagaagtgcctgggctgcccagggtcctagcaggacccgttttaacatgcaggtgggcattgagtggagggtgccagggcccacccagccaacccagccaagccagccaactagaattcgaggaggtaagccagcttttccaaagttctcaagtttgtccaggtgaaaaaacacctggaaatcaagggtttttttcctaatattgtaacatgaaaattttcaaatatacagccgagttgaaggaattttacagtgaataccagggcaccttccacctagattctgccactgacattttatgagattcagttgcattttgaagaaatgacaatatgatgaattaataaatacaaataagaaacttacagtttcttgtaggcttgcgctcaaatccagccacttactagctgtgtgtccttgggcacattgcttaatgtctcagagccttggttttctctacaacgaaatgaaaataaggacacatacttcacaggagtgattgttaggatgaaaggggatgattacgtaaaacagtgcaagaactgctacacaggaggtcctccataaatagtactgtcatgacacacacacccgaaaggatagtctttattcagttagatgccacattttattaaagtcttgtgtggacaagaagtgaaacctcagaggaatttatgaagaataattggaggcacttccttgtgacttggcttcatccggaccggatgacttctgggtgccagcaacagttccccatttccattcacgtttccccacatcgttcatgccaaagagatgggtgccaagaggccatccgtcttcatcctggacatagaatgagacgggaactcactcttgaaggacttttgaagtctcagagaagaaacggagccaccgtagaccttttgaaatacggcctgtgagaagcacggtgacagtcaccattactaccaataatcacattactctttgtgggaaaaaagacctactatgtgccaggaaggcttcggtaatcatctccaacacacacacattctctcacacacacatgtgcgcatgtgtgcacacacacacacaccacacacacacacacacacactccgcagcccttctgccatgcccagctcagggccatcttctcccacaaggatgccggtctcatctcctgaaatgaggttgcagtgagccgagattgagccactgcactccagcctgggtgacagagcgagactccatataacctctgcctcctgggttcaagaaactcttgtgcctcagcctcccaagtagctgggattacaagcgcgtaccaccacacccagctaatattttttgtattttttagtagagacagggtttcgtcatgttggccaggctggtctcgaactcccaacctcaggtgatctgcctgcctcagcctcccaaagtgctgggattacaggcatgagccaccgcgcccggcctgatctcagtctttaagagagcagcagctcatctgtggccactgcttcccagggacttgccagaagggaggtgcagggcacagggaaataacccacctctatctgacggcttcaatggtatcgaatgtcctcagtggcagcacgcagcacagaagctgaggtgtggctgcattccatttggagaattccactgtgattcatggtgtcagctgcgggttcaaggtgtcacaatttaattattaaacatcatgaggcattaggaggcttgggcacgcactgataagtgatccatttctaacacagctggtttattactgtttgtggcagctcctgcacgaattggtgtccgttaactaagcaatggtattataattacacatttaaattatgtatgggaagggtgtcagtggtagaagtcagactgcagtgattactttcagtcttcagacctcctggatgtagtctctctgcagatagctgtaactctggcttgttttctgctcattttctgcagacatgtagaatccactgctagggtccactgagctgtcttctgggtggtttttggtgctgcaggagataaacacatgtgtcttcctggttggacccagttgatgcactaacctaattctgtcctttgcctgccctgatctccatagcctgcttcttcctggaaatttgctgctgctgctgcttcttttttttttttttttttttgagacagggtctcgctctgtcgcccaggctggagtgcagtggcgtgatctcagctcactgcagtctctgcctcccgggggttcaaaccattctctctgcctcagcctcctgtgtagtgtggattacaggcaccccccaccatgcccagctaatttttgtatttttagtagagatgggttttcaccgtgttggccaggctggtctcgaactcctgacctcaggtgatccacccgcctcggcctcccaaagtgctgggtctacaggcgtgagccaccgcgcccggccggaaatgtgcttctttagaggaaagcaccgttgatcccacctccttgatctggtttctaagacctcatacaaactgggcccgttagtctttgctccctgatactatctgataccatctggtctcactccttccttcccatcttgttcattcattggttcactcattcattcactcacttcacgccctccctctggtgaatcagttcccctctgtcctccccactctgtccagtcctcccctaggctgccaggttacatttccaaaactccgatctgatcaggccctcttggtctcagatcctccaagggcttccttcaagggctcctgcaccaacctcgtggtgtggctgtgtgacataataagaaacattcacttctatttggtctctttccgggttcctgacacaaagctcctaatcccttgtctttggtttaatgaggtgactctcagtggctcctgggtggggttgggggctgagcaccagaaagacccagattcgacgaggagcctggagcttttggctccacccccaccctccaggaaagggagaggggctggagattgagctaataatccatcacgcgtaagtaatgaagcctccgtaaaaatccctgaactacaggatccagagagcttctgggctggtggacacatccgcatgctgggagggtggcgccccccaactccacggggacagaagctcctgtgcccgggccccaccagagctcgccctgtgtgcctcttcgtcttcctgttcatctgtatcatcaataatgtcctttacaaggacattattgtccttgtgataatgaatgaggaaggaattattccattcaggaaggaatgagaccagatggtatcagatagtatcagggagcaaagactaatgggcccagtttgtataaggtcttagaaacctatacatgtaaccaaagtgtttccctgagttctgtgagccattttagccaattaccaaacccgaggagggcgttctggggacccctgatgtgtagccaagtcagacggaagtgtgggtaacctgagcgcccaatctttgcaactgacatctgaagtagggacggtcttgcaggacggagcccatatcctctcgggcctgtgctaactctgggtggccagcgtcagaattgaactgaagtgtaggacgcccagatggtgtctgcagagagctggccgggcgtggtggctcacgcctgtaatcccagcactttgggaaaccgaggcgggcggatcacctgaggtcaggagttggagaccaacctggccaacatggtgaaaccccatctctactaaaaaaaatacaaaaattagccaggcgagatggtgggtgcctgtgatcccagctactcaggaggctgaggcaggagaatcgcttgaacctgagaggtggagtttgcagtgagccaagatcgcgccattgcactccagcctgggcaacagaatgagactctgtctcaaaaaaaaaaaaaaaaaaaaagcgggacagacaggggtgggaagttggggagggggctctgggagggggaagatgtgggtgccccatgtggagctaagaatggaggagtggcagggggcacaaggtcacagaaccaggctgaggaagaagaggttgcctggagggtgggacccagaagctactgaaatgtcgcagcagaaatggccattgaacgccccttctaaggtcctcggtgggaaagtcaagtcctaacatcctacatggggaaatctacgcagttagcagagccaaatatgacagcgacatgagccagccactttgggaaacagtcaagtcctaacatcctacatggggaaatctacgcagttagcagagccaaatatgacagcgacatgagccagccactttgggaaacagtcaagtcctaacatcctacatggggaaatctacgcagttagcagagccaaatatgacagcgacatgagccagccactttgaacctgacgtttcatcgtcacgtgagactgtagctctctgagtcccacaccctggtcaccttgtcctggttcctgcacctttgagggtgagttattcaagtcagccggtggagtagacggtgctcctgatcattcctaaaaggcaacagccttttctgcatttcttgcaggaaaagtcagacagatctgagaagaaatctccagattccccagaaagcactctcttgaacatcctttcctgtgcatacacagcaggtgtttaattcttgctctagggagcagagcccgtcccagtgtgaagagtggctttgcacacaagaaactatttctccattgtctccctagattagagaggcccccagttgaaactgcttcccctgagccttcggtattagaaactggtaaaacccctccagaagcatcgccctggaaacttgagcacctcaacccccaaactcagatcccagcagagaaagcctttggcatcccaggaccgaatgctaacggcgctgaggtcgggtgaatccgctctggcctgtggtgatggtgacttgctgttgagaaccttagtgttttgagtgaacaagaagaaatctattccagcatgattattccaattgggatttaggaggactgggcattctccacattccagtcttcttcagttccatgggcttaagagggggcttatttttttctttctgtgccacaaaaacttggcagcgatgactaacctagggtaacatgagaaagcttactaggtcggtctgtggctttcctgctagctttcctgtttgtcatacgacagtgagaccaatgccagctcatcatggcacagagagctttgggtgatctttgcagctggatgtgaggcccagcttggtgggctaatgccctggagaatgggtaccttgggtgttcagtgagaggcacggtaggagtggggtaggggtgagaggaaagaggcatgcggagctcagaggtagaagcacagcctgtttctaatagacattaaaaagaaaggacacttttggccgggcgctgtggctcactcctgtaatcccagcattttgggaggccgaggcgggcggatcacctgaggtcaggagttcgagaccagcctggccaacatggtgaaacctcacctccgctaaaaatacaagaattagccaggcgtggtggcacatgcctgtagtcccaactactcaggaggctgaggcaggagaatcacttgaacctgggaggcagaggttgtagttagccgagatcatgctactgcactccagcctgggtgacagagtgagaccccatctcaaaaaaaaaaagaaaaaagaaaaaaaagaaagaaaaagaaaggacatttctaactggacagggatgaccttcgttagagaaacagcagcaacttggccttcaccagccccaaacaacactgccaggttgagatcattactaccattttgcagaggacaaatgtgagcctcagaaacgaagaaactcccccagagtaggacacggccaagctgtttcttaccctccggcctcctgtgctctttccatgacaagcagaaagaagaggctacctttggtttaaggtctcgataaactttgacactgtggaaccaatccttcctccttgcaaacaacattcagttcaacttggtgaatctctattgaccatttattatgtgcaaatgcctgtatgcatgaaataaaattaaaaaataaaatatgcatgaaattaaaacaacacacaacaataaccaggcatggacacaaggcctaggaagggcttggcatgaacacactaaatcaatttagccgaggagaccattcccaatattctggagggggcaagtctgatattaactccccggggaaaagagccctttcctcgcttactcctggtaggaccaaacccaatatctagcactttttaccaactctttcaagatcctcccagagagttttttcatctgtatcagttctctcatctgaaaagtgagcctaataattactaccttgcaggagtttggggagtatgaagcaagatggtgactacaaaacgtgggcacggtgcctggtccggaagaggagctcagaaaatatctgttccagttcttctcttcctttcccaggcacgtgcctttgtgagttctcagtaaatgtcacctcactctccttttttaaaaaaataaaaatttttcggcatgtctcctataactcaggtacagggctaggcccagagatacagtgatgaatgagacacagtggtggttacgggacttaccagcaggataacgtgaaggctggcacggggtctttcaggcccagtaaaagcaagtttctttcattgtttattgcaaatttactgaactacgttttgttttcatcatttgtgttttcttaattttctctcaatgcaccaaactgtttaagacaaagctcgtttcaatttcataagagaaatgaattctagaagcagggtccaatgaagttggccattatttaacttcactaacgtgaataaaagcaacctatgcttttagtatacaaataattttgtaaaaggtaaagagtatcataatagaaatcaccctacacgatagccaaaaggcggaagcaacccaattgttcaccaatggacaaacggataaacgaaatgtgatctatggccaggtgcagtggctcatggctgtaatcccagcattgtgggaggccaaggatggcagattttttgagcccaggggtttgagcccagcctgggcaacatggcaaaatcctatatcaaccaaaaaagaaaaaaaaattagctggatgtggtggtgcatgcctatagtcccagctactcagaag

SEQ ID NO: 1085 - DNA, 36291 bp, Homo sapiens
caccatttattaaatagggaatcctttccccattgcttgtttttctcaggtttgtcaaagatcacatagttgtagatatgtggcattatttctgagggctctattctgttccattgatctatatctctgttttggtaccagtaccatgctgttttggttactgtagccttgtagtatagtttgaagtcaggcagcatgatgcctccagctttgttcttttggcttaggattgacttggcaatgcaggctcttttttgattccatatgaactttaaggtagttttttccaattctgtgaagaaagtcattggtagcttgatggggatggcattgaatctataaattaccttgggcagtatggccattttcacgatcttgattcttcctacccatgagcatggaatgttcttccatttgtttgtatcctcttttatttcattgagcagtggtttgtagttctccttgaagaggtccttcatatcccttgtaagttggattcctaggtattttattctctttgaagcaattgtgaatgggagttcactcatgatttggctctctgtttgtctgttattggtgtataagaatgcttgtgatttttgtacattgattctgtatcctgagactttgtagaagctgcttatcagcttaaggagattttgggctgagacaatggggttttctatatatacaatcatgtcatctgcaaacagggacaatttgacttcctcttttcctaattgaataccctttatttccttctcctgcctaattgccctggccagaacttccaacactatgttgaataggagtggtgaaagagggcatccctgtcttgtgccagttttcaaagggaatgcttccagtttttgcccattcagtatgatactggctgtgggtttgttatagatggctcttattattttgagatacgtcccatcaatgcctaatttattgagagtttttagcatgaagcgttgttgaattttgtcaaaggccttttctgcatctattgagatagtcgtccggtttttgtctttggttctgtttatatgatggattacatttattgatttgcatatattgaaccagccttgcatcccagagcctgggcaacttctagagaaaacagatttgtttgcctcacagttctgcaggctgtactggaagcatggcaccagcatctgtttcctgtgacggcctcaggctgctcccactctggcagaagggaaggagggtctgtctgtgcagagaccacagagatcacatggcaagagagggagcaagggggagggcgagcgatggagcttccaagctctttttaacaaccagccctccgggaactaatagagggggaacttgctaaccccatcatgtggggcagcattaatctattcatgatggatccacctccatgactcaaacaccttcccataggcccaaacttccacactgggggttaaatttcaatatttcagtgtgaggtttcaaagggtcaaacatctaaactaaagcagctgtatcctcagcatgttctatggtttctatgagagctgtaactgagaaagcaggagaaagctgggtctcccgccatcaggctgcttgtcctaaggagatgttccatgtggttacctgtcaatcaagaaatgagacaatccataaagaggaactgctatgattagcttcttattggattcccatcttcctccaggtatctgcagacacctgcatgttctgattgggacctcagtggtcatcttcctcttcatcctcctcctcttctttctcctttatcgctggtgctccaacaaaaagagtaagtctcacgaagcagaggccagagagctcagggccatgtggggaagcaggatgggagcacgcgggtgtgtgttcctcactggcaggatggtccctggcccaagggaggagccacagaggcagggctttctagagagagcaccagacaacctgcccctgccttcagctcacagaccattgcctggttctgaactgtatcctcacatcccctgcagctactgacatccagaagcttccatgacaggcagaaagtgggagacagaatcaatgggatgccaattgagagcacttcatgggatggggtcttgaactcagagagatagaatgtctgagtctggatgttggcagctgaagagcctcaggcacctacagcctccccctgtgggttggtgtctgcccatgaaatgaggacccagaagggccctccaagcggttttgatgacttccgtctcctacagatgctgctgtaatggaccaagagcctgcgggggacagaacagtgaataggcaggtaggtcctcctcggcccagcctcacggatacagtcttatccctaatagtcctgaaaaatgtgagcaccctccctcactcagcatttccctctctccaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcgataatgtgactctttattcgccaaaagtttccagtgttatcattactatgtccatataacctgatatgttctctactgggttctcagccctggactctgagcttctggaagcagggtggagcctcatttgtctctgggactccaatttccatccaaagatgcagcacataggaggttccaaggatcgtgaatcacatgaacaagtgatattcttactctctgcagacctggaaagctggcagagtcattccaagatgaaacatttgtagagtcataggccttgttagtctcatctccacagggacacatgtcaacacatcatctttcatactataaatatacagtcgctcctccatatctgtggggtttacaggtgtttattgaaccaaatataaatcaaaaatattcagagaaaaaatccacaaagttccaaaaagcaaaaatactatattgtgtggacacaagtgaggtggtgtgtaggctgtatcaggaattataagtaatctagagatgatttcatgtatacaggaggatgtgcatgggttatatgcaaacgctgtgccatttcatgcaacaggcttgagcatctgcagattttggtgtctggtagggaggggggtttcctggaaccaatcacccatgaatagtgaaggacaactgtatataattttcattcatcaattttataaataaatcatcaaaatgtatgataataagataaaaaattagcagtgtttttatggtgtgaaaataagcttagatttattttttcctgcttgtaaccctctggtccaatgttatttactgagaagacattctattccaccttaatccgcatggcagcctctgtcaactataaaaggactgtgtgtacacagatgtattttacacactcttttctgctcagtggctctctgtgtccactctcatgaggatgctgcactttatgtggccttatagaaccccttaaaatttggcagcctgaatcctctaatttctccttcctctttaagattgccattattattattattggctatttgcttttccatgtaaatttgtaatcatttttctcatttccaccaaaaacaatgcttgtaattttgttgtgactcccttacatctacaggtaagttctgtcctatagaaacataatgcaaaccacatgcattctttcaaacttgctagtatccaaattaaaaagctaacaagaaacagataaaattaatttaagttaacccaatggacccaaaatattattaacccaacagacccaaaatattaacctaatagatccaaaatattattttattatacaagtagactcaaaatattatcatttcaacatgtaatcatgtgtcatcttggaaaacatcagatccctgtctaggtgggcaaagatttttcttcgtaatatctcatttccacatttccacttggcacagaaactgcccccaaggctcaggatactaagatgcagtaggaatgggtagatgtatctggaggaaagtgactgaatgaaattgagacatcagagtctgggaaactcactagaactacagggacagtgtgggggagggaattgggagatgttgatcaaaggatacaaactatcaggtattcaggaggaatgggtctgaagatctcttgtacagctttgccactatggttgacaatactgtactctatacttgaaatttaccaggaaagtagatttttttttttaaatatggaacacttcacgaatttgcgtgtcattcttgcgcaggggccatgctagttttctctgtatcgttccaattttagtatatgtgctgccgaggcaagcatgggagagtagatttttttttttttttttttttttttttgagctggagtcttgctctgtcacccaggctggagtgcagtggcgcgatctcggctcaccgcaagctccgcctcctgggttcacgccattctcctgcctcagcctcccgagtagctgggactacaggcgcccgccaccacgccctgctaattttttgtatttttagtagagacggggtttcactgtgttagccaggatggtctcgatctcctgacctcgtgatccgcctgcctcggcctcccaaagtactgggattacaggcatgagccaccacgcccggctgggagagtagatcttaagggtcctcaccacaaaaaaaaaaaaaagaaagaaagaaaaagaaaccataggccgggcgcggtggctcacgcctgtaatcccagcactttgggaggccaagacgggcagatcacttgaggtcaggagttcaagaccagcatggccaacatggtgaaaccctgtctctactaaaaatgcaaacattagccaggcgtggtgacacaagcctgtaatcccagctactcaggaggctgaggcacgagaattgctggaacctgggagcggaggttgcagtgagccaagatggcaccactgcactctagcctgggggacagagtaagacttcctctcaaaaaaaaaaaaaaaaaaaaaacaataaccctgcgagatgatggatataactagcttgactatgatgatcatgtcaccatgtatacatacatcaaaacatcaagtgtaatacaccttaaatatatacaatttccatttgtcaatcatatctcaataaagctaaaagaaacctctaagtttcaactttattttcagaaagctgtgccatgcttacctcagtgcctaagtatactctaattcatggaaatggcctttaaaactgcagagagtggctgggtgcagtggctcacgcctataatcccagcactttgggaggcggaggtgggcagatcacgaggtcaggagttcgagatcagcctggccaacatggtgaaactctgtctctactaaaaatacaaaaaatagctgggcatggtggcaggtgcctgtaaatctgagatactcaggaggctgagacaggagaatcgtttgaactggggaggcagaggttgcagtgagccgagatcctgccattgcactccagcctgggcgacagggtgagactccatctcaaaaaaaaaaaaaatactgcagagagttaaggccctcactggacactctccggtacctctgaggtcagtggatagagaagcagctccccttcttcttcctcgaaacaaaggcctccttccttcttaggtgtttgagacaaattctccacacaggtgcagctgagtgctgtaaagtcccactgagagttgaaggtccccactgccagtcacagttcggtcccactgagggttgaaggtccccactgccagtcacagtttggtcccattgagggttgagagtctccactgccagtcacagtttggtcccattgagggttgagagtctccactgccagtcagtttgggcttattagggtttatgctgtgcacggagaatggaacctaccaatcaactcttagtgaccagttagacagattcaaggcaaatttccctgctgggaaatcccaaatcccaaaatatgcagagaccaatagatgcctcaattcttccgtgtctccgtctaaatccttgggtcactgtgactcctgtagttatgtggcttgtaattccttgggccgtagaatggctatgataggccctgtgctaaggggactggtgacagttgagacaggaacatggaagctatagtagtcagggttctccagaaaaaaaaataatcaacactaataatgatagatatatagataatgattgatagacaaataatgatagatatataatgatatcacaaataatgatagacatatagttggataatgacagatatataatgattgatacacagatagggtatttatatattggcttatgcaactatgtagactgacaggtcccatgatctgccatctgcaagctggagacccaggggagtccacgtgtagttccagtctacgtgcaaaagtctgagaaccagtagagttagtggtatacgtaacagtccaaaagctagcaggctcatgccgggcatgatggctcacgcctgtaatcccaacactttgggagaccaaggcaggcagatcacctgaggtcagagttcaagaccagcccggccaacatggtgaaaccccatctttactaaaaatacaaaaattagccgggcatagtggcattcgcttgtaatcccagctactcagaggctgaggtacgagaattgcttgaacccaagaggtgaaggttgcagtgagccgagatcatgccacagcactccagcctgggtgacagagtgagactctatctcaaaaaaacaaacaaacaaaaaaagctggcaggcttaacatctaaagagtcaatgttttagtgagagttcaagagccagaaaagactgatgtccaggcaaaaggaacttcatcttacattaccagttcaatgttttgttctattcaggtcccacctgattgaatgaggccgactcacattagggagagcaatctgctttataaattacactaattccattgataatctcattcagcaacacccccacagacacacacagaataatgtttaaccaaatatctcagcaccccatggctacgttaccattcctgttccacaaaaggaggaaacaaaagaacaaaaccacaccaaatgttgtggtaagttgacaaaatctgttccagcccattagtaaatattggccactgaagttcctgaaattcaacaattagtaagtatctctctcccaatagaaagccacgtcatttgtaaaccataacaatagcttttgtttttttgagacacagtctcgctctgtgttgcccaggctggagtgcagtgatcttggctcactgcaacctctgcctcctgggttcaagtggctctcctgcctcagccttccgagtagctggaattacaggcacccgccaccacacccaagtaattttttatatttttagtagagactgggtttcaccacattgaccaggctggtcttaaattcctgaactcaagtgattcacctgccttggcctcccaaagtgctgggattacaggcatgagctactgcacccagccaacaatagtatttttaattaggtcatcctgcctttacaatctctgcattttaaatactcaactaagagtacagccattatttgtctttcacccaaagtcccattcaagtgagaacaaaggaatgaataaataaggcataagtaacaaaacaacaaaaaaagaaaattagaatgcggtcaatttcatgcaatcatcaacaccaaatttccagaacgtagtatttccaaatttcccgaacgtaaatatgtatgtggaaattaacaaaatgtggcaaaacaaaaggtcacttaaatttgcacaaatgaaacagtcaacatggaagctgatcggctttctgaaatatgggacaagctcaggacttcaaaatacttcggcgttggaagggctaagttatgatgtattaaaatgaaaataaagtggggcgcggtggctcacgcctgtaatcccagcactttgggggaccgaagtgggtggatcacgaggtcaggagatcgagaccatcctggctaacacggtgaaaccccgtttctactgaaaatacaaaaaaaattagccgggcgtggtggcggatgcctgtagtcccagctactcgggaggctgaggcaggagaatagcatgaacccaggaagtggagcttgcagtgagctgagatcacgccactgcactccagcctgggcgacagagcaagactccgtctcaaaaaaaaaaaaagaataaataaaataaaataaaatagtagaaggtttaattaggaatatttcactctccatacctgaagaattcgtgatagccaggagtctacaatcaaaataacataaataataagataaaaataaaattaatttgaagccataaaaaaagaatgagttcatatgttttgtggaaacatggatggagctggaggccattatccttagcaaactatacaagaacagaacaccaaatacagcaggttctcacttataagtggaagctaaataatagaactcatgaacacaaaaaagggaaaaacagacaatggggtctcctttagggtggagggtgggaggcgggaaaggagcaggcaaagtaactattaggtaccaagcttattacctaggtgatgaaataatctgtacaacaaacccccatgacacaagtttacctgtataacaaaccttcccatgtacccttgaacctaaaataaaagttaaaaaaatactcaatgagcaacaatgtacattatttgaggataattatattaaaagcccagacttcaccactacacaaaatatccacgtaataaaatttcacttgcgctccttaaatttatacaaataaacaaaaaagtataataaaatagtagattctttctttagagatgacaaatagtgccagagaaaatgcctccacactctggcattgagatcatctccaggataagggtatactgcatgcctggtcaagtccaagtaaatatactcagaccatgaatctcagagatgaaacataggttcagaacagacaaagccacagagcttttgactaatggcccagtgaaggcaatgtctgcctgtatggtatccaccaccttatattctgtcccaagcccgtctatttggatgtagcatctggttcaaagatgaatttgaacaccattagacactggcttaatgaaaattcacttctcattcgtttctcatctgaaacataaatagaaatataggtcttaggcaggaggatttcttgatgccagaagttagagactaccctggccaacatagaaagaccccatctctatttaaaaaaatatacatatatatgtcttctcttgggctccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttggtgagtttcagagtaaaagtgggttagaggggaagatagagaaatcccaaaataatcagggtgtctcttaacagtgtgactaggagattttagtggctgccaaggagattctgatctccttagtggaaaggccgtctttgtcaatgtatctataactttgtctctacccaagcccaagctagcttgtggggctcaaggtttaatatttgtattaaacctatagtgtgttatctgggattcatgatggtcccaaggttcttatcaaggagagacttagaggctggaatctgaaaggtaaaaataaagaatgaacctcaaaactgtgattgttgtggaaggaaaacatatgatagaaccccatatagaaatatggttactagtattttgttgaagatttttgcatttatgttcaacaaagatattatccagaagttttctgtttttgttgtatctctgccacattttgttatcaggataatgttggcctcatagaatgagttggggaggagtccctcctccaggatttttttcaatagtttcagtaggaataatactagctcttcttggccgggcgcagtggctcacacctgcaatcccagcactttgggaggccaaggcaggcggatcacaaggtcaggagatcaaaaccatcctggccaacatggtgaaaccctgtctctactaaaaatacaaaaaaattagccaggcgtggtggcgggcgcctgtagtcccagctactcgtgcggctgaggcaggagaatggcatgaacctgggaggcagagcttgcagtgagccaagatcatgccactgcactccagcttgggcgacacagcgagactctgtctcaaaaaaaaaaaaaaatgccagctcttctttatatatctggtgggattgagctgtgaatccatctggtactggtctttttctggtctgtcattacagagggtgatttgtcgtaaaggttggaaatggaagcttgatttttcataaatctctctcttccagtgctctgtctgggccagaggattcaggcacaggaaggtaagtgtcctgtaaatctctcccagcccctttagaccctcttgggagctctaggataaagaaattgaagaatagcctgaagcaccattcttattttaatccccattctagttgtttctgctgtgcttctcttgcataatttctatctcactttgttatctccaaacccttcagactcattaatgctcaggcctggatttatagttagtccttgcctgtgttagactgtccatgaaggatctgtaatttactgaatgctcaaactgcaagaatgaggaagtcaggagtcatctgcccaatatccttccttatgctgattctattttgttttagcaacccacttcctcccgtcacttcatttaaaaggatgctgccatagtctaaccctactgaacactctagcattctgtagtactactgcagtactaagcatgaggcagtcttagtgtactactgaatattctgccaccccaactactactgccttagcctcctaatgggtgtgagccccacgtccatccatgtcttctctcttccagctccttctaaagcctgaattatttgtgtgttgaacaatactcattcttcctatccatgagcatggaatgtttttccatttgtttgtgtcatctatgatttctttgaccagtgttttgtagttctccttgcagagatctttcacctccctggttagctgtattcccaggtattttattctttttgcagtaattgtgaatggattctattcttgatttggctctcagcttagatgtttttggtgtataggaatgctactgatttttatatattgattttgtatcctggaactttgctaaagttgtttatcagattaagaagtgtttgggcagagactgtggttttctaggtatagaatcatatcacctgcaaacagggatagtttgacttcctttcttcctatttggatgccttttatttctctcttgcctgattgctctagctaggacctccagtactatgttgaacagaagtagtgagagacggcatccatgtcttttgccagttttcaaggggaatacttccagcttttgcccattcaatatgatgttgactgtgagtttgtcatacatcattcttattattttgaaatatgtttcttcaatgcctagtttgtcgaggttttttagcataaagggatgttgaattttatcaaaagctctattgagaggattatgtgtgtggggagggttgttctatttatgtgatgaatcatatttaagatttgtgtatattggccgggcactgtggctcatgcctgtaatcccagcactttgggaagccaaggcttgtggatcatgaggtcaggagatcgacaccatcctggctaacacggtgaaacctcgtctatactaaaaaacacaaaaaaattagccaggcgtggtggtgggcacctgtagtcccagctgctcgggaggctcaggcaggagaatggcgtgaatccaggaggcggagcttgcagtgagccaagttcacgccactacactccagcctgggcaacagagcgagactcctatatcgaatcaaccttgcatcccagaaataaagcctacctgatggtggtggattagctttctgatgtgctgctggatagtttgctagtattttgttgaggatttttgcatttatgttcaacaaggatattgtcctgaagttttctggttttgttgtgtctctgccatgtttttgcatcaagatgatgctggtctcatagaatgagctggggaggcattcctcctcctgaatatttttggaacgtttcagtaggtatagtaccagctcttctttatatatcagatgggattcagctgtgagtctgtctggtactgggctttttctggtctgtaggatttttattactgattcaattttggagctcattattggtctgttcatgtattcaatttattcttggtttgatctcaggagggtgtatgtgtccaggaatttctccatttattctggattttctagtttgtgtgcatagaggtgttcataatattctctgatgattgtatttctgtggggtgagtggtaatataccctttgttgtttctaattgtgtttatccggatcatctctcttttcttctttattagtctaactagtcatctgtcttactaattttttcaaaaattctactcctcgatttgctgatcttctgaatgctttttcgtgtctcaatctccttcagctcagctctgattttggttatttcttgtttcctatgagctttggggttgatttcctcttggttctcttagttcctcttgttatgatgttaggttgttaatttgaactttttctagctttttgaagtgggagtttagtgctataaacttcccccttaacactgccttagctgtgtcccagagattctgctatatttacccaaaaattccagaacagactgcttaatttccatgcattgtacagttttgagtggttttcttagtatttattcctatttttattccactgtgctctgatttcgcttttctggatttgctaaggattgttttttttttttttgaaatggagtcttgctctgtcgcccaggctggagtgcagtggcgcaatctaggctcactgcaagctccgcctcccaggttcacaccattctcctgcctcagcctcctgagtagctgagactacaggtgcccgccaccccgcccggctaattttttttgtatttttagtaaagacggggtttcactgcgttagccaggatggtctcgatctcctgacctcatgatccgccagccttggcttcccaaagtgctgggattacaggtgtgagccaccgtgcccagcctgctaaggattgctgtatgtctgattgtatgattgactttagagtatgtgccatgaggcaatgaaaacaatgtagattctgttgttttgggggtggagagttctgtagatgtctgtcaggtccatttgatccactgctgagttcaggtcctgaatatctctgtttgcctcaatgatctaatactgtcggcgggatgttaaagtctccccctattattgtgtggttgtctaagtctcttcgttggtctctcagaacacgctttatgaatccgggtgcttccatgttaggtgcatatatatttaggatagttaggtcttcatgctctttttttaattttttttttctttttctttttgattcagcagttgggctattacacactccttagcagattccgacttccgtggccactgtcctgctatggtcttcatgttgaattgaaccctttaccatgatttaatgcccttctttgccttttttgatctttgttggtataaagtctgttttgtctgaaattttaatagcagctcctgcatttttttttttttttggctttccatttgcttggtagatttttctccatttctttactttgagcctatggatgtcattgcatatgagatgggtttcttataggcagcataatgttgagtcttgcttttttttttttttttttttttgagatggagtctcactctgtcacccaggctggagtgcagtggtatgatcttgactcactgcaacttctgcctcccaggttcaaatgattctcctgcctcagcctcccaaatagctgggattacaggtgtgtaccaccacgcccagctattttttttttttattagagatgggatttcatcacattggccaggctaatgtcgaactcctgacctcaaatgatccacccacctcagcctcccaaagtgccagggttacaggcgtgagccactgcacctggcctcttgcttctttatccaacttgccactctctgcattttaattaggacaattagtccatttacattcaaagttagcatttacatgtgcagattttttcctgtcatcatgttgttagctggtttggttattatgcagacttgtttgtgtggttgttttatagtgtcactggtttatgtacgtaagtgtgttttctattggctggtgatggtcttttctttccatatttagcgttcctcttaggacctcttgtaaggcaggcctgatggtaataaattccctcagcatttgcttgtctgtaaaggatcttatttctccttcacttatgaaacttagtttggctgggaatgagattcttggttggaaattcttttcataagaacattaaatataggcccccaatctcttctggattgtagagtttctgctgaaaggtctgctgttagctcgatggcattccctttgtaggtgacctgccccttcttttttgctgccttttcacatttttttttttttttttgagactgagtcttgctctgttgcccaggctgccaggctggagtgcaatggcgtgatctcggctcactgcaagctccgcctcccggattcacgccattctcctgcctcagcctccccagtagctgggactacaggtgcccaccaccacgcccagctaattttttatatttttttagtagagatggggtttcaccatgttagccaggatggtctcaatctcctgacctcgtgatccgcccgccttggtctcccaaagtgctgggattacaggcgtgagccaccgcgcccggccgacatttctttctttcatttctaccttgaagaatctgatgattttgtgtcttggggatgctcttcttgtgtagtattttgcaggggttctctgtttcctgcatttgattcttggcctctctagtgacgttggggaagttttcatgaacaatacactgaaatatgttttccatgttccttgctttctccccatctctttcggggatgccaatgggctatttggtctcttttcatgatcccatatttcttagaggttttgttcattaatttttattctttttcttcatttttgtctgactgaattagttcagagagccagtattcatgctctgagattctttccttattttgctttattttgccattaatacttgtgatcgcattatgaaatctcgtagtgtgtttttcagctccatcagatccgtttggttctttcaaaatgaccatctcatagattagcccctctgtcattttattgtaatctttaggttccttgcattgggtttcaactttctcctgaatcttgatgaccttaatttctatccatattctgaattctatttctgtcatttcagccaggtaaagagcccttgctgggaagcttgtgtggtaatttggaggaaggaagacactgttgctttttgagttgatggagttcttgctcagttctttctcatccatgtgggctaatgttcctttgagtgtgctgcaatttgaatttttttcttttttcttttaaccgtgatgtaatttgagcacagtcagtagacttcttttctggatggtttcagagggctggggcttcgcacagggtctttatttatagctaaattcttgtccttggtttcacagggaggtatattagcgagcatttttggtgttgaagtttgggctgcaatccggtaaatgatgcttcagcacaacggccagtaggtcattcctcatgattgccgctgtgctccctctcacgctctgaaagtgcgggctcctctcccacccaagtgctggctgcagatctgggctcggcactcccaggctgcacatcacagctctggggtgagctcagactttatgttccctccgtggcttgggggcagcaggggaagggaccttagcagcggttgtggcagacggcctttcacttgtcccttggaactccaccccagagagatgtggagccactatcagtgcgatgagccaagagtgaggcgactgcactgtgggtccaagctaggggccctgcctagtgatgagcaggggggacaggtgggtcacaggggtgacagactggcctcttctccttagggcagtttgccggaggtgtggttgaagcactcagagtctttgctccttccccagtctgagggcagcaaggccagtaccaccgcagtggcagcggcagagtgaccttccgttgcctctgggagctccgccacagagaaacgcagactcacagctgctgggaacgctccgccagagggtggggctgttgtgccgcggaatcaagctggggcttggtgaagagcagggggttgagggctcacagggagaggagactgagctcctctccgtatggcgactgcggtgtgctggaagcatgaatgaaggccgggcgcggtggactcacgctcggaatcccagcactttgggaggccgaggcgggcggatcacgaggtcgggagatcgagaccatcctggctaatctggtgaaaccccgtctctactaaaaacacaaaaaatgagccgggcgtggtggcgggcgcctgtagtcccagctactcgggaggaggatgaggctgaggcaggagaatggcgtgaacccgggaggcgcagcttgcagtgagccgagatcgggccactgcactgcagcgtgggcgacagagcgagactccgtctcaaataaataaataaataaatagaagcatgaatgaaggccccaggctccttgcttcttccccagatcacgggcagcagaggcagaacccttgccatggcagtggcagaggggctgtcagttgcctctgggagccactccccagggaaacacgagccaccaccagtgagtgtgctgagggcggggcagctgctctgcactcccgagctgggggctctgcctggtaaagtgggggtgggagctcacggggaagagagactggactcctctctgtctgatggctgtagcataatgaccgggcccccacacatgaaaaagaattctgggaactcaaaaagccagtgtgtccccaccatggaccccttggattgtgtttcaaatttctcctcaatttcgaagagcgtcctggccatccagattctgaattctataaccctcgtttcattcatctcaatgtagctaagaaccagatttctggggaactatcgagttgccagagttcttgtgttgattcttttttttttcttttttgtggcagagtcttactctgtcgcccaggctggagtgcagtggcacgatctcagctcactgctgcaaccttcacctcccgggttcaagcgattctcctgtctcagcctcctgagtagctgggattacaggtgtgtgccaccacgcccggctaatttttgtatgtttagtagagcccgggttttgtcacgttggtcaggctggtctcaaactcttgacctccggtgatctgcccacttcagcctcccaaagtgctgggattacaggtgtgagccaccgcgcccggccttggtgttgattctttctcttgtgtgagggctggtgttcctttaactgtgatgtcggttgagtacagtcgcttggcttcatttctgggtgttttcagatgccaggactctgcacaggatctttatttgtggctgaatttttcccttcattgtatactggcaaaatttttcagtgttgtattttgaagtgtgatccagtaggtggcacttaaaagggttggccagcatacaggatcttagccacaaggctcttttgtagttttgtttcgttttttgtttcgttttttgacacagggtcttgttctgtcgcccaggctggagcacagtggcacaatctcggctcactgcagcctctacctatcaggctaagtgatcctcctgcctcagcctcctgagtagctgggactacaagcacgcagcaccataaagagaaaatttttgtaattttttttttttttttgtagagatggggtttcaccatgtttaccaggctggtctcaaactcctgggctcaagcaatctgcctgccttggccccctaactcttgtattttgacaaagtcggcagtagtgctctgtggttgtggggaggggtgactccctcgcctggtccattcttgggccttggaggagcctcctacagtcactggctctgcacccactgtttcctttgttaggattgttctgcccacggggctccctcaggcagggcatggtgggcagacaggctgtatccttccccggccagccctatggagggaggaccaccccgcacctctgcaggctgatgaaatcaggtgtttcacccctctgaacgttctgagaatgagggctcctcacggcttggtcgccacctaacgtggtgagtccttctcagcaagggtgattggagccacatgatctgccatctcagtgcttcccaggggaacacagagctactgggcatggtggctcacacgtgtaatcccagtactttaggaggccgagatgggcagattgcgaagtcaggagactgagaccatcctggataacatggtgaaaccccgtctctactaaaaatacaaaaaaaaattagccaggcgtggtggcgggcgcctgtagtcccagctactcgggaggctgaggcagaagaatggtgtgaacccgggaggcggagcttgcagtgagccaagatcacaccactgcactccagcctgggcaacagagtgagacttcatctcaacaaaaaaagaaaagaaaagaaaaacacagagctgcacaccccacagagttcaggcagaagggggtctgcagcgctggaagacccagcaagcctggcccgtctggctgcaagtggcaggggtgggtggagtcacccacttcaccatctgggtgctttccagggaagcatgcagccacgaccccgggcagagttcaggcagaagctgggccactatgctggaaactggccttgagccttgtggagtaacggcaggtggagccatctcactgctcccacgcaccatgcccgtggcctctgcgggggctgtggtaacggcacccgactgctctggggtcaatgcctgcggaggtccccctggcttcagtgttgcctctgcaaaaaccccagttgcagccaggtgcggtggctcacgcttgtaatcccagcactttgggaggccgaggcaggtggatcacttgaagtcaggagttcaagaccagcctggccaacatggtgaaaccccgtttctactaaaaatacaaaaattatccaggcatggtggtgggcacctgtaatcccagctactcggaaggctgaggcagcagaattgcttgaacccgggaggcggaggagctgagattgcaccactgcactgcagcctgggcgacaaaacaagactctgtctcgaaaaataataacaataaaaaataaagatggcaaccatagacactggagactactagatgggggggaagaaagggggttgaaaaactgcctattgggtactatgctcagtacctgggtgacaggatcaatcgtactccaaacctcagcatcacaaattatttaaatttttctctttttttaattttttttgttgttgttgttgagacgaagtctcactctgttgcccaggctggagtgcagtggtgtgatctcggctcactgcaagctctgcctcccgggttcacgccattctcctgccccaatctcccgagtagctgggactacacgcgcccgccaccacgtcctgctaattttttgtattttcagtagacacggggtttcaccgtgttagccaggatggtcttgatatcgtcaccttgtgatccacccgcctcggcctcccaaagtgctgggaatacaggcgtgagctaccgcacccggcctaaatttttttttaaataaagaatggtaggttcttcacaccctaatgtatttttacttctcccacagagaaggaaaggaatggcttccccatggcgagccacctcagtctgggctttcttttcttccaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggtaaggaaacatccagggtccacagccctggtgtgatttttttcttatttttaatagagtatttttcaagaagttttagatttacaaacaaaaaaaaattgatgattgcttcagagagttctcagccatctggcaccccacttcccccagagttaacatcttacattagtatggcacatttcttaccattaatgaacaaatatcgacacattcccagctacagtctacagtttatttacattttcttagtttttacctgatagtctttctctgttccagaatcccattcaagatttcacattgcggctgggagtggtggctcacgcctgtaatcccaacacttagggaagccgaggcgggtggatcacccaaggtcaggagttcgagaccagcctggccaacatggtgaattccccgtctctactgaaaatgcaacaatcgccgggcgcggtggctcacgcctgtaatcccaacactttgggtggctgaggtgggtggatcacctgaggtcaggagttcgagaccagcctggccaacacagtgaaacctcgtctctactaaaaatggaaaaaattggccaggcctggtggcacacgcctgtaatcccagctacttgggaggctgaggcaggagaatcgcttgaacccaggaggcagaggttgcagtgagccaagatcacaccactgcactccaggctgggcgacagggcgagactccatctcacacacacacacacacaaaagatttcacattgcattcaggtgtcatgcatctttttttttttttttttttttttttgagacggagtcccgctgtgttgcccaggctggagtgcagtggcacaatctcggctcactgcaagctccaacctcccgggttcacgccattctcctgcctcagcctcccgagtagctgggactacaggcgtccgccaccacgcctggctaattttttgtatttttagtagagatagggtttcactgtgttagccaggatggtctcaatcttctgacctcgtgatccgcccgcctggcctcccaaagtgctgggattactggcgtgagccaccacgcccggcctccgaaaatgctgggattacaggcatgagccaccgcacctggcctcccaaagtgctgggattccaggcgtgagccaccgtgcccagcaggtgtcatgtatctttaggtttgtcttggctgtcacagcttctcagatgttgctggttttccatgaccttgtcagttttgagggtagtggtccattattttcaagggtactcccactactggaaattgtctgatgttttgctcatgactagactgagttatgggtcattgcaggcaagaccacagaagcaaagtgccatttcatctcctcatagcaaaggtttaaactgtccatgggaacatgactgtggatgttgagctggctgttgttgaaagcctggctgaagtagtaactgtggccagacaccgtggctcgtgcctgtaatcccagcactttgagaggccgagatgggcagatcacttaagcccaggagaccagcctgggcaacatagtaagaccccatctgtacaaaaaatcaaaaaattagctgggcatggtggcatccacctgtagtctcagctacttgagaggctgagatggtaggatcacctgagcctgggaggtcgaggctgcagtgagccgtgattatgccactgccctcagcctgggcgatagagtgagaccctctctaaaataaataaattctaaaaaagaaaaaagaggctgggcactgtggttcacgcctgtaatcccagcactttgggaggctgaggcaggtggatcacctgaggtcagggattcaagaccagcctgaccaacatggggaaacctcatctttactaaaaatacaaaaattagctgggcgtggtggcgggtgtctgtaatcccagctactcgggaggctgaggcaggagactcacttgaacctcggaggtggaggttgcagtgagcggagatcatgccactgcactgcagcctcagtgacagagcgagactccatctcaaaaaacaataataggctgggcgcagttgctcatgcctgtaatcccagcactttgggaggccaaggtgggcaaatcacctgaggtcaggagttcgagaccagcctgaccaacatggagagaccccgtctctactaaaaatacaaaaattagctgggcgtggtggtacgcacctgtaatcccagtttctcgggaggctgaggcaggagaattgcttgaacccgggagacggaggttgcagtgagctgagatcacgccactgcactccagcttgggcaataagagcgaaactccatctcaaaaaaatatataataataacaataagaagaagaagaaaagaataaaggagaaaaggtctttctaatagctcactcttttctctcttaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggttcaagcaattctcctgcctcagcctcctgagtagctgggaccacacagacagggtttcaccatgttggccaggctggtctcgaactcccgacctcaggtgatccacctgcctcggcctcccaaagtgctgggattacaggcgtgagccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctcaagaaaaaaaaaaaaaacacggttgggcacgatggctcacgcctgtaatctgagcacattgggaggctgaggcaggtggatcacctgaggtcgggagttcgagaccagcctggccaacatagtgaaaccccatctccactaaaaatacaaaaattaaccaggcgtggtggtggtgggcgcctgtaatcccagctacttgggaggctgaggcaggagaatcacttgaccagggaggcggaggttgcagtgagccgagatcacgccactgcactccagcctgggcaacagagtgagactccatctcaaaaaaaaaaaaaaaaaaaacacacacaacctgcccataatcacctccttcccagtttatagcacttccctgggaagcacagttccttgcccgtgaacacagtcttgctgactgatcagtgtggtgctggcgaagcatgagctcattgaggggatgcttgagggagtcccattttggcaagcgaaaaggaaaatgagctcccgtttcagggctctggggttgggatggaatggaacacaaccaccaaccattcatctccttgaattgtgtctccagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattacaggctcccaccatcacgcccagctacttttacagtatttttagtagagacggggtttcatcacattggccaagctggtctcaaacttctgacctcgtgatctgcccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatgcaaagtatttctaactttctttattgactgcttttcacactttatacaagttctggcccatatcttcagtttgttctgatttttttcaccaggtgtggtggcaggtgcctgtagtcccagctactccaggggctgaggcaggagaatggcgtgaacctgggaggcggggcttgcaatgagctgagatcacgccactacactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaactcatataagtcgttttgctgacagaaggaccttgtttggaaaaagcgttttcagaataataaagttcctgagctcttcagaaaagtattttattgtcctgtaaccacagtaacaagtagccaccaaaactgatttttaacccatcatcaatgacaactcatctctgtgaagatgctctttttttttttttttttttttgagacggggtcttgctctgtcacccaggctggggagcagtgacgtgacctcggctccctgcaacctctctttcccgggttcagcaattctcctgcctcagcctccccagtagctgggattataggcacctgccaccacacgcagataatttttgtatttttagtacagacgggtttcgccatgttggccaagctggtcacaaacttctgacctcagggtgatctgcctgcctcagcctctcaaagtgctgggattacaggagtgagccacaaagcccggccactccatacgttttatattgttatgttaccatcagtcaggcagctccttgcttctaaaagtcatccaatcagactcatttcagtaaacacccaagcatgagtgacaaccaatcaaagtaatatcttcccaatgaccacacttttccagatgacgtcaagccacagaaggccctgaaaatccaacaatctctgaagtatacatttcccaggctgagcgcagtggctcacacctgaaatcccagcactttgggaggctaaggcaggcagatcacgaggccaggagttcgagaccagcctggccaacatggcaaaaccccgtctctactaaaaatacaaaaattagccaggtgtggtggcacgcacctgcattaccagctactgaggaggctgaggcaggagaatggcttgaacccaggaggcggaggttgcagtgagccaagatcgtaccaccgcactccagccttggtgacagagcaagactccatctcaacaacaacaacaaaaatggttgaaataaaacttctatgtgttgaacgattcctcttttaggcatagagtttcagttttacaagatgaaaatattctggagatctgtttcaaaacaccgtgaatacatttaacactgctatactgtacacttacaatggctaagatggtaaattgtatgttatgtttttactacaatttttttttttttttttctgagacagagtctcactcttgttgcccaggctggagtgcaatggtgcggtctcggctcaccgcaacctccgcctcctgggctcaagccattctcctgcctcagcctccagagcagctgggattacaggcatgcgccaccacgcctggctaattttatatttttagaagagacggggtttctccatgttggtcaggctggtctcgaactctggacctcaggtgatccacccgccttggcctcccaaagtgctgggatcacaggcgtgagccaccacgcctggcctacaatttttttttaacttttttttctgagatggagtctcgctcttgtcacccaagttggagtgcagtagtgtgatctcggctcactgcaacctctgcctccctggttcaagggattctcctgcctcaacctcccaagtgtgggagatcagtcagagtagcagaagaaattataggaataggaagcagcaaaccttcttggaaggccagggaggttggcatagcttcagatagtttggctgaaagcagccagattctcttttcaggagccaaacagcttagggcgcagatacaaaggaatgcggagtattttatctaaatagcttgcttagtcatatggtcctaaaatcaacctttgatcattctcgggcaagatggccctctccagggaggtggcggggggcggtgaccaggttaattacccacaggtgtgttgactcaaagcctttgttaattaaatctgtgctaaataaatgcaagcgttgccagcttagaggggctgcactctctttggctcctagtgccggcagccccctggcctgctctttcactgaatattggtgtctgaggacgtgtctcatctgtcgtacagctgggatctgcagaacagatcccccccgcacccaagaagctgggattacaggcacccgccgccacgcccagctcatttttgtatttttagtagagacagggtttcaccatgttggtcaggccggtctcgaactcccggcctcaggtgatctgcccgcctcagcctcccaaaagtgcttggattacaggcatgagccactgcgcctggccttagaaaacttctttttcttttttttttttttttttttgagacagagtttcactctgtcgctacgctggtgtgatctgggctcactgcaatctccgcctcccaggttcaagtgattcccctgcctcagcctcccgagtagctggaactacaggtgcgcaccgccacgcccggctaatttcttgtattttcgtggagacggggtttcaccatgttggctaggctggtctgtttcatgcgcgtccgtgtgaagagaccaccaaacaggctctgtgtgagcaacaaggctgtttatttcacctgggtgcaggcaggctgagtccgacaagagagtcagcgaagggggataggggtggggccgttttataggatttgggtaggtaaaggaaaattacagtcaaaggggggttgttctttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatatgatggcttagcttgggctcagaggcctgacattcctgtcttcttatattaataagaaaaataaaacgaaatagtggtaaagtgttgggatggtgaaaattttggggggtggtatggagagagaatgggcgatgtttctcagggctgcttcgagcgggattaggggcggcgtgggaacctagagtgggagagattaagctgaaggaagattttgtgttaaggggtgatattgtgggattgttagaagaaacatttttcatttagaattactggtgatggcctggatgcagttttgtatgaattgaaaaactaaatggaataaggaaaggagaaaaacaggtataaaaggtctaagaattgggacgactcaggacatctgattagagagtgcctaaggaggttcagcatagccttgccagcaaagattatttatttacttcaagagttaagagtggcggtttggggatagcaccaggagatatcagctgtgatggcttggaaaaacagtgtaaaccagcagtgtaaacaagagcagggcatgtgtgagtagttgagaatggtgaataggagtatgactagacagaagatagtagggatgacaagttttttggggcacaatctaagttggtctggtgtctggaatgagactggggcttaataaaaagcagtgtctatacaggagctcaaatgtgctgtaccttgtagcattctgaggacaggcctgaattctgagaaaagaaagtggtaaaagtattgtccagtcttttttaagttggtggctgagcttggtgaggtgtgtttttaatagaccattagtccattctacttttcctgaagactgaggactgtaagggatataaaggtttcactgaataccaagagcctgaaaaactgcttggctgatttgactaataaaggccggtgtgctatcagactgtatagaggtgggaaggccaaactgtggaattatgtctgacagaagggaagaaatgacctcggtggccttctcagaccctgtgggaaaggcctctacccatccagtgaaagtgtctacccagaccaagaggtattttagtttcctgactcagggcatgtgagtaaagtcaatttgccagtcctgggcgggggcaaatccccgagcctgatgtgtagggaagggaggggacctgagcaatccctgaggggtagtagaatagcagatggaacactgataagtggtttccatgaggatagatttccaggatggaaaggaaatgagaggttctaagagatgggctagcagcttgtaacctacatggaagaggctatgaaatatcaaccgaatagaatgggcctgtgaggctggaaggaggtattttccttggtctaagaaccatttgccttgtgtgggaagagattgatgggtggaagtttcagtgggggagtaggtgggagtgactgatgagaaggagaaaaactggctgtgggggacagaaattggcatgctagctgcttgtctagctaccttatcagcataagcatagatgtgagagacagaagttggaaagctagctgcttgtctagccaccttgtcagcataggcattgtctagagcaatgggatctgatgacttttgatggcctttgcagtgaatgactccagcttcctttgggagtaaagcggccttgagcagagtttttattaaggaggcattaaagatggaggacccttgtgtagtgaggaaacctctttcagcccatatgaccgcatggtggggcagaatatgaaaggcatatttagagtcagtataaatattgatgcatagtccttttgcatcagtgagggcttgagttaaggcaactaattcggcttgctgagaggtagtggagggggcagagcggtagcctcaatgatagatgtggaagatactatagcatagcctgcctttgctggtgagtggcgattaggcctggtggaactgccatcaataaactaaatgtgattagggtgaggaataggaaagaaggaaatgtggggaaatggggtgaatgtcaggtggatcagagagatacagtcatgggggtcaggtgtggtatccggaataatgtgggaggccggattgaagtatgggccagtaacaatggtgattgtgggagactcaacaaagagtgagtgtagctgaaggagccgggaagcagaaagtatatgcgtcaggtgtgaggaagaaaatagatttttggaagttatgagaactgtagagagtgagttgagcatagtttgtgattttgagggcctctaaaactattaaagcagcggcagccgctgctcacagacatgagggctaggctaaaacagtaaggtcaagttgttcggacagaaaggctacagggtgcggtcctggctcttgtgtaagagttccgaccacgctaaccatgcctaggaaggaaaggagttgttgttttgtagaaggtgctggggcttgagagatcagtcagacacgatcggcatggagagcacgtgtgtttttatgagaattatgccgagataggtaacagaggaggaagaaatttgggcttgactgaagtaatgggggctgtctgtgaagctttgcggcagtacagcccaggtaatttgctgagcttgatcggtgtcagggtcagtccaagtgaaagcgaagagaggctgggatgaagggtgcaaaggaatagtaaagaaagcacgtttgagatccagaacagaataatgggttgtagaggcaggtattgaggataggagagtatatgggtttggcactacggggtggataggcaaaacaatttggttgataaggcgcagatcctgaactaatgtgtaagccttgtctggttttaggacaggtaaaatgggagaattgtaaggggagtttataggctttaaaaggccatgctgtagcaggctttaatccttttaaagcgtgctgcggaatgggatattggcgttgagtggggtaagggtgattaggttttaatgagatggtaaggggtgcatgatcggtcaccaaggagggagtagaggtatcctatacttgtgggttaaggtggggggatgcaagaggaggaagcaaaggaggctttggattgggaagaatggcagcaatgagatatagctgtagtccaggaacagtcagggaagcagataatttagttaaagtgtctcagcctaataagggaactgggcaggtggggataactgaaaaggagtgcttgaaagagtattgtctaagttggcaccagagttggggagttttaagaggtttagaagcctagctgtcaatacctacaacagttatggaggcaagggaaacaggcccttgaaaagaaggtaatgtggagtgggtagcctccatattgattaagaaggggacgggcttaccttccactgtgagagttacctagactgtgatggtcctgtaggcttctgaggcgatcgggatcgggcagtgtcagtcttcagctgctaagccgagaagatctgggaaggagtcagagagccttgggccagagttctagctgctctgggagtggctgccaggtgagttgaacagtccgattttcagtggggtcccgcacagatgggatgcggcttaggaggaatcccaggctgtggacattccttggcccagtggccagatttccagtacttgtagcaagctcctgggggaagaggttctggaggaacccctggcagctgcggttcaggcgtttggagttctcgtgtgctggagatgtggctggggtttgtctcatctggatactggagtggaggcaaggaattgcaactcagaaatatgttgctatttggctgcctctactctattactgtacaccttgaaggcgaggttaattaagtcttgttgtggggtttgagggacagaatttaatttttggagctttatttaatgttgggagcagatttggtaataaaatgtatattgagaataagacggccttttgacttagggtctagggctgtaaagcgtctcagggttgctgccaaatgagccatgaactgggctgtgtttttaaatttgatgaaaaagagcctaaacactatctgatttgggagaggtcagataaagaaaaaggagcattaaccttgactatgcctttagcttcagccacctttttaagaggaaattgctgggcagttgggggagggctagtcatggaatggaactgtaagctggaccgggtgtgaggaggggaggtgataaaaggattatagggtggaggagcggaggctgaggaagaattgggacccagctcggcctggcgaggaggggagatgtcagatgggtctgtagaaaaggaagattagaaagactcagcgatgcttggggttgggactgacgggacaggcgggagggaaagaaggaagatttgggacgagttgcactgggcatagagactagggagggaccgatgtgtaaaagaatgcctggatgtcaggcacctcagaccatttgcccattttacaacaagaattatttagatcttgtaggatggaaaaattgaaagtgccgttttctggctatttggaaccactgtcaagtttgtattggggtcaagcagcattgcagaagaaaataaggcatttaggttttaggtcaggtgtgagttgaagaggttttaggtttttaagaacacaggctaagggagaagaaggaggaatggagggtggaaggttgcccatactgaaggaggcaagcacagagaaaagagagagtagagacatggagggaaggggttcaggggttcttaccttccagaaaagcgggaaaggggtcagggcacagaagtaagggattggggtgcagagacaagaggtcggggtgtggaaataagggatcggggtgcagagataagacgtcagggcacagaaataagggatcgggggattcttgccccctagaaaagcggtacttgccactaagggtgaaggagaaggggttggggggttcttgcccccccagaaaagcagagaaggggtagagacacagagaaggagttgggggttcttgcccccccagaaaagcagtacttgccactaagggtgaaggaccaaggcaggcatccccatgtggtcagacacctctgaaacgtgggtgaataatcagagaggtgtccctgcgtgattaaacaccaagggaaggctgccttcccgagtccatgaccggcgctggagttttgggtccacgaataaagcgcgtctcctgtctctaccagaaaaggaaaggaactgaaattaagagaagggagagattgaagagtggaaaggagaaagtggttgagggatagtgagagaggttggagaagagagtaaaaagaggctgcttactggatttaaaattggtgagatgttccttgggctggttggtctgaggacgagaggtcgtaggtggatctttctcatggagcaaagagcaggaggacaggggattgatctcctaaggaagatcccctgattcgagttatggcaccaaatttcactcacgtccgtgtgaagagaccaccaaacaggatttgtgtgagcaacaaggctgtttatttcacctgggtgcaggcgggctgagtccagaaagagagtcagcaaagggagataggagtgcggccgttttataggatttgggtaggtaaaggaaaattacagtcaaaagggggttgttctctggcgggcaggagtggggttcacaaggtgctcagtaggggagcttttgagccgggatgagccaggagaaggaatttcataagataatgtcatcacttaaggcaagaacaggc

SEQ ID NO: 1086 - DNA, 183818 bp, Homo sapiens
gaaagaaagaaaagaaagaaagagaaagagagaaagaaaagagaaagaaaaggaaggaaagagaaagagaaagaaaagaaaagagaaaggaaaagaacgaaaaagaaagaaagagacaaagaaagaaagagagaaagaaaaggaagaaagaaagaaagaaaagcaaaagttgagttctgatgctgtcactgtgtgaccttgagcaagtcacttcacctttccgagctctccccactccatagcaattcaatgagtgatcataaacgcctccactcttttagataatagggataagaataaacactctgttctcgggcgctctgagaataatactgctaactctggctggcggaggagtagatgagataaggacagaaaagggctttgtcagcgtaaagccattcgcaaaggggaagctctgttccagttggaaggcagactggctttgccaggtgagcagtagctagacagttttctttagcagaaaagtgctctgtggcatttgtctgcagttaaaacaaaataaaacagagtcacacaaaaatcttctaaagaagtgaaagtcagactgggtggaggaagacagcccactcatttgcaaattgcacatgtgagattctagtgagactaaggtggggtgtgaggcatgctctggccatgggttccaccttgggctgggaagggccagtgggaggaagttgaggcccttagcaggccctgattccccacctctgctgaggaacaacacgcagatgtggagtgaagggtggctgccgccttcattctcttaccacagaaaggtaagctgtgctttgggcagttagggctgtgtgttctgaaggattgaagagatctccaagatgcagagctggcttctagagtcggttagactagggttcaaattcagattctgacacttaatacccacaggagcttgcataggggactttctctttgagcctcagtttcccaacttgtgctacagggatgataatgttagtacagtagttctcctttgtccacagtttcactctccatggtttcagtttgctacagctaactacaataaaaaaaacatggaaaattccagaaagaattcatgttttacattgcacaccgttctgagtagcgtgataaaatctcaccctgtcccaccctgtcctgcctgggacgtgaatcatccctttgtccagtgtgtacacatgctgtctacgccacctgctcatggtcctcttagttatcagattgaaaaagcatgggaaatataggattcagcactgtgggcagcctcacgcattcactggaggtcttagaacatgtgtgtcacagataaggggggactattgtatcacactcagtaacacacacagtattcttgagatttaaaaaaggatgcggtggctcacgtatgtaatcccaacacattgggaggcagaggcaggcagatcacttgagtccaggagtttgagaccagcctgagcaacatggaaagacccctatctctacaaaaaatacaaatatttgggcgtggtggtgatgtgcacctgtggtcccagctactcacaaggctgaggtggaaggatcgcttaagcctgggaggtccaggctgcagtgagctgccatgacaccttcgcaatctgccttggtgacggagtgagaccctgtctccaaaaaaaaaaaaaaaaaaaaaaagaaaaaagaaaagaaaaaagataacccatgttaagatacttagtgtggcatttcttacatctgtgaggatcaaaggagagactatagatacaatcacttagcccactgtgtgaataaacagacagtagagaattgctgtcatgaaaattgctctgccctgccccttctgatctccaccttggctgctggattaagagtgggagggttggagtgaaggcctgtgccttcttttttattttttgagtcagggtctcactatgttgcccaggctggtctccaactcctgcgctcaagaaatccttccacctcagcctcccgaatggctgggattgcaaggatgagccccccggccggactcccatgccttcttcaagcagcctgcctgccagcagcccctgccttatctcaggtcaaggctggctggtggcgccattttgaatctggaactgcaaaatgccattatcttttgctacctggtggggaaggcctgccctctcagcactcctcctcttcttcccacctgagtgggcttcctcccagcaccctacccagatggtctcaggaccttcacagccagactggggctggggggtgagcacacccacctgtctagggagctgttgagaaaccagctcctccttcctctcagggtggaggcaaaggaaatatgcttctttatattttgcttctctttcttggtggcagggtgtggacattggtgtaaaattacaactgagaaggcccccgccctggggtgaggactcctggggccccaccctggggaggacatgaattcattttgcaagtcctgactctctatctctatttcctttggaaagcgggcttctaaatctggaaccttcagcctgcattctttggatgttcagtcatgaaggtgcagtgatgatcatgataatagcagtattaactccctcagttgatacttatttgctaagtgctatgcccccagtttctcatttatcagaaactcctggaagacatgttaacaatggcggttacctgtaaggaaacaaactctgggtagctccaggtccttgcagttaatcataactgttcccgggggacttttttagtatccacgctctgccactctgtgatctcaggcatatgactacccctttcagcctcagttgccttacctgtaaaatggggataataacaacacctcctagggttcttgtgaagactaaatgagataacatcagtactccagaaatggaagcttctattactatggccaccactacttttactattacaaatatcctgacattaatataatgactacaatagtggaccccaggacactgagaaaccacagaatgaaggttcacctgggacccctctcacagagctgggattcctgaattgtgcaagtgggtttcacatatagaaatggaagtccaagcattaggaaaaataactaatgcatactgggcttaatacctaggtgatgggttgataggtgcagcaaaccatcatggcacatgtttacctatgtaacaaacctgcacatctgcatatgtaccctgcaacttaaaaataaataataaataaataaatatgccaggtgcagtggctcatgcctgtaatcccagcactttgggaggccgaggcaggtagatcacctgaggttaggagttcgagaccagcctgaccaacatggtgaaaccccgtctctaccaaaaatacaaaattaggctgggcgcggtggctcatgcctgtaatcttagcactttggtaggctgaggagggcagatcatgtgaggtcaggagttcaagaccagcctagccaacagggtgaaaccctgtctctactaaaatacaaaaattagccgggcatgatggcaggtgcctgtaatcccagctactcgggaggctgagacaggataatcgcttgaacccaggagacagtggttgcagtgagcggagatcatgccactgcactgcagcctaggggactgagagagattccgtctcaaaaaaaaaaaaaaaaagtaactcggtgtggtggcacatacctgtaattccagctacttggggggcctgaggcagaattgcttgaacctggaaggcggaggtgagctgagatcatgccattgcactccagcctgggcaaaaagagtgaaattctgttttaaaaaaacagattaaaaaataaataaataaataaaagaaaaaaaagaaagaaagaaatggaggtcccaaggttaggatcttggtgagaccactatgggttgccaacttattcactggtttatttcaacatcaagcctatctctactcctgcactgacccacaggaaagccaccagtagccaaaggtggctgttgagcacttgaaatgtgccagtctaagctgagatgttttttaagtatgaaatacatattggatttcaaagacagtacccaaacaaagtaaaaatataaaaatactttaaaatatcaattgcattttgaaatgatagcattttagatcttctgggtagggcgatcagcttgttctggtttgtcagggactttactggttgcaacactgataggtctgcatcccaggagataccttagtcctgggcaaacctggtcatttggtcaccctactatcgggttaagtatataattgtcattaattttacctgtttctttttactttttttttctttttttgagatggagtcttgctctgccacccagggtgcgatggcgcagtctcggctcaccgcaaccacagcctcctgggttcaagtgattctcctgcctcagtctccggagtagctggggttacaggcatgcaccaccatgcccggctaatttttgtatttttagtagagatgggatttcaccatgtcggccaggctggtctcgaactcctgacctcaggtgatccacctgccttggcctcgcaaagtgctgggattacaggtgtgagccaccgtgcctggcacctttttactttttgaatgacacttagaggggagccttagcacattagtggctgttgggcggagttgatcacatttgctcatttcacctagcagggaggagggccctgggagtcacactggctgataagttttgatggatgagtgcgaatggaggaaagtatgaggaactgagggccttggtcgtgggggaggaagaggttaccaactctgcctggagtgaatctgctgctcaggggcccacggaatggacaaaaccatgtcccaggcttggggagaccacggggacccttgggcaaaatacagcctttggagttagacccaggttcaagtccagctttgtccagtcattaccagctgaccaatagcaaatcttatcacttaatcactaatgaggggaacaagcattcaaatatagtcatgtgtacataatgacatttctgtcaacaacagacagcacaacacattactgttgtgtttgtggtgatgctggtgtaatcataaccttctgtgctgcagtccagtaaaaatatagcacaggccgggggcggtggctcacacttgtggagggccacctccacaagttgcagtgagctgagatcgcaccactgcactccagcctgggcaacaagagtgaaactccatctcaaaaaaataaaacaaacaaacaaacaaacaaacaaacactttttattgcctgggtgtggtggctcacgcctgtaatcccagcactttgggaggctgaggcaggaggattgcttgagcccaggaattttagaccagcctgggcaacatggcgaaaccctgtctctacaaaaaatacaaaaattagctgggcatggtggtgcgcccctatagtcccagctactcaggaggctgaagtgggaagataacctgagcccagggaggtcgataataaaattttaaaaatttttagtagagatgggatttcaccgtgttggaccaggctgatctcgaactcctggcctcaggtgatctgtgcacctcgacctcccaaagtgctgggattacaagcgtgagccactgtgcccagccaacatacttgtttattatcaaatattatatactgtacataattgtatgttttatatatgtatgtatgtgtgtgtgtgtatatatatatatatatatatatatattttttttttttttttagacagagtcttgctctgtcacccaggctggagtgcaacggcaccatcttagctcactgcaacctctgcctcctgggttcaaaccattctcccgcctcagcctcccaagtagctgagattacaggcactcgccatcatgccccactaattttttttgtatttttgtagagatggggttccaccgtgttggccaggctggtctcgaactcctgacctcaggtgatccgcctacctcagcctcccaaagtgctgggattagaggcgtaacccaccgtgcctggccaataaaaagttttaaatacagaaaaaagcttacagaataaggatttaaagaaagaaagaatttttgtacagcttataatgtgtttgtgttttaagctgttattacaaaagccaaaaagtcaaagaattaaaaaatatataaaattaaaaaattacagtaagctaaggttaatttcttttttatttttcttttttcttttttttttttttttgagacggagtctcactctattggcaggttggagtgcagtggcgcgatctcggctcactgtaacctccacctcccggattcaagcaactctcctgcctcagccttccgagtagctgggactacaggtgcgtgccaccccacccagctagtttttgtattttcagtagagacagggtttcaccacgttggccaggatggtcttgatctcttgacctcgtgatccacccgcctcagcctcctaaagtgctgggattacaggggtgagccaccgtgcccggcctctaaggttaatttcttattgcagaagaaaaagattaaaaaaataaacttagtatagcctcagtgtacagtgtttataaagtctacagtagtgcacagtaatgtcctaggccttcacagtcacgtaccactcactcactgactcacccagagcaaattccagtgctgcaagctccattcatggcaagtgcccatacaggtagactatttttatctttttatttatttatttagttagttaatttttgagatggagtctctctctgtcttccaggctggagcgcagtggtgcgatcttggctcactgtaacctctgcctcctgggttcaagcaattctcctacccaagcctcccgagtagctgggattacaggcgcctgccaccatgcctggctaatttttgtatttttagtagagaccgagttttgccatgttggtcaggctggtctcgaactcctgatctcaagtgatccacccgccttggcctcccaaagagctgggattacaggtgtgagccaccacgccccgcccaattttatcttttatatcgtatttttattatacccttttaatgtttagattcacaaatacttattgtaacaattgcctacagtatcaatatagtaacttgctgtacaggtttgtagcccaggggcaacaggtgatcccctctaacctggatgtgtggtcgcctgtaccatctaggtctgtgtgaacacactctctggtgttcctatcatgacaaaatcctctagcattcctgttgttaagcaacacatgagtgtagttactgagtccctattgtgagccagggccgggtaatatattctctcccccaggctgttgtgaccatttccagtgagtcagttcatctgtctgaacaaagcactctggcattgattgtatgcaaataacctgttacagaatggttctacccataaactggctggcctcttttgagcaaccctcaaagttgcaagcccttgccctctgtcctggtcaacctctcttcctcagaagcttgcctgctctgaactcctctcccaaaccgggttaggagccccttctctggtatcagggcaccctgtgcctctcttacagacttgcattatggttctaactgtgctgtgtggcctgggcaagccgctcaaccactcggttatttcttctttttttttttttgagacagagtttcactgttattgcccaggctggagtgcaatcttggctcaccacaacctctgcctcctgggttcaagcgattctcctgcctcagcctcccaagtagctgggattacaggcatgcgccaccacgcccagctaattttttgtatttttagtagagctagggttttttcatgttggtcaggctggtctcgaactcctgacctcaggtgatctgcccaccttggcctcccaaggtgctgggattacaggtgtgagccactgcacccgacttgaaagaaattgctttgcactgtgcttggcacagaggaacagcaggtgttcattcaatgcttgctgttgtaattattcaggcttttatcaacagagggctggcctgagactctgccatatctcagaacctagcacagaacctggatgagtacagagtaagtgctcaatgtatgctgtggtaggcagagtaatagcccccaaagacgttcacatcctaactctcaggacctgtgaacattcccttaaatggcaaaggggaattaaggttgcaaacaggattagggttcttaatcggctgattttaaaatagggagatcatgttggactaaccagctggcccaatgtcatcttaagagtccttaaaagggccaggtgtggggaggttgaagctgcagggagccgagattgagtcatagcactccagtttgggagacggagtgagacaaaaaaaaggctgggcaaggtggctcatgcctgtaatcccatcactttgggaggcagaggctggtggatcgcttgaggtcaggagttcaagaccagcctggccaacatggtgaaagcccgtctctattaaaaatacaaaaattagcggagcgtggtggcgggtgcctgtaatcccagccactcaggaggttgaggcaagagaattgcttgaacccaggaggaggaggttgcagtgagccgagattgcaccactggactctagcctgggcaacggagtaagactccatcgcaggaaaaaaaaaaaaaaggaagatgtgcctatggagagaggactgtctgaggtctgagagactccacctgacattgcaggcttgcttttctgttttttttttttttttttttttttttgagacggagttttgctctgtcgcccaggctggagtgcaatggcaccatctcagctcactgtaacctctgcctcccaggttcaagcgattctcctatctcagccttcccagtagctgggattacaggtacgcgccaccacacctggctaatttttgtattttaagtagagatggggttttaccatgttggccaggctggtctcgaactcctgacctcaggtgatccacccaccttggcctcccaaagtgctgggattacaggtgtgagccattgtgcccagcccattgcaggctttcacagagaaaaggggcaggagtcaggcgcgcaggcagcttctggaagttagaaaacacaaggaaacagattcttccctacagcctccagaagggaatgcatcctgccaacactttgtttttagctcagcaagacctgtgtgggccatcgaacctacagaactgaaggataatacatttgtgggtgtgtgttttcaaagacactaagttttggtaacttgttacagcagtaactggaaactaagacatgcaacaagccttattgttcatttttaccaccactactgggctgttggttatggtggaattacacttttctcttccattaggctgtgtgaactccttgaggttgtgcaatacgtttgtctgatttactactggttagcaggctctgagaagaatggctggtacacaggcggagctcaataaaagcccttactgaattttattcaatctatatgtggatgaagacctccgccccgcgcgcccctcccgcaagtcccactgaggcccgacccattctgtccggctcccagcccccgcgggtccccccaccccggggctgaccgggtgattcaggcagccctacatcctgctggggtggtgggcttcgagcgcgggtcccaggacgcagtggggcgcagtgcctgcggcaggcggcaggaggcgagcgtggcccaggaactcccgcgggagggtcgggacggggcggggcttgggggcggggcggctcagcgcgcaggcgcggggccaggcgcctcgcgcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcggtgagttctctggccgggcccaggcgcccactgtggtgccgacccgcccccgcgcgtgcacccctgcggagggcgaggatttcccgcagcgcgcccccacctcggagataagggggagtcgtccccaggggtgggttatagggggcctagaccccctccccggtgtcttcccctgggatgggacctgttgtgatcgctccccgccatccgccccagcagtgcacctttggctggctaagggttgagggtttgggctggggtcacaggaggagaggtggagttgttgcatttctctacacctggggcgcccctatgggagctaggggactagaaaccctcgttcgctgtccccgggggcgggccctagggtcagatgctccgcggagtgctctccctgctgcgcccaggttggtgctctcagaggcagctgaatgggcgttggctcggaggccgggccgtgagacctgaggaggaaccgttctctgcgcctggggcctccctgcccaggtggagacagagacctggtaccttcccctgccgtcgctggaatgggtgtgggccccgaggttgcaagggtaggcgcgggtgtgtgtcctcgctctctctgctcccagctcagctctggccgcgcgccgcaggttgaacccactccttgctgccgaagttataatttagagatggtggtggtaacagtaattgctgtcttgtagggagcccaactagcgtccactgtgtaccgtcagccttctaagttatctccgtccctacgcatcctgccatctggggtgaggctagacccattttacagataagggggtccggagggttaattgacctgtccaaggtcagcaagtagggcccagctgagaactgaaggaagtgggcaacagttagaaggaggctttgttttcctctcctctcccaaacctacaccagggtcttcctgaaaggagggagggaattggtgtctcttgctggactgggccttctggtctggggaggaagaataaggatgaagtctcccttgtggtctgagatagttggaggcttcccagagggccacaaggctactgatagtgtgggctgtgatggtaggggctgtgatgtgtgtgtgcatgtgggcgtttgtgcagagaacgtgtgtacacacatagcatgtgtgtatagcatgtgcatatgcaaagagtttgcatgtacacggaatgtatgcagagaatgtgtatccacctacacgtgtgtatgggtgtgtgtatgtgtgtgtgtgtatgtgggtgggtgggtgtgggttggggcagaggagggttctgggtctggatctcttcctaaggagaaccagggactggccctggcctgtgatttgggtctcttcctgaggaaaccaggtcactatagtgaccctagtgacaggaagaaagggagatgggtgtggctgccaggactttctccagtggaaaagggattccctctaggctgagcctcccctgggccttagggcctcacccttcccttcccccacacctgtcctggcaggtaaggctgcttcctgcttcctgggcccagatggcagccgcaccacccagctgatctccagcagccctccccctccccaagggtggcttccctgcagaagaatctgcatggcacgctgttgtcttctttctggggtccatctcctgtactggggagggagaacctcagaatctcctggaattctttaccattcagaaaccagcctcccctctgaagaatcccaaggcccagctgggctcaatttggatctgttctttgttttaaaaatgtgtatttatttaattaactgaataaagaaacttaaagtaaaccagaagtatccaaatacgacatgaaatctctaaaacaacaacaaaaccaaaccaaaccgcagcactagcaaatcacagactgcctgatctacccactgtttacagaggcagcagctacttccagcactgtctctcatcagtgcccggggctgtgggtctcattctagattttgtctacatttttttacatggttctcctgattccctgctccccctccccaccaccgccccgcctggagatggagccttgctctgtctccaggctggagtacaatggtgccatctctgctcactgcaacctccacctcccgggttcaagcgattcttctgcctcagcctcctgagtagctagaattacaggcacatgccaccacgcccggctaatttttgtattcttagtagagatggggtttcaccatgttggccaggctggtctcgaactcttgacctcatgatatgcccgcctcggcctcccaagtgcgggggttacagccctgagccaccgcgcccagcccggtcctccttttattttcgaatccactcaggccctagctactcccattgtcccgacgttccagggttagttagcttcccttcctctgtgctgggcctgtgggctgttggcagcttcttcctgttcctaccacaacttgcattctatttttttcctttttaatgatttcttggatcatattccccagagtgacattcctgggttaaagggtgtgaccacatttatgacttgtatcattggctgcctaattgctctcccgagagatcttgcaacaaacaggttttccagcctctggagaccacagagagccctggcaagtgccaggactgctgtggggataaagcaggaggcttcttccctaagctcttgaggctgttgtgggtaatggtccttcatccttcaaggcaaagttacctccagcttggactaaggttcatatattcactgcttaggttgtgttacattgtgctgacaatgacactagcttcaatttgggggcacctactgggtgttaagtgtgttctgttgatcaccccattgaattttcatgctaatcattgattgacagcaactactgccctatctctaatgatctgcttctgcaagtcacttagagagttcagggcttaacactgtcctgggcatgtgttgcttagaaaatggcgcctgttaattaaataaggtgctgtctaataattatctcaaaagtaatgccagggctggatgccgtggctcacgcctgtaatcccagcactttaggaggccaaggtgggtggatcacctgaggtcaggagttcgagaccagcctggacaacatggtgaaaccctagctctactaaaaatacaaaaattagctgggcatggtggtgcacacctgtagtcccagctactcgggaggctgaggcaggagaattgcttgaacccgggaggtggaggttgcagtgagccgaggtctttgtgtaactgcactccagcctgggagagcgagactctgactcaaaaaaaaaaaaaaaaaaaaaagtcatgcccgaatggtttgcacaccgaagggacgttcaaaattaggggagaacagcctggttgtttgtttctgtttggttgatcatactcttgccatggttagtattattatctttatttaaagatgggaaacaggagtgaagccacttgtggaggtgacccagctagctagtaaatggtgtctgaaacccaggtctgcccagctgttgaattggagccttaactgacttgccttccagtttcagagatgagtaaaatacagcttttctctccacatcagagggtccctgcaacactaggtttgcaagtcttaggtgttagggtggtggctggatacccacactctgaacctctgaccttggacaaaatagggatgtcagggccttccatgattggcaggatgaatcctctgggctgtgatgaaggtctcacaagttgagagtcagccgggaattaagtgggatcagtttgcctcttgtgttttcctcattgtgttttggttggttggttgagatttcctactacccaatggatgatgttttattccatcgtcagggaaggtatcattgaatgaatacagggttttgtatgctttggataagaccagacagttgtggagtcattagaattgtgtacatgcctccagctctgagataggtggtgtttcaacagctgccagaggactctggcttttctgcctagaattcactgaaagacaaccctggctattgattcacatttgtggttcattgtaaggtaggcccctaggcgccatccaaaagttgaaaatttccttacgtttcttgttatgtgatgggcagttcatagtgaggactcagtgtctttaattccagctgtttgccaggagttggcagttttatttacttgtttttccaaaaacctttctgacatggggcagtccagccagctgggaggaaaaggggtctctcagcccaagaatgatgatcaaggcctagaagtttgggtggtgtgttttgttttgggcctttagagaaaggaattgtttccttttcagaggatgtggtctaaccctaaagtttacttgactgacttaaaccaggccagcgccagagcaggcagggtgcgtgttcccaagacttcgggtcactaggcagcttccagggtggtgggtcactggtccagtcagctccttttccttcctctcccttttgtgctactactaccaaaataatttccaaataaccttaagttctgctctttcttgcatgtctagcagatgccagcatgtcttttgggtagtacagagagtgcttaaaaagtagcaaagttggccggacgtggtggctcatgcctgtaatcccagcaccctgggaggccaaggtgggtggatcacctgaggtctggagtttgagaccagcctgaccaacatggagaaaccccatctctactaaaaatacaaaattagatggccgtggtggtgcatgcctgtaatcccagctacgtgggaggctgaggcaggacaatagcttgaatccaagggcagaggctgtgttgagctgagatcatgccattgcactccagcttgggcaacaggagcaaaactccatctcaaaaaaaagtagcaaagtagcatgctttgtcagaattattaataacaagttgtgggccatgtacaaggtggcacattagcattcaatgtcacttgtgtagtagttaagagcaaggattcttggttcaaatcccacttgccactaagtagctattagaaacttctgtgccttggtttccttatcactaaaatggggataataactaccttcttaaaaggctgttataaagattaaacaagttaataatttttaaagtgcttggcacagtttatggtacatagtaagtgctctgtgaatgcctgttaattaaataaggcactgtttaataatctcaaaagtcatgccggaaaggtttgcacactgaaagggcatttgaaatcagcgcgctctggggagaacagcttggttggctaaggttgatcctacttgctaaaatacggctatggactgcctagagggtgtcacctccttgaaaggggctgccccctgctatgttatggctgcctccagggcccattcacaccagctttgtttccaagctggacagggagctccaggcgtctggtcattccagcctcccacccctttcaggaatctctgggccaaatcacttccagatggtggttgggcctctgtggagttctcccagcaacggcggagccagcatgccagtcggcagccgccttcgttcttggagagtctgagctaaaggagggctttgatttggagccaaattgtgtctcttgggtcctggttttgtgctgtgaggcaggtaccatggagtgggctgctggcttagttgaggatggctgccctgctccttaggggagcagatacccagggcctggagcctttaggccctgcctccagtagctccatggtcagggtgccagtcaccttgcgttttctttttctttttttttgagatggagtcttgctctgtcgcccaggttggagtgcagtggcgtgatctcggctcactgcaacctctgtctcccggggtcaagcaattctcctgcctcagcctcctgagtagctgggattacaggcgtgcgccactatgtctggctaatttttgtatttttagtagagatggggtttcaccttgttggtcaggctggtctcgaactcccaacctcgtgatccacctgcctcggcctcccaaagtgctgggattacaggcgtgagccaccggacccagccaactttgctacatcagtttccaggtagcatatcctaggcaaaactggatgtagcctagtgattcagggcctcggtctgaagctagactgtctggattctaatccgcactctgcctgataccagctgtgcaactctagtccactgctttaacctttctgtgcctgcttccctgtctataaaatgcaagagcaaaatagttgctatcttagagttgctgggagcattatatttgatgaggttaagttatagcacagtgttgtcattatcactatgaatattgtgcttttggacccaagtccaggactttgtcttgtcttctgtctattctctggccagtccagatatttttggaatcctattgctgtcatctggtgtgttagctgttccctttctccaagttcagaacgtctgatgaagatgtctcccaagatcctttcttcctttcctcattcaacaaatatatgaaagcccatctctgaaccaggccctgtgctgggtgctaggacaacaggaatgagaggatcatgtcctttgcttgcctcagatactgctcagaggagaagagacaagcaagcagggagagccatgcagaggagagctgctcaaaccttcaggcccatgctcatcacctggggactttgttaaaaatgcaggtctgattgagtaggtgctggggtgtaggctgggattctgcgtttccagtcagcttcagatcctgctgtctgtgcaccgtgctgtaagtagcaaggatctaggtgccaagccctctgaaaaggaggagcacctgcccctaggctgggtatgggtaatctagaaggttccctggaggaagggacctttcagctaagacctaaagcgtgactagaattaggcaggcaaacagacatttacacaggagcagacgagtgtgtcagtttagaggtcttgatgctcaggtcagaggggcagtggaggggtgggcagggctggtttaccaagggctttctgaaactggaggctgcctatggggtatgctccttgagtttgtttgtttgtttttttttttgagttggagtttcaatcttgtttcctaggctggagtgcagtacagtggcatgatctcggctcactgcagcctccatctcccgggttcaagagattctcctgcctgagcctcccaagtagctggaattataggcatgtgcacacctggctaattttgtatttttagtagatatggtgtttcaccatgttggtcaggctggcctcgaactcctgacctcaggtgatccacccacctagcctcccaaagtgctgggattacaggcgtgagccacggcatccagccccttgtttagtgtagggtagtaaacccagccaaaaggggtcgtttatctcaggggtctcacctgttgctccagtcattcctattagcagaaagttttgtatgtgccccttcctcatatatatatatatttatatatgtatttatatatatttataagttataaacatactctactgtcaatttgtatattaaatattagtaaatcttagtttctttttagatgacaaatccaaatataaaatctgtttttttcctggctctaacggattatcttatgtccccttggggtggacatacctcttttggaggctcccgtgaaggtttgtgtttctacatttagtttttttcttttttccatattcttgttattctgcttttaattttcatctttgagtattctaaattaaggagctggatctgtaattgtaacaccttcccccaacaataagtttaactaatgaaaatattcaatggaatgagccattttaatctaaatggggctatttcctgcttttataatgattacagttgcttttcatgacattctactagaagccatcttacattactgttgtaaatctagttattcattaaacgggcacagtaatccctaaattggctcaggttattgtataataaacaacaatactttcttcttcaggagcttgagaagtgatcttgtatttttaaggtgcctaactaacttttcatgggaaactgagtccatgtactgggaagaaagctttttggggaaaatgattagaaaaccaaatgggtctctttatgactgaagtgatgaaccagcaggtgagagtaggtatagatggtacagaggacggaattactgggtattttaatcaggcccacttagtatcacaatttattattctattctatttttattattattttttgagatggagtttcgctcttgtcatccaggctggagtgcagtggcgctatctcagctcactgcaacctccgcctcccgggttcaagagattctcctgcctcagcctcccaagtagctgggattacaggcatgcgccatcacacctggataatttttttgcatttttagtagagatgaggtttctccatgttggtcaggctggtctcgaactcccgatctcaggtgatccgcccgctttggcctctcaaagtgctgggattgcaggtgtgagccatcgcgcctggccagtgtcaggatttattctgtgggaggggaggaggacaaagaaaaatactgagctatgtttgaagctcctgccctctaagagccttagagcagctgacttaaatgtgttcctttgataaactgtagatggttgttgtaactcttctgcaaactgtttatttttaaaaacaatttgatgagattttacttatgcccattgtttgagtacagcatttaccaaagaacaattttggccagatcccatgcagtagaatgcccttggccaaaattttcttgtactataagcaaagaagcagtttggtttttcacttaggcaagactgcctatcagactgagttattgtgacagagccgctgactctctccctttccccattatcaaaatctggcttttctaagcagcgcatgtaaaaagcttggcaaggaggacccttgtcctcctacatattattctttggctcttcttggtaccaagaatacatacaaataatgctggctgtgtactgaatgttgaggtgtgcactgttgaggatattcatcctctaatataacatctagtatttctcacaccttccgtctgctgagcattggtctatcttacttatactacttctaatcctcgtgaactctgcaaaactagtggctttacatctatgagaaaagaaaagaacttttatcggaagaaggtgagtccttttaaagtatcaggcctggaaagacattaaatgagacagcgaacacatcctgctaccctctttgagctatgtattcattgacttttttttttttttttttttttttttgaggcagagttttgctttgtcaccaggctggagtgtagtggtgcaatcttggctcactgcaacctctgcctccggggttcaagtgattctcatgccacagcctcctgagtagctgggattacaggcgcctgccaccttgcctggctagttttggtatttttatttttatttatttattttaagacagggtctcactctgtcacccaggctggagtacagtggcgcgatcttggctcactgcaacctctgcctcccgggttccagcgattctcctgcctcaacctctccagtagctgggattacaggcgccttggcaccacagccagttaattttttgtatttttagtagaaacggggtttcagcatgttggccaggctggtctcgaactcccaacctcaggtaatccgcctgctttggcctcccaaagtgctgggattacgagtgtgagccattgtgccccgcctatgtattcatttcttaaaattggttgctggctaggtgtggtggtacatgcctgtcctataatcacagcactttggaaggccggtgctggaggatctattgaggccaggagtttaagaccagcctgggtgagatcacatctctacaaaaaaaaaaaaaaaaaaaaaaattatctggatgcagtggcacaagcctacatagttgtagctgcttgggaggctgagttgggaggatagcttgagcccaggagtttgagtctgcagtgagctatgattgcgtcactgcactctagcctgggcgacagagtgagacccgtttctaaaacaaagaaattgctattgtcacaattagttataaattaatctaataatgctgcacgcagtaccataatccacaccctatagcttaacgatggatggccaaccactaatcaatgctatttctgtacgccaatgagaattcctgacaaaaaactttgtatcagccccactccctgtctgtcccctcttttgcttttaaaaacctgcttgtaacaaaggccaaacagagctcatatccaaggttacttgggcctgagtctttcaggcagctgtcttcactttggctcaagtaaactctttaatagtttaaattttaagcctctgcctctttcttttaggttgacatctgtttccattttacagatgagaaaactgaggctcagctctgcctcactttacaggtcaggcttaatccctaatccctgcctgcatcatgctgtaaaggacttttgtgtcaaaactgagtttcacactctgtaaagtaaaatagatatattgtagtgagagggtgtagaagagactgttttctgcttctgtggattttttttcttcctgttttgctttgctccaaactttactcatttgcgcttgattcatgtgaaactgaaatttccttctacagaacaaaactttttgggggctacttaccatatcttttcccacaccgtggagctctgactgggaccttttccagtttttggagacattgctccagttctttccctgcctttggtttccagggggcagtaatgtcaccgcaggtgtggacagtagggaccagctaaaggttgctttggaggaggtgggcagggcttttgtttgtgaggtctagaaaccagaggtgaggaaggaggtgtccctggaactccccctggctgcagggctcacagcacacaccatgacaccacaggggtgtgtgtgtgtgtgtgtgtgtgtgtgtgtgtgtgtgtgtgtgtgtgttgaggggagtgttgttgagagccaactatgccaggagatccttggtgacagcggacataggcacagctatgctctgtcaggaatgagttcacccacacccttttcttctgctaccttgtttaactggtgggagggtgtgctgggttgtgtttgctggtgagcccagcaactgcacccttctttccaggcctagcacccagcctttatcagtctcatggccctggcacaagtgggcagcctgcttccaatccaagcaggcagctttccgctcatctgcaggtagcctcgtgctgtggcagcacaaagttgtgtgagccagagctgaacttgtgatccccacgggcatctcctgaggcgcacctctcctgagagagaaagctggtccgtccagcccattcagggctcagcctccccagccgtcgcagggctggcttgctgaaaggtctgggtgttaacacagcactcctgttctctctctctgaaggccctttatgctggcatgaattccttttctcatagagatctgaaagctcttttgactaaatgggtcacctttctgagtattttcataaggctgtcagcctttaccatgccagacaagttttctggaatttcctttccagaaaaaaaaaaaaaaaaggctactaaagaggttggagttatttggaacacagggtggaattctggcattcgaactatagggaaacgggtggggatttgtggcaggcactatgtaaatttgccgcaagcccataaattcagactttaagatgaaagatggcaagcagcagtcagctttccttcaacaggcaggaacggtgctaccttccgcctgtgctgagtgtgactgagggagaggcaggcctcctagggaggccggggcaggaaaggtttcttggtggctaaaataggatttctcagtttcccccgtgtcccaagaaaataagttcttatcatgcttgtaccacacttcttgtgcgtatcaccctggtttccctgcacctccttgaagtggtttatcagattccagggacacaagaatggtttggcatctacagcctattgtgggagcaggggcccggcctggtgcttcttgcccaggaacaaactgattgttcccttggtgtggggtaaagcaggccagagtatgggaccaggccctgcctcccaggggacctgaggtgcaaggtctttgagctgagaccctaaaaggcctttgtgagtctgtagtgctatcagttgagcagagttcagggttctgtttacaagattccctctcagcagaggcagggaggggtacctgctggaagaccaggaatgtgctgctgctgggatgggggccctcggtggagcttctagccatctggaggcagaacccagaatgtgttctgagtgaggcgccttggcagagttggcttgaaagcacctaggcagtggcttgtcacattccttatctccaccaaaggaggcaagctagcacctgggggatggctctcccatcagggagtcctttacaggatgtgatccaggtgtcacattacacttcctgcaggtgtgcacctcttacctaattgtctctcctatccctttttctcagcactattgtctgacatccatggggagtcacacccaaagttgggcatgaggtcctctcctgggcacccaacaccttgtttttttgtttttgttttttttggagatagagtcttgctctgtcacccaggctagagtgcagtggtgccatcacagctcgctgcagcctcgacctccttggctcaagcgatcctcccacctcagcctcccacgtagtcagaattacaggcacacacaccaacactgctggctaattttgtattttttgtagattcggtttgctatgttgcccaggctggtcttgaactcctgggctcaagcgatctgcctgcctcagcctcccaaagtgtggggattacaggcatgagccacctcacttggccacactgccctcttactgagccgtattggtgttctaaatggccttcttactctcccacgggtcatcagtgctccaggggcaggcgctgtgtctcttgtttacctctgtggctctgaccttggcacttaataggaatttaataaataacttgttaaataaacagtctctagtataatagcttgagtattaagactggtacattgacttatttgcaattcagaaaatgcaaaacagtggttctttgctgcctttagtgaagtgggaattatatgtagtagacaactgggtctggggtcccagtggaacacttcgtttttggactgtgatgctgaacttaaagaactcagcagttcatgttcattctctggacatctgtgatttgcttcaacaactgttagagaacaaggccttttccaggtgaagctcagaaaatgaatttaataggaaattactgaaagtcacaatcatagtaacagtttcattagttacagtgaatatagagagagcccatacaaagtaccaggcattgtgataaacgcttcttactaatagctatacaaaacatcattgcaattctgagaagtagttattgttgtaattcccgttatgcagatgagaaaactgaggcacacccagattggccagtgagtgtgtggttattactcagattcttgtctgagattttaatcttcatattttactgctttcccaaggaaagccatcagctcagcaagtctttgaaatttgcttctttttttttttttgagacagagtcttgctgtgtctcccaggctggagtacagtggcgcaatcttggctcactgcaacctccgcctcctgggttcaagcgattctcttgcctcagcctcccgagtagctgggaatatagttgcatgccaccacacctggctattttgtatttttagtagagacggggtttcaccatgttggccagcctggtcctgaactcctgatctcgagatccacctgcctcggcctcctaaagtgctgggatcaggcttgagccaccgaactcggccttttttttttttttttttgaaatgatgtctccttttgttgcccaaactgcagtcttggctcactgcaacttctgcctcctgggttcaagtgattctcctgcctcagcctcccgagtagctgggactacaggcacgtgccaccatgcccagctaatttttgtatttttatagagacaggctaagcttgtcttgaactcctgacctcaagtgatccacctacctggccctcccaaagtgctgggattacaggagtgagcccctgtgcccagcctgaaattcaattctaataaatttttattggagcattaaaaagttacatctgtagttgttactctttgcaaaaaattgcaagaacacagaaaaatataaagaaaaaaatcacctgtgaagaattttaatgaatctttttctacttttaggggattttgcttacagctgccttttaatcagaatagggaagaaagagattcctttctcaggaaaaaagtgactgtggactggaaatgctttgtgaaataattttggtcatactgatggttataacaagattcgtcttcaattgagttattgctgagctttgtccaacattaaaatgaaaggtctcatttgagtctcattgtggtttgcaagtctcccttggtctagaaatatgtttggtcaaccacggcatggaggtgttccagccactttctgtctcttaaaagtttttaggacctacttttattgggactgccagggtctcttaataatagttattatacttggtaactattgtgaccttgtctcataggcagcccagcatagaaactcatttagcttttagttgctcagctccattagctgtttaaacatgtttcagatgtgagcctgacaatgtacttgggcagcttggttcacccttgactgcctgggaactttgagaagtctgaaaattatatgtagccctaaggtcttcatggtattgtttttttggaggcaccatttcccaatagccctgaggacaccaggcccatgaagccatcctgtctcagccaggaggcagaggagatggaatggaaaccacttctggatacagatccagccacttccggagtgcttcagagcatgggtcagatagaccttgctgctttctagctggcagacttggggaaggttgtttgacctctctgagtttgtgtcccagactatagcagtacccccttactggcgttatcgaagataaaatgatataatcctgataaatcacttgacccagtccttggaggtggtggtgggggctggggtaagtgccccatgaatggtggtcatcatgctccccaccaacctcctttctctcttctcctttcccgtctttcacacccctaattcctggacctgggggtggtctctccagactagatgaagaagcaatctaattatctaggaaggtgaaaggtggttgggaatactcccagaaataggccaaagataccgcctcctacctaacagactctttttagaagaagaggcaacctgggtttttggataactgttgagtaggaaccatcatgagtggcatttctgcatttctggtcttctggccaagcctcctttttttttttttttttttttttttttaaccttgagacagtcttgctttgttgccaggctggattgcaatggtgcagtcttggctcactgcaacctccatctcccaggttcaagcgattctcctgcctcagcctcctgagtagctggtactacaggtgccgccactatgcccagctaatttttgtatttttagtagggacggggtttcatcatattggccaggatggtctcaatctcttgacctcatactctgcccgcctcggcctcccaaagtgccagaattacaagcgtgagccactgagcccagccttccttttttttttttttttttaagtagctccattgccctccctcaccctttcttttgtctcctgtaatgtccttcccttccatttcttttttttcttttttcttttcttctttctttctttcttttttttttttttgagataggatctcattctgtggcaaaggctggagtgtagtggcacattcacggctcattgcagcctcgacctccaggactcaggtgatcctcacatctcagcctcccgagtagctgggaccacaggcacacaccaccacacccggctaatttttgcattttttgtagaggtagtgttttgccatgtttcccaggctggtcttgagctcctgggctcaagtgatactccctcctcagcctcccaaattgctgagattacaggcataagcctctgcacctggccttccctctcatttttttttctttcctggttttgcctgtcccagaccaccctcttggaaagatgctctcccagcagcggcagtaaggtcctggtcttgtgtttgctcctgggcctgagtcttggctttgctgctttgtagctagctggctgacaccagggagctgcttccctccaggagcctgtcgtccatatgctgaatgtgatccttaaatgctctgtcttacaggggccagacattgtggctcatgcacttcagggggctgaggcgtgcagatcacttgaggccaggagtttgagaccagcctggccaacatggcgaaaccctgtctctactaaaaatacaaaaattagccggaggtggtagtgtgtgcctttaattccagctacttggaaggctgaggcaggaaaatcgctagaacctgggaggcggaggttgcagtgagccgagatcatgccactgcactccagcctgatcaacagagcgagattgtctcaaacaaacaaacaaaaaatgttctgccttacagagttcttaggtataaaagagaaggtgcctctaaagctcttggcaccgtgcctggcttatagtaagtgcttggtaaacgtcagctgctgctgttgtggtgttagtatcagcattgttgctgtgagaccctgcacttcccacttagccttggaaaaataagtcttcacgttaatgccatgggctaccgcttctcttttcagggcttcttggaggagggtggagatggagagacaggtgggggactgccagggttacatcctccatgaggctgaggctgtgctgactgccttgtgtgctttcaacctggagtaaagggtggctgtgccagctgctcccatcccccaggagtctgactcgtccctgccttggccctgggcagcactttccctcctagctctttggcatctggggtcatggtggggctgcctgccatctgtcaaaatttttgctgccctgggtgtggtggtaaacccccgcactatccaacttggtgtcatggagctggcgacaatatttttacagtggttagtgcttggaaactggacttctgggttatgccctgtacaaacagcatcaaagtcgctgggctagggtgacagaggaggctgccaacagggaattctgtggctcctgggacaggaatggatatgggaggttgggggccagtattttcggttctcttgaggagttggcgagtattagtctttgccctgatggatagaaggaatctgtctgtgtcttgcatgaaccgtgtacttcccccagttactccttggacaccagctgcctgctgttcataattgggccagatttctaatactgcagcgctaccaaatgtcagttttaggccatctctggtgtagccagggaacgcccaacacctttcccaaaggtagaatttgtgtgggttttacttcactgagtgactaatgcagatctttatgttttaatgatgggaagaaattcgtcagcctgggtactttttccatgtgatggggcaaaaatttaaaacacttgcacaacggcttttgtttctccagctactaaaggtgactgtcatttaggcattatcagtatgatcagctgatgttaacccactccccttctggagacccgtttctgtttctgggaaaggtgtaggacatgctggatttggcaagattgcaggtcccaggcagatgtccggacttagactctggctcttttttttttttccagacagggtctccctctgtcacccagtctggagtgcagtggcgcgatctcggctcaccacaacctccgcctcccaggttcaagggattctcctgcctcagccccctgagtagctgggattacaggcgtgcaccactatgcccagctaattctttttttttttttgagatagaggctcactgtcacccaggttggagtgcggtggcccggtccgcctgcctcagcctcccaaagtgttaggattacaggtgtgagccaccgtgcctggcctcagctaacttttgtatttttagtatcaacgaggtttcaccatgttggccaggctggctttgaattcctggcctcaattgatctgcccacctcggcctcccaaagtgctgggattacaggcatgagccaccgcgcctggcccagaccctggctcttactcctaggtctacctctaccatcactggggccctcgcctgaaccttttgccccatctataaaatgggagaactagactaggtctgtgtcccccaagcttcaatcatttgtaaaggaaccacctttactattttgccatatcccacggctgtctctatttcatttttcacttaatattattttcccctgcagttgactcacttgtaaaacaaatgtatttgaaaaggagactttgtgtcactataataacggaaaaacagcgtcactaggtaaatggaaggtaaccataaataaaccccaaacagttattaaattccagccagcactgttgcctgttcacaacatgaggcatactctcttttggttaaaaagggaaattagcaagagatggagaggtgttgaaggtaacctagcactacattgagccttttccttgacctgctcaggaggattgagaaagaactaggagaactgggaagagaataacgtctttttgtgatgcaaagtgcctgagtgtgaccaagagctcagagtagtaatgtatagatgctttgtttggatacttatgcagccattaccatgtgccaggggtgtagaggggctaggagtatagaggggattgggacttgttcactgacttctggttgcttgtggtctagtagtggggaggtggtcatagaatattgaatacaaacgaagatcgaacaggctgcaggggtttaataggaaaatcacaggactaaattctgtcatgtgtacatggggtctacaaataagagttgtttagaattttttttaatttaaatttcccatgaaatataaatctatttcattccagaatgattctagagaagctctaaatacattaaagttgtgttggctgggtgcagtggctcatgcctgtaatcccagcactttgggaggctgaggctggagaatcacttgtggccaggagtttgagaccagcctgggcaacatgggagaccttatctctaccaaaaaaaatttttttttcttttcttttttttttttttgagacaaagtttcgctcttgttgcccaggctagagtgcaatggcatgatctcagctcactgcaacctccgcctccctggttcaagcaattctcctgcctcagcctcccaagtagctgggattacaggcatgtaccaccacacccagctaattttgtattttttttagtggaggtgggatttcaccatgtcgatcaggctggtcttgaactcctgacctcaggtgatccacccatctcagtctcacaaagtgttgggattacaggcgatagccactgcacctggccaaaaacattttaataaattagctgggtatggtggtatgtgcctgtaatcctagctacttgggaggctggggcaggaggatcccttgagcccaggaattccaagctgcagtgaactataatcaggtcactgcactgaagccggagtgacagagtgagaccttgtctcttaaaataaatttgtgtcattgtttgttgtttttatggtgttatgacaatgatccatcttaaccctttatgtagtggtaactaactttctcttttcctaaaagctgatttgagttttaggttctcttggagtctgtgacaattgtaaatagataagatataacaaaatggcctgaaatactcttgcaacactcatatttcccccctcagattagcatgttctatactctctgcaaagcaagatatacaccagaattaggcctctaaaaagcctcatactgctaatctctgggaatgaatggtgttctttgggataatgggatatgaagctcagtctgatttttctgttctgctggtagcttagggccccctttcttctgttgggttttttgggagaagggaagttgtgattaagaatgagaattctttttttttttttttgtctcaagagtcttgctctgtcgcccaggctggagtgcaatggctcgatctcggctcactgcagtcttcacctcctggtgtcaagcgattctcctgccttagcctccaagtagctgggaatacaggcacctgccaccatgcctggctaattttttgtatttttagtaaagatggggtttcaccatgttggccaggctggtctcgaactactgaccccatgatcccaacccccccgacctccccggcctcccaaagtgctgggattataggggggagccactgcgtccagccaagaatgagaatttgggagtcaggcacctctgggattgaatctggaattgactgagtgtacatgctttctctgaggcctccgtcctcactgctctcatctataaactgggaataatcatagtttctatctgaaacagtgggtgtgaagatttaacgagctaaattgtaaagtgcctgagacatgggaagaagtcaggatgtgctaatgggtaatcttacacttccccaatggaaagggccaggtttatattactctaggctggtagtaagcgaggcaaaggagatatcaggtttcagctttgttagaacatgctaatggcaccaggacactcagaagagatacagagtttgagacaaatggcaccatgagccctgagacattgtgtatggggtgaatcggatagcaagaatagacttcaaggagggaagtagggcagttagaatcctttcagctgcaaggaactgaaaactggctcacatagaaggaaaatgattggctcatgtcagcaagcctagatgcagagcaagttatgggtttcagggatccagcatctaaatgatgtcatcaagaacccaagttttttgggtctctgctctgttggtttctttcatcctaaagctggttctcctgtggtttaccatagtagagttcctgtgagaactccactctgaccaatcaggccttcccagagccagggatggatggagtcgcttcttttgaggcccatgggtcctatctggaggggatggatccagactcctatcaggaatctaggaggggccgggcacggtggctcatgcctgtaatcccagcacttcataatgccaaggtggacagatcacttgaggccaggagttccagatcagcctggccagtatggtgaaaccccatctctactaaaaatacaaaaattagctaggcgtggtagcaggcgcctgttgtcccagctactcgggtggctgaggtgggaggatcacttgagcctgggcacagaggttgcggtgaggttgtggtgagctgtggttgcgctgctgccctccagcctgggcaacagagtgagaccctgtctcaaaaacaacaacaacaaaatcttatgtaccccataaatatatacacctactgtgtatccacaaaagttaaaaattagaaaaggcaaattgcagagatttccatatgctatgataccgtttatatgaagttttacatatgtcataaaaatacagataacctttaggggaatgatcattaccaaacttttggataacggtttctggggatgggcagagagggctatacagtcatgaagaggtgtataggggctttcaactctttgtagtgttttatttcttcagtcccatggtggttatatgattcttcactcccctttttttgtgtggaatatttttcttataaaaagtgtgtcttttatttatttatttatctttttcacatggagtctcactctgtcgcccaggctggagtgcagtgttgcgatctcggctcactgcaagctccgcctcccgggttcgcgccattctcctgcctcagcctcccgagtagctgggactacaggcgcccgccaccacgcctggctaattttttgtatttttagcagagacggggtttcactgtgttagccaggatggtctcaatctgctgaccttgtgatctgcctgcctcggcctcccaaagtgctaggggattacagacgtgagccaccgtgccctgcctttttttttttttttttttttttttaaaggcagagtcttgccctgttggccaggctgcagtgcagtggcctgataatggctcactgcagcttccacctcccaggctcaagcaatcctcccacctcagcctcctgagtagctgggactacaggtatgtgccaccaagcctggctaatttttccatttttaaaggttttgccatgttgcccaggctggtctcgaacccctgggttcaagccatcctcccaccttggcctcccaaattgctgggactatagacgtgaaccactgcacccccatccaaaagtgtcattttaatgctgacatactgcattactaagcttgaccaggggaagagaaaaaaaaataccttgtgtttattattttgtttgtttgtttgtttgagacagggtcttgctctttctcccaggctagagtgcagtggcatgaacatggctcactgcagcctccacttcccagggtcaagccatcctcccacttcagcctcccaagtagctgggattacaggtgtgtgccaccacacctgactaatttttctttttttctttttttgtatttttggtagagacagggttgcccaggctggtcttgaactcctgagctcaagcaatcctctcttcagcctcccaaagtgctgggattacaagtatgagccactgtgcccggcctgtttgtttgttttaaagacaagtttgggcccagtttataagaaaagaaaacagaccatccttagggtgtcaggatgatattttgacaaaggcattcatgcttagcaggatttctctccccctacccccaccccaagtgttgaaacggctgagctaattaccttagaatgtaaggcttcctctgttgcttgtgaacgtggcagacttgggattctcagagacagagggcttcagaagcttgcctctgggagcgtccagtcaatagctttttgtctgagcagaaggagatattgctcaaggtaccatctcaagggactgctgaatcagttgcattgtctctaaaagtaggtaaaagtctagagtagggctggttcaacagtggaatgagtgttaagagagagttgcattctaagaacacctttacactgtggccaaattcaagcaggtccattttgtggtttggtggtccccatctagtgggatgtggtctggtatcccaggcacctgcatatatgagctcagatgggtttaatttttgaaaaactgctttattggctgggtgtggtagctcatgcctgtaatcccaacattttgggaggccaaggcaggaggatctcttgagcctgggaattcaggaccagcctgggcaacattgagagatccccatctctactcccttccccgccaaaaaaaagctaggtgtagtgacatgcacctgtggtcccagctactcaggaggctgaggtgggaggattgcttgagcccgggaagtcaagactgcagtgagctgagattgcatgactgcactccagcctgggcaaaagagtgagacattgtctcaatctccccacccctgccaagaaaacccaaaaaatattgaggtataattgttatacaatgaagaacacattttgattagcttatacacacactcctgtgtacacatgtacactcacacatcaggaaaccatcaccataatcaagacagcgaacctccctatccagccccagaagtttccttgtgcctctttgtaattcttgccttttatctctccatgtcttccacacccatgctcaagcattcactgatctgctttctgtcattatcagtcagttttcatcttttagccttttatataaatggaatcatatagtatgctgttttgtttttttttgagacaagagtctcactctgttacccaggctggagtgcagtggtgcgacctcggctcactacaacctccatctccccagatttaagtgattctcctgccctagcttcccgagtagcagggattacaggcacatgctatcatgcctagctaatttttgtatttttagtaaagatggggattcaccatgttggccaggctggtcccgaactcctgacctcaggtgatcacccgccttggcctcccaaagtgctaggatcacaggcatgagccactacgccctgccagtatgtactctttttgtctggcttcttctagcatagttattctgaaattcatccttgttgcatgtgtcaatagtcctattcctttttattgctgagtagtagtccattgtatggatatactacattttgtttatacatccttctgttgataacatttgggtggtttcttatttatttatttatttttgagacggagtctcactctgttgaacaggctggagtgcagtggtgtgatcttggctcactgcaacctccacctcccgggttcaagcaattctcctgcctcagccttctgagtagctgggattacaggcatttgccaccacacctggctaatttttgtatttttagtagagacggggtttcaccatgttggtcatgctggtctcgaactcctgaccttaggcgatccgctcacctctgcctcccaaagtgcagggattataggtgtgagccaccacgcctggccgggtggtttctaaataaagctatcatgaacatcttttactactctttgtatggatgtatatttctatttttctgagtggaatgttaggatcatacatcataggtgtacgtttaactgttcaagaaactgccaaactgtttcccaaagtggttgtattgttttacatttccacgagcagtgtttgagagctccagttcttgcacatcctagccacaaaaaggttctgttttttaaagacaatttttttttttttttgagagtttcgccctagtcgcccaggctggagtgcagtggtaagcgaatccctgctacaggccagagactgttctcagttggtttttacaccaagtatcgcacttcattctaacactccaccattttacaaatgaggaaaccgaggcactgagaggtttagtaacttgtggcacagccaggaagcagtagagaaagactttgaatataaatgtatccattaggatgtatatggttccaagtcatgggaaacctacctaatcctggtttatccaaaaagggagctcattggctctcgtaactgaaaagtcaaggggtaggcaggcagttggacctggaagtctccagggcatcagagagccttggctctgcttctctgattctgttgtctctccacagacgggtgggtgtagcagtcccaggcccgcagccacaccccacacctcccagaggaagaaggcgggccctgatcccagcagtcccaggaaagccctgaggttcactgtgattggaccagcctatgtcacctgctcacatctcagcccaccactggcaagggtgtttgactcttgggaatgactcttgggactggcttgtcctagatcacatgttctacctgaaattggggacattgcagaggattggtggagtggacctcaaggaggtgtttcacgtggcttcctgtgtcactaggttgccatttattctttagaaagcccctttgtttgatgaaaccctggtgtcacaggctgtgtgacttagggtaatccccttgtccacatctgtgaagtgagattacctcttcacctcacaggcagatcaaacaggaaaacaaaaacaaaaccaaacccaaaatacacgtaaattgcagagtgcttgaggtttcttttaagctgtctatgtaattaaaagctgttacttagacttggatatgaaataaaatctgacttcaaatttaagtggtgtaatttccatgcctcttaaaatatcaggtaacttcatttgtgagcctcagtctgtagacttgagggatttccatctgaagagggggcagaatggtggtttagggaacgcaacatgtaccccacccccaacttttttaagaggaagagttgaaagaaataatgaatgtgtgagaaataaggggtttgattgccttccagggtccatgttgaaggagaggaaaatgtagctcaaccacagtgactctccccaattaaaaactaaaaaaagatccgtggttatagggcttggacttcggacaagccagcagcctcagtcattgtgagtgtgattccagattggaaggttctgctaggaggaaagtggaagttttgagaattcctagttggacagaatgcctcttgatcacggccttagctaaaggagaccactctttgctggatggatcagtcagctacgtgtgaagtttggctcagtacaacattctcggcctggggcggcagcatgggaaagatttttattggaattaactttctacagagatgtactttcaaatgagaccatccttctctcactggtgagctcacccgggctcttattccacaaagcttaattgttttggacccatacatttaaactccttaattaattgactcaagacttaggacagatttgcttttctttataatgactccatggctgtaaatgctgctgattcagatgaaagaggaccctagagcacagaatgagaaggacgtggactcaggatacctgtttctttattctgactgtgctcttcgtcagctctggggctttggaccccagttttgtaaccacctaacgagttcaccttgcctgctgcctagacggagctgatttatcaagacagaggaattgcaatggagaaagagtaagtcacccagagccagctgtgtgggaggctagaattttattgttactgaaatcagtctcccgagcatttgggatcagagtttttaaagataattcggcaggtaggggctcaggaagtggggagtgctgattggtcaagttggagatggagtcacagggggtcgaagtgacgttttcttgctgtcttctgttcctgggtgggatggcagaactggttgagccagattaccgctctgggaggtgtcagctgatccatggagtgcagggtctgcaaactatctcaagcactgatgttaagttttacagtagtgatgttatctccagaagcaatttgtggaggttcagactcttgcagtttctgacccctaaaccttaatttctaatcttgtagctaatttgttagtcctacaaaggcagactgctcccaaggcaagaagagggtctttttgggaaagggctattagcagttttttttcagagtgaaaccataaactaaattcattcccaaggttagtttggcctatgcccaggaatgaacaaggacagcctaaaggttagaagcaagatggagtcggttaggtctgacctctttcactgtctataatttttgcaaaggcagtttcagtttctcacctgtaaacgttgaagactgagccagaatcagggtcatcaaatagcaccccggctatactttcttctcttcatgacaaacattgctggtcagttgatatgatgttctttcccactgggcccagacttgacattagagtcttttttttttttttttttttttttttgagacagtctcgctctatcaccctggctggagtgcagtggcaccatctcagctcactgcaacctccgtctccagagttcaagcaattctcctgcctcagcctctcaggtagctgggattacaggagtgcaccaccacacccagcagatttttgtatttttagtagagacggggtttcgccatgttggccaggcttgtctggaactcctgacctcaggccatccgctcgctttggcctcccaaagtgctaggattataggcgtaagccaccacgcctggccgacatcagagtcattttagcctgcaatgcaagttgtcctcagtgggctgctagcattggcttcaaccttcatatcagccagctaaagccccttgtaatgaatggggaggttccttcacccttgcctcccgctgcctcctcttgaccactcattttttttcttgtagttcaggaaccaattcagatgatttccctcgtgaagtcctctcgaaagcccccaggtagaattattcattttttcccttgcattcccacagcactgtgcacacaaattagaatccttgtaaaatggccatgattctgtttatgaccctggccctccaccagaccagcctctctgccctctggcttttttagatcactggcatggtttctgcctactccaggtgccagtattattttgtgaatgttttttttcttcatatctactcatctttatactactttactcgtaaaaggaaactagagaacatgatcttaaatgaaaaccacgatcacttgccagaaagaacaggtaactaggctttgaaaaaataagttagaggagatagcataagaaaaaattaaaaaataaataaaatcaatgaaaacaacgtgttactaaattcttgaaaagttttttgaagactttgagcctgaggcctgttcttattgtttgtttgtttgtttgtttgtttgtttttatgacagagtttcgctcttgttgcccaggctagagtgcaatggcatgatctcggctcattgcagcatttgcctcctgtgttcaagcgattctcctgcctcagcctcccgagtagctgggattacaggtgcccgccaccatgcccagctaatttttgtattttagtagagatgggtttttgccatgttggccaggctggtctcgaactcctgacctcaggtgatccacctgccttggcctcccaaagtgtggggattacaggcgtgagccaccatgctcggcctgttcttattgttaaaaagagagatttgtgtgaaagctgctgacgtctttttggcaccaagtcaagactgagttagttcttgtcagaatctgattgtttgtgaattgatggcttttttttttttcctgagttgggggtctcgctctgttgcccaggctggagtacgaccactataacctcaaattgctgggctcaagcaatccttccgcctcagctgcccaagtagctgggactactaggcatgctccaccatgcccagttaattaatttttttttttttttgagagacagggtctcactatgttccccaggctggtctcaaattcctggcctcaagtgatctcctgcctcagcctcccaaagctctgggattacaggagcgagccactgtgcctggccggattttaaagttctgcccatgcacctccttagctctggcagttactacttgcaggcatctcctttgtctgccctgccccttgttaggaaaggctgtgctgactgtcagctggcacccagtgcatagaagagatagttctctgtagatgatgttgaacaatgtggtactataatcccaacctgttgtatctttgtttactctcaaaagcaacaattgggctgggcatggtggctcatgcctgtaatcgcagcactttgggaggctaaggtgggagggttgcttgaagttagttcctttttttttttttttttaaaaaaaagacaagatctcgctctgtcaccccggctggaatgcagtggcatgatcatagctcactgcagccttgaccacgtgggctcaaggaatgaaccattgtgccaggagttcaacaccagcctggataacatagcgagaccctgtctctacaggaaaaaaaaaaaaaaagaagaattgcataagtatcatcagaactgttgaatggaaaatcagactttgtgggtttggtttgttaattacttctcgttggattagaatttgataggtaaaaaaaaaaaaaaaggtgtagaaaagtgattccagtcttgagcaaatttttaatggaaaacggtgtcttggttctctgttcactacaacttgtatctaagggaaagcctagtgatgcagacatttcatttcgtgatgggaaaactgatgcccagaggttcacagctgaccaggggctagtctgactggggggatctaggtcaccaccccccttgccttgttttcccagctagtgcatttcctactagacttgactctactgtaattcaagttgctgagtagcaaacaagaactacaatgactagaaggaacagaactagcttttttgtgctctgaaagtggaaacttattgagggttcttttcctcccagagaatgcagaagtgccctgatttgcttttggaaggacaccattcactttattgcctcttttcattgttgcccagaatatcaccatgatttattcatgggtggtggggagggtagcactagtgtatgctcccagcaaagaggaacatctcacgttgtgaagagatgcgcaaaactaagccagggcagggtgtggtggctcatgcctgtaatcccagcactttgggaagctgaggtgggcagatcacctgaggtcaagagttgaagaccaccctggccaacatggtgaaactctgtctgtactaaaaatacaaaaattagctgggtctgattgcaggtgcctctaattgcagctacttgggaggctgaggcaggagaatttcttgaacctgggaggcagaggttgcagtgagctgagactgtgccgttgtactctagcctgggcaacaagagccatctcaaaaaaagaagcaagccagatctttggggtgctgtgacggcaaatcccccagcgctggcctctcaggttctcttgcgggattagtgtttgttgaataataagcaatacaccctgacccagcgagccaaagcaaacaggacagtaactgaaactgcaggggagtgtgagtaaacagttaccttctaccctcatggagctggcctctggccagcaacatgatagctgtttgcatcttactcttatggagccattggccctctcattaaggtgggggcagcttctggtccatgcctgcaagtcctcatgggagtgggtacctgacagggtgtaaagggtaggtctgaggacatggtttcttttttttattgttgttgagatggaatcctgctcttgtcacacagtctggagtgcagtggcctgatctcggctcactgcaacctccgtctcactggttcaagcgattctcctgcctaagcctcctgagtagctgggactataggcgcatcctgccatgcctggctaagttttgtatttttagtagagacggggtttcaccacgttggccaggctggtctcgaactcctgacctcaggtgatccacccacctcagcctcccaaagtgctgggattacaggcgtgagccaccgtccccagccaacatggtttctttaaaatatactccccgctccatcccattcatgtgtgggagttgagctgcatctgggtttttcttttctctttttctgtaaatctttattgtattttttttggatcatagaatggatacatgtttcttaaagtttgatcattatagaaacttaattagactattatttgagtgctaaccatagtgagtgagtgcttactgtgtgctaggtggctttttatgcctcatgtcacttacatgaggtctgaggaacggtgttaatcccgttttgcagctgaggaaactgaggctacatttacggtcacctagctggcaagcaagtggctgagcctggagcagcagcagatctggggaactccacaaaccagatttctgtgtggtatccctgtggacacaaggatttaacttgattctttttgctttcagtatcactttatgatattacaatgagcttgcagtatttattttcagaagaaaagccagattattcccatttatgagagaagcagccaggtgggcagggatttccagcgctgaaccagccagtgtgtgcattgtctcttcccgctgagcggccctggtgtgctgggttagtctgtgagccacaggaaatgttgtcagggcctctgggcttttggatgtcagcaggccttcagtggtgaggaggttgtggctggactcagaggactccttgcttttgctgaacgaccctccccaccaaccaccaccaccaccaccagtgggactagcccatgagctgtaagccaaccttttccttcctaacttaattttccaaagaatagtaacttacccaccaccactgcagtcactgggccgggaagacaagcactcttgccttgaatccatgccttgagccagtagccttgacccagggtaaagcagttatgtgcttgggtcacctgggtcatgtttttgaaattgcctcaagcctaccttacaaatccttcctggaaccctgcttggcttttctttgtgggcttcccttaggagggaagcttcccgagcagcttgtcttgactgtagccagctgggtggtcccagccacagaatttaactgtcaaacagcaccagaagggttcctcatccagctgtcttgccccaagtgccctctttgctttctttttagagagttctgagactcattagagagtttagagattttagcattcttgaagttctttctgtggtcagtttggtgaaccacttcatttctaaagtttctcagttgaccccattcttccccagctttgcattctccatgaagccacctgtgtttggtgtgtatgggttttctgcaacctaggttgaacaagtcctctagaatcctgaacaattggtgattcatgctggcctggtttttctaattggcctggaaatgtggctgtagtggacacaagtggacttggcctcctctttgatgcgggtaaactttagatttgcattagctctgtttgattagaggatcttactggtttttgttgttatttatttaccttttaggagctttagtctctgtaggtttttttttttttttttttaaagtccgggtcttactctgtcacccaggctagggtgcagtggcatgatcacagctcactgcagcccccaccttcctgggctcaggtgatcctgccaccttagtttcctgagtagctgggactacaggcatgtgccaccatgcccagcaaatttatttctactttttgaaaacagggtctcactttgtcacccaggccagaatgcagtagcacgatcatggctcactgcagtctcaacctcccaggcttaagggattctcccacctcagcctcccaagtagctgggaggctacttggcatgcatcacaaggcccagctaatttgtgttttttcttgtagaggcggggttttgccatgttgcccaggctggtctcgaactcctggggtcaagttatactctctcctttgcctccagccatgagccgttcgttgcgcctgggctagtcattatagatttatcccttctttcatctcatgctacaaaagcagttcttgtatttttacccgacttgtgattttctactgggaatgtttgtttgtgatggttagcagggtgctgagagggaattaatcccaggaggcccaatattgggccatgtcgtgctgttgagcacagtcatttgacacctataacttctcatcaattcttctgatagactgaggaggaattgggaaatttcctagagttttgtctgcattattgggttgttttgagaacataaaccttaaactctagctatgtaaactggataagtcattttggtaatttggcattcctttttttttttttttttttttttgagacagagtttcactctgttgcccgggggaatgatctctgctcactgcaacctctgcctcccaggttcaagcaattcttctgcctcagcctcccaagtagttgggactacaggcacactccaccgtgtccggctaatttttgtatttttaatagagacaggatttcatcatgttgaccaggctggtaatttggcattcttttgagtacaagtgagagaaactcacttgagctggcttaagtgaaaaaattctttgtcaggagagttttgtgaatttctgtttagtggcaagttgtagaaaccacttgaaactgcttaaaggcaaaagagggagccacttgtcccagtaactgagacatcccagagccgactgcccccaagcattacttggtcccaagtttcaaacgggtcttcagggtttgatctctctcctcatctccagtctgcttcattcattttggctctatgtggtggcagaagggcttctggcatctctggacctttatgcctcccaggtccaaacccagccagaaaggagagtgagagtgctgagtgcaaaactctcctatagctcctatacaagtccaggatttgctattagactccttgaattatgtgcccagctctgagccaatggctgtgcttaggaggctcctgtctcatgcacccaccccagtactgggcatcagaaacaaccagtgatccctataatgaaccacgggttcacagacttaagtgtaatcctgcagcagggcctcaggaagacttgaaacccaaaatcagaaagccatggtttcttgtcttcctggtgtctgttttgtcccttccctctgtagaggagtcctgctatcactgcaggcaacggggctgccctgcagctcctgctgtttacatttcactcggtgtagccataggcagagacctcagggagaacctgattcggcttggattgagtcaggttccaccccagtccagtcagttgtggactgagaggtgatgaggctgggccctttaagacaaatctgggtgggtggagtctgtgcttaatgaagttgtgatgttagctgatggcccagaagggactggtaggtgcctctcattgtctggttgggaagcattctcttaagtccaagatgatgataaatagtattaggccaggtgccgtgtcatgcctctatacccagcactttgagaggccaaggtgggaggatcgcttgagcccagaagttcaaagccagagtgggcaacataaagagaccctgtctctacaaaaaacaaacaaacaaacaaaccaaaaaaaccccacaacaattagccaggcatgatggcgcacaccagtagtcccagctactcaggaggctgaggtgggaggattgcttgagcctggcgggtcgaggttgcagcaagctgtgatcacacctctgcgctccagcctgggtgacagagtgagaccctgtctcaaaaagtaaaaaattcaaataaataaacaaataatatcaagggcctctctcccaagctaggaagatatcagctgaagctctagcccagctacgtggatggctgcttcctgcctggaagcgatgcccagatcagcaccttgggacccccctgaacttgcctctgctccagtgtgggcccttccttcctgcagaggagacagcactgtctgagaggcatgaatgagaatttcctccttctaggcccaagtcagcatgactcgaggatggctttgactggaaaaactgaatcaaagagtgtgctacagccaaggatttccccaaacactaatcagtgctgattacttccagggtattgcctttggctctgtggagttttgtccactgtggctgcaatgtctggcttctgctgcccagaagatgagaaatgagtttgtagggatgagcctgggtgaagggatgtgccccctcaccatcctgacctctattaggtgtaaaagaccctgattgccaaattcataggtcatgggttggctctgcctccagcattaacacttgggggtggagttggggaatcatagtattacttgcataaatggaatcctaaaagtttgttgggacagtttcataaaaatcctcaccatgatcagtttgaaaatgacgttcccttcacatgtttgtcttctgaactgagttgcaatgctgagtatgagtttgagagtcccaagaccatctaaagcaagcctgtccaacccacagactgcaggctgtaggcagcccaggacagctctgaatgcgccccaacacaaattcgtaaactttcttaaaacattatgagatcctttcgcatttgttttttaaagctcatcagctatcattagtgttagtgtatcttatgtggccaagacaattcttcttcttccagtgtggcccagggaagccaagagattggacacccccgatttaaaggaagtaactcaattttgtgaacctgaaacttgatcttggatgaaccaaatgaaattttatgattctcttaagctcacgaaagttcaataactgtgctgtgtaaaatagaggtaaaagacttgagttggaccaggaatggttgctcatgcctgtaatcccagcactctgggaggctgaggcgggtgcatcacttgaagtcaggagttcaagaccagcccggccaacatggtgaaaccctgtttctactaaaaatataaaaattagccgggcgtggtagtgtacgcctgtagtcttagcttcttgggaggctgaggcaggataatcccttgaacccaggaggtggaggttgcagtgagcaagatcataccactgcactacagcctgggctacagagcgagactccgtctccaaaaaaaaaaaaaaaaaaaaaaaaagacttgagttggttctaatagaataccttggagaacctcaagatgccttctggtccagccaggtttacagattggaagatattctgttaatcagaatctcagagagggacaggccctgatcaaggtaacacagtgagttgtggtagctgggctgggctagaacctgggcctccttggttccaggtcacagggaccaagggatttggcttgtcttagtcctacttgtaactacaatactgccttctgctaggaagaataagagcttgcaggctagaggaatttataggaattttctttctttaaaaaaatccccccaaaaccagctttactgagatataactcacacaccataaaattcacccttttaaagtatgcaatttttagtatattcacagaattatgcaactatcatcactataattttagaattgtttttttttttttggagacggagtcttactcttgcccaggctggagtgcagtggtgcagtcttggctcactgcaacctccatctcccaggttcaagcgattctccttcctcagccttccgagtagctgggattataggtgcatgccaccacacccaactaatttttgtatttttagtagacatggggtttcaccattttggtcaggctggtctcaaactccgcctgccttggcctcccaaagtgttgggattacaggtgtgagccactgtgcctggccaattttagaatatttttattgcctcagaagaacccctgtatccattagcagtcactctccctttcccttccccaaccaggcccaataaaccactaatctactctgtctctatggatctgtccattcagaacatttcatatggtaaaatcatacacgtgttctggtgttactgacttctttcacttagcagaatgttttcaaggttcagccatgttatgtctgtactttattcttttttacggccaagtgttggaatgtgtaggatttgaattttcaaataaagctttaaagttttcagatttatttttactttgcctggtgtgttttttcctggaaagccaacttctacatttggagattaaaagacaaactttctcaaactccctgtacctaagtggttgctgcttttcttaaatgttttgacaccaaagagaaaaattggtttctggaagaaagtgtgttttcttttattgccaagaaaattagtgcatgttaattaatatagatgctcaggacccagagttgtaatgaacttttttcttatatttattttctagatgtttgacttattttaacagttttcattttagcaataatgtttccttcccactcccaaatttattggaaaccctcaatcaaccctatttatttatttattttagagatgggatctcactatgttgtccaggctggtctggaaaccctcactcttatagatagtatgaaagaagattatagccaactcttatataaccttccccagagcctccaattgttaatgttttgccatatttgcttgctctatcacttgctctaaagatgcatatcacacactttttttttttttaatttatttttgagacagagtctggctctgtcgcccaggctgtagtgcagtggcatgatcttggcttactgcatcctctgcctcctgggttcaagcgattctcctgccttagtctcctgagtagctgggattacaggcacgggccaccatgcccagctaatttttgtatttttagtagagatggggttggccaagctggtcgtgaactattgacctcaagtgatcctcctgcctcagcctcccaaagtgctaggattacaggagtgagccaccatgcctggccacatgcgtgttttttattgaatcatttgaaagtactcagctcgtatcatgacccttcacccccacatactccaacaagcatctctaagaaaaaggacattctcctaaccacagtgtctctgcattcccaggacattcttctaaccacagcgtcactgcatacccaagaggttagcaccgatacagtaataacatcttgtgtaaaacttcccaaaatgctcccaagtgtcctttatgacagtttaaaaaaaaatggcattttttgggatccaggaaccaattaacgattactcaattgaatttggtttcaaagtcacatacctcaacttttcctttaatcaagaacagcccccctgccttttacacatttttttgtctttcgtgaccgtgtcatttttgaagaaatcaggcccgttgtcttgtagaactggtgtttctcaagtgtgcttgggagggtcttggtaaaatgcacattctgattctggagaacagggtggagcctgggaatctgcatttccagccagcatcccggtgatgccagtgcagctggtcttcggctgtagaatgttccacattctaggtctgtctgtttccttgtgattaaattcaagttgaatatttttggctagggcacttcctgaggtcataggtacttcccactgcctcacagcacaggctcacaatctcagtttgtcctgttacttcgtggtgctaagtgtggtcacctgcttcaagtggtgtccgcctgctctctgttgaaacaatacctttctcctagtataatgattaggtaacctgtgattgtaattggtaagtaatctttgagactacatgaatatcctgttccccagcagttttcactcattggtgaactgttttgggaaaaataatagcatcttacagttataataccctgctggtaacacatggctcttacataatcagcagttaattgtttgtatgtgtgttaatttttatttttaaaatgtaactagtgactggtaactctcatttgtattttaaacattggcttttacagcttctcagtacatttcactctgtgtatgtttttggtagagcatttgttgtcctgtataatggtttaggaaatcctataggccaaatgaagggctggagactcacctgtgttcccaccactgtgtttcactgtgtattgccagagaaaatacagttaaatttgaatttcagatagacaatgaataactttttagtataagtatgttccaagtgtggcagacagctctcacaagttacaagtcgttgcgtaggacatacctatgctaaacgatttgatgtttatctaaattaatatgtaactgatatcttgtatttttatttgtacgatcttccaagcccacgtcccaccgccttctcggggatggccaccatttgtgtttgctgcctggtggtgtttgcagctgcgagaagggccttggaggaggagcaaagtgtagtggtatctccgtgctgtggccttgggcactggggtgggggttagatgagtaattagctgaatatgacctcacccatgaagaatgtgcccttgctaggtattagcagaggtttaggctccagggagccattgtcagaagcttgtcagtgatgtcatcagctggaagggccagctttcaggcctcaggaaaaagcttgaaagtcagggctccagttttggtaataaatgggaatggagtttcacaggtagggtgtggaggaatttattgtgacaggaagcctgatggagcctcttgcctgtgtgcagcccccagccaggtttctgagttctgatgaactaccagaaacttccaccacggcctgtgattacactgttggcccaatgccctggaaaaattggcttgctctcggggaacactccaggagctgcaaagggggtgtcaggactgttgtgcagctccccttaaattggggaggaggggtggctgatgtggaaactgttcattagactgctcagggtagtgtgagaaaacgtgtaatctgtgggcatctacccctagctgcccctctgatctcacccactactgtgggaggaccccgtggatgggggcagaggagggtcttctggatttagacactcacaaaacttccttttaccttgttcattggaagaaatagaaaatgcctttttttttttttttttctttttttttgagacagagtctcgctctgttgacaggctggagtgcagtggcatgatcttggctcaccgcaacctctgcctcccgggttctaacaattctcctgcctcagcctctggagtagctgggactacagccacgtgccaccacacccagctaatttttgtatttttagtacagacggggtttcaccatgttggccaggacggtcttgagctcttgacctcgttatccacccgcctcggcctcccaaagtgctgggattacaggcgtgagccaccatgcctggtctctttttcatttttaaagggtaatttgctgtgcaggagtgggctctcagaccagaagtggggacctgaatgaaatcaaggactgagtatggtaactacagccatttaattttatttgaagtctcccgtaaaatgttctggaaaaaacaggggttccagggctgggtgggcagtttcaatcatggactggattttgtggttcagatttctctgggcctgttggaggttccccttaagcaattacccaaggcagttctgcccagctgaagtactgattacctgcacactataccagtgaggactcatgggtgagcagatgggaggcactgagcttgattctgaaaccctggcctccatcccacctgacattcaatgtcagattagaatttggaagaccctaagtctccagattggtgcactgggtagctcctgaaatggggtggctgagacaggtcctctgtgcccccttccacagcttcctctggggcccttctgctcactggcatgtgcttctgggcaaataggcctctcccagcatttgttttggctctgtgaaatggggtaatatttgttcctattgcgggtgaagcgctgctgttgggatgctcaggtaactcactccgtgggtagctgatattgcctgggcaagtggcattttagaggaaatctgtgccatcaaaagagttggacctgatcacacttttgcttttgaatatgctttgtcccagcctggccattcgtcacttgggaccccctgagtctctctgaccccactgtaaaatggatatgccatggagttgtcccaggaatcaagggcaggtcctctccagtgagtgatgggcttgcctctcacttctctaacacccttctgcttccttgtgtaagatttcactattagtggctattctcttttacagaagaaaaagggagacgcatgcctcttccagttcactgttcaccattgcagcatatttattccaagggactggccgaatcatccctttctttgttagaatgtggttttgttgccttgagacaagtggcccgcatgtctgcactgaaggaggctttgcgcaatagccttgggcacctccggttctgcaagcatgtacagtacttgctctcctttccctttctttgtatactttttctggtctgctacgtgtccatctgcatgtggataaagggtcgtcgtcttgagtagtgattttgctgtgatgtgattcctgtgaggtctagttgcacacagtgattccgaaggtagacccagctggaaagcttttaaattgctgatactccagccccactccccaagagatgctgattttgttttgttttggggagggcagtttttttgggttttttttttaagctttttgatgtgtagccagggttgagactgaagtgatttttgtgagtaacggagaagtgttaaggcttgagaagttggaagagccatgcttgagataggaccaaggtcatatccccggcattagcacagagcaaccctgacctgttggagagttgggctggatggatgcggtcaggggagagactcgctttattttatttatttagagatacagtttcactcttgtcacccaggctggagtgtaatggcacgatctcggctcactgcaacctctgcctcctgggttcaagtgattctcgtgcctcagcctcctgagtggctgggactccaggcacgcgccgccacaccctgctagtttttgtgtttttactagagacagggtttcaccattgttggccaggctggtcttgaactcctgacctcaggtgatccgcccacctcggcctaccaaagtgctgggattatgggtgtgagccactgtgcccagcctcgactcgctttattatatccacacttggaatacaattcggattgattgtagtggggcattttataattaggaaaaattaatcaggaaaaatcactccatgtagattagtaccaccatatgaggggacaagaatttcttcagattaggaacttcttccaacaggactgacagggtccaaaactactcttggatccagctttaagatggacccagcccactgttgagtcccctctgaggtcttctctctgtggatggatttgattgttaacaatggctgagtcatgtggcacccagcccggtgagtaagacagctgagtaagaggggaaacagggcctttggtcagaaaaaccagactgacttcagtcttatctgtttagagaagccccagaagctgcaaaaattgcagcttccagactttagtgtgccgtggtcatgacatcggtgtggatggcaggttgtcatctgagcagtcagggtggcagcacacagcttgcgggctggctgatggccgaggtgtgtgaactgacctgccccaagtgacttcagtgctgggcacagcataggagcagtactaatgatatggacagtatgctcagaggacgttagggagcacagctttgtgtaaagggcatgccctgccctgtccggatttaaagcagctatagcactgaaaccccatggtcaccctcgcatttctacacttctgcctgtgccaagtctagtttgtgtgcctcctccattttgtgtgtacatgggggtatttttttctgctaggcaactgctatttatgcctctcagtactgtacttagtgtgtaccattcctgcaaggtatagacattgtcagcccattttacagatgaggaaaatggagtttttgagagggtgagatcattcagtggcagaatggaatgttaacccaggtagtctaacctctctgctgtagatctgatgtccatttgaactttagacttcccatctgtgtctacagtctagcccttaaaaaatgtgataaacaggtttttaggtaagtctgttaatttcagaaagacattattattattttttagaaagttagagcttatgttagggctcagtctatcctcctgcctcagctgcctgaatagctgggactgcaggcacatgccaccatgcctggttaatttctgtggtatacatcattgattactgagaagtcacagtccgttgttaaataactgagctattcatagccaaatcatttttaaaaacacaaatataagcaaaaacaaaacatttatttatttatttattgagacggagtctcgctgtcacccgggctggagtgcagtggcgctatctcagctcactgcaacctctgcctcctgggttcaagtgattcttctgcttcagcctccccagtagctgggactacagacacccactaccatgcccggctaattttttttttatttttagtagagacagggtttcactgtgttagtcaggatggtctttatctcctgaccttgtgatctgcccgcctcggcctcccaaagtgctgggattacagacgtgagccactgtacctggcccaaacatgtggtttttttaaatgaaagtgtgttcattttacaaacagtgcattcttactaattttacaggccctgtgctagggacatggcctcgtcttccgctatcttagagtgaagaagtaaagacagagaaagtgttcacaagttgctgcacaagtctcattgcagtgcctcccagaggcgcgaagagcaacacctttcacctgggctgtcctagaaggcccgtggcagggtggggttggtgaacactggggcttaagggggtgaattcagaagacaaaggaccttctgggcaaagaagggcccagtagtgggaagtgcaggagtgtgagagtgcctggaattgcccactcactggctctggagcttggtgctgagtgcttgggaagtgttgggaggatcagttatattgctggctgggttctaaagaacctccaaagtttacataaaagttacctttgatttgactgttctaccctccagtcacgtggctaaattaattaaatcaaatttaaaattaagctcagccataccaagtatatccagtgttcaataggtacatgtggcttgtggctgatgcactggacagtgtacatataaaacatttccatcgttgcagaaacttctattgaacagcagttgtattagtccgttctcaacactgctgtgaagaaatacctgagactgggtaatttataaaggaaagaggtttaattgattcccagttccacagggctggggaagtctcgggaaacttacaatcatggcagaaggggaagcaaacatgtccttcttcacatggaggccgcagcaaggagaagtgcagagagaagagggggaaaagccccttataaaaccatcagatcttgtgagaacagcagcatgggggtaaccattcccctgattcaattacctcccaccaggtccctccaatgacctgtggggattatgggaactacaatttaagatgagatttgggtggggacatagccaagccacatcagtgttgttacacaccacagtggtgctgtggtgtgtaggtgggaaaactatggcatgggggccatatctggtcctctgcctatttttataaagttttattggaacataggccacactcatttatttatgtactgtctatggatgctttcacactgcaacaatagatccaaatagttgcaaagagactgtgtggcccacaaaacctaaatatttactatccaggccaggcatggtggctcatgcctgtaattccagcactttgggaggttgaggtgggcagatcccttgaggtcaggagttcaagaccatcctagccaacatggtgaaatcctgtctctaccaaaaatacaaaaattagctaggcttggtggtgcttgcctgtaatcccagctacttgggtgtcgagacacgagaattgcttgaacccagaaggcagaggttgcagtgagctgggatcatgccactgtactccagcctgggtgacagagtgagattctgtctctcaaaaaaaaaaaacttactctttggccctttatggaaagtttgctgacctcttctgtagatggtagggtacggtagaaggtgttcaagccaggagtaacatgaatgattgtatttatggcctaagaggataactcgtggtggtgggcgggccatatttgtggagagacccattttcagtgacttccaagagtctgcgtgagagatgactgaggtcttgccctggcaggaatggttccattaatctgtgtctcatttgacaaatgaggaactacaaatgggaacagtttaagatgagatttgggtggggacacagccaaaccacatcagtggtgctaatagacagtggtgctgtggtgtgtagtagggaaaactatggcctgtgggccaaattttgaagtccttttactttttggttctaaaaattattaattgtagccagagttgttaacttaatatgtcttggaccccttgggctctctgaagactgtactctttctttccacttaataatatacatggaattgcaaaggaaaccaatgatattgaaatagatatcagaaataaaatttttagatatagcaataaatgcacatctgtattaaaatgtgtaataacaagatctaacagtgagtctaagaactactataattatcatgtagcaatggcataaaggatagtttgtgctatctaaaacagtcaatgacaggagaaaatctgatttctttggtgataaaacgacaggtgctgctaatacacctgtgttttatggtcttcgtttgtaatgaaaagaaatgccattaataaattttatttatttatttatttatttatttatttattttttttttttttgaggtggagtctcactctgtcgcccaggctgaagtgcagtggcatgatctcggctcactactacctcctcctcctgggttcaagggattcttctgcctcaggctcctgagtagctgggattacaggcgcccaccaccatgccaagctaatttttgtatttttaatagaggtgggggtttcaccatgttgaccaggctagtctcgaactcctgaccttgtgatctgcctacctcgggctcccaaagtcctgggattacaggtgtgagccaccgcacccggccagatgctgggatgttttttaagaccttagaccctaagcctatcatatcaaatacaatgaaacacacccacttttcacactttaaaaaaagtgtgttggtgtttattgctgtaaaatagtttgaaactttttaaaaaaagttttggtcttgctcatacttgtgttttaaaaaagtatttggctatgactaactcagttatgtatttatttatttatttttgagacggagtctcgctttgttgcccaggctggagtgcagtggcatgacctcggctcactgcagtcgccgcctcctgggttcaagcctcagcctctcgagtagctagaattacaggcgtgctccaccatacccagctaatttttgtatttttagtagagatggggttttaccatattggtcaggatagtcttgatctcctgacctcctgatctgcctgcctcggcctcccaaagtgctgggattacaggcgtgagccaccacgccctgtgactaactcagttatttaacaattgactgtaatttctcagcaatcagtgtatacttggaaattcttgggatgtgagaaaactaacctataactcattttcttttttctttgaggtgaggtctctctttgttacccaggctggcgtgcagtggcatgaacagggctcactgcagccttgacctcctgggctcaatcctcccacctcagtctcctgagtagctgggactactggcacgtgccaccatgcctggttaatttttgtattttctgtagaaatggggtctcactgtgttgcccaggctgatcctgaactcctgagctcaagcaatccacccactttggcctcccaacataccgggattacaggcatgaatgagccaccatgcctggcctgcaacttctataaatagcaaagttagtaattagtgaagatgatggtttgcaagcactgaattatacttctattaatttcatttcctttcaattttctaatgttttgtgcccaatctgtcctgtctgcctctacctagctttagaagtgttttgttggttcctgagatggagctgtgcctgaagggtatgaggttaccctctgggttcagcggggagatttgggaagagttttgatttgtaggccagtaaaggggcctgacattagatgatggctgctgggctagggaacaacttagaggcagctaacaggattcagggagagtggatttggtgggagagagtagtctaggatgaatccaattgggtttttatgagtagtttggtagttggttgactgggtgggtggtcccttggtaattatttgttgattagtggttgttgggttaggttggttacacttacattatagtcgatggaatctcagatttggatctaataccacatgtaagtcgagtggatttttttttgagacagagttttgctcttgttgctcaggctggagtgcagtggaacagtctcagctcaccacaacctccgcctcccaggttcaagcgattctcctacctcagcctcccgagtagctgggattacaggcatgcgccaccacgccgggctaattttgtatttttaagagttgggggtttcaccatattggtcaggctggtctcgaactcccgacctcaggtgatccgcctgccttggcctcctaaagtgctggcattacaggggtgagccactgtgcctggccagttgagtggatttttttagcactcaagcttcgtggctcattgctattattgtgcatgtgagcgttttatctttcagtagcattagggatgctacttggatgtgttttagttattacagaaatagtttttactaacttttactaagttatctttcctctcctgtgtaggaagtttagagtgaagcggcagttggctggaggttctgaaggtttccccctttcacataatttgatgttccagttgcccacatcaggacgactccctctctttctactgatgtaagcagtgggccaaattatggggctccatccctgcatcttcctacttgtctaaatcttcgtcacagacaacatattgctctaaaggaaacctagaaaggaggagaagctggttttcgcccaaattcctcaaaatcatcgcctgttgtttaagaattacagtttgcactggaacaataagatgttccttaatgtggtttttaagtgagttggttgtcgcctgaatttcataaacactggctaaggattgtgcaaaagggtgtgcttccctttagcatccttaattagggacagcgttttgaaaactgctttttattgtcctttatctgcaaaacttcttgaatccaaatagcgagattctcatttcttaatcactgccacagaaagttgtagattagagaaagctccaattccttatttcctgtcttcctttctttctgtgtgtttattgcctgtgtctcatcctcactcctgccagttttatagaatgtaacctcccagcctctgggaatgtttgggagacttgttcatagaggatctgaagagcagtttaaagtggacttacccaaactatcttctggagaacattagtctctttggagataaaatttttaaacatccgctagtccaatagtgttggcaaattccctgtgacactgtagccctctctttgagattgtcaatgtacgttggcatgttaaaggctctgagaagtcctgcagcagttaaaaaattgtttagtctagtgtgcccccagttgtttggccactgaaacccccttttctggaaaaaccagctaacatctggtagtcttttctaagaggtggtactgaagatgatactcatgttacacatttaaaaattctaacatgtgtttttcatgtgtttataaaatgcaactaatgtatcaaacctgtgatttccaggacataattacttaagctaaggaaaaaagaaaacatgagtgaaggaaaaactttagtaaataggccaggtggtaagaggagagagccttgtctgtgagtgtggtctagggggatgctggacctagcttttcagagctaggttcaggcagagctgctctgagatgtagacactgcagctggggttcttgttgagccgggaagcagcttctgactaaggtgcagactgtttagatgagctggtcataaagagccctgactgtggactgcgtctccagccacggcagcagctggtggatggggtgatgccttggatatttatcgtgtgtttcttgcctggcctgcccttggacagtgcgcctcaggaatgttagaatgtgttccccctttagcagcaaagccgatctgctgtgtacttgttctgtttatcttactgccacgaccgtttatcacgggccagagttcaggggcacactgataaatctcttttaggaggatgatgtaaccctcagcattttccccctacttggttctgagtttttaaagcttttgtaacaccatcatgtccttgtttgggcatcttcctgtgtactcccgtttgggtctccagggtgaaatagccaacagtggattctggagtcatggcctgggttcaaattcctgctctgctgcttatcaactctgactttgggtttaattgacctattcattatttttcttaatctggaaaatggagccaacagcagttcctcataaagcagctgtaaggattcaggggggtaactgcacagggccaagccctcaggtttcacctctcactgggaggtcggacctctgcataatggacaagctctcctagggtgcaagtgaacgggggcgcaagggagttaggaaggtgggtgttttttgtttttgttttttggtggcttgaaaaacatgcccaaggctgggtgtggtggctcatgcctgtaattccagcactttggaaggcagaggcgggagcattgtttgagcccgggagtttgagatcagcctgggcaacatggtgagaccctgtctctctttttttttttttttttttgagatggagtctcgctctgttgcccagactggagtgcagtggcgcaatctcagctcactgcaaccttcacccccaggttcaagtgattctcctgcctcagcctcccaagtagctgggattacaggcgtgtgccattgtgcccagctaatttttgtgcttttagtagagatggggttttgtcatgttggccaggctggtctcgaactcctgatcacaggtgacccatccaccttggcctcccaaagtgctaggattataggcgtgagctactgtgcctggctgacccaaaaaattagctgggcgtggtggcacacacccctgtagtcccagctacttgtgaggctggggcaggaggattgcttgaggccagcctgggcaacagagcaagaccttgtctcaaaaaaaaaaaaaaaaaaaaaaaaaaaaaagaaagaaagaaaagaaaagaaaagaaaagaaaaacatgcccaaaggcaaccaaatgactccatcttttgcaatgtaatcttcaacatcgactcctctggcaagctgtttggaaatggcaaagtccatctcctgaggctgggagattgcttgtccaggacgggtgtgtctggtgaggaatggaaggcatttggatggccactgagaaagctgagccaaggagcatcagaaagacaatcaggcaaacccacagagtctccaggtattcctttgctgataggtaacattgcactagcgatttaaacaaacaggtgaaaggccattgccctaccaccccacctcacctctattccttgctgctctttccagaagcaactgcatggtctgggaacagttttttgtcttgtcaagagacagtctgtacatagatgaattcaattatattacttctgtagtaccctgtactcaaatttgaacctgtcatacacattgcttttatcatttcataatacctgttgattttcccacgttagtacctatagatcctgacaagcaattttgttaagatgaagagttcttcatatgtattgtactatgtttctttttttgatgatgtatgtcaagatttattataaaagtaacagatgggtagggcatggtggctcattcctgtgatcccagcactttgggagaccgagatgggaggattgcttgagcccgggagtttaagacaagcctgggaaacctggcgaaatcctgtctctacaaaaattacgaaaattagccaggcatggtggtgactgtcccagctacttgggacccaaatgtcccagatactcaggaagctgagtcgggagcctgatcctcagaggtcgaggttgcagtgagccgtgattgcaccactgcactccagcctaggtgacagagtgagaccctgtctccccctggcctccaaaaaaaaaaaaaaaagtaacatatgtagtttaaattttaaaaattaaatttttgggggggctgggtgtggtggctcatgcctgtaatcccagcactttgggaggccaaggtgggcagatcacctgagatcaggagttcaagaccagcctggccaacatggtgaaaccctgtctctagaaaaacacaaaaattagctgggcatgatggggggcgcctgtaatcccagctacttgggaggctgaggtgggagaatcgcttgaacctgggaggcggaggttgcagtaagccgaaatcatgccactgcactccagcctgggtgacagagcgagactccattaaaaaataaaaataaaaaatcaagcaatgcagaataaataacaacaataaaatgaaagcccatcttccaccatcagcttcttagttttcttcctagaaggagccagtgaggacagtttggtgtttatgcttccagatctttctgttcagatgcagtcatgacttctgaaaaacaggattgtacaattcatacttttctacaaattatccccttcccttaatacatcatagaagcctattcatattggaacaaacaaacatttcttattcttttcacagcaccctgttttcctcttgcttgaatgtaaagtttatttaaccacttactgtcagggaggcatttgttttcagttctccctccctccccccaccagttgtcttgtaatgaactgctttaatggctaaagatcactttaatatcaaaacctcccccacctcccattagaaaaagaaatcatgttagggaacttcaaattgaatttacggaccttgtgtttaattttctatcagcagtggccccagcctggcccctgcagactgccccggaatctgtgggaggagttggggtggcctgcagactagagcacactgccagttcattcagcagctcaccgagcaagaaacatcttgattctatcagccttaatgctgtgtcccattagggacccagctcttgtggtcattagcagatggaatgctcatctgtgctagaaggcggaattctagggcattcggctctgagcagtcttgaaccagaattgaatggcttgaatccttttcacaatgccaacggggaggcacccttagctcccaaacttgtgtgtgttataatactatggtagtaataacagtggttgtagtagcccccgtgaatttgatgggacagtcgtcaggcagtgctgcttgcttgctttactccatcgtatcaccgcagcctgatgaggcgagggagttacgactctcattttgcaggtgaggacactgagcacagggaatcgacccactcatggtcacacagcttgccaagtcgctgtgcttgggaggtgaaccaggcttctctgacgccccagcaggacgtctgaacttctagctgccccatcactaactgacttaatgcccctgactcctgggtgacttggccaccagttacttcagccagcgacctgccctttctttgagtgggttccacccatccctgcaccatgccttttactttggatgttggtggcatggaattccacccgtaagaaggaggtcggtccctgggctgagagagtttgcagagagctctgttgggattgggtgggacgtgtgtttggaggcctcctcacataattgtgggctgaaaggtccagatttggggatataaagttgagccgtcagctgagctaaagacagggcacagggaggagccatccagaaagtgtcagtgtaggtaaagcaggcagagttccccctatctgtcctctgagggcctcctttcttgtggtttcctcccttttctgtggtgatggtcagagccagcggttataaattatttggaattttcctcagcttggttcctactcaagactttaaattaggagttttgttcccttttatgacttcacaatctttgggcaggctgccatctctacagcaggctaatatgagttgtaacttgaggtgagttacaggggaaaaatggaagctgatttctccccttttaaaccaaggaagccaccttgatctgactttgtaacaaagctcaacttttgtaagtttgcaattaaaggataaatacctatcctatttattattattattaactttttattataaaaggggaaaaaactcccaggaaacatagcctaatatgagggacaaaaagccaaaaggttttttttttcttcctttaaaaggtcctcaatgtcttgccctgtggagacaccagttttcattataataacgccattatctctttgtagagtcatttcaagccaatttaactttctcatttaaaagtataattggtattcagcacagagctgggagctcagtaggcagttagaaaatatgtgtatattttttgagacgaagtttcactcttgtcacctaggctggagtgcagtggtgcgatcttggcttactgcaacctccacctcccgggttcaagcaattctcctgcctcagcctcccaaatagctggaactacaggcactcaccaccacgcccaactaattttcgtatttttagtagagatggggtttcaccatggctggtctcaaactcctgagtttcgccaggctggtttcaaactcctgatttcaggtgatctacctgccttggcctcctaaagtgctggcattataggcatgagccacagcacctggctggcagttaggaaatatttattgaatatgagaaaagaaaaatagagcaaattgaatcttcaagtagtatgtgagtaactctaattcctgttttctggaaaacacacaggctgataggtttgggtaaataagagcagagctgcatcttctctcaagttccctgattccctcaaggagttacctgagaatagctctgtgccaagcagtgcggcatgcataggggacctcttgaatggagggacagtccattatcattagaatccccagttccagccaggtgcagtggctcatgcctgtaatcccagcactttgagaggccaatgtgggcagattgcttgagttcaggagttcaagactagcctgggcaacatggcaaaaccttgtctccccccgccacacacacaccacacagacacacagacacacacacactggctaggcgtggtggcaggtgtctgtagtcccagctacttagaaagctgaggtaggaggattgcttgagacttggaggtcgatactgcagtgagctgtgatcgtgccactgcactccagcttgggtgacagagcaagaccccggaccctgtctcaaaaaaaaaattccccagttctcagggtgtggtagaggccgagtcagtcatggctgagacaaggggactgtgctctgtgtgcttctgtgccctgtgtttatatggttcatacgctgcctgtccaccatgtttttcccgagagcctcggcagcgcaggcatcatgggaatgactgagtcaggtggaaattcagaggccctgccctggtgggcagagaagcctggcttacctcccaagcacagcatgtgtgtggatcacttctgtgcactgtctcctcatctccaaaatgggagtcataactgaactcacctcatcaagttgttatgagatgatgtagattcagcgaagtagcaagagtaggagtttgggctttgataacagagagaagtgagtttccatctagattctccccctgtgtcacttttggcagttggcttcacctctgtgggcctctgttatgtcatctgtaaaatgggattaaccctaaaagccaccctcacagggtcattgtgaggattgcacaaggtgatgcaagtggcacagggtctggcccaggagagggggctggaagagagcgagctgccattgtattttggttgctgtggatctaaggagaagagatgtttaggagtctttccctggcatggttcctcctgccttcacccatcactcttttcctcgagggattccctgtggggtgcacagccccagggtgggccagactgagctcacaggagcatgggctgtgtttcaggtgaggtggcctcaccacatgacaaactgagctggagtcaaagggtcacgaggacctccattcacagccagcatttattatttcagctggaaatgtttgccgagcagttgtagctggaagctgtgagcgagacacagactgccatcaggctgaggcctccagagctcatgctgggctttaacctgagcctcttgggggctgggctctgagctcctccacttctgctcatgcccaggcgtccttgggggccttgaactgtcagttgtccaggagaactgtgtggcagcaacagaatgagtttgtatagcaacctgttgctttgaggtttaaaacttagtttagaacgcaattgctttgaccattttggagtgtctatactttttttcttcttctttaagttttcttttttctttttttcttttttttttttttgagacagagttttgctcttgttgcccagtggcaacaagagtgcaatggcgaaatctcggctcaccacaacctctacctcctgggttcaagctattctcctgcctcggccttctgagtagctgggattacaggcgcccgccaccatgcctgaccaatttttgtatttttagtagagacgggtttcaccgtgttcaccaggctggtctcgaactcctgacctcaggtgattcatctgccttggcctcccaaaatgctgggattacaggcataagccatcaagccctgcttttttgtttcccttcttcgacctttctaacaagaggttggaatcctcgttttgacttttaaaggatttcccagtgctagaaagtggtaagatagttactgtatcctaggccctttagcagacctgtctcattgatcatttatttagtccagtgtggctttgttgttggatattaagtaattctcaaaattttaccttttcaaaagtggcattgaaaataaaggcattgggtgatgaaaatggaacttttaaatacagtgattcctgttaaccagaaatagggtgtttgggataatttatgaagcagtacaccatcatagatactatgagctgaaagttcaccaaactctctatcccaaaataacaataaggtatttatgaagtgattcgttccaactatttgaggcaaaaattgtccagcaagtgagagagaacagaaggaatagttggcaaaatagggaatttgaagtctgaggttatgcataaggaatgtgttatgggcctatagtagaaatctcaaatcagggattagggaatgtttactcagttctgttgcagagaaatcctggccacgactcccccatgccatgcccagggcaggcattgctaatcttcactgcctccattctccatgccctgttcacggaagacatttctaatgcattttagcagtcttttttttttttgctgaatccagatgtggcctcagaatccttctcaacacagtgtactagcaccacttggtgctcctgatctactgtatcatctcttgaaaaactactaacatgaaaagacctgccaagtcaactttatattaactgaacccttgacacagtgatggataaaaattaattcaaacagcttctttgtgatctttgagtagttcatgagcaagaaagagaattggaaatccagccaacttcggcccccttgtctacttgtattttactgtggtttatgttttctcttaccaattgagataggcccatgagacttctggtcttccaaagcccagaacatccccacattatagtttaaccactgtaacaaagaggttttttttgtttgtttttttgttttttttttgttttttttttgggacagaatctcgctctgtcgcccaggctggagtgcagtggcatgatcttggctcactgcaagctccgcctcccaggttcacgccattctcctgcctcagcctcctgagtagctggggttacaggcgcccaccatcacgcccggctaattttttgcattttttaatagagacggggtgtctggatctctgacctcgtgatccgcccacctccgcctcccaaagtgctgggattacaggcgtgagccaccacgcctggccagaggttttcttaaaaacaataacaacaaaaacagttgtggaaagcatgtagagtgtgggttttttcggtcttcaggttggcagggcatctgatactgggacccaggttccttccctcaccttgctgtgcctctcctagtgcaggccaaagccaggtgactgcgctgtctgggctcctggctggcaatcggggaaagagtgcatggagcaggcatgcccactgttcaggtcctgaagccgtggctcatttcatatcatttgttgcttatttgaaagacaggcacagcactgacttccaggggaggctgactgaccatctaggtggaagttgcatgcctgggagggagaaggggacaaaggccacagataggcatcagttatcagggccttaagtctgccttgttggcatgcagccttttattggatcaaggccctggagaaaagccctgagcaggaggagataagccagcttggtccccttcatcctacccaggggcctctggggtacctgagccaaagtgcacagttcattggctgtgtggatggaagggatatgggacttgaaaatgggacactggtcctgggcagctgaccgacatggtcctccttaacctgctgtctggggagatgggttgcatctggctaggttttgactgaggaactgaggagagctgtcagctgtccccgctttggttcagaatgcccttttgtttggacagctgaagcctacaattcagccatggtttgtttgggctcagaaaacaggcaaggatggagagaaactgcaaagctgacctgggctgtcagtgggcaccaggtcctgctggcctggggtctggatgcaggagatctgagctcttcaatgtggggtggtcttgcagcagctcttcacaggctgctgctgctgctgctgtaggctcacccaagcagccaagacggacaggatctattctagttttgtgcagagttggatatagaagaggcattagagggagaggggatggggaaggagttccaggccaggtgagcatggggcacagtaaactgggatgttaaggaggggccagtttgtgaccagcctgggcaacatggcggaaccctgtctctataaaaaattaaattagccaggtgggtggcatgtgcctgtagtcctagctacccaggaggctgaggtggaaggatcgcttgagcccaggaggcggatgttgcagtgagcagagattgtaccattgtattctagcctggatgaccgagaccctgtctttaaaaaaaaaaaaaaaggaggggccagacccctgacccatatgtgctgctcttttctttcagggaggtctgataaaatatcagtagttcaattctttttttttttttttttttttttctgagatggagtcttgctctgttgcccaggctggagtgcaatggagtgatttcggctcactgagacctccgtctcccaggttcaagtgattcttgtgcctcagcctcccaagtagctgggattacaaggtgcccaccgccatgcctggctgatttttgtatttttagtagcgacagggtttcaccatattgtccaggctggtctcgaactcgtgacctcaggaggtcctcctgcctcagcctcccaaagtgctgggattataggcgtgagccaccatgcccggcccatagttcagttctttaggtggttcttggtgctgcatatgagatctctgcaagaaggacacgtctgagccgggtggtttagaagaccagcatggcccaagaccctcagagcaacaccaagaaccacctaaaattctttctcagacgtgtccttcttgcagagatctcacgtgccccaggttcgctgcagcgttaggggtcagcctccctttggagcaggagagcaggggccttggaggtggcagtcatggccctcctaattaattgcttggctcagagaagtgacaaattgaacatttcaaccacctgttaattcacaaggtacttcttttcatttcttgctgcttgcacaaaacacttggagtatggcttgtggatgtctggccctagggaagagtgtttggcacatagcaggtacttaagtattaggaaaatgaggatggaggggagggagggaacattattaagcggccaactgtgagacaggcattgtgcttgactctttctttctttttttttttttttttgagacagagtctctttctgtcacccaggctggagtgcagtggtgtgatctcggatcactgcaaccgcgcctcctgggttcaagtgattttcgtgcctcagcctcccaagtagctgggattacaggcgcctgccattatgccctgctaattttatttttagtggagacagggtttcaccatgttggccaggctggtctcgaactcctgacctcagtgatctgcctgcctcggcctcccaaagtgccaggattacaggcgtgagccactgtgcccggccgacacttggcattctctaacctacctactccttataacagccctgggaagtagttgaccatggccatttctatttggtagatgaggaaaaataaggttcagagatggattgttcaaaccgatgtatctagtcaagctactggttcccgagcctgtgtttgcaacccctctaccatgtagcctctccgggtggtagagatgagggggcagagtgcacagtgcatggcatcctgttccccagatggccaagtcttagtgcgagtgtgtgtggccttggtaacttgtgtcaagcacacaccccatctctctctctctctctttttttttttttttttgaaacggagtctcactcggtcacccaggctggagtgcagtggtgctatcttggctcactgcaacctctgcctcctgggttcaggcgattctcttgcctcagcctcccgagtagctgggactacaggcacatgccaccacgcccagcaaatttttagaagagactgggtttcaccatgttggccaggatggtcttgaactcctgacctcgtgatctgccctccttggcctcccaaagtgctaggattacaggctctcttgctctctctctctcttgtttttttttttttgagacagagtcttactttgttgcccagcttggagtgcagtggcgtgatcatggttcactgcagcctcgatctcctggctcaagcaatcctcctgcctcagcctctcaagtactagttggtactaatgggcatgcaccactacacctgactaattttttttattatttgtagggacagggtgtccctatgttgcccaggctctggtcttgaactcctgggctcgagctatcctcctgtctcagcttcccatagtgctgggattacagagatgaaccgcctggcctacacacccctatctctcctcgattcttttttttttttttttttttttgagacagagtctccctctgtctcccaggctggagtgcagtggggtgatcttggctcactgtagcctatggctcccaggttcaagcgattcttgtgcttcagccacccaagtagctgggattacaggcacacaccaccatgcccagctaatttttgtattttgagtagagacagggtttcaccgtgttagccaggctggcctcgaactcctgaccccaagtgatcctcctgcctcggcctcccaaagtgttgagattataggtgtgagccaccatgcctggcctctccttgattcttacagtcactttgttggctgtttctgactcagcagctacctgcattgtggccaaaggatgacctattccttctcaggagggcaaaaatgtggaatagtgtctgtccatgcctctcctcatgggctaccacctctgccaccgtggttaatcagtaacaaccaggagagaagctgctggaactgacctctgggaactccctggatggtttggtgcaggaatgtagtaggcatacacgtggttgcgtggatctgggccctcctgatgtgagtagagaggtaaaaggccaccatctccttgacctctggggaactcatccacaaagaagatgtttccaagatgcttctgaagattgcctaaaaatagccggtttccacccccgtgaatgcatccattctagaatgctccttcaccaggaccagagaactgatttacagaagtgacatgaaaacattccatcccagaatttgcagtagctcaaattaagtttctagctattaaaaagaaaagaaaacaaaactaaacaaaacacacccaccctgctcacttagaagcaacactgagtaattttaagtagttcgagaaaatgtatgtggtttgagggtcagggttgtccagagccaagaccagttatgtgggaattgttattggctggatttggggaggagaaacccatggcccaattccaacccactgaaatctaagcagattctaggtggttaggcggacctggtaggcgttggtttattttattcccgaaaaaggccctggagcaagtcttcacatggaatcctgctgaaaggcttccggctcatctggccttttcctcctcttaaggttctgctccatgttttaccctcggcgtaaacattgcagagcacgttcagatctgaaaagtgtctcatctacgtgatggtcagacgttgttgaccctgtgatgctgtgtaacatttcattttcgaggcttggggagtctcctatttcatgtggatgggaacctggaggtctttgggcaagtcgccatctttttattgttccaagagtttggtgaagcgtttgaaccttcacctgtcaaaatcagttttggaatgagaactgctctctctctagtccttataatagcagaaggaaggtatcatttatcccaatgagaccataaagggggctttcccgtgtggacacccaccttgaattcaattggaaacagaaattctgggcattgtattttttgtaaatttggctcagacttcaactggatcatatttcccccaaaatcttttcgaaaaagacttgtgtctcattcctttagactagcatgtgtaagctgggtaaaaatagagcaagccgatttcatgttaatgatttcatgttaggtttgtgaatcaaatctgcaagtctgcttttgaaaagcatttaacatataacttgggaaagtttgagttttgcagactaatgcctgtggccggatgagacttcatagctccatccaatccctcctggtgcaagagatcaatgccttgagggtgcctggccaccaccattaccctgacagtatacccactatttatttatttatttatttatttatttacttatttattgtttacccttttgaagattgctcttctccctttaacttaaaggaattggcatggaaacttgtttgatctggaatttctgataatcagtaggtagtaactccgtaatcaatagcacttcaaaacaacaaccaaataacaggataactaatccaaaaaattcagtcatggtcaaggacttccagctcaggaaatgtctggtcccgtggggtggattccttggataaccaagttccgtgcagggcctggagttttatgcagaccattgctccttgattgaccacaggacctcaaaaggagggctggcttcatgaccacatgacccgtgtgctcagaagggccctgtacttggtttattgctctgctgttgctgtcttgaagttcttaattttttttttttttttggcactggggagttgcagtttcaaacaacacttattcattgtctcacagtttctgtgggccaggagtccagccatggcttaagaccaggtcctctgctccgggtctcacgagactacaaggaaggtgccatctagggtgtgttttcatctgaatgcctaactaaggaaaaatccacttcattcaggttcattcaggtttttaaaagaatccatttctgtgtgattgtcccactgacaggtcccagctttttactagctgttgcttggaggctaacctcaggttttacaggctacgctcatatctctgccatgaggccttctgcataggcaattcataacacaggtgcctgtttcctcacagccagcaagagaatctgtctcctgtctgctaaagtggagtttcatgcatcgtaatatggtcatgggagtaatagcccgtcacctctgccatttttctgttggttagaataaaggcacaggttttccccacactcaggaagaacccatgatataaaggctttcagtaaaggagacgacaaacagaatatggaatgatcagaattactcttatgacccagaccaagaacatcagcattacctacgaatttattggaaattcaaattctcctgtttcaccccaggcctgttaaatcagaaactttaaaagcgagcccagcattctgtggtttaacagatccttcaggtgattctgacacctgctgaattttgagaaccactggtctagaggcaggcaggtcttgctcccctaggagttaagtttgatgtatcttctggtaatactgagaaatgagctgggaaatggttccaaaatcagattatcctccccaggattaacaagactcatacttgcaaaagagagtgaagaagagaaactaaaaaaagcaagaggctgtgtgtgaagctagattcaaacagttaaagacagcaacacatggcaaaggatgggaatttgaggaagtgggtagtgaaagcaattcttgagctaaattacaagaaaacacggtgaatttgtatctgtttcctatatttagggggctggcttaaacgttagtgatacatttggggagtagaaaatggatgttggtgtgaagttcttaagttttggacaaggaaccctgtattttcatttttctctgagccccatgaattatgtagacagtcctgcttcgaagttattatttatacaattcattatagagaaagtccttgggaaccttaactttgagtgaggattgcttgagttagtttttcttaccagccactccatgatactctttgttttttccaggttagatgatcgagttttattatgactgaatctgcacctgcaaaattaattctgattaattaatttaataattaaattctgatgatttctctctgatggtttgggtgtgggctcttaaagagggtctttttttgcaagaggatataacaataatcaggttaattaaaaaaataaggctctcaccctttcatttttgagtggcatgccatgcaccccttatcagcatgtgagtatgcttttcatgtggtcgtggttgggtttcattaagtgtaatttggcatgtgttcaaccagcattcaggtggctcttggtgggtggctggggagacaccaagatgcagatagctcagtcactcctcaacaagcggcttagttctggaatgaggtgggaggccaaggaactcacacataaatgctggtgggagtgaagtgccaccagctgtagaatctggtgtcagaatgatgagccaggagttatcccacaggaggatgggtgaaggtcttcccatcaaagggatagagaacatgtgaagaggtccaggggctcagggcaagatgtagtccaggaacaaggagtctttgagcctgcagtatggtgggtggaagtggcaagagtggaaagcggattggatggggtttatgtaggttctgaggtgctgtgtatgtttaaggagctgattgtgtgcagcgggaaccctggtgaatttggaagcacagaggcacctgacgagaaagatggttctggggttatgtgaacagtgattcggcttcaaggctatcaaagacaaaaatgtttattgggagggtatagaaaagggtttgccaaaagagttaggtagggatagaattgacacattgtggaaactatacccagagtttaagaggtggagtccaggatagtgcccatgtttgtagcttggggtcctggtagaatgggagctggctatggagtatctttgttggagagtgggtatagggaaacggagagagagagaaagttgcagggggtgcgggagatggatagctgcagagaaggcaagggcagggaaagtggaaacaaatggcagtgagactcctggaaggtgctggccaggggcatggcatggcatgttctgttaagcaaggaaaggactagaaaggggccatgattttggctgggcacttatcctcctcacaacaggacgcatttgtgtcatggcttactcttaagaatgactgacgtgtcagaatagcaaatatgaaaatgattgataacacctagcattggtgagatttgcagggataactagctggcctcttaaatctatagataggaatgtaaacagaaacaaactttttatagggaaaagatatctaggacataatgattaatgaaaagaaaaaaattcctacctatcgaaaaacgtgaattcaggcagcaaacacacatgcatgtatacacatacacacgtgcacacacgcatacacacacaatctggtaggctgtatactaccagtttagcaggttgttacctctgggatgcagtcactcctttttgttgtgtatatttgtgaaatgatttctttcaatttttgagacagggtctcactctgttgcccaggctggagtgcagtggcgtgacgtcagctctctgcaactttcacttcccgggctcaagcgatcctccaacctcagtctcctgagtagctgggactacaggagtgagccaccatgctcggctaattttttttttttttttgggtagagagggagttttgccatgttgcccaggctggtcttgaactcctaagctcaaagcaatcctcctgcctcggcctcccaaaagtgctggggttacaggagtgtgccactgcacctggccattattatggaaaattttaggcgtatacaaaagtagagacagtggtgtcttacatgctcatgaacccatgatccagtgacatccgttaatggcattttggaatcatatttcatctgtttttgtcctcaaatgttttgaagcaaatttcagcattacatcatttcactcttaaatatctcagtatggttctctaatagttgaagactccatttacatttatataaggagcataatttacacttgtgtaacccaaaggaatgaccaagcctgtgcttctctccccagatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtaagtggccagggctgcctaaaccatctgtccaggatgggggtgtgtgggtcccaaacattctggttttcaacgggaatgctatctttgctttgattagcgtatttctccaggtcttagcccattataagcccattataaggaaactaaaactggctctgtgtacccttccaagggcagattttctaggtatatccatagacatgtttgagcatcaagttgagtcttttatccaaattccaatgaaggagttggtgcttagaagcaagacttgggtttaggttccagactccaaaatcctgtgtcttcccacattggtgctcagtttctcattggatttggagaaacatttggtcctattaggtggcttggcatgaaaatctgaaaacttccatggagtggaaagtacccatttttattaaccactggtttgactatatatggcattctccacccttttctttctgtgttgctgtgaaatagcatttggtcaggatccagttggagccttttccacccttgatgggctgctcatttcttagtggttgagtgtatatgaaggttgtaattattcccactggagggtttagattgatgggtagagtttgctggtacacactcagtagaaagaccagagtcagagtttacacacaccccctaaagttgattttaataaaaaaaaaaggtattaatcatattttccatttactgtgtattctgtatttactgggcacattagtatttagttagttagtggttcttgacatactcaaagcagaactagtgtcagttgggtaggggagggctgaaggcctcattcttacttgagagcctataagttggtgtcatccaggaaaaattcaaagtgcagcattaattgatttcctaatatcctcttctttacttccatttaaggacacattttaggatacctctttccaatttaaacctgggagtttttactctagtcctttacctcatgtgcttacaaaggcttttaagataattctaggtttgtgcctttgagcaagtggatttttgaatcacacaggatgctattctagactttttagatatatccaggaatagagtaaaaaataaaatccctcctgcataaaggcaccaggctttttccaagctttgtttattttttaacaccacttcttcaaggaatggataatccccatcttcatgcaagaacatagcacccggaggagaagtctcagtaatggaggatagtttacaccctggcacactcatacctgtgatactttttgcctattaaatatatgatttgctcagattttaggaaaaaatcattctctgaactaaaagaaaaaatggggttagtttaggcacatggtttcctttaatctctttggtcagctaatgctaaaagaatcttttgtgttctgttaacaggtctgtgcccagactgggaatcctgggacccgcagaagcctgtggataatgcacgagaagccatgcagcaggcagatgactggctgggtgtcccacaggtatgcacaagtgtgccaggtcctgtgaggctgcccccacccactagcttgttctgtggatgccttcccgggtcaggcagcccgaccttcttggcattgagacttcagagagcattgcctgtgatgctctctcatcttcctcagtttacccataataatagtaggttctcattgactcaggtgcttatagatcttagtgtgttggtttaatgtagatcatccagaaattttcatgtcactcttctttgtcacacactggcaaattttctagtatttcttctctaaatattttgaagactacctttaaaccccagactacaaatatggaccctaactattaggttgagccataagaaattgatagtatttgaccatttttcaatctacattttaaaaggtaattttaatccaatagcttaagaaaagtcacaggacttaaaatttttttttttttttgagatggagtctcgctttgtcgcccaggctggagtgcagtggtgtgatctccactcactgcaacctctgcctcccgggttcaagcaattctcctgcctcagcctcctgagtagctgggattataggtgcgcaccaccacacctggctaatttttgtatttttagtagagacagggttttaccatgttggtcaggctagtctcgaactcctgacctcgtgatctgcccgcctcagcctcccaaagtgctgggattacaggcgtgagccactgtgcctggccgacttaaaacttttaaaaacatgtaagccaggataatccaccattaatggaaactgtggaagaatctctatcacccataatcctatcacaggaatataacaagagaactcagaaatcaaataagtcttggataccatctacagtagtcacattgcttagttgaagtctgatcttcctagctgggaggaaaaccagtgttttctttccagaaactccctctaacagttaggcaccatgagtcccgtgtccaaaggctagccagggaagattgcaggtagccagtgccatgggactgatggcgtcactataggctgcattgaggtctgagttcagtgtattttgtaacagggtcccttggaaggtagaacaacatgcctgtttctttggtttggttttggagtcatgtctctcctacatggctcattggtttcttggctcgtccaccctcaggaagtggtgtggtgtgtttttcatctccgcttaaacctaaaccgtctcctttttacgttcacgtgatgttggcatgggtgaagttgttgaaggagctgctgggaagaaatgccaaatcgacacacatcctactttttatggaatgtattgaaggcgactgttcaaacccaagtagctcttttgttcctgcaggctaatggtcagaatgttttctggtgctttttatcacatggggagggaagttggacacatctgttgttcattgcacatggttaacctggtccatgagacagagcctctgttcatctgaggaagtgtgatttacctccttagcaccattactggaggcagggaggactctgcaagctgtttagggctgggtcagatgatggtactgaaactgaggtggtggcaccttcagggaagtcacctgtccaggatgggtctagtcttgctcctaagctgaatatcaagagaagttcacccattccctattttttttttttttttttgagatggagtcttgctctgtcacataggctggagtgcagtggcacgatctcagctcactgcaacctccgcctcctaggtacaagcgattctcctgtctcagcctcccgagtagctgggactgcaggtgtatgccaccatgcctggctaattttgtatttttagtagaaatggggtttcaccatgttggccaggcttgtcttgaactcctgacctcgtgatccacccacctcggcctcccaaagtgctgggattacaggtgtgagctactgcgtctggccttttttttttttttaaagagacagcgtcttactcctctgttacccaggctggagtgcagtggcatgatctcggttcactgaaacctccacctgctgggttcaagccatcctcctgcctcagcctccctagtagctgggattacaggtgtctgccaccacactgggctaatttttgtatttttagtagagactgggttttaccatgttggccaggcttgtctcgaactcctgacctcaagtgatttctcttgtcttggcctcctaaagtgatgggattacagtcatgagctaccacgcctggcttccctatttttttaatggctcctaatatattgagatcacatatctaatatttacatgttatttcttttttatttaccttttttaattagtagagttaatacagatacagaccatgagtatacaagcaaaggaaaaagctggttaacctgtgcacttttttgtaacatgctctaatcccatgtgtgcttgtttcttcattttcctgccttgctatagcttatccttttatcatttttgaaattttgaccagaggagtaaatggacttttggggaatggggaggacaatgaacttttggaagttacatgcagaattttttggagaggggcccctagctttcaaaggggtctgcaatttctcaaaaatggttaaaaacactgatattggtgtgttggtttaaagtaatttcacttaattgagaagctgactcagtttcttaatatttgtagtgcttggtttaagaggcatttgcaaacacttcaatagttgcaaagtgatgtgttctgggtgttcatccaccatgtcattatcctaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggtgagtgctggtcctctggtgttgtattggagacatgtcctctggtgttggagatgatttcatggcttcaagagtgatgttcttagaatcaaaaatagataggtgtaatcctcaaagagaccccaagcctcctttgtaacacattttatgactgttttattctgccttgtttttctaaggctttaagaaatgtttctgcttagatggaaagggcaagtttgctgcttggtgattttagtgcagtagcccattgctcccatttttcagaagaggaatcgcggggtagggagtcgggggagtttggtcttgccccagatcaccacagtcagtgatgggggtgggccatctggctgctgattcatttctccttctgttacactaagcctgcctcagatttccagccggagtgggagctattgttaacccctggcagatacttccttgctaagacatcctgtttatgactgcgaggcagctgcggaacaccgttttgctcagaacattatagtgggtagaagccatttcaaggcatttggtgttgtgattggcacctgacttcaagcacactagctttgtgaagagaacagttacatggctgcaaagtgtggtttctggtgaagatcaacatggccagatacaacttaatgccttttctatgggggaggggaaggagtgcattttatttctcatttttcataattaagaaaatatcggccgggtgtgatggttcatgcctataatctcagcactttgagaggccgaggcgggcagatcacctgaggtcaggagttggagaccagcctggccaacatggtgaaaccctgtctctacaaaaaatacaaaaattagccaggcatggtggcgggtgcctgtaatcccagctattcaggaggctgaggcaggagaatcgcttgaacccaggaggcagaggttgcatcgagccgagatcttgccactgcactccagcctgggtgacagagtgcgtgagcctccgtctcaaaaaaaaaaaacgagaaagaaaatgttatcccagtgggataatagttatacacacagtattctgtatatcttctcccagaattgacagttgttaccattctagcttaatagttttctcttgccctttgtgtgtgtttgcatatgtgttcatgtgtatgattgctgaattatttgaaaataagttgcaagcatggtgacagttctgtcctcagtacatcactaagcttctcctaagaataggatatcctctagcataaccacagtattcattgccacatgtaagaaaattaacaatagtttcatataatctaatattcagtttgttgtagaatttctctattgtcctaagattatcttttatagttgttgctgttttacaaactaagatctgattaaggttcacttactacatttgtttgttatttctctttagactcttttcatgctaaataatttccccaaacttttttttttttttttttaaatgacactgactttctgaatagttaagggcatgtgtcttgtaggatgttccttccctacaaatgttccctttgaataaagtattttcctgcttggtatcagcttagtctttttttttttttttttttttgagagtcttgctctgtcgcccaggctggagtgcagtggcacgatctcagctcactgcaacctctgcctcctgggttcaagcgatcctcctgcctcagcctcccgagtagctgggattacaggcatccaccaccatgcctggctaatttttgtatttttagtagagatggggtttcaccatgttggccaggctggtctccaactcctggcctcaggtgatctgcccggctcggcctcccaatccgcttattcttaagacgacacatggctagggcagtgatgctgaccacgtgctgttctcacctcagtggtcgagtcttctcatctgactttttgggcatgatttagaccggcagatagttctggaacaaaccccttaccatttgaggttccgtttgcagtgggttgtgaggtgtgtgagacatcacttgtgttatgtagggactagggacttcaaagccctcctcccattcacagtcacttgaaggctggcatgtcctcactttctttaaaagtgctttctttggccgggcttggtggctcacacctgtaatcctagcactttggaggctgaggcaggcagatcacaaggtcagaagattgagaccatcctggctaacaaggtgaaaccccatctctactaaaaatacaaaaattagcttggcgtggtggtacaagcctgtagtcccagctactcgggaggctgaggcaggagaattgcttgaacctgggaggcggaggttgcagtgagccgagatcgcgccactgcactccagcctgggtgacagaacgagactctgtctcaaaaaaaaaaaaaaaaaagtgctttctttaaggcataccacaggtggtggctggaatgaggaatctctgactttaaaggttatgcttccttaatgacaaaacagttgcaaacaaccaattaaatcctttgtcaaccagattggtcaaatggactgaatctaatcaaggcatagtgtatgtttgtaataaccttatcactggccatccggcttccctgttgttaatgtgagacggtttcctttcacggtgctattttctagaaaatgatcacttgttatggttcaggaatgtggctggtcattgccatttccttcatctgcctcttagcaagtgtggtgcacttgtagaggaaacacacccttttaaaaaaaaatttttttttatatgtgtgctttttgcatttttttaattgtgggaaaatatccataacataaaattcactattttaaccatttttaagtgtggcattaagtgtattcacgttgttgtgcaaccgccactgctatccatctccagaactttttcaacttcccaaactgaaactccatactcattaaacaatagcgccccattctcccctctcctctgctcctggtaacctttattctactccctgtctctatgaatttgcttattctagggacctcctagaagtgaaatcatatgctgtctgttaggtacctcctagaagtggaatcatacgctgtctgttaggtacctcctagaagtagaatcatatgctgtctttttttctctggcttacttcatttgtcatatgttttcagggttcaccatgttgtagcatgtgttagaatttcattcctttttaaggctgaataatattcctttgtacgtgtatatcacattttgcttatacattcgtctgctgatagacatttgggttgttacattcttttggctattgtgaataatgctgctatgaaaacatgggtgtacaagtgctgtttgagaccctgctttcaattcttttagggatatacccagaagtggaattggtggatcatatggtaattctatatgcagcttatttttcaggaggaagtggcctcactctgctttttaaagtaggagacaaaatggtcatattaggtgacagggtcacaaggccacatgggtggggctgtgagatatgtccctgtcatgtggttagatgaaagccggggtcagttttggtcttctctgtgtgaccacattgcttcatttctgccacctgagcccaggaagagagaccgtttcatcttctagtttctaaaagatttgaaagtgttgttttattttttatttcctgattgtttaatagatgccagttgccagccagttagcatttgttgatccattcactgagtcccaccttgcttagttctagtgggttgaaaggagagagggctggggtgaggtggacctccagccacaaacagatctttgtggtgggcttccttgcagggttagctatgtgaaaagcattcgtccatgagctaatcagaaatctttgtaaaaatctagttctctatgaagcatttactgtagagcaatccttaagcacccttctatctgagtaatcagaggggtaccagttgtctcctttcatggtaagcaaagctccgcagaagtttacagagttggggtgtggttcaactttctaaccagccatggttagccacgggtgaccaacccaagcccagacctttgacaagctgcagagtacgttgtttcttaggctgctggagtcacacgaagtggaacttttagtattttaggtgcatgtttatttacttacttatttttgttgttgtcgttttcagatagagtctcactctctctctctgtgtgtggagtgtcgtgatgccatcacggctaactgcagccttgaccttctgggctcaagtgattctccctcctcagcttccctagtagttcggaccacaggtgtgcaccaccatgtccagctttttttttttttaatattttagtttgagaccagcctggccatgttgcccaggctggtctcaaaatcctgagctcaagcaatccccctgccttggccccctcaaagtgctgggattacaggcatgagccaccatgcttggctattaggtgtatgtttaaatccatttgcttatatcagttacataacctgagtgttatgtaaatcttaagcaaaagaaaaatatatgaaataaaaattgaaactcacttcccaactgccaatctcattcctgccttcaaagtttcaggtatttatttctagccttttttctatgctgagttaaactgtgtatcttctttgctttgcatttcttactgagcagtgtgggaaggctaccttttaaaatttatttgtagttctttataatttttacctttctttttaggcagaaagattatcttattatataacagtctacggccattttttcttaaactaaattattgggaaatgaatagaaatccagagtatagtaacaaatgacctagtgtctttaacagattggtagctaggaaaaggaagtggtggagagacagccggagattaaatgagacttaagagacttagcaaccatttgtaatatgtgaccttatttggatcctattcaaactaatggttaaaaaaattcatgatagctgggcatggtggctcacgcctgtaatcccagtactttgggaggctgaggtgggtggatcacgaggtcaggagatcgagaccatcctggccaacgtggtgaaaccccctttaccaaaaatacaaaaattagctgggcatggcggcatgtgcctgtagtcccagctacttgggaggctgaggcaggaaaatcgcttgaacctgggaggtggaggttgcagtgaaccgagatggcgccactgcactccaggctggcgacagagctagactctgtctcaaacaaacaaacaaacaaataaaaattcatgataaagcagcagctcaaggtgctgtaagaaattcatgatatttataagataattgaaaatttgaacactgaatatttgacattaaggaattatttttttttatatggtatcgatattgtgggtactttgcaagtatcttttaaggatacatagtgattgtggataaaaaatctgaggtctaggatttgtgtcaaaataatacaggaaggggaggtggcgggagtgaaggtgaaacaagaccagctgtgagttgatagttgttgaagctgggtacaggaggtccactgtgcagtgctctctacatctgtgtttgtaattcttttttttttttgagacggagtctcactctgtcgcccaggctggagtgcagtggcatgatctcggcccactgcaacctctgctgcccgggttcaagcgttctcctgcctcagcctgccaagtagctgggattacaggcgcccaccaccacacccggctaattttgtagttttagtagagatggggtttcaccatcttggccaggctggtcttgaactcctgacctcgtgatccacctgcctcggcctcccgaagtgttgggattacaggtgtgagccactgcgcccagccttttttttgagacagagtttcgctcttgttgcccaggctggagtgcaatggcacgatctcggctcactgcaacctctgcctcctggattcaagtaattctcctgcctcagcctcccaagtagctgggattacaggcatgcaccaccacaccccgccaattttgtatttttagtagagacaaggttacaccatgttggtcaggctggtcttgaactgctgaccttgggtgatctgcccaccttggcctcgaaagtgctgagattacaggtgtgaaccacggcgcccagccttttttttttttttttttttttgctgaagtttcacttctgtttcacaggttggagtgcaatggtatgatcttggctcgctgcaacccccgcctctgcctcctgggttcaagggattctcctgcctcagcctcccgagtagctgagattataggcatctaccatcacacctggctaatttttgtatttttagtagagacggagtttcaccatgttggccaggctggtctcgaactcctgacctcaggtaatccacctgccttggcctcccaaattgctggaattacaggtgtgagccactgtgtccagcctagtttggaattcttcataataaaaagctttttaaaaaggtaatatttggacttctgctcctgggaagatggaataggacttttcctaattctttcttctaactacaactaaaacccctgggctatacataaggaaaacacagggagcctctgaaaaaggatgaggcagaccaaccagggatcttgggactcgaggaatgacacagtactgagttccttgggtttactttgctttatatatcccagacttggagccaaagaaagaagctgacaacctgaaaatgccagtgggcacaaacacagaaagtgccaacaaaagctcccctgtccagccagaagaccaggaaagggcagcccagtgaggcagaaaacttaaagagtcactgctctactccaggtccacaccatagaaaaaactatgcagccccacacttacacccgcagaggtgaatggggagcctaggctttgacaacagtctagcaataaggaagccactctccggggccatggaggagcagtaatgaggcactcctacttcctccagccagaactcccaccttcacgcaccagtaatgagccccccaatcttgagcatcagtcgaggttgaatggagagcctagacttcttcccccactgttagtaacaaggtgtgtacccttccctcccctgccacagtggtatcataaaatgccagctacaacagaacatttacagaagacccagagtctcattacatgataccccaaatatccagtttcaaaaaaaaaaagaaatcacttgtcataccaagaaccaggaagatctcaaactgaatgaaaaagacagttgatgccaacactgaggtgatagagatgttagaatcctatgacaaaaattttaaagcagccattaaaaaaggcttcagtagccaggcgtggtggctcactttgggaggcttgtaatcccaggactttgggaggccgaggcgggcagatcacctgaggtcaggaattcgataccagcctgaccaaccttatgaaacccagtctctactaaaaatacaaaaaattagccaggtgaggtggtgggcacctgtaatcccagctactcgggaggctgaggcaggagaatcgcttgaaactgggaggtggaggttgcagtgagctgaggtcatgccgttgccctccagcctgggcaagaagagtgagactccatctcaaaaaaaaaaaaaaaggcttcggtaggcagttaagaacaatcatgaaaaaaatgaaaaaattaaaaatctcaacaaagaaatacaatgtcccagcaaaataataataaaaatttaggagataaaaagaaccaaatggacattttagaattggaaattgcagtaactgaaataaaaacttattggataagcgcaatagcagggtggaaggacagagaaaagaatccttcaactggacaacaattggttgttttgttctgaggtggagttttgctcttgtcacccaggctagagtacagtggagtgatcttggcttactgcaacctctgcctcctgggttcaagctattctcctgcctcagcctccctagtagctgggcttacaggtgcccaccaccacttctggctaatttttttatttttagtagagacgtagtttcaccctgttggcctggctggtcttgaactcctgaccttaggtgatccacctcggtaatccaccttaggtgatccaaagtgctgggattacaggtgtgagccactggacccggcctctgtaagcttttttctgtgtttaaaacttttcatttttgtacttttaaaacttttttttttttttaaacacacacattagtctagacttacacagggtcaggatcatcattatcactatcttccacctccaaatcctgtcccactgtcccactggtaggtcgtcaagagcagtaatgtgtggaaccgccgtctcctataataacaatgccttcttctagaatatttcctgaaggacttgcttgaggctgctttacagttaacttaatttttaaatagaagatgcccactctaaaatataatgataaaaagtatagcatattaaatacataaaccagtagcattgtcatttatcatcaagtattatgtattgaacataattgtctgtgctatatatgtttctatggccggtagcccagtgggtttgtttataccagcatcatcacaaatacatgagtaatgcgatgcgttactgtgacgtcagtaggcaacaggaattttttggctctatttataatcttacgggaccatcattgtatgtgtggactatttttgactgaaacttcattatttagcaaatgactatattagcaaataaaattgagctgtatataatgaagaagtatgcattataaccaagtggggtttattgcagggatgcaaggcctcgttcactattagaaaatcagtcaacagcctggctcggtggctcacgcctgtaatcccagcactttgggaggccgaggtgggcgatgggcggatcatgaggtcaggagatcaagaccatcctggctaacacggtgaaaccctgtctctactaaaaatacaaaaaattagctgggcgtggtggtgggtgcctgtagtcccagctactcgggaggctgaggcaggagaatggcatgaacccgggaggcagagcttgcagtgagccaagattgtgccaccgcactgtagcctgggcgacagagcgagactccgtctcaaaaaaaaaaaaaaaaagtcaaatagtaaagataccacctctcctcaaattgtcattcaggtttgatgcaattgctgtcaaaatcccagcaagagtttttgcagatagcaagattattattttaaaacctatatgaaaaggcaaaggaattaaagtagcaaaaacaattttgagaaagaagtacaacatggaggaatcagccttcctgatttcaagacttgctgtatagctacagaagtccagattttgtagtattggtcaaaggatagacattatagatcagtgaaacagaattgcagccccacacaaatatgcacaactgattattgacaaaggtgcaaagataagtcattgggggaaaaaaccttttcggcacatggtggcagagaaattgaacatccctaggcaaaacaaaacaaaagcaaaccccaaaccaaaaaacaaaaaacccatataactataaaactttgagaaaaaaacatagaagagaatctttgagatctagagctaggcaaatagttctcagatttgacaccaaaaacatgatccattaaaaaaaaataagttggatttcatcaaaattaaaaactttttaatgttttaagaaggatggtctgtctcaaagactcaacatggtacatggtggttggcctttatgtgctgttgagggttttcctgcattgaagggtgcactcctgggtcacctactgtcctgcaagacaagctgtcttagccctcacactataaaagccacccggacaccgtctcaaacagaactcaaaatgttgctgagactgggatctgggggctggattttacttttacaaacaatttaaaactttttacagttaagaggatgaatatacaggctaaagactgggagaaaaaatttgcaaaccatatgtccaacagaacactagtatctagaacatgtagaaagaactctcaagtcttagtcgttaaaaaacagacaaacatttaaccaaacaacccaataagaaaatgggcaaaagacataaacagtttctgctgaagagaacgtccatatgacaaaaaaacacatcgaaatttgttcagtatcattaaccatgagaaaaatgcgaattaatcctagtacacactatcagaacggctaaaataaaaaatattaatactgataacactaaatgcagaacggatggagagaaactgaatctggatcactcactcatacattgctggtgggaatgtaaaatggtgtagctactttggaacactgtttggtagtttcttaataaagaaataggctgggcacagtgactcccttctgtaatcccagcactttgggaggctgaggctggaggatcacttgagcccaggagtttgagaccagcctgggcaacatagggagattgcatctctacaaataatttttaaaaattatacaggtgtggtggtatgcacctgtggtcccagctactcaggagattgaggcaggaggattgcctgagcctgggaggtcgaggttgcagtgagccgtaattgtgccactgtgctccagcctgggctacagagtgagacttggtctcaaaacaaaaacaaaaacaaaacctcaaaaaacagtacatgcaactaccatatggcccaacaattgcactccttggcatttatcccagaggaatgaaaacttactgtatatgagagccactgtttttccttctatagtctcacagctaaagaaaaaaaacttttctcatcttctctactactcctctcagtatttcgcttccggtcaccaaaatctatggatttctgtcccccatactgacaagttctccaattttatgtggacaacaagtaggtgtcctataatcaattcccttcaattctgacactatctacctgaagttagtgcagacgccattaagggctcggtccctcaaaactgcccctgacttcagaggccagtcagaagtggtgggtcctcaggtaacccacagcttctgtccaggtttgctacaaatcagaaggtcccattaccccttcctcatgttatgttatttgctagagtggctcacagaactcagggaaacacttacctttagcagttgtgtagtgaaggatatgatagaggatacagatgatgccccagatgaagaggtgcacggggcaaagtttagaggcgttttgaacacaggagcgtctgtccccatgaagttggggtgggccatcctcttggcacatggatgtgttcaccaacccagaagctctctaaactccatacttcagggatgtggaggctaagtcacgtaggcgtgattgacattaactgagactacagttcctctcccttccctgtaggatggggagtggggccgaaagttctaagcttctgatcatgacttggtctttctgttgattagccacatcttgaaagctatccgggagcccactaagagttgcctgattagaacagaagatgctcttgtcaccaaggacattccaaggggtttaggaactctggaaccaggggcagagacctatatatataatttcttactattttatacttatgttcacacacacacacacacacacacacacccctatgcacagatgtttacagcagctttattggtaagagacaactagaaacaacccagatgttcttcagtgggcgaatggttaaactgtggtacatctataccatggaatattagctactcagcaataaaaaggaaaaaaaccattgacagaagcaacaacctgggtgaacctgtagacaattatatgtagtgaaaaaggccactcctaaaaggttacatagttatgattccattgatgtgacgttaccgaaataataaaattacagtgtggagaacgggttagtggttatcagggctaaggagagtgtgggtgtggttatgcaagggcagcaggagggctccctgtgctaaagggaatgttctctattttgattgtatcaacgtcaataccctggttgtgagattgagtcatagctttttaccgtgttaccactggggaaactattttgagatggagtcatgctctgccgcctaggatgcgatctgggctcactgcaacctccacctccctggttcaagcaattctcctgcctcagcctcccaagtagctgggattacaggcatgtgccaccacgttgtatttttagtagagacagggtttcaccatgttggccaggctggtcttgaacgcctgacttcaggtgatccacctgcctcagcctcccaaagtgctgggattacaggcatgagccaccgctcccagcaagggcattgtttcttacacctacaggtaaaatctgtctcgatgaatttgctcgatcatcttaaaataaaaaggttaattaaaaaaatgattgaatataatttttaaaaatgtcaggcaatacaataaatgctgtttaatgagaaataagcttcgctcctccctgctgtgttgcttccatcaaggcaagctctgctactacttattaaccacattatttccacaattttatatagactcctgactgaggttctctgaatatcaaaattggatattacttcaataacatgggcaaaattaaggctttcgacctgcctgattttccttgtcaaggcagtttgtccccatttcccacatgggatctgcagggctgggtcccatctctcagttccctgaaagagatgcagtgggcgatggctcatgacacaccctcgcctggcttctaacatgtctgtgtaaacctgtggcaggaatcgagcccactggaaacatggtgaagcagccagccaagttcactgtggacaccatcagcgccgggcaaggagacgtgatggtgtttgttgaggacccagaagggaacaaagaggaggtatgttggaggatgctgcctctcctttccagcacctcatggagcttttggggcttgtaatgcggccagggactgtgcctccattttcatttcagctcacaaccaaaagtgttttttaccaaaaggatactgaggcttatagctgttaaagtaacctgcccaagaggtgagccttgaaatcaaatttaaattgattgccagggacacagtgtttaatgaaataaaggatactttggatttagcaaaggtgccttgtcagttgaggtttatgtatgtatttatttatttatttatttatttattgagacagagtttcactcctgttgcccgggttggagtgcagtggcacaatcttggctcacggcaacattcacctactgggttcaggcgattctcctgcctcagcccggctaatttttgtaacccaagtaactgggattacagggacctgccaccacgcctggctaatttttgtatttttagtagagacagggtttcaccacattggccaggctggtcttgaactcctgacctcaggtgatccacctgcctctgcctcccaaactgctgggattacaggtgtgagccaccgtgcccagcctcagttgaggttttatatactgatggccagaataataagagtcttgccctgctctcttcccacattggccattctttggttcctccctcagagcctttgcacatgctgttctttctgtcacttattttcgtaggaccatattttattcttggcatttagcataatttgcaattctaagtttacagatggatggtccatttcccccaccggggcagggattgtatctgacttgctcatgttttatttttagtacctaacactgggccctgcatttcataagctttcaatgaactattgagtggataaaggtttaagtttcttgcttcatattctctcttacctagagagtgccagcctgacactggacactggagagtcctgactctgttatgcctctgtgctgcatggttttgtttctgtgacttcaagcagtttctctctaggggcgttgtgcaagagggacaggagctcgccagcaccttcagtgtttccgacctggcagctcctgcagaacccctgctgacacagcatgctccttactcacacccggcaccttttctaactgttgcccaccttccctcctaggcacaagtgacccctgacagtgacaagaacaagacatactctgtggagtatctgcccaaggtcaccgggctacacaaagtaagatgaagcagcatggctgtggcttgggctgctctggggctaggagaagaaagatagcccaggaagaagagtgtttttcttaagtgaatttctgattttcctttctgattatagaaggatctatgctcatgatagaaaattggaatcactaggattccctctactagctaggatgagttgtttgcaatgtcgtaagatttttccaactccatctaggtaactaatggttgcagctgtgtgtctggagtgtagatgctgtggtgactacactatagatgggttctttgtccttgattctttttttggagacagggtcttgctctgtcacccaagctggagtgcagtggtgtggtctcagctcactgcaacccccgcctcctgggctcaagcgatcctctcacctcagcctcccaagtaggtgggattataggcacccacaaccactcccagctaatttttgcatttttagtagagaccaggtttcaccaggtcacctagactgttcttgaactcctgacctcaaactatcctcctgcctcagcctcccaaagtgctgggattatagacatgagccaccacaccctgctggctctttgtccttaatgctttcttaagaactctccttggaggtgctctggaggagctgtcagcattgaaggctgaggatggagtagttcagctgaatatagtagagggaaatggccctctcagcacctggagaaatgatagggattgaggcctcaggctctttgtcttggcagcctttcgagttctgtttgagatgacatccaggtgacctatagggcaagggctgagagagcctgtcttgcaggagagtggggtgacccaggagtacacttttcattggaagaaagccctcaacagcacataaaggccaatcccatcatgtacctgcccagactttggaatacagactgtactcaccaccttgggctttagtgaattcacctggaatgatggccttagcgttctcttagactcttagactatgatgcatttggagtaaatgctcttgaagggagcatttataatgtaattaattaattccagtcaagtataggttcacatgaaacccaacccaattaccccccaaaaatttcagagatgagaacagtgactcaagttttagatggaaatcattctactttgtcccaaatccatgtatctaagaatgattttcgtcccttgaaaaaacagtttggctgtggatttgaaatcctggaactgcatattttattctgagggatagtggcccattcagcccccgaaaggactcaatgtccagagattgaaatgtgtttgtttcctattaaagagactaagtgtatataaggtcagcatttttattttgctaaaggtgtgatgtcccagacccagctgtatggctgaaggggccaggtgggagtcccattcaggctgttaaacttggttccagggctccttattctagacaccttgtgtgtgccatcatgggagggtaggagaggtgatcatcaatgtatgtggcttgatgtcagtcttgctgggcacagagaagtgattatgtatttctcacctatctgtcacctataggtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggtaacgtgcctctcctccatggatctgacctttgcgctttcttccagaggctgaaatataatcctcggggacttgaaggcctgaccttttgtcttttaaatcaaataaataatcacaaagacaattttttcaaatgtgttatattagatttttcaaaaccagcttttcttctctaaaatactcaggcttcacttgaataagacatacttcttgaattgttggcttcttttccatgtagtaaatagaaaatgcagaagaaggaaacattcaaccataaacccttcaacccctagaaaatagttgttaacatcttggtgtggacctctctgagggcctgtctcctgtttacttgttttgttgttgttgttgggggaacagagaatcactctattgcccagactggagtgcagtggcgtgatcttggctcaacgcaacctccgcctcctgggttcaagcgattctcatacatcagcctctcaagtagctgggattacaggcgtgcgccaccatgcttggctaatttttgtattttttttagtagagacggatttcaccatgttggccaggctggtctcgaaatcctgacctcaagtgatctacccacctcggcctctcgaagtgctgggattacaagcatgagccaccacactggtcctgtttgcattttgcactcagcagcagtgagctttcagagagggtgacttgggctcatggaatgcttgctttcttgtaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaaggtgagtgctgggctgctggccacatgtgcttctcatagggaagctgactgcacagctgggcagggaggccaggaaaacagtcagggcccaacattgaccttatgcctatcccttttctgccagggctacttcagcagtaagtggcttactttgtcctcaatatattaatattaatatcttctatgagccacgcagagacctaaatgctttgcttatattaactcatttacttctctccaaaacacatgtacaggagagtaattatcctcatggagggaggtgggactgaggcagtgggaggactcggtagcataactgaagttagcagcagcaacatgggccctgcagcctccattgcttggcctttactggcccaggcacttaccatgactgcatctaatcattgcaccagcctgtgtgttgcaggtgctattattatccctagcttgcaggtggagatgctgaggcttagatagcgttaggtatcagtactacaaggcatcagcagggctagaaccacagactctgttggccttacccttaactactctgctaaactccctctggcgctgggggtacgcatttttctcaaatgttagactctctccctctgactttgttgcccctttttttctgttttgttttgttttgttttgttttccaactgtactaccttttctaacccacacttgcctttccctgttctgtcctctgaatctgcgtctgcagacgtggcttcctcttccgaatcctacctctgggccagcctggaccctgaagctgttggcttcctagttgagaccactgggccagaggcctcttgcttggtaagggctggttgggtgggacttccttgccagttctttgtgctgcttgtgaatgttagctgggcccgtgttctgtgtgattttaggaaactctgtgcaggtgttattattacagcctgtccagccggaacccaaacccactgtctaattgcctttaaacacatctagggcttttttagatggtgaaggagctggtggtgcccttcagactctagccccatttaatgtttatatgaactcagcaattactcttttgatgttgagactgttgcacatgttcataatttccatgagtgtgtgtgtgtttcttaagacacattaaagccctccgaggaagtcctgtcattgtattgtgactgacttctggtatgaccaacttttctccccttgacaaagaaaaaacaggcaaaaaaaattctaacatattcctaagcaaagctcttttttacataagagagcattttgaatagctttcctaattctactattgttttccaacctttcctcactcgtggacttcctttttcttttctggcctgtacatcctatactatttagcatttaatgaataacctttttcttttaatttactaacatcctctctcccacctaaatgattttacatatgtaaaaaaaaaatatatatatatttgcaggggcgcggtgggaaggatacagggtctcactctgtcttttgggctggagtgcagtggtaccatcatggctcacttgtagcctcgacctcccaggctcaaatgatcctcccacttcagcctcttgagtagctaagactgtagatgtgcgccaccatgcctggttacattttttaccctttttttttctttttctttttctttttttttttgttttgttttgttttgagacagagtctcactctctcacccatgctggagtgtggtggtgtgatcttggctcactgcagcttctgcttccctggttcaagtgattcttgcctcagccacctgagtagctgggactacaggtgcacaccaccacgcctggctaagtttttttgtacttttagcagacacagggtttcactatgttggccaggctggtctcgaactcctgatgtcaagtgatccacctgcctcggcctcccaaaatgctgggtttacaggcataagccaccatgcctgacctaatttttcttttttttgtagaggtggggtctcactctgttgtccagactggtcttaaacccctggactcaagcaatctccccgcctcagcctcccaaagtgctgggtttacagatgtaaattattttatgttaaaagaaactttatatcactttcacaatggaaaaccaaagtcacttgccataaagtgccaccgtaagcttatgttcatccataaaccatctaaaatcatctctaactccaagggtatgtgtatgactctttgggaagcagttgtttgccaaatagccagctaaggccattgcaggaaggaggaaccagaggaggaattaccttccgtctgtggagtagagtcccgtcttctggagtctgtgaccttcctgtatagagatttgtcaaattttcagtgttagatttggaaaggaaaagccacttaataacatgacattttccccactagtctcccgtttctatttactgaaaaggttgtccgtgctgggcagaagatttattctagggcataaaggtatcttttatcaacctctagataccatggaacagtagttctgtggacatttcaagtaaggcatattggaagctatcttcgcccttaacttttagacttacaactctaggttttcaagctagacccggaaatgaaatcagcaatggtgtttactgctaattattgcctttatagccacccacattctgaaggccttgtaacagacagcacgaaaagattggtctgcctcagccaaggtggggctgaactggtctctttccaagctgtgttggttgtttttgcctggttgttcaggcggaagacaacaacatttagacacttaaaaatggctgacccaggttttggaacccagacaggcattttcaagtactgcattttccaagaagacttgaaaaagtccagtctatccaattactgagcccttgagtatggcagtgaggtttgaataatgtccagcactcggccttaactccctttcacaaatgaaaggttaaatgctggaagcaggagcacagcatggatttgctgtgctctcctgttttctttgccaaagtcacttttctccagtccttctgtggtgtcactggacaaagttatattgtgtctgtatttgctagcctggtgtgctccctgagtgggacccctggtcttgggcaactactgcatactatttgtgcaaagcaaatattttcttggcgggtggctccaggttaccttggctttcacgactctgactaaagaatgaaagattgaattgatgtcaaaactgtgcttgcagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctagtaagtgttcctttgtttctctatctcaggtgtggttttggctaactttgcagccatggcatatggatttcatcccacggccagttgtcctcaataatcccagaaggctatgtcaaggatttgaggctatctgggctccttggggaagacggcagtgattgattagtaatgtctgccctggatgcggccagtgggtggcttgacagctttacattacatcaagacttctgggagtagaaaaagcagtgatgtaaaggagttggggaaatgctgctgttggaacaagtggctcattttttattttagacatctgggctcagagaggaaggctcttgcctaaggtcatacagcgtttgtaatcatctgagctggaattcaagcacagtctccaaagccagtgattttcccactacaggttacattttatagagtatgaaattatgtcaagtacttaattactatgatcagtgcttatagaaggagaataaaattccctaagattaagttttctttgtagataaatgccatttgtggaggtacaggttaaaccctgcaacccattctctctccctcttttggggaaggagacagcagatgtggggatgggtgtcttcacttttttcgttggaacagagaagcatttcagcacttctagtctcgggtgtagcagcctttggtggttttactcccatgcctgtggaatcttgagcttcctgtaccaggattgctcttaccttctgtgttcccaacaggctggggcaggagcattctgagctccagaaagttaatatttgacttcacagcaccaggctttgggtcaggctgtgccctgagggtagccgaggttctagactgcccagacctggagtcaagctgcttggggactgtcttccctcccagattattccaacaggagccaaggagggtgtgtgtgtgtgtgtgtgtgtgtgtgtgcacgcgcgtgcatgcctctgcgtatgtgtgcgtacgtgtgtgttttctcctgaccttgaatacttgcttgactcaacggctttcctggccaaacctcagggctcaacacaaaacaagttcctgcctgatggctgggtttggagtttgcagcgtcacatctaaaacctgtcctcttgcagatagcgtctgaggactttcttgcttttgttgtccagctttagatggaaaagtatacgctggaacactgaacctaaaactcataccaaatacttctaaaggtttacttcttccccagtttttgtgggggactaggaagggtagctatgattattgggaaatactgaaatgtgactggatttatctttatgcaggcccagggagttcaggacctcagggcccctcgtagccaagcaagatttctaaagccaattagctgggaaatcctccatttcctcataccttgaagcagagatggctgtgtttttagctttgaaataatctcccaggctttgaggggagaggtcccatactctggggcagcccacttggtttttatgtatggtttatgttttgttcagtgtggctgcctctctgttcttgtccttttgattctcattttgggcctaggattgtgttggaaagattatctccttccttcccacagagggtctggaggagctggtgaagcagaaagactttctggatggggtctacgcattcgagtattaccccagcaccccggggagatacagcattgccatcacatgggggggacaccacattccaaagaggtgaggctcctgctgcagaggggtcttctctggagggtgctcggcccagggcggactcatgggtagttgcttcccgggctgcaggagggaaagagatctgctttgttgaaaactttttttttttttttttcggagcagcacagacatttggcctgttctcaaaagcagcagaaagttgctgtggttttagctgacttgctttaaatcaaatgctggtggttaggggctggtgggaggcaggggaggcagaaggagcagttagagcaaatgggctgtgtgtctagatgcccgcatataaactgagattctctttttcaatgaactcctttgttcatgaatgccacggggcagaatctgctgtggtttacattaagaccgtctacgtgagtgctgtcaggggccaagggacgcagtctacagctttgccttgtgggcattgcacttgcccctctgcgttctgtgttttccagctcccctggaggtgcaactttaaactccgaataaattcagttagccttgagaaatatttgggcattattgggttccgaatacctaccacgcttttttttttaagcctcccatgccaaggttacagcacattcattcatgtatgagataaagcccattcaaccaagttttctggttatagcataagcaggatatagtgtgtggactctctcactttccagggtcatagtctggggaggcctgcacacaaaggtaaagggccaggaggctggtgcaaagcagcgtggcttgagtgccaacccagtggccacctgagctcccagaagcagtcacattacattatattgttgacataacagtagctatgggtgagaggcctgcaggaggaagggcttggctgcagtttgggatgccagatgaaaggatcaggcaagtggaaagaatgtgcaaaggaactgcagcttatggctatagtgacaccttactttactcttctttgatgcttcttctattcctttccctgtagcccctttgaagttcaagttggccctgaagcgggtatgcagaaagtccgtgcttggggccctgggctccatggtgggattgtcgggcggtcagcggacttcgtggtagaatccattggctctgaagtggggtctctgggtaagtggacacagctgaccagcatcttctggaggactgaggattacagggcttccgggctgtgtcaggctggatgttggggccttgcctagcctcaatacctttagcttcctggcctcctggccaccctaagccatctctgcgtgctgctgtacatttgcagttgcctctgataccagcattgattcattcaggagaccttgagggcagaaaccttatgtgggtattgtgcctaaaacaatgcttggaacgtagtaaacacttagcaaatagtgttgactgacctttatagtttagatgaatgaatgaatgaattttgctgaaatttggatttggaagataaatatttcctttggagcacagctgaagtatattttaaatacatgtctaatgtatatatgatcattttatatcaggagtcagccagctttttctataaaaggccagatggcaaatattttccacctgtgggccttatggtctctgtcacagttatttgactctgccgttgtagcctgaaagcagctataggaatacgtaaacaaacgtgtgtggccatgttccagtaaaactttatttgcaaaagtaagcaatgggccagatgtggccttcagactgtcgtttagcaacccgttttaggtaatagcaataagcaaaagagaaaaataagaaatcacatttaattttcccttctagagagatgatatgaatcgtcttgtatattcttagtctagagataatattaagtcttttagtgtatccttctagacttttttctctatatatgcatgcaaatattgatttggtacagaaaatatcttagacaagtctttatatctttatgcgtaaatatagggtatgccttcattttccatagcttccatggaattccattgtatggctctatccattgtcaggctcttcagttatttccagggttttgctataaaaacagtgctgactgtgtatccttggtaattgccttcagataaaaacccagaagtggatttggtggtgctaagagtgggtgttggttcaaggcttttgccacatgttgccacatctccaacagaagggtttgctggttggacttcccctgttggatgatgataaaatacatataatgtatttaatactatatatatatatatatatatatatcctcctggcctcaagtgatccacctgcctcggccctcccaaagtgctgggatgacaggtgtgagccaccacacccagcccaggcctacatttgaaaaaaaaaaaatatatatatattttccaccccttccatctctactgaagacttaatgagcttggttttggaagaaagggatacaaacagatttcaatcttctggccaacacttggcttttagggaggcagcgggaatgagctgtcgtaacatagaataggtgctttccaccatataaccagggagacccttccacctccaccccctagggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggtgaatcagctgctgtgcttctgtcttcttgtccctggcccctggttcctcacccccatgcccgaagttgccttaagcagcatgttgagagatggcagagaggaatcatttggattttaggaaggaaacaggcctgcatttgtttgtttgtttgtttgtttgtttgtttgttttgagacagactcttgctctgtcgcccaggctggggtacggtggcatgatcacagctcactggaacctctgcctcctgggttcaagtgattctcgtgccttagcctcccaagtagctggaactacaggcatgtgccaccacagctggctaatctttgtattgtttagtagagatggggtttcaccatgttggccaggctggtctcgaactcctggcctcaagtgatccacccgcctcggccctcccaaagtgctgggattacaggtgtgagcctccacacccagcccaggcctacatttgaatcctggtagtagcacttagcacttttatagtgttgggcaagtaacttacctatctgactcttggtgtcttcctctataagacaggaatgatagtagtctctgcttctagagagcttctaggatgattcaggaggtggcatgcataaagaccgcctttggcttatgcctggcccatgcagggagctccataagctgttattttcttgcaactccggggatcatatgtcagtcttacagccattttctatagttattatttcaaggtgctccatagataaaggatttttttttcctagttccgtgtctcttaagttggagcaatgtttccaagagtgtcctctcaaacccttagcaggctgataagcatcaagtctgagccagcctggctgacagggagttggccccagaggccacgtgtgctactgttggcccacacgggcagctgtccataggctgatgtcagtctgggctggtagctaccccgttttggccaaatgatattcctttgccctctagggcaaatgttgtccgtggtaaagattctgagtcccctcaaagtgggaacgttgaaactgggcatgactagaggtctctgccccagttgttagaagttctttaggtcaactcagaataaggcagggagcatgggttagtttgggcatggttttagaacaggggtttccaatattttgccttccctgggccacactggaaggagaagaattgtcttgggccacacataaaatactaatgatagccgatgaacaaaaacaaaaacaaaaaaaaaattgcaaaaaattttataacattttaagaaagtttacaaatttgtgttgggctgcattcaaagccatcctgggccgcatgcgggcttcaggccgtgggttggatttgtttagagagttttctcccttatgagggagagacatttgtttttaagttacaacctactttagcactttacttcccataaccaacctcttatgtggatactgtaaaaccagacacaggtcattttgttcttcccccaccccctggttacctgtctttgtataagggtttagttggggcattacacagaaagagacttactatctgcctttgcttcaggttcgagcatacgggccaggtttggagaaatctggatgcattgtcaacaacctggccgagttcactgtggatcctaaggatgctggaaaagctcccttaaagatatttgctcaggtaaatttcagggggccacctgtgcaggtaattgtcaggtaacaagatctgaccacgtaatggcaagttgctgagtccatctgatcttcagtttcctcatctgcaccgtggaaatgataagaagattatcttatagggttatgtgagggttcagtgagactaccatgtagagtactgggctttaaaaaaatcagctttctgatttatattctgtggaaatgaggcttgtttgtttcaggttattctataatgtcttttggtgtggctgaagctgctgaggccatggggggagatttgtaaacaaggatttaaaaagtatgtttatttaatctaattgaatttggccaaaggacttaaatgcaggaattgagtggccaaagctttgtttttgggtcacttgctcttaataactaaaaataaataaatgcatgtcatattttgtcactggttgtcaccgtgttgtgaaaatatggcacattgtagttggtccatgaagttttgttgtataagcaagtggtgacttggctgtcttgggaggccacagtgaccctgtctgatagagacagtgtgagggccacctctggtcctagctctggcttttttgcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtaggttgtgaggcagaatcctggctgttttatggaaatgcctggtcatacaccaggtctgggatccatgcctgacagccaaggcagacatatggaaggaacccatccctggtgggccttgaatgatggaggggcccgaagggcagagtgctccagcctgctcagaagaactatttctaacaatgttttttaatagtattttactgggtccaagtggaggagaacttgatgaccttctccatgtcttctctaggtcaacatcgggcaaggtagccatcctcagaaggtcaaagtgtttgggccaggtgtggagagaagtggtctgaaggcaaatgaacctacacacttcacggtggactgtactgaggctggggaaggtgagaaagggctttgttcaacccagtgatcattgctccgtggggaaggcagttcttttcataacgtttcaatgccttttgaactaggaagtagtccatctgaataggtaatcatctactgagcctctgagtcattccttagtgatatctttgctaatccatcatccctttccccaaatccttactctttctcaggtttcttactagaaacttcccaattgctttttgagggtgttaacctgagctggaagagattgcacaggacatgctgtttcttgtaagctggtgctaataagctggtctgttccaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggtacgtggtggggcctgggaggagatgggtggagtaggcctggattctctttggccacttgtgtgcatgtctcatctactttttggtgttttgttagtattattatttttgagatggagtctcactctttcacccaagctagagtgcagtggtgtgatcttggctcactgcaacctctgcctcccaggttcaagtgatcctcccacctcagcctcccaagtagctggggactacaggctcataccaccacccagctaatttttttttaatttgtttttatttttttattttttttttgagatggagttttgctcttgttgcccaagctggagtgcaatggcatgatcttggctcactgcaacctctgcctcccgggttcaagtgattctcctgcctcagcctcccaagtagctgggattacaggccaccacgcctggctaatttttttgtatttttatagaaatggggtttcaccatgttagccaggctggtctcaaacttctgacctcagatgatacgcctgccttggcctcccaaagtgctgggattctaggtgtgagccaccgtgcctggccactcagctaattgttttgcatttttagtagagacggttgcccagactgctctcgagctcctgacctcaggcccacctggcctcccaaagtgttgggattataggcatgagccaccacatttggcctcctttttggtgttttactgacagggaagttgtcttgagaacactgctcaatcgttttctctctggctccttacaaccaagaaggaaaaaaaatttacccagagctaaattattaccactttctaacaaaagtgaggcagtgtgttcagtggttaaaagcaggggtctggagagagactagtttgtaataaattttcatcaatattttggttgaaatgcagttagcttctagatatgttctactttgatgcctttgaagcaatgactgtggtctccacccttaaatttttatagagagaggtgatttgaagtttcaggtatgcaatagtgaagatagggtgagcaggatcctgaaagagagaattttgaaatcctagggattaaaattaaccttacataaaaatggaaatcttagtagaatgttctgtgcctaaaggtagtggtcttgacatccatttaacctcttctgcctttattccaatagtctgcaacattctttttgaagaattataatcattctgtctctgatcacttcttgcatttccccagaccttagctctcagctgtccctggaggacatttccttcccccagccccatgtattattgtcgtttttggttttattcttgttggcatttttcatcctgagtactcaacattcagtattaaaggctcaaagtcctcgggtttgtttgtgacatcagggatccaggcattagagagtgacctgttatagaaggccctttcccaatgctgggcccttttggcttatcttacccttctgtttacctgtggtaatagaagtctgctcaccactcgctaagtcagagtgatgctaaggttcaccctttgttgaaggctccctgagctctggctgttgcttcaggggctttcctactaagactgtgtctctgctacaggaaatccccgccagccctttcagagtcaaagttgacccttcccacgatgccagcaaagtgaaggcagaaggcccagggctcagcaaagcaggtaagatggcacgtctaggttgtcctgggcccctctgccagccggtggcactgggcgtgtttcatccacggccttgaggaacttcatctccaccaacaccaacaccaagctggcaggttttctgtgcagctctgatgcagcagtggctggccaggcccgttgctggctgtcataatagacctggtgctgttgaacctgtctgacgggttctcaaagtgaaactactccagctggtctgtctcctcacttcacagtatatctttccaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacaggtagggtccttctcccctctgctcccctggcccccagccaggcccctttctatgcagtcggtgctgggtcactgtggacaccaaggggtgtgagaggtgctctgccaaagtgctccctgatgggaggcagctcctggcactttgaacccctctgggagcacctataggaagcccaatgggttctatcaggtgaactgcagaattccccaaaagcaagcaggaagctggtcccatatctccacctttggtttgcattttatcagagaaatgctcagttcttgatattcaggccctaatatctatctttctgttacacatgtgcacacatgtgcacacacacacacatacacacacacacgtgcattccctcgcggcctcaccagctgccttttagtcttttcattaattacccacagaaaaagagctgctacacctttgtgtttccttcctggtccttttagcttagtttaccctttttatgaggtgttggaatgaggtcttttctcaaagagccagttcagcctttcgtccctaaggcccagcacactatttagggcagcaaattattcccctttacaaaatgcaggatttcacatgtgatcttaccatctaggctggcttactctgattatttcaggccataagggccttaaaactgcctctctgtacaagttaatgtttatttgtttaaaaacattaaaaaaaatttgtatcgtggtaaaatacacataacacaaaatttaccgtcttaaccatttttaagtgtatagttcattagtgttaagtgcattcattatgtcgtgcacccatcaccaccatccatctccataattctttacatcttgtaaaactgaagccctgtatccattatatttgtttaaaattttgtttcgcttcatgttcacacctctggggtctggagagcagacatcctggcagaaaagtctggattttaatacttaagcctagtgttcgaagtggttgttccaagcctctgagattcctttattcttaagggaaatgatcctgctgtgtttgaaatgccatttgtaggagaagaagggcaacgctttctgcagaagcactgctcagaagccttgctcccgtctgggtcctctcagcgaggagcagtcaagagtcaagtggggaagaaagaggattatagtgaggaaggggtcatggtgtaactgtcccctgagtttgggggctgcactcccttggagatggaatccttactgtgagaacatccctgcagtgggagggattccctgggcgaagggattctgtgtgtcgtgttataaatgtggccccttacatccaggcttgctgctgtttgtgctttcttccccaaatttttatttttatttatttattttttagacaaaagtcttgctctgttgcccaagctggagtgcagtggcatgatctcagctcactgcaacctctgcctcccaggttcaagcgattctcctgcctcagcctcccgagcaggtgggattacaggcacatgccaccacacctggctaatttttgtatttttggtagagacggggtttcgccatgttggccaggctggtctccaactcctgggctgaggcaatcctttcacctcagcctccaaacctgcggatattacaggcatgagccactgcgcctgacctcagtatttgtctttttgtgactgatttatttttcttcctatatgtcctccatgttgtagcacgtgtcagaacttcattccttttcgaggctgcattccactgtatgtatatatgttttgcttctctcttcgtctgttttttgtttgttttttcttgagactcgctctgttcctcaagctggagtggcactgtctcggctcactgcaacctctgtctcctgggttcaagtgattgtcctgcctcagcctaccgagtagctggaagtacaggcacgtgccaccatgcccagctaatttttgtatttttagtatagatgtttcaccatgttggccaaggtttcaccatggggtttcaccatgttggccaggccggtcttgaattcctgatctcaggtgatctgcccacctcagcctccgaaagtgctgggattataggcatgagccaccgcgcccggccatcttcatttgttgaagaacatttgggttgcttccgtcttttgtctgttgtgaataatgctgggtgtacaaatatctctttgagtctctgcatttaattcttgtgattataaacccgaaatggaattgctggatcatatggaaatctctttttaattttttgagaaactactatactgtattccacagtggctgcactactttacagtcctgccaacagcatgcaagggtcctggtttctccacatccttgctaacatttgttttttttctgttttttttttttgttgttgttgttgttgttgatagtgaccatcctgttgagtgtaagatggtgtcttattgtggttttgatttgcattttcctaatgattagtgatgctgatcatcttttcatgtgcttattggtcctttgcatattttctttggagaattatctacttgcccatttttatatcaaccttcttaattttatgttgagttttaggaattctccatgtattctggatattagttccttatcagataaatgatttgcaaatatattctctcactccttggtttgccttttcacgccgttaacagttctcgtgtgcaggttataaacgcggcttcttatctccagacttgctcttcctgtgctttaaaataaaaaatccaaaacaaaacattcattattagtaatgataaaactaacacttttatagatagagcattcttttctcatcaggccactcaatagtaagtaggtaattattttcctgctgatggttctgagggttggtgggagccttactactgggtgcaccacgctgaatcttctttgttgccaaattctccatattctttaggagaaagcaccagaaagccatagctgtctgcgtacaatgactgggatcacaaggccatgacgtcttctaaaaacattttgtgacttctgctttattctatgtctatatgccttttagtgttttggctgagccgttagaaagtaagttgcagatatcaggacagggtcagggtttgacctgcatccttggaaaggactgcagaacccagtaccccagacgtcccctgctgctggttgaggcagaagtggagattaggagcctaggtccggttttgtcccctttgaagtaatgctggagtgggaggctccttacttcagagtcaccccaaggtcacattcatccagttctctgatagcagcaggtttgagaactgctgccatgctgagtactcacttagggctttgtgtccggatgctcccaggatgcattcaaggagccgggtgggccttggtggcggtcgttgccaccaagtggcaacatccaagctgcttgaagccacccacaaccccacaaccaagagaagagaagaccaaagtcctcaggtaaatcacaagtgtgaatgacttgcagggtggcactggggtccttcttgttgtttgttgcttggagctgggtttattgtttcattatttgggcaacttgcaattctgcctatttttctatggcaaagaacacattaaatctctccttagattgaatttccttcccacccccacccccagcacagagcctggccctataagtgctctgtgtggattaatggctgtgagtgagcgaataaatgacatggcgcctggattcacaagcggagatggcctaagaacgttgtaatctggtagaggagtgatgccaacacctcctcattctcctttgaactctgttttctgaagagcagctaaaagctcaagactgggctaaggaagtgtgcccttggatgtggttaagagacctgggtcagcccagaaagccaccccctgacacgggggagggagcatactttgagggctgacacccacaggcacaccttctcatggtagttttagggtataacaggctggaaatccccagaaaggtggctgcttgggcatgggtgtgtcctggcctggtgtgggcgcttccccctcagaacacaggctgtgccacgtggggagccgaggtcctgcctgagtaacccaggtccctgattgctggttttgctccctgacacctgcaggcctgccactccacctcgcaaagtccctgagtgacagcttgcaggtgcttgcctgcctggggtggatgagtgatgtggatggctgtaggatcctgtgagtcccttgaggatgcaaaagtagagcgcgttttgccttagaggaatggacttgttggcttggggcttgaggaccctcccagaggtcaaagactcggttttatagaagggaagtgatttccctgaggactttggtcttctcttctcttggttgtgggtggcttcaagcagcttaaatttctcaccgcacgttcccctgcgcagagcagtttgagaagctggtggcaatgtctccattacgtgctgtgctgggagccactaggattggggaccactccatgtagtactctggcacctttagaaatccctgtgagctcacagaccctcacagagtaacagcttctaccttgaaatgttcttaacgtggtggtcctggctgctcctggagggccctaaaagggatggtgctgagggtggctctctcagtcccatcctcttctgagctgtctggtcagtgtcttgtgtatgtatattttgaagaataagattcaggtttcagaagcatgtagaggagagtgaaactgtcttgcagcctgcgaagtcgtggcgaaatgcactggccatcactacccagacatccctcacttcatagccctgttggggaataaacacagtccattccttagttggggcctcaggggacactttaaaatgctgtaggcattgtaggtgtaaatctccgagattttttccctcccccttcttaggttatttaaggtacagttcattttctatctgagtttttgttttgtttttgactggtaacaagagcatactttcttttatgggatgggtgggcttaactggaagagggtttttccctctcttttttagcacttcagagaagaggccagaaaactttatgcgggtgagggaggaggtatccccaagacctctggttagcctgaggtctgcttagtgagcccctgaattgttaggggctgtggggaaacggaagctcgggaagagttggcacgttgggaatgccacgttggctgaagtagcgagtcagtcctgccttaaacagtacaaaaaggagacctttcctgccccttggctggctcccagctctgttgaatttgacctgtacacattttaccaggaaatgttgttcacatgaggcagggggccaattggttttgtgtgcagtgcttaaaaatgctggaaaattaatcctctcttcattgatgcaaccagtttttttttttttttcttggcctttacccccttccttattacaaaaggaatgtgacaaaatatacataggccaaatgctacacccttttaacacttgatcagcaacagctttcagcagggcctgcattccagcaaggctgctggattcttggggggaactcgtctctccctcacactttcctgttacattatgcctggccgattgtggtgaaggggatcttgatctactgagacagccatgagatttcttggagcctcgatttggagggagggaacttggccaaccatggagagaagaagccggctgtgtgccagcctggaaccggcgagaggagagaaatggcgcacacatggctatcgcgtgccacccggccacccgtgagggtgcctgccaatcctgcaagcaccatctgccttcacacttgcaattttattttctttcacatggaaatggaagttcagatattgtgcgatggtcttagcacaggtctaggtgaactcttgcaaatccctgttgcagcctgggggcctcaaactgattcctaggacagaaatggttctgtttggtgagtggccccaggcccagctgcactggctggcactgggtatgatgatggggaggtggtgtggcagagcagctaggacacagatttgggggccatgggtatgaggcccagctcgcacccttaccaaggtgtgtgacttggggcacgttcctttaccagtctgagccacagtttcctctcctgaaaaaatgagatgacagtaggaactaccccttaggactgttttgatcttgaattgaggaaatgcataaaagcacatagcatggtgcttggtgtgtagaaaatgctcattaagttgcttctgttattattagctgctcttatttgatctaatttttctgttattcttgccttgtggtcaaaagctagaagaaatagatctaagatactttctacattgattggaatcaagtctcccctgtccgtgagaagaatgagggatcttgaggggattttaaatgccaagttagctttttggtacccaaaggtaaactgagttttctctcttgttccagggcaacatgcaggttctggtgacttacggtggcgatcccatccctaaaagccctttcactgtgggtgttgctgcaccgctggatctgagcaagataaaactcaatgggctggaaaacagtaagtgcctgaatggagagcagatgggttgttgatgaccccccaacgtggctgctggttagattttcttcaaaaggtgaaatttgcagagaagcaaattctatgttaagagactttgcagttgcacagactttggttcgaattaaggccgtggtgtgaagtaactgtgactgtgtctgccccttagccacaccgagactcagctttctcatttgtacagtggggggtggtcggcggggagaggttgagaacacccatgggaatattttgaaaattatatgagctaatggttcagaggctggcacgtagtcagccccctggcattgcagtaggaagttttcattaaaaagagaatttgggctatgttgctttctgatgagtttctaactgtgccagctatccttggcaactgaatccgcactaaggttgcgagtcaagcataaatgccaaatccctggcactcagaagtcactaccaccacacctctgccccatcccaatgttcctttagcttgttagggattttactagtataagctcatttcgcttattttcaattttctgattattttttagtagggaaaatttcaaacagaaaaggaaagagaatagtataacatgaacactgatgtacttatcactcagcttcagatgtgcaacacatgctcataaaatgatttttttatacaagtaaaaatatatccatttttcatctaaaaaacattacagttaagggataattccactttaaccctcacctctccttctccctagggttaaccaaagttttcaattcagtttctgttcttccagatcttctctctgcatctatacatatagatgtgcctgtggaacacatttggctgtatttattttgcattaaagttgccctgctgtataaacctacttcttcggcctgccttccaacagtgcatctcgggaatcattcactcctacatcttttccgtctgtgtttactgctgagtggctccagactggatgtacctcagggctcacattcacctggtttcaggcttactgaggcagggctgagtgcatacccccaggacggggcctcctgtattcacctgtgagggtttctccagagtaccactagcagtgccattagtgagcatcttccttcactcgtgacccaagtgcacaagttgcaagcaaggccagctcccagttgcagagatccaaagtgagagctcactgttggcttttgtggctggagcagccagctctgagtgtgtaaacgtccactgcccaaccctgtcatgtgtccccttgtcactcctttccccaagacactgagagctttgactccagaacaggaaaagcagggtgccaattaggaaagcctcttttccggtgggaagtagcgatccgggacctccttgcctgtggttcggcagtgtccatcttgccaggccctatgttccttcagagtcaaggttctctgggttgtggcaggggccctgtgttcccagtgcttttgttttgggtaaagtcctttccctgttcttgtctaatctaacacttgggcttcctgcagccctgctttgcagagaccttttggaaaccatcacggtacagtcagttctcagcacttgcttcaatcggctcgcatttggcagctctgtgacttctgctttcttgagggggaggggtgcctataagatggagttggctgccaagaattagtaaataaaacattgacttatgagggtgtttggatatcaagttaacaccaaaagtaagtaaataagagacgacagtgtcagattacaactttctggtcagcaaagattgtggggtcaggtaaatttcactttgagtcccagcttggcaggctgctgcatatgtcaccctggacaagttacttaacctctctgagcatcagtttccccatctgtgaaagccattggttaataataaataccccataggattgtggtgaaaattaagacaataacctatttgtgcttggcatataaaatgcattcagtaaatgatagccgttattgctgtcatcactaattgattattgtgccgacacttgttgttactgaggctgagatgctgatgatacttactcagctttgctgcttgtcctctgcagcagctgttgcttacagtggaggctgagataagtccccgtgtccaaagaaccattgcttctgtgctctggattgttcctgctgctgaaaagggtcagctcttcacctcagcttgtgtttcttttccaggggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtcagcctttgcttttgtcccagaacttgtctcattgctgtcaaacatgacaccatagtccttctctggttcttcctggcaaagaccttctgaaaatcgttttgtgatgaaagttagcacaattcactgtgaaaggtcccctgggtaggtgggtcacaaccctgctcctcctcttgctctctgactacaagactttggtgaggggctccctgtcccagagtcttctttcttcgcttgttagcataatcacagtcctcactacaaagccagcctgtaaggggtaggtgagttagcaaacgtggaggcctctgcccagcacccagctcacagacggagctcaccctccagaagctagaatcatgtaatataaaaatacattattctggccaggcgcggtggctcatgcctgtaatcccagcactttgggaggccgaggcgggcggatcatgaggtcaggagatcaagaccatcctggctaccacggtgaaaccccgtctccactaaaaatacaaaaaattagctgggcatggtggcgggcacctgtagtcccagctactcgggaggctgaggcaggagaatggtgtgaacctgggaggcggagcttgcagtgagctgagatcacaccactgcactccagcctgggcgacagagcaagactccgtctcaaaaaaaaaaaaaaaaaaaccacaaaaaaaaacattattcttggctgggcgcagcggctcacgcctgtaatcactgcactttgggaggccaaggtggatggataacttgaggtcaggagtttgagaccaacctggccaacatggtgaaaccccatctctactaaaaatacaaagattagctgggtgtggtgacgcatgcctgtaatcccagctactcgggaggctgaggtgggataatcgcttgaacctgggaggcagaggttgcagtgagctgagattgtgccactgcactccagcctgggcaacagagtgagattccgtcccctccaaaaaaaaaaaaaaaagttcatcgtcatttcttcatagtaaccctgactcaaggggttttggaagatttccagtggtctcaatggtgtgaatcctatgaaggtgtcttatttgttgaattagaggtgaaagcctccttcctcactcttttttagaaacagtttagttttattattatgcagaatttgttgagcaaattgcaacagcccaagccacagctagctccacaagagcccttccatgagccctcaacctgggatctcgtgtatctttgttggaatggacattaggtttccaagtccaggcctgtgatttagaagggtcaggttgggtaggagagaggagagtcttggaggggctgctccatgggggtcacacctctctcctgtgggttttcgctggtgattgagttctgaggcatttgctgcattgactgttgtagctttaactcgtgtgcacgtgtgacacataaagccccaagagaagggctgcctggctcagatgcacttccatgctgattatatgcatgggtgttgaaagcagtgctggctgagcagcgatcccagtgcagtttgactttattctttgctcaaataggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaaggtgggtttcatttaaaaaaaaaaaaaaaaaaaaaaagacaagctgggacttaagggctacctgaaacttggagctgcaaactcagccacctgcaggagccaggtgacatataaggcggtgctcacctgttccctctgcctcggggagtagttggggggccctggtgaaggttaagcacattgcatttctggggaccgtgctactcaacccctgttttctgtttctccatggggaacaggacctagcattgtcagcagaatctctagttttttggcaaaggcagaaatcttgatttttctctggaaactcaacatacaacatgttggcatttaattggaaaaaagtttaaaatgtagtgttgtctaacacctgcatgccacacagcaggttagtcttcaacctttaacctgtcctcgagcccggtgtgagcagtcgtgttgtcacttagccgtggctactctagaaaggccttctttgggatggagggggttaatattcttgatttgagagttagaaaaaccagttttccagttactgaaattggacttcatgtgtcctgaagtgccaagaaccttggttctggggtttgcttttgggtctggggtactggtggcagtgttagctatgtgcttgctctgcagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtgagccgccctgtcctcggactggaccctcgttcagagctgcccttggtcattgcctcctggtggctggtactgatgcctgccccatgtgctaggcctgtctcagcagggccacgtgcagagtgacagagtggaagtcagcgtccgctgcagtcacctgcccactcagtgcctggcttgctggccttgtgtaataggtgggctgggtttagcctcagtctcacctcagcaagttatggggtaatgtcatgatgttgctcatttgtgccatttttctttgcgtatgaatttctttcttcttgagtattaggaattataaaaaatttcaataaatagaaaaccataaagaaaaaaaagtgccatgtatatctccactacctggagatcggaagcctgcgatattctgatatagatattttcagtcttcttgtggatgcctgtttcttctgtttcacgggtttcgctttttcttttggttaatggctggatggtgttttcccgaatgagagtagtctgtttaggatgactgacttgaatatttgcttggttggggtggagtggcttatgtgactgcagatagacggtttgtattatttaaaagtcagatcatacctacattactgtgggattgttttgttttgttttgaaacaggatgtcactctgttgcccaggctggagtgcagtggtgtgatcacggctcactgcaggctcaacctcctgggctcaaatgatcctcctgcctcagccccctgagtagctggaactgcaggtgtgcaccaccacactcagctaatttttgtattttttgtagagatggggtctcgccatgttgcccaggctggtcttgaactcctggactcaagtgatctacccacctcggcctcccaaagtgctgggattataggtgtaagccactgcccccagccacattactgtgtttttaacccccttttccaaataacatagtatagcatgcagacttcgatgctagatgaaactctgaagtagagaatcatttttcacaaataggggatttgtatgcaaatatgcgtttctgtttgttgttttgagcaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccaggtaggcaaggccctacatttggtgtcttgagtctcacttttgtggctagattctacctatgtgtcatggtttcctaacttttgataagatgaatttttatttttataacatgtatttccttctgtagagacttatgttacatagaaagaccaagcatacctaaaaaacataccaaagcacttgataatggtcatgaaactatttagcaaaccaggagtcaatcaagctctataacttgataatgtaaaaatttgtagccaaccttgtaagtatttttattaaagttggttgcaaggcatatgcctgcgttgtacttgcagtcctagccagtgcaattagataagaaaaataggctgggtgtggcggctcacacctgtaatctcagcacttcaggtggccgagacgggacaattgcttgaggccaggagtttgagaccagcctggccaacatggcaaaaccccatccctacaagaaatataaaaattagctgggcttggtagtacacgcctgtaatcccagctactacttgggaggctgaggcatgtgaattgcttgaacccaagagacataggttgcagtgagccgagaccgcgccactgcactccagcctgggcaatggagtgagactctgtctcaggaaaaagaaaaataaatgaagcataagcattgaaaatgaggggtcagagtgtctttacttacattatactaatgtgaaattccctatgtgagaggtgtagtaattgagttggggtggctacgtggaatagtttataaagggaatttgcatgaattttggcaataagcagaccagcataaataaatggtgcacatttcactttcttttccactctttccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggtgagctattcctcagagaggaccccagagaataattgattttgcaggaaaatgggtttgattttggttatctctctgagtggggaaaacaatctgatatttgtaatagctgcaaaaggagagtttttcttagggctacatctccaagattatctcaactcccagtagaaccggtaacatggcaaaaagcatcggcttagaattttgactggaaacagttgtgcgtgtgttggaggacctagttcttgattcaggggaaagctggttctttacaaagttgaaaatcacagtggctcacacctgtaatccccaaactttgggaggccaaggcatgcagattgcttcaggtcaggagtttgagaccagcccaggcaacatggggaatccccatctttacaagaaatacaaaacttagctgagtgtgatggtgcgtgcctgtaatcctagctatgtggggtgggggctgtgatgggacgatgtctgagatgggagcctgggaggttgagtgagctgagattgcgccactgcgctccagcttgggtgacagaggaagaccctgtctcaaaaaaaaaaaaaaagaaaaagaaagaaaatttctaccttattttgtgcttggctccttattcatgtgtcttggtttcttttttttcactgacaatactagtagctgatcaagatatgcagattcaaattctttcttttgtatttagtgatgtcatgtgtaatcactgtgaaacacggtttctcaactccggcactatgacactttgggctagatgattctttgtggtgtggggctgtcctgttcattgtagacttttgtcagcatccctgccctgtacctgctagatgcccatagcagacttctccttccccattcttatttgtggcaaccaaaaatgtctccatatcttgccagatgtcttaagggacaaaatcacttcagcctgaaccactgctgtaaagattcaaacaataaataaatatatgacttaagtagtgaaagaccctcctccatttgttttggggggaggactctccataggttctagttatctactcaaatgattgtcacccccacacattttatttatttatttcaatagctttggggtacaagtcgtttgtggttacatggatgaattctatagtggtgaattctgagaccacctcccccgcccccatttctaaaagggcaggcaagtgtgtggtgtggacagaagaccgagggctggggctgttctgggccacttatgccttgtcttaggtgtggtgtgaagagggcaaagccccaccccaggaccccaggagcagaaagagcctcagcggggtcttgttcttctttctctgggtcacgctgagaggggaagggcaggttgaggggcccactgctgggttctgggttaactctcaggcagctggagtgtccactgaccacacgctttcctgattccattcctgcttcccccttaccacatggaaatgtgcacacacactcacactcactctctctcacactgatcagaaagtattgacattcaactcagactgattctactcagatactcatttaagcctcaagtcatttaaaacaacatgtttctcctcaaacttgtgcttgcggctcattcaatatagatttaaaaaattcctataatcactagtctaggggacttcagctgtgggcaagacaaagttcctgccctcagggagcttactgtctagggcttttacaactaaaacttgtgatgactgctatgaagaatgagaatggggctcggtgacagaattcagagctacgggcttgttttggagttttgtaacacttgcgttaggagagagttgggcacaggaaacgggtagaaggctgctcccaggaggggtgatgtggctccgacctggcaggcaacagtggagatgaacatctcctgtggcaatgaaactttttgactatggggaaaggctggtgagtgccaccagcttccgaatcccccttacagaaaggggtcagagtttgtcccctgtggccgacctgtgagcttaaagcaaatggtcgtctttgagcataacaacagaaagacactcatttgtggttttcccatcaggtgtggatggtgcctttttatgtttcaggctctctgttgcctcccagagagccaaatgccggcttttccagaaccccagaactttcccaggcagagatatttagtgaagtgttggttggttttctaagcatcaggcttcttagctaaggcaacctatgggggtactgccgggaaacagtcggctacctgccaccttctaatttgctttcatggtaattctgggtgcttaaatattagcctagtttttcctggcctggttaaaaacccggagtggagttatttttaacaacgtgtcctgtcttacccgtaatggcatgttgatttcctgtggtaggccagctgtggttggttggtggcggctccctagaccactggattgactggggttcagagtgcatgaggaagaagatctggcatgagggaatggtgacatgtgtctgggcatggaacaggggagtggcggataatgcttggggtctgccatcttggacagtttatcttacccgggtttgttggtttttggctactctcatgctgagctcagacaacttctagtggaggctctgacttaaagattggcctcagaggtagtcccttgccatcagctgttgacattgaaatcctcaactgtcactctctaaagtaaagcccccttttgttcctctcaccccagtgtggaggcctgtgcttgtttgccagggccagccatttatttcacgtagctaaagacctggatgccgttgaaacccagctgttgttagaaagccagggactcaattctttgtgtgtcttggctgtctaccatctctaattctacaaagtataaattctctgggatgcaaagcagagatccctcagctttcacggcagtcattaactttgccagataccatggggagcaccaggactcccatgcgaggcagaggtgcacgtagccccttggtgatgggcgtggtagcctgaggcatgctgccgttcgctggatggggaggtccccctccacagtggagtccatgagtgtccttggcctagcccttgtttctctgtttagcacttctctagcaaatcactatctcctctcctcgactcctctgtgcttcatctttaaaactgacaccctcaaggagtcagaggccctcagggtcccccggggggtcagccatgtagcaggagctcagcttacactcaggaagacggcaaggcttcaccaggtggccgagtgaccgagaaggctgagtgtggtcagaaggtgccagctgcattggagggagaggagtctgggggacacacaggagccatgtgtgggggacagggctggatgtgggctgcagggcctgcccatctctctccgttctgttgttccaccacttggcttcctccttcagttgctccagcagcctgtctcctccctcgcctctaggctcctgcatgtgctgaggcctctctacttgaagcacctctctgtctgctccctcttgtgccgcaactgagatgttactggaaagctttctctggtctcccgcagaccaggttaattgcctcctgagtgctccaccttccacaccccaaatatgttatgtaggatgttagagtgacttgcttgcctcatccttctcctgcagttgtgggttcctggggggtgttaaccgctcaggatccagcacgtggcacaacatctgcacgtagtaggtgttctgtgagaatggttgacaacaatgagtaggcacatgagcagtgcacacagtgaggcagggggagctgaccgaggcctgcatggccgaggtcccgggggagcagcagtgctattctgggtgtgcacaaggtggtctccaattcccagcttgtgctcagaatcccacaacctctcttccaggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggtaagtgtgcaccctgccttcctgcagacattcatctgccccaggcaggggcagctgtaacccagagcagatgctttgcttttgagtttgctcatgagcttaaaattaaattaaaaaaaattattgtttcatttctagttaaacagtagaaattcctgcttacaagtaagcaggcttgttatttctccagtgatctgtccccccatttaataatatggctatcaatttcttagaggaagcagcagtatttgggctgtcatatgtaatatggtggcgactgtttcattatgtgtttcagcatttgtgagggggtgggttgctctggatgtggcagatggtggggtttggaggtgataactcattgagatatcttggtgtccatgtggtacataccagaacctctgggaatgccaggcacatgatgcacgtgatacgtggctttgtcattgtcttagttccccagagagagagtgtgtcttggggaatgggctttgttggcaatttggcctgccttgttggcagcttggaacttgggtttggtaaggctagcgggccatatagggacaaagccctgaagtgcattggaacttgccttttttgataagtgaccatgtttcctcctccagcacttaaaatgtgcctttctcccacatagaggacagtgtgcctaatttcttacgtaatctggattttcctcgccaatgatatgttcttggattcacagaagtggcaaatggggttttccctctttgaagaggaaccttctccttcatggggttcagcaggaggttttatcttttgaagctcagggcagaaatggtttgggggaaattaggtcatgggtctgggatcagattctgtgaagttactgagcttcaggacctgcatgtgtttgtgtgcatgtatgtgtccctgtgtatgtgtgaatgagagagggagaaaaagaagaaagagaagctttacttggatatctgcctctattatgaaggactctcaagtaacagccttttgattttagctgacgacacggattcccagtcatggcgcagccccttgaaagccctttcagagttctttaaaggtgacccgaagggtgactttaataagacaggtttgcattttcccatggctgctgaattatgtaacccaaatgcttcttgctggcctcacttctaaaattgcttacacctgcctcatctgctttgcttaatgagcatgccatcctttgattaacctaccctggagttgacccatccttgactgtcacgttggaagctgggatctggactctgcaacccaacgcgtgccttgattatgttttagcataatctctaacatctccacaggcttcaccttgagggtccccttgccccatgagattggcaccctcacctgccctgcacctatgccccagcatgctggtaccacagtgttctttgctcaaaggtggccacaagtcttgactagccagcccattggttaatttttgctcttcacaattctggactctttggcagtgtctcagctgtagagtaaaattgccacatcctaagcgtgcctaaccagcttgaaaggttatattgtgtcttcaacacacatcatccacatacaccctccagcagcaagcacaggcagtctccttaattatactctagggcagactgagtgtattttagccaacaaaaagctaaaggtgtctctcggggtcatttctgcaaccatgaattggggatcctgtgatttttttcaggcctgtgattatggttgctggcctttttgttactcatcagtggaaaccaatagctcttggggatggatgtggtcctatttcagactcagccaagggtggagtaaaggtgaggccaggcagctccttaaacctctcatctctgtcctcaggcttggtggagccagtgaacgtggtggacaatggagatggcacacacacagtaacctacaccccatctcaggagggaccttacatggtctcagttaaatatgctgatgaagagattcctcgcaggtaagctccatccatctgcccatccattcctccatcagtctatctgtccacccatccattcctccatcagtccatccacccatccgttcctccatcattccatccatccactcatccattcctccatcagtccatccatccacccatccattcctccatcagtccatccatccatccattctttcatcattccatccatccacccatccattcctccatcagtccgtctacccattcatagaggcagcaagtattacatagaacctgcaacttgtcaccacacactagccttgatatttgtggctcccgctctctcactcccccagttcctttcagacatctttagtttaaaggtgagctgaaattaagaagttggaaatcctaaccacgtgtggtgggattcgcctgtaatcccagctacttgggagactgagatgagaggatcacttgagcccaagagtttgaggccagcctgggcaacatagaccctcccctgacatctctggaaaaaaaaaaaaaaaaaaaaaaaaaaaagcaatagtagtagacaatcattgatgaaataaataatttattagtttattagaggcttccttttggtgttttggtgaacctgcaagtagttttctgattgggacaggacaaaggtctttacttcagggtttgcttgataaaagcatttccaaaaggttttacatagaaaccttgttccttgttgatattaatacaaaaaaaaatgttacataagctcttcacctcttggaacaatctctaagggttttcttttctttttttaaaaaatcatgccccttaagatgaaaaactttcacccatatcccctaacacatattttatatagagataagcatattagctctatgtagaaatatgtaatttataaattacatttgtatattgctttactaatataccatgtaccatatgaagcatactatagaataattatagatacagaatatagaataagatgagatataaatattaaaactgaagttccagtattctctttccatttggtgaccatgatcttagcataacaaaagtggggtaaatgtgtttaaccctgtgtttcccaaactaatttgtgaactcttcctccccaaactacttgtatcccttggaacagaggtccccaacccttggagcgtggactggtgtgggtgcacggcatgttaggaattgggccgcacggtggtgggtgagccatcattactgcctgagccctgcctcctgtcagatcagcagctgcattagattctcataggagtgcgaaccctattgtgaactgcacatgagaaggatctagattgcacactccttgtgagaatctaactagtgcctgatgatctgaggtggaacagttttatcctgaaagcattcccccaccaggccccctggtcttctacgaaaccagtccctagtgccaaaaaggttggggaccgctgccttggaacacactcaggacaaaaccagtctgtcatatgatggttactacctcatagttgtaaatttctgctagacttaggcaccttgactaactcactgtcttatctgctgtagaaatccccttttccatcccactcttatgtgtaagaaaagtcagatgcagctgggttgacatgtatctttattgactagggtgtgtgtgtgtgtgtctatcaagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggtaacttggagttattttctgagccaaaccttaatcctaagacttaatttctgggccagatttaagaacaagggtttcaataaccgatttctgactcaatgcaagttgtttgttagattttcccaccaaagagtcagtaaatgtgcagaagcagaagcagctcacctgagagatttgagggtgtagctccaagaaccactttttggtgaattttcatgtttttttactacatctattcctatgtttttatttttattttttttaaagatggggtttcaccatgttgcccaatctggtcttgaactctcttgggttcaagcagtctgcctgcctcaacctcccaaagtgctgggattgcagacatgagacactgtgcccgtcccctatgtttttatttttaaatgttttaaattactctttggttcatttaagactaagttatgctgcatatcacagtaaaccttaaaataagagtggctgaaataaatgagattattctctcttgttaaggaaccccaggctaagccacctgggtgccctgcagctcaccaaggaagtcagctccatctctctgctcctctacctagcatgtggcttctgtccttaaggtctcctcctggaccataaggctgccagtgctctggccatcacatccacatggcaggccagaaggaggaagaaagaagggaaaaaggggtcctcccagctcagtgggctctcttaagcagccctgccaaaagtccatcatagacttccattcccttctgatttgttgggggttggtcacaattcacattacctagtggcaaggatgctaggaagtggattcccatcttctgggagcggtgcacctagctaagagttatggtcctgttaataaagagaaaagggagactggatgtggtggtgtgtgagcagaagcctctgcctcctcccctccctacatttcagaggatttcgagctaaaacactcttggttcacctgacaacaaaattactaaaaattggccatgtctgtcatggtgttaaagggatctgtgaccctctactctccctaccaaaaaacaaaacaaaactagattgtattaagccatcaattctgtctgtttccactagaggcactaattggaaaatatgtcagggttttccatgaatgttttctacatcttgacaacatcctaaatagcatttctctatgatccacaggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtgagtacagggcatctcaaggtcaggggcacaggctttgcaatcagaaagccgggccgtagcccttctctgtgacttacaagctacatgatctgggcacgttgctcaacctcactgaacttcagtttgacatagattgaagctctttgtttttatttggagaacatttagatccaagaagctcttctaaggaacagagactgttttacagggttactgcaaagattagatgaggtcaggcatgaaaaatgcttagcacagtgctaggtacatgataactattattatatgcttttgaaatgttgagaacccaactctgatggcggctcccatgaaaagcagcacatttctgccttttatgagtagatagttactcaggattcattcaagagcatttcaggtcagcattagagaaacacatttaaggatctaggtttttttcatcatgcatatgtaaacctctcaggaattctccatgaatatttgagcatcacagtttctttggtttctttctttttttttcccctcctttttccttcagtttctaagacacaactattgactgtcacaggccattctttttttttttttttttttttttgagatggagtcttgctctgttgcccaggctggagtgcagtgacgcaatctcagctcactgcagcctcagcctcctgagtagctgggaccacaggtgcccacgaccatgcccggctaagttttgtatttttagtggattcagggtttcaccataattggccaggctggtctcgaactcctggcctcaagtgatctgccctcctcagcctcccaaagtgctgggattacaggtgtgagcaccacgcctggccggcctttcagtttttaagaacagcccttgggcagctcagtgctgctgctcaagcagattttaaaacacgaatccccatctctaaaatgagacagatttacttctttttaaataagaagactaaacacaggaccacccttgatgtgttctgtttctctcttagcccatctttttttgaatggagaaaatctgggctttcacggcaaggttgtgaattgctcagcgtggccctttttggctcacccatggcaaaaaatggaaaaattttggaatgcaggccaatccaccacctcctaggtctatgcagctgccagcgacaaccagatcatctttactaattgatggcatgttaacgttggatggggacttcccccttgccttgcaggccctatttcctcccccagcttgggcagaagcctgagctgaatacttgccttttggccacacctctgggtctgtcattcagggtcttccacagattgactccagtcttctcttccactcctccctgaacaaactgttcttgccaccctccctattactcctacgcacttggctcatatctaccaatgtgcttttagttcatgcttttctgcatttcctgatatgtggatcctgtgtaaaggggcgccagaaatcaagagagagactggtcactggggagaggttgcaagtctcccttagctaacagcacccatccttcagggttcagccatgtttcctttctttaggaagccctttgtcagtgcggcaaccctgggatataaattcttagaacctttgcctagatatgctgccagacacttctctgaggaacagtttgttattttttctgtaacttagttcctcttcagcatttccactgcagttggaaatgtcgttcttggtgcctggccctgttaacatcttgagagcagggactgtgtcttgcccacctttatgtgtacctggcacttaagaaaatgcccaatatgtttgctattgaaagtcaaccttcattgccatacctttaaatgctggcaaacccaggctaacctttagtcaacactcagagcttacagatgctccttatttagtaagtaattgatgacgtaaccctttgagcaacacctgatcaggggatctttgggatatccctctgaatggcagcagttggaggcctaacatttacaggcacagacaacatggatgggtatgatttgttcttgggcctccaggatgtgtgtccatacttccattctcttcccctgaactcttctccaggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtaaggaaaattccttctcccgagcatgctgttattggtggaaactgtaacagctgccgtttgttgaaccctgactaggatatcctcttcaccttttttttcctttggaaaaaaatttgttaagcagtcatgaccttgtagagtcccagagtaatctctagaaactcagagaccctttggctgtaagggtttttagggaatcttactggccaccaaggtgtctatcataataagggacttgggcaatatcctggcctaagcccaggcattttgaaagataactcctcagaaaaacacacctttatgaaaatgtttctacataaaacatgacaggtttttaaccggccagctcttccttcttccatcttcatggccattctccatggctggaggagagagcttcctgatgctgttttgtttggagacttgactctgaaatcccaggactcaaagtacctccacttgtgttttggaaagattcacactttatgtatgagggggaaatacctcgtcttttgcagctaggaacatctggaataaaaggaggaaaccattatgcaaacacctgggttagtgaatgaccaaggtctttcattttcagttgtgagttacttatagatcttcctctgtttatttatttttattattacataatagatcttcttctgaatattcttcaaccaggaaaagggttagaaaccttggggacattacctcattgaaccctcaaaaccaagcatcgttggcttttttacaaatgaagcatgcttggtctagacagacaccaaataccatgctgtcatcctcactggtgtcctttgatactgtggtcagcagccgcacttgaccacaaggtttataggcccttaatgacctggccttgtgcacagccgacaaagcaccttctaattatttcattttgtgcagcaatggagaggtgcatgaagactccattccaaactccaaagctcagggactttcttccgaacagtctatactctgttgtagtattattcccttccatcgacgtctgtttatctgtaaacagcatgccagagatctggaggctcttttatgtctcaagtatgtaaatgtaaacacttgtcaacttttgacattgttcatttaagagtgtttttctcctgtaggaagaaagaaatacagctgggaagttgatgtccttattcacagagaagggtaccagttgtagttttcagaatctgtttttagcccatagtgggttttatctggttggttagaattaggtggaaggagggaagagcagccaagcactgagcagtggtcatgggcctgctggtgcaatgatttgggggtaagagaagaccatattgggaaggtctacgtgagaaagtcagagtaaaaaaattgaggaccctttttgcagaagtggaggcttccaaactcagtaataagtgtcttctagcccctgaatacacacaaagcaagaatactttgtgtttacccactgccccctgaccactgctgaaggcagaaagggacgatcacctacagtacctggtttgggtctttattctctcattccagggagagaaccttaactagatggactgactgactgttcattggctttggttgggtagattccctgcttccctctataagtttgacgccaaaaaaggacaccgaccagcactgcagtcatagcaaatgtctcaaggagacccacagggtggtttcttcaaatacactactcacacacagcacatggagtcatggacaaacagcttaactgcccattgcctttgagaagtcctggaccaaaggccatagctcagccattgaaagatcttccttctgactgatatgtccctgcatagctccaacctgtgcaggcagaggatagggctgttccaaatgtcgctcacagagctgcctttgcctttctgcagatcccaagatacacacaaagcagttaacatgggtaaataggccttcctctgtaggagagggcttctgattcttattctttcttatggcggaagagggtgttgagaggggttcccttgctgttggttctgttgaatcaggagcattaaatcttttttgtttttttttgagacagaatctcactctgtcacccaggctggagtacagtggtgcaatctcagctctctgcaacctccacctcctgggtttaagcgattctcctgcctcagcctcccgagtagctgggattataggcacctgccaccacgcctggctattttttgtatatttagtagagatggggtttcaccatgttggccaggctggtaactcctgacctccagtgatccacctgccttggcctcccaaagtgctgggattaccggcatgagccactgcgcccagccatgagcattaaagctaagatttgttgaaaatgaatttataaaaaactttagaaacattaactgctgagcatggtggctcatgcctgaaatctcagcagtttgggaggccaaggtgagagggttgctggatcccaggagtttaagaccagcctgggcaatacagtgagaccccatctctaccaaaaaaaaaaaataataattagcctggtgtggtggtgcacgcctctagtcccaactgctcaggaggctgaggtgggaggatcacctgggcccagaaggttgaggctgtagtaagctgagattgcgccactgcactccagcctggatgacagagcaaaactctgcctcaaaaaaaattaaataattaaccacagtagacatttatcaagtaaaaaaagaactttttcctgattctgtgctgcagagatgccttgtgttagtttttacctacttacacttcacacacctcactttcatgcctggggtcacaccgtacatactgctttcgcaccttgcttccttccctcaatgtgtcataggtacccttacatattgattcattggacctgactgccatgttccactggacagactcaccagaatttatttgaccaaatcccttccagatggacattgggttgctttagttttgcacgaccacagacagcaccagtcaaggtccttacacacatcaattaactatggagtctcccgccagcttaggtctgcgtgctacaagtggggttgtgggctcacagggcatgcgcatctgacagttgaagagaggacaccaactgccttccaaaagggcagtaagaaagtgtccttcgctagagtgagtggctcactgcagttcaagatggagcagtgggggaagcagctctgtggtggtagtctactgagtgtatccttccagtatggttcccaactaatctccatttgccactgaccaggccacagatggggaagtcacagccgtggaggaggcaccggtaaatgcatgtccccctggattcaggccctgggtacaattttggttttttcctttttgtgtttctgtgtttactcagccttcatttcagaaaatctgccatctgcttctgggattgcttaagccctgtgggtgtcctggtcattggtgtgcccctcactgatcagcccatcacgatgatccctgctttttctgtaataagatcacctttgcgtcaccatccgtgctccacgaatcgccagccgtcgtgtctgtgatcacgctcggtgcagtttgtctctgtgtttaaagagaaagacagacagctgtctgcagccctcctgctgcctctcaaagccgccacttgcacattcagtttctgttcagggggaaagccacccactgctactctctgccacttaaaatgcaccttcttttccaggccacaagcaactaaacctttccagatggagcctcttgggactcatagacattgctgtctctcacttttccactttcccgtgggtgctgctgggaattttacaaacagactcccgagtgattgctaacagttggtcagcatgacctctccagtccctcaggttctaccctgggtctggagccacttagacaaagcccataccacaatgggcagccgcattcccaaatcccggcctcactggcttgtagaattcccagcagctctaacccctgtagcttcaccagctcccgctgttgtctgctttacccagtgaccactgccttctgtttttaggtgaccgaagaggcctatgtcccagtgagtgacatgaacggcctgggatttaagccttttgacctggtcattccgtttgctgtcaggaaaggagaaatcactggtaagcacttgccataaaggccgtctcattctcacttgctctcacgagcttcccagaatggtgctggggaggtgtgtccactgtcccccagacccaggctccttaacccagggtcacgagttcttggtctccggtgttgggccgtgggctcctgaaactacagaatatgccacgtgtgtgtttctctgaagaagtggctcactgacaacttgcattactttcttgagcagtcccatgattctctctaggttaaaaactgctgtgtttagatacctcatgactgtcgggttcttgtttgcccctttttcctgccttctcttatttgacttttccagatgtgactttgacactgagtctgtcatacaggagttcctttctcccctcagcctcttttcaatggcccacttctctttggtttgatgctctatgtatccagctggtttcatggtgttctcaagtcctttctgagcttgattttgccagttgtagaaaactctttaagagttgtctgctatattttgtggaagccaaatggaactggaaaaaaaaaaaagaaaagagcaaatggtctctcccattgtgggacttgaatgttttaggcagcaacgaatgttcttgggtctggaaacctttattttgaatacatctgtgccttgggctctgcttctctggggaaggttgctggtgggcttcattgccccgtctctctgtgctccataggagaggtccacatgccttctgggaagacagccacacctgagattgtggacaacaaggacggcacggtcactgttagatatgcccccactgaggtcgggctccatgagatgcacatcaaatacatgggcagccacatccctggtaagctgagtcagcaggcccagcagggctccaccattcaggggcatccgggcagcctgcagacactcctcagccgctttgcagggagcagctctcggcagcaggctggagaatgcagcgttggtacccctgtgaaaccaaacagtctgggaccctagcaggtccagctgatttctggaagggatgatgtagctcagtgtcttgggtcacagtgcaggcctttgggtctgtggttgtttatctttgtcactacgctgagtgtggccagaggtcaagctgggagaaaaatgggaggcatggtgagggactttccagcctggcctgcagagccctgtgtgggctggaggcttggggccaggtcagaggtggaagaagaggaccagcagccctggaagaagaggaccagcagccctctacaagggaagccagcccaggtttcatgggtcaccaaccagcacagtgtcaccagttcattctttctttttgtagttgtatttgttttttaatttagtattttgaataggtaacacattctcatggttcaaaaataaaaatgatacgaagaaagttttccttcctacccctctccttgaactagactatcataaatttttttatgttcgatttcagagtttcagggttttattttttatttttttgtggagatagggtctcactgtgttgcacagattggtctcaaactcctgtcctcaagcagacctcccgcctttgtctcctaaagtgttgggataacaggcatgagccgccacgcctggccaatttcagagtatttttaagactctccatgcaaacggaaatacagatatataagagagtgtcttcccagccttccctcatgtggacgaaccattacatatttgaccatttccctattggagggcattttggttcttcctgccctcgctgtccccagtgttgctgcgcaaatcgacttttcccctagtcacctcacactcacaaagatgtatctgtgagatttagttaccagaggaggcaatgctagggccccagtgcaggcatctatgattttgacagatcttgccaaattgcccttcagaggggctgttgcagttcacacgccctctggccatggagaagagcaccttcttttccacaaaatttgccagtagaatatggtatcaaatttttggagctttgccagtctgatggttggaaagaaacagaatctcagcgttgctttatttgtatttctcttgtgaatgagaccacacaactttccctatgtctatttgtatttctttttctgtgaactgaacatttggatccacggcctgtttttctatttggttattggcctttgtcatatagtttctaagagcaatgtaaacattggagagattagccctttgtggtaggagttgcaaatgtttctctgagattggcatttactttagttgtctgtatgtaatattggtttaaagcaaaaatgtattatctgcttctatttaaatattctaaagcggcagatggagagagaggaaaaaatgtctttctcacatctgccatccacttccactgctggtgtgagttgtgtatcttttcagatgtttctctctgtatctacaaacatacatataattttattctattttgtttttaaaggaatagcataatggtattcatagtttatagcaacttgctttttttctttttaatgcatcatattatggataatttctcaagtcagtaaacatgggtcttcctcactctttttaatggcccatgagtagatcagcatttatttaaccggtcccctgttgtgaacacttaggtcttttcctgatgtgcacccgaacactgcagaaatgaaagtgcttacatagggctaggagtcggggtgggcagagaagaccactgtggggttgattccttacaggttgaatggcatgggcaaatggccttccaaaagccctttccacttaccttccctctggccatgggtcctttcaccacccagtgcaaaagtttcttccttatttgtcaggttgggctggtaccttaccttagcccccttcctcatctggagcagcttccaggattgtttttcttatgttgtgattgaaggaataatactgcgtagaccctctctgatgtcctaggatggcgggggatgggaggtgcatgtgcatctccttctgtctcttcatgcctctgcttaggaggcgccagacctgtagagaggtggacgtcaagatgccagttgtccagggtcttcgttcaccccttaatgagcaccaattttgtttgtgtccttcgtaaacccagagagcccactccagttctacgtgaactaccccaacagtggaagtgtttctgcatacggtccaggcctcgtgtatggagtggccaacaaaactgccaccttcaccatcgtcacagaggatgcaggagaaggtactgtgtggtttacgtgtttatacgcctccagctgtccatttggagggtgaagtggacacggttccagggtggcttttaaaagtgagacaatcgaatggtagtatttgtcttgtcttttctctcgtgtaaatctgtttcttctttagagccgcttcgtcttctacccagacagacatttttgaagtcctttgtgttctaactgaaatcagattcatgctatgaaatactttatgtgacttgtctggaatttaagtgtgttttggttggtgatgtttttgttcttgttgcacatgtatccacaagaccacatgacttactgagtggctctttttgataaagctgtgtgcccattcccgtggtattcatggataatcccaaatctgtggttctaatgggatttccgtgatggcagccagtgcctgatgggcagggacaatccacctctgccctccaccacccaccgtctcctatgtgtaattgatgtacacggctccttccttttctcatcccatgcatcctgagagtagagagagctccagggttacttgcagtgaagaactcagatgtttggggtttcttctcagtgggtgtttttactgcgtggactgcttcattctgacagatgtccctttgcccacagctcacgtggagtgcgtcaatccattgtccccagcatcagggctgccctggatgagttgttaaaaggaaactcttaaaacaaggcaactctctccctaacacccctgcatccctgttcccacttgtaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacaggtagggttgtctggcttctggggtcttcctcgtgggaagtatggctgcctctgactgccaccctccttatcagacccctggcagcaggctagacgtctctttgagtttaggtttcacagagacttgttgaggaggagcaggggatggaatgcaattttggattagctaaatccttctcttgctgataatccaggaaaatgcgagagctagtatttggagcacacttttattgtgccagtgtgactctagggtgcaaagagaaagctctcagatggagtgttcgaatcatacttactgcaatagtgcatgaagtgcatgagcttagacatgcccttcagcgtcactactaggtaaattttctgctatcccttttacagatgggaaaactgaggcttggcaaggtagtggtgtagccaagttcacatataggtaaacagatccaggttatcaaattccaaagcccatgctcctcaccttgctgtgttcaggttatgctttcagtgggttataaggaagatgcacaaggcagatcctgtttccccaccgtatttagacctgtctgtgaagcagccagtagtactgtgtggaatgtggtcattgtttacctagaaatgcccacagccatgccaggcaggtatgaggtgccttcaactaacaaaaattcctatattttattttatttttgagacagagtctcactctatcacccaggctggagttttagtggcatgatctcggctcactgtgacctctacctcctgggttcaagcgattctcctgcctcagcctcctgaatagctgggattacagcacccaccaccacacccagcttatttttgtatttttaatagagatgaagtttcaccatgttggacaggctggtcttgaactcctgacctcaagtgattcgtctgcctcagcctctcaaagtgttgggattaggcacctggcccaaagattcctttaaaatgtggtccatgaggactcaagtctctaggtcctgccagcttcttgtctttgctgcaagcaggcatgaatcccatcattcttcattggttgggtctactcagtgttcaaggctcatttttttttcacttaactttgtgtaattagttcttgcgtgttcatccgtgaacagcatatggcatggcagctctgtgaagccagggtaaccacatgtaacgggagtcctttttgggggatgtttcccagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggtgagctaggctacccttcctggctggagccaggacatcttgggtgggagatggggactcttgcagtcctttcttgggaatgggtagcacaatggagtgtgatgtgataaacctgctgggtcacacgcacgataaatgcccaagcgtatttgtgcattgtgatatcgacactctggattgttgggtgtcaggaaagaggacatatttctatttctgagagtgtgtctctctcctgcttcctctccgccatccccttacaagccccaatctgtgttctggtccaggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggtctgtgtggtcccaggggagaggcccagagcttgtgggaaccgacttattttgctgaggcagcgtcatcttttcatcctaccaactccttttcctttctgagcatccttcaagctataggtccttctgcctgcattgtcttttatgcctcatgaccattggcaaaaatgggattgtctttgttttttagatgatgaaactgaggcttgcaaggtttagagccccctctgcactaggatctgaacccagagccacaacacctcgcaaacccctgttttcttatctgctctcccacccttgttctcagcttcccagcgtctctccaagcaaagaatgttgggttgattggccaagaccatggtcatctgagcagagcttttgtggaaatgaagcatctctttctgttttctctttgagatggtttgagttagattgtgtctcttccaagcttgccacaccccagtgcctccagtcatctgctttcttgaaggatggccacgctggtgaattctagacaaattctaacccggggagagggctggagaatttctggtcctggttgggagatactccctgttaaaccttcggatatgctgacctagctgaggtagccaggggctatttaaaaattcaaaatctcagatctggctgtggataaacccccaaggtggtacgtgcagtacttggaggcgtgagggcagaaggtcctccccagcagtttgtacgggacacatcatctatgggatattagtaaatatccttaaggaaaggcttctgtggtcaaaaccaggttcagcaggttatttcactatggggcttctcaggacgcttaacctactcatccccctctgggctttgcaaacgaggccgccattgctttctttctgctatgtagaaatagattgaggcgtaagggtcggatgtcctttctccattcatcaggctccctcttcctgaggagctgctgtcagaacagcctggggctgctgtgttgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctggtatgtgcattccattcccctccaggtgggatgcttgggttttctgtaaatgctgtgccttggcctctggcctgctcacaggagccttcttgggtcttgcagggagcccatttaccgtgaagatcagtggggagggaagagtcaaagagagcatcacccgcaccagtcgggccccgtccgtggccactgtcgggagcatttgtgacctgaacctgaaaatcccaggtgggcgtcggggactagtagggtggggaagccttggctccagccttcagggcagtgggtgcctttgggaaccaagtttaggcatggcccagaacacagtatccaagtcggctgtgctgaccttttcatttcacttcatttcattatgttcttctatgtttattttcacagagtctcatccaagaaaaacaaatgtttaccttgctacctttttcctcttccaaataaaaatagctttattgtgtcacatgggggaaacgtagatatgcttttagatttttagattaactatctgtcaaatagaatcatgtcagtgaaagaactggccctgccgatgccagggtctggaagtatttaagaggtggcagcccagcggcatccttctagtatttctctttcattcctgaaattagaacgagggctgtgctgcagaactcgctgggccacatctagccctttggtggtgaattgttcttcttgggccccgattagccagtcaacaggtcacacagtctgtctgaaatgtgttccaagttctttctataaagaatccttccagagggaagccactgtgagtgaaaattttgaggctcctctgcccagaagttggcatgtcctgtggaattgcacaaattctacagagaagggaaatctaaatcgtcttcagatggagcttgtgttgcgagctctggagagggggttgtctttctacactgcatctcccatccttcctaacgagtcacggagctgtcgactccgccttcttggctttagttaacaggttcttcttgtgtagtcacatcaacgtcgggtcacatgggaatgtggtaaagcctcattactgtagagttcagacatgatcacttaaaaagagctttattgggccgggcgcggtggcttactcctataatcccagcactttggggggccgaggcaggcagatcacctgaggtcaggagttcgagaccagcctggctaacatggcaaaaccctatctcttctaaaaatacaaaaataagcagggcgtggtggcgggcacctgtaatcccacctactcaggaggctgaggcacaagaattgcgtaaacctgggaggtggaggttgcagtgagctgaaattgcaccgctgcactccagcctgggcaacaaagtgagactccttctcaaaaaaaaaaaaaaaaaaaaaaaagagctgtactgatcgtttgtagtcataaacagttcgtgtgcctcaaggtggggggaggaagtgtcacctcccagagagagcttggttcacattttaggtacagagttggaccctggctgccccatcctcatagccacgtctgctcactttccagtcacattggtgtactcatccactgtttttgtgggcatcttcccacctcaaaaaatagacatccacatcatctctttcatgaccctgataaaatgccatttcattcaatggaactattggtgatagaaaaagagagattccatttcatgtctagatgcatcaaccttcgttactcatctctgtgcctcagctcccatcatcagggctgctgtgacatttgccaccctgtgctcaggctgtgggctggatgcccaggagtgggctgggctggtgcatttcagatgctgccatgccttggcagaccgccctccacatttctccatactcccccaccagcactggggctgtctctccttctcactttggccaacctgatggaaaaacatggcattcagtgttcagtttcatatcttcgattactagtgatatgtgtactgtgttttcttttcatttgctttacatttctcatttggcaaaatttctgtgctctgcttatttcttgaggaactagcaagtatctgcagtgtggacgtttaccctttctcttaagtctcttccagctcttggccattttgttattcttttagttacttagtaccagatgactctgggtgaggctcgattttccactcattacccaaatgatcctctcggagatcccctcctccttaatggaggacagctcactaacttcagatgtcctccggacccaggttttgcggggcatctttgtcagtttgggctgctgtagcaaaatcacatgaactaggtggcaaccaacagaaatgtatgcctcacagttgtggaggctggaagtccaagatcaggtgccagcatggccagattgtggtgagggcctccttccaggctgcaaaccgacagcgtccccttgtatcctcacatgctggagaacggagggagccagctgtctgggactcttacaaggccactgaccccatcacagggtcgctccactttcatgaccttatctaatcctaattgcctcctcaaggcccatgataatcccatcacattgttgggggtagggtttcaatatttgaattttggagggacacaaacattcagttcattacatgggtgaccctcttttcaacctcccttcccttttctgtcctcaggggtcagagtcatgaactgctctgcccagatcctgtggggctggagggtgcagtttcatactggctctaggtgatggcagtgctccgtgccccgcatgcggccgcctggcctcaccacggcagtgcaggcacagtcgttggcatgacgtgagcagctcacggagagtgatgtggtcttgcgtcctagcactggtgacccgagacattgcttttctgaaagtgtggcccctggtctttggtttgctcaaagctttgctcacgcatggtttcccctctgccattgggacttacatatgttcacctttttctctaactttgtcttgttgcctaaaagaaatgccaaagcttcttgacggtaaaggatgatggctcttgttttctacccttacctatctgtggaaaggagcccgtctgtgcatgatggatgaccacgtcacctttggcaaaaagtctcagtgcccccagcatgggtggcctgaagggccctgcccactccatgctggccacagaagggcaggcacccagcctgaagggaaggaagcctgggcacctcacgtccaccgggctgcacacaccttgctctcggctgcttgccctgcatgtcctgccctgtctcaggcccttgccctaaccctcttctctcccccaacctccctccctctttcagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccaggtgagcattgcgggcaggattttcacttgggaagaatagagttgagcccaggcagtgtgggcacccacatacttttttgccccatttgaaagagaagacttctgataggtggcattaagggcattatttaaaacaaggcatcatgactaagtctggcacagtttgtaactaagctttgctcacttacgtaaagccaaacaggtttcttactgggagcctccttggagcccgtatcttattagtgtgcacctgagtctctaattggggagcagagtaatacggtttccagagcatctttcagggctgatgttctgtggaacatactagaaagctacaaaactgactgtaagcatcctttcctgtggttgccgctggtgggaagatctgtagggaaaaaatggaacattctcatctttctctggcttggttaaggtgtattcattttttaaattttttatttaatatctttttctctcttgtttgttagagatggggtcccactatcttgctcagactggtcttgaactcctgggctcaagtgatcctcctgccttggcctcctaaagtgctgggattataggcatgagccactgtgcctggccggttaagatgtattcagggctgggcgtggtggctcacacctgtaactctagcactttgcaaggccgaggcaggcagactgcctgagctcaggagttcaagaccagcctgggcaacacggtgaaaccccatctttactaaaatataaaagaaattagctgggcatggcggcatgagcctgtagtctcagctactcgggaggctgagacaggagaattgcttgaacacaggagatggagcttgcagtgagctgagattgcaccactgcactccagcctgggcagcagagcaagactccgtctcaaaaaaaaaaaaaaaaagacatgtcttcagaggactccagatgtcctgtgaatttagttatcactagtgatgcttaggaaacttcagcaatggaccttggaccttgcttgggttctgcttggggttggagaaagaggaaagggctagcaacagacgaaacctagcactgcaggtttgaacaaggatggaagagggacaggggctctgtggggctcagtcactaaccaggtttctctttgctctcagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtatgtattcagggttcacaagaggacattttccttgtttgaacatgattaggttgcaaggaacagaaatccatcaagtttgctgaagtcaatgaggaatctatgtgtatgggcacatgggacagcctcctagaaatccagttgcaagatacatggccagacctcttaagggtgggaacgcttgttctggttgccttttgcctttctccattagcctctctgcttcttgctttcattcaattgctccattctttccaccaaccagcctctgtctgcccacccatggctaccctggctggctgccccagaagagtggccttggcatctgagctccctctagcaggagctcttaaccttttgtgtgccattgactcttgccatctggcgaagcctatggggactgttcttgggataatgttttaaagcacataaaatgaaatatgtcacattataaaagaaatcattgatattatagtacagttaccaaaatcttacaagaacaaatatgcaacatagaaacatgcatatcttcgttaatacattaaatcataagatttggtgacagtatattaactgtcatcaaagtgacaaagtaataagtgaaaatgatacgtcaaaataactgtaaaatgacataaaaatatatgatttttaatggtgatgtaagtcatatgtacttataatgtgctgtgatttcttgtcaacatttctgaagaaaggaaatggtaaatttcagttagagaatggtgaaaattaaaacgtaattttttccccattgaagtccatggatctgctgaattcaatacaggccatttggggaccctgtgagccccggttaagagtccctggccttaccccactaaggaaatcatatcggcccagcctcagccaggcgactcccactcaaccaatcagctgtggccattgaggagggctgggtctctctgaaggcattttagcccttggtgagaagcaagagtccactctgggtccagagtctctgaaatgatgggactttcctgtcctcataggtaactacgaggtgtccatcaagttcaatgatgagcacatcccggaaagcccctacctggtgccggtcatcgcaccctccgacgacgcccgccgcctcactgttatgagccttcaggtgagatgcaaggaagcatccatctccttggccgcaggccaccagtgagacccctggactcctgaggctgcttcaatgtccccttaggtgctgaggccccttttcacattttgaccacagatgtcacccagtcactggggagctttcctgtggcagagtcaactccccatacacttagggcggatgacacttggggcgagcaaaaacagagccacagtcaacaacacaccttaatgtttggggacacgtttgtttttaaaggtttatttaagagaaacaaaggaagcctgttcataactggttaagggataacaagggctttcaaaacaaaaccaacacaaaaataacagtgcagtgatgttttagcctgctgttgttggctgcctttcttcaagaaagtcagttgcaacttactgtgattcattaataagtgtgcagggaactatattaagagctttatcagtgttacctcagtaaatccttgcaatagcctgacaagtaggttctcttgaccccattttaatgatggaaaaacagagatacaaggaggttttgtccactgggaaccagctagtatgaggcagaacaggcacagtgtggctccagaacctgtatttttgtttgtttgttgttgttgttgaggcagagtctcgctctgtcacccaggctggagtgcagtggcatgatctcggctcactgaaacctctgcctcccaggttcaagtgattcttctgcctcagcctcctgagtagctgagactccaggcacgcgccatcacacccggctaatttttggatttttcgtagagatggggttgcaccatgttggccaggctggtctcaaactcctgacctgaggtgatccaccccactcaacctcccaaagtgctgggattacagacgtgagccactgtgcctggccagaacctgtgcccttaacggcaacctctctaacccccacctgatgttgtggcacacggttgcatagtccatcccattaggataccaggagatgcaacatttttcctcgtcctaaacaggtcacttaattcaaggttgtactagcaccttcagccaaactaagaaccatcggggatgcctctgggtttttgcccaggacactgaaaaataattaggtgtctgaactgggagtagcaattaagttgtgaaataacatcgaaatcccaaagtatgatttctgggtaagagtttctaaatagccttgagctgcccccagttcttgaaaatattggattcattaaaatccaatctgatgtctaagattggtgatatcattggctttagttccatacacttggtttacatttgagattctaatcttactctgaggggaactgggatacctccagttgttccaaacattagtctttcatttagagacgtaaacagaacccaaaccagactcagtccacacattgaagcggcctcatccggagaataccaagggtactaactggttactgtggtgtagatgtttttcttgtgtttcatttaaaggcttcttaacagaagtgtcttttgtggccaacttaactaaaacctacggagggagataaacccagcacttattgagggcaggagctgccctcatgcatctcgaagatttctttcaaatctgccgaggcatttatctccctcttgaggatttagcggcaagcggattcaggtaatgtaaatgattctgtctaaaaggagctggtttggaaaaatcccctccaggaaacttctgtagagtgctctcgtcatagctgggtcataaatgtttcagtaagtgcacagcaggctgtttcttaagcttttgtaaccagctgctgccgcaggagaagtgtgttcatcagcatcgccccctgttcttcccgggtcatttgatgccgagtgatatgtaaattattgatcagagattttgcggaggcccacgcaagcaacatctggtgctggttagcaaagagaggcatgtatcgttttgtcttgcttttgagactttttaggaaattggagtaggctggcacttggggtgggggtgggatgggagtgatctggtgatcaaagaccctctaattctgtgttctgtcctccctcctcagtctatatcccctagggcagcacagtccaatagtaggttctgcagtgatcaaaatgcttcaagtctatgctatgcagcatgatagccactaaccatatgtgactattgaacatctgaaatgtggccagaggaaccaaggagctggatgtttagttttatttaagtgcattaagttgaaatatatgtatatatggcctcgtggctggtgactaccaaattagccagtgcagctttaggaccttgccatgaagatgtggttcttgggccagttcttggacctcagcatcacctgagaacttcagtcccagacccactggaaaagaatctgtattttaataagatccccagatggtttgcttacacattaagtgtgagccatgctgcttcagagttattgcctgaggagtggctgtccgaccaagtctaaatcaaaattactgacttgtaaaatgctgctgttcaggattggctagtcttaaaatatctcaaatgttgttgctcagctttgttcttaaccatctgaacttctaatcccctcctcccagaagaggagatagtttccaagacaaagtatggggagtgaaactgatccagggaagagcaaaagctatgtctttctatggcttcttgtggggatacaacctctaaatgcatattaatatttaataataagctgacgttttcgagcctctctgtgtatgggctaggccctgtgataaatgttttgcatgcacagcttcatttgatctttatagtagccctcgagatagatcgttattatgcccattttacagatgaggaaactgagactcgaagaggtttggcaccctagatatatagctaggaaatggtaggaaatccagatccagctgattcttaactgctatggagtactgccttctttgcacacgtagccctttataatatgttcctccaggtctgcccttgagataacaaacagcataacataaaactgtgttcgtgttcgtgagtgcatgactttgttagctgcagtatcctcttaaaagaggacacttttttgacctggaacatactgggttttctggcctgcatgggcattattttggatgctgagatgatagtccttttgaccaggatgtctcaagtatccaagcccagaaatcatctcttctaggctgaatcaagatggtttgcataagagaccatgcagatgcacgtctctgctatcttacattaaaaatgcagaatggctcacctgccctttgttgtcatatgttatatagaaaaacctatttgcatgagaactgtcacccacagttttgggtagggtcagtgtgtgccactgagcaggaacgccgagggccataacctgtctgatgtattaaattctcaggaatcgggattaaaagttaaccagccagcatcctttgctataaggttgaatggcgcaaaaggcaagattgatgcaaaggtgcacagcccctctggagccgtggaggagtgccacgtgtctgagctggagccaggtgagcaggaggcctgctggggggtcccagcaccagcactttccagcagaatgttcctgtaaatgtgtgtcccaagggagggctgatcagtttcattactgccagtgagcctctgaattccctttgctgttgccagatattgtttataaattagggtttaaacatgtgccagggatagggagaccctttatgctaggagagaatgctcattctttctttcttttttaaacaaatgctgggctgggtacagtgccttaacctgagaggtcaaggctgcagtgagctatgatgcagtgagctatgattgtgccactgaactccagcctgggtgacagagtgagaccctgtctccagaaaaaaaacaaaaaaacaaaaaaacacatacacacaacacaaaaacaaatgcttctttgttttctgttagtttttcagattccttttgcatgacattcatcataatttttctttcatattgtaacaacatcttacagatttttattcattgaccttatggcacgagtaagcatattttgatctcactttactctaaaggaaaagtaggttaatgttctgtaaatttaaaaaagaaaatctgggtctctaggccctaatgtcctaagatttttcttgcttggtgccttggtatatggaattctctgatttaatcaactttaaagagacagtgttaccggtgaacataataaatttattaagtgtcagaaacttgaaggaaggtataaggctcaaagagttgctcaaagtttagtgaaggcctggccaaaaagcagatgatgaccccaaatgatcactagtaccacaggagaactgtgaagcaaatggtaaagatggtcagagcaggagagagaaatagtttctgcctcggtgagttcaggagggcttctcagaggaggtgacatttgatgtgggccttgatgtatgaggaggagacctatgattactgccttatagggcatttgttgtgtgcctggctgtatttgtatagtgtagttggaaatctaggctctgaccaggcatggtggctcacacctgtaatctcagcactttgggaggatcagttgagcccaggagtttgggaccaacctgggtaacatagtgagaccccttctctacaaaaaaaagtaaaaaaaaaattagccaggcatggtggcacacacctgtagtctacttgtgggggatgaggtgggaggattgcttatgtccaggaggtcgagactgctgtgagctgtgatcatgccattgcactccagcctgggtaacacagcaagaccctgtctcaaaaagaaagaaaaaggaatgtaggctctgtgtgaacatttagatctatgtttcctagtaggcagaaaggcagtggggagcctcaggaggaacaagtgtaaaggatggggtcagatcctggttttagtctgaaaggccaagtggcaagctggtgctcccagagtggtccatttgaggaagcagtggcactggaaatggagaggagggacttgaggccagagatctatggtggctatagagagtgagagagagaatccattccaaaatgttccacgtagcttagtgattgggtcggaagatgacagtgcagttatcagaactagggccagccaggcagagggtgggtgaggattggtcagggccttaaagggtttaatattttactttgaggggttttgaaggatccccaatacccaaatggagatgtttactagatcactgtgaggtttggtggcctcagccccaacagtccctcactgggtaccctccctcttctcttaaagccaatgtgcttcaggggaagctaactccaccccagacaggatttgaacccctacagatgtatgagatcattagcatgacacagttactattgattgcaaattacagaatacccagctcaagccaactcacacaataaaggggcccagtaagttgcataactagaaagttcaagacatccaagacaggtttcagcaatttgatttggtcattgagctgcgccctgcaaggcgtcaaatatttctgctgttctgctttgtgggcctggttctggccttcctcttggtggcaggatggccttcctcttggtggcaggatggctgcagcagcaccagatgtcccaccttcacgccacatcaattaagagagacaccctctcaggattcttagaagtcgagagcctcctttcccagaagtctccagcacgtctgccttcccctctcactgacctggacacatgcccactgctgagtcatttcctgtggctaaagaaatgccatgtgctcattgactaaggcttagtgaagaaggatttttccctgatccactcagggaccacacctggacatggcggtggagccagcttcccctacaacacattggctttaagggaggcggatggggactgttggaggatgttcagtgccaaaggacgtagggtgcacagcttcatggaggtgcacctctgtggagacgtccagaggcagggagaagagctttggggaacacaaattctgagagggatgaagagtactaggcaccagggagagaccgagagactacctggagaggtaggaggagaacaggctctgcaccctgggcaggagggcttcaaggaggaagcggcagtcaggtggtgcacaatgggtagatgttctaggtgcccacttcagttaacagattaccttgctacatgctgtgacccaaacgcacagccacaaacctgccctgtgggggcagttcctagctttgagcttaattaaggagcattaatgccagttggaaccgttttttttccccttcaagtggccaaatagagaaacatagaagaagtgaggttttcttttttcccttcatatatattcctttttatttcttgttatgccttcccaaaacagagacattgaacagtagttagaatggccatctcccaatgtttaaaaacaaactgaactccccaatgggtgaacaaagtaaagagtagtaacctggagttcagctgagtaagccgctgcggagccttaagtggtgaggtcttccaatttcagagtgctgtgtcttcaacttgtatcatcattttagtggaaaaacataatttaattttggtgaaatgagattcatctcgtgacaggattagtaacagcattcacagaatttcacactgaagaagtgaggttttctaaagaaaggaagtgttcttctgaggcaggggtcagagtcttgtcctgtgtttataggatttgcaatgtggatgcgtttcccttggggctgatgagggatacccagggggtctgtctggttctgaaatccaggatgctgagtgccaggctccctgtagaactgttgattttaaatgggccatctcagcttggcctccatcctttatcctcactgaactcaggggtgtccatttgcttgatttcaccctgtgcctttgctcattctcctagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtaacccactcttctgcttcttgaagccttaactgaaccagctccagggaccaagccagatggaaatcctcaagccccatgaaagctttttacacgtactccccgtggaaactggggtcatgcacacttcggaggcgcttgctgtccaaagctgttttgggagttgcggtttgacccacgataaatccagagtgagagctcgatggccgtgttatcacacctcattactgttagttgtgattcagattccttcctctgccaagtttcttgactttcagaacaggatgctgatagtcagggaacacagcacagtgtcattaattttgagggtttctttgcctgcacagaattcatgatgcgtccaagtgggctcctacccgtctgttctttcatggtaccaggctcccagaaatgcactgaagcagcaataagacctgtcccagcctatctcctcctctttttactctcagatcttaatggaggaggagaaaagactgaaatgttcaaagaattctgaagctttttagacccgttacaatttacttttattctttgccacagatgggacatgtttgattatgaaagatacaggcagtgaagaagtaaataaagtgagactcactccatcttctctcctcctcccccacctgggtctggaagcaaacggctctgggaagggaggaccttcaccctgtctgtcatctcattgtctgtcttcattcttggttgctgggttggttagctaattggttcattagacaagcagacacagagttttgcttttgtcttacagaaagaatcttactgtatccactgtgtggtatagcttgtgtttttgctttgacatcttaaagatctttccatgtcagaacagatcttcccctccttttcctggctgtagtgagaattcctgctgtgaatcgcagttatttgaacaggtggcatcgggtggtgcgcagtgagtgcgtcactgttatggaggctgccagggtggagagtcagtccttagtctttgcaggggaagtgcgcagtgtggactcactggggcatgtttgcatttggtgttactttggaccctcttgggaaagcagtatgtcctggtttcttgagtctcttgtgtgtgtacccccaccccgcataaggagagtgggatggagcagacttgcctcccaggggtgaggggtgagtggctgcatggttgcctggcatccagccctaggagcaagtgacctgtgtggccaaggggccctctccgggtgcaggagtgactggtgggctggcaggctgcccgggactctggccaaagcagtggcctcagcaaagccacccacaggggtggtgtgagtgctgccagactccccaggcaaatccagcccggctccacgctgaactctgggcctgcggcttgccttttgtgaaaggcatggtatcattttaccgtaagtgatgtccattttacagatgtggaaagtgagatgcagaggttgagtcactccccaaacaacactcccccaaaaagcagtcagctgggaggaggcagaaccaggaatcagtctacatccgtgacctcagagcctatgcgctgaacccccgagcttggccccctctctaagtggctggctcacccagaggcagtgactgcatccccagcccactttggggatgtcctaaaccaggacccctgtcctcccagccactcaggagtactttccaggcagcagtgctggcacttgggccctgacaaggtactcacctttgagggcccaggtggggtcctctcggcacttggagcgcgtggcaggcttcaggccaggcctcacagcagctgctggggtctcccacactggccaggaagcatctcaccctcctgctggctcatgccgctgtgcctgggccctctcccatttccttttggctgttcgcacacctttttgggagcttgggtttcaggctgtgctctgcaagtgctggacgctgctgagagaaggagttgctcttgcagggaagctcctagccaggaggggagaggtacagaaccgcctgcttcaaaccctgtgtaaatattgctcttgtcacagggaaggcgccttgtttttccagccctcctgctcccaagcctttccctaaatatccattctgagattacacagctgcagtgtgcatggaatgaaaaggtatctgtgcttggccgccagagcgcccagtatcctgaccttctgaacaaagcaaacctccctctgtttttaatgggtgagtttgctgtatctcttggctcaagctttaaatggtccattctgtagattttggagtaggggaatgtggagaatttggggcgggaccctgctggaggcggcttgagaggctgggagatagaccagggagctccagattctttggagccgctgagcaattttcctaatgaaatggtccaggaaccccagtgtgctcggggtataccagaagggcctccttccttaactgccttgaagaacaagcagtgctgcgtttaacatgcattaaactcacaggaactgagctggacatatttgagggggtgggggaagaccgccacgcccagagatgttttgtggtgtcagatacaggttatagctagaggcagtggtgagagacttctgcttgtggatttttttccttccatcttctctcaggtaagtgctttagctccaagttggacagactttatgtttaaatcccagttctgctggtccccagctgtgtgactccagatgaattatctgacttcactgtgcctctgcttcctttcctgtaaaacaggattaataacaggacccacctaataggcttgtttggagctgtagaggaggtaacagccaagtagtagctcttgtcccataacccctgctttctcttttcccacctcgtcttccctgcccttttgggccctcacagtcaagatgaactgatttttggttggtcaaaatattgcattagggccaaatgggtgcggtggctcatgcctgtaatcaaagcactttggaaggccaaggcagaaagattgtttgaggccaagagtttgagaccagcctgggtgacatagtaaaactccatctctaccaaaaaaaaaaatttttaaagacgaacttaggaatgaaacagcttgttaaaaaatggtggaactttcccctgcagccacatcatttcaacttcactttaaaaatatctttttggcctggcacagtggctcacacctgtaatcccagcactttgggaggtggaggtgggaggatcacttgagcctaggagtttgagaccagcccaggcaacacagcaaaaccccatctctacaaaaaaatttaaaaattagccaggcgtggtggtgcatgcctgaagtcccagctactttggaggctgaggcaggaggatggcttgagcctggaagattgacgctgtggtgagctgtgatcatgccaccgtactccagcctgggcaacagaggaagactttatctaaaaaaaaaaatattagtaataaggccgggtgcgttggctcatgcctgtaatcctagcactttgggagaccaaggtgggcagatcacttgaggtcaggagctcaagaccagcctggccaacatggtgagaccccatctctactaaagaaatacaaaaattagctgggcatggtggcgagtgcctgtaatcccagctaatcaggaagctgaagcaggagaatcgcttgaacctgggaggcggaggttgcaataagccaagatcatggtactgcactccagcctgggcaacagagcgagactctatctcaatcaatcaatcaataaaatatctttccttatcatcaccttacagctgcttcctggatggacacactgtctccttgttgctcacctcccgcttcttccctacgtagccccaggcctcagagctgctgcttgaggggcttcttggctgcacagattagataccatgatgaggttgagatagtgttgggggtggaccttggggcaggagcctcaagagcttccaggaacagctgggttgtgtttgagagttgcacgatagcagctcttttgtttttattgatatccagaacaataattctttctctggactaggagctataattaaaccaaaatatttcccagctggggcagtgtctagggctctggcagaagcatagccctgcatggggatgctatgccaggcatgccccatagagggcactgtagcaggcatgcgccagacctgatgactgaaggaggctctccctgggccagctaagttgtctcagggctgcagttaggggatctgaggcagctccactgcccatccaggggtcaagagatgagcctggcaccagagccatgcagacatggttcaaacccggctctaccactttctggttgtgtagcgtgactggccccctccctgagccgcagagtcatttgtgaagcaggaatcacggaaaggattccataccacatgcgtaaatggtgctgtgcacaggacctggagccggagtggggtacgcatgccccgtcagcgggagctgctgttctgttcctgtgcttgttgctggaattcacggcaaagtgggtgggctggcaggtcacagtggctgcacccggtctgcagcacagtgcctggggtgagggctgaggaggaagggaggagatgcttggcctccctggcttctccaagtctacccggagaagaaaggacagtcagaggggcccacgcctcccccacacccctggagggagagctggactctggtggctgaagcagcacttcaggctcacagtgtgactcaggcttcttgccctcagccacaatggctcatgcccagaggagagaacagggtgtccaggctgttggtgcttgtgggcgaaatgtcagccatgctcctcctgccttggcctagaaaagggagcccccaccccgcagggcctgaggttctctctgccagaagttcagagctagtgccagtgggttcccatgccaccagggtgagccctctgtaaggggatctatgtgtgtccctcaccacggcctcagtgctcccaggaaagccctccaagtcatcaacacagcattttctattcctttctcccaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggtaacgaacaaccaccttcggagttactctcccttcctggggagctggttgtgtcagatcaatcatagtggaaactatggatggttttagatgtgttaaagctactttgaactttgaatgtcagtaaatagtatgagatgtcagagggcagtgtttgaaacttacaaaagtccacagagtggagccgtgcagaagttgagaaagcatgttaggatgttaggtggttttctatctctaacaggaaagaatacatattgaaatcttacgtatttgtttagatcagggtctgaaaaatcccctgatttctaattttcacttgaaaaataatcaaaaagttttcctatacttataaaaatgtgtctcctccaaaacactggaaaaaataccaaactatgaaaaccacttcacagccaccacccaaggtaaccaccataaacactgtagtaaatcccttccacacgtcatgattcactgttacataaagaatgtaggttcatcgcaggaaaattagaaaattcagatagaaaaatcatcctttctcatccacagaatcattttttgatatttcattatatgtcatcccaaacttttacactgcttatacatagactattttatgtcaatagaaagatgtgaattccacaggcacatctttggtgggtagggggtggggggattgggagggtccttggccttgtcagccaaggccagactcatccatttgcccagaaagccagatcctagttgtatgggggtgggatcctaggggtttagaagacattatgggtgtgagatacaggtgtggtggcttttgtgttggggtgcgcgggctctcctggggttactgtgtagggtactcgcctgtcctctggctgagagacccctcttgatctggccattcatgcctgtccccctccctcctgtatcttaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggtaggtgtctgggccttttcaagggtggggtggggcaggggcaggctgggcaccctgggtacactggccttccctgctgaggtctcctgcagtgcccacccccatgtaggccagccgtttgcaagtaaccatcgtcatgaccctgttctcctgcacttaatatttttaaatgatttccttctcttttgccttttgaacttgggtatttatttgggtttcaagggtcggttgcctgggttctggcatccagtacacctgggctggaaacctagtaccgccacttcattcattcattcgtttgttctaaaacttatttagccatgtgaccttggaaagttattaaatctctttccaaaagtcagtttcctcttctcggaagtaccttccttaaggtgcttgtgagagtaaacaagaagattctcatagccaacacttagaatagcccttactgtgtgctaggttttgacacccataactcttaaacctcacaactagttcgtgaggtatgtgctgttctcattccctgtttacagatggggaagctgagctagggagaggtgagattccagtccaaggtcacccaggtagcaagtggcagggcagggattcgaacccacaccgtcaggctctatgagcctctgcttgtaattgccacgctctcccacctcttaggggccccagcattatcgtggaagcaccttacctttggctctcatatttcctcttcttcctgtgcctgtcctgatgcatccgggtggagtaaccaccttttgcctcctaggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaagttgccttggtgttcttggatgatgtcgcttctgaataaattgtttaatcctaggagttcaacaccctcagcctgggtaacagcaagacccagcctctacaaaaaattaaaaaattagccagcatggtgatgcatgcctgcagtcccagctactcaggaggcggaggcaggaggattgcttgagcctgagaggccaaggttgcagtgagctgtgtttgcaaccctgcactctagcctgggcaacagagcaagacagtgtaacacacacacacacacacacacacacacacacacacacacaggcacatcgttggagccccagatcagctctcccaaccccttaagggacacaaaactagcaacttgttttgacaatgaacctgggctccttttgtgggggtggggtggggctggtaaacaagctgtcacctgtcaccctgctgtgcttattgttgctgctgcctctgtttctcttttttttttttttttaattttccttttttgagacagagtctcactctgttgcccaggctggagtgcagtggcaggatctctgctcactgcagcctccgcctcccaggttcaagtgattcttctgcctcagcttcccaagtagctgggactacaggcgtgcaccaccatgcctggctaatttttgtctttttagtagagatgtggtttcgccgtgttggccaggctggtcttgaactcctgacctcaagtgatccgccctgccttggtcttccaaagtgctgtattacaggcgtcaaccactgcgactggcctgtttctcctttttctagaagagcttttgattgctgaatgcttacgaggtacctagcacccctcctccgcccccacctcctcctcctctgtctccgcctcctccccaccccacagcagtgataccgctttacagatggcactaccacctcaggtgctgcaatgacatgtttgcagatgcaaagctcacttgggggaagaccctaggcccctgccttcttgaccccagggtgctagctctaccccctggtgataccgctgtggaaacaggagtccccagataggccccggcaggtgccacggtgatgggaaatcacggctgggcccccagccctccagatgggggttgggggtggagagaaaagcagggaagggagactggattcttctgacacctggctgtcaattgggatcaattgtttgcctctgagaggagggaggaagagagtggaggaaaggtcctctcctcccggagggagcagccttatctgtggcctgcaccaggaagcactgcttcctggactcctatctgagaaggtccgtgggcttcgggattctgcagtggcgggcagttcccccacttgccaaagagtccattcaggctctgcccggtggggtctggccgggccacagtatcatgctagtttgcccacagaggagcacagggcgcagccattggtctctccactgtgaagcctggcggctttctgttgggggaggcagcatttgtaaattaacagcatgggctttggtgtcaggcaccccagagcttcaacgctggctctgccgttcattagctgtgtggccctggggaagtcgccttgcctcacctctctgggtggtcgtgaggatcaaataagagcccacagggagctgtaaggaacaattccctgccagagtctcagccactgctgtctgtgaccaacacctgctggaagtgatgttcctggcagaaggccgccccctggctgcttgttggcatctggggctacacttggttgtcccctgcatgggagcgatggtgatgttaccctggggtaaatttccccactagaagccactgcctcctgttacatcaaagacatcccagggtgggatgcacctctttatcagtcaatggctaggaccacagggcaacccttacctgcacctgggcttggctgctatggaaaccagctgtttgtgcaaataccttgaaaactttgaaacttgaccccggacaggcctggtgccaggtcctttccgacttttgtgttttctttccacctttcactactgactttgcctctttcctaccaggaatggacagggccgatggaggtgaagcggacagcagctgcactgccctgtagagattcccaggccctgcccacttcaaagcacacaagcccacctcttcctcatcacatttccctttgcaacccagggaggcactcaccaggatgctgccaagaaggaaacattttattaacatgtttctttgtttccgatgcacttaaaacacttgggcctcttgaccaagtctagttttaggacttcaaaggggcgttgaaagccacattttgatgactttggtgtaaaatgagtagggcatatcgggatttaatttcccttgaaagttgcacagacttaaaaattagcagaataggctagcagaataggccggatgcggtggctcatatctgtaatcccagcactttgggaggccgaggcaggcggatcacctaaggtcaacagttccagaccagcctggccaacatggtgaaaccccctctctactaaagatagaaaaattagctgggcgttgtggtgcagcctgtaatctcactactcaggaggctgaagcaggagagttgcttgaacccgggaggcagaagctgcagtgagctgagatcgtgctactgcactccatctggcctaggcaacagagtgagattccatctaaaaaaaaataaaacaaatagtagaataaaggttaaaggcaaaatgagtgcttgatccttgtcaacccgccaagtttatattaaaaatggggagtgttgctgttaactgaagtgcgcattagcctcagttctcagccctatggaagtagagtcaaggaaagagatggagtctttccaaatctccattaacttggagggggaagaggctgtataatctgtatatttcacgaatgaaaactcccagaaattagtatcttatgcaggtattttttccctttcacagtagtaaatcataatttgaggaagtaaaaatgtcacattgggggcagtaagggctcaggcaagcctggattcagtttatttttctggctttgtcctaaggatgctgcctaacgcatggtgggaggaatctttctaaacaaagagatccttctctgcttcgtgataaggcttttgtctgagcccccaggcccacggggaccggctcatgggcatggaatttagggagacctactccacagccctcacaccctttttctctcttcctcaagagctctcaagagcaggcaggaaatggagaatctacgagcctgacttgtggcacggatccacatatccaagggtgttttgtattttggactcgcttatctccccgggacaaagtacaaagatgaaagaatctgcaagccttttgttgcccatgtttctccctctgccctgactgccttgccaagataccaaaacacctctccctgtcgggggctgccctccctttctaggaagtggacgtgcttagggcaaagctggtgctgaaccccggcagggtgtattcagaggaggagaaaacctcagcagaagcaccaagtcctggaaatgccagcttcaggcccagctacaagcagcctgctccatagcagcagaataacctcgtgtagcagcagcattcagagaacagcgggtcacatgctgcaggttcaaaccggattccaagcccagcgctgctgcttaccaaccgagatacctcaggcggtcaccttctctgtgcctcactgctctcatctgtaaaatacggaaataatgggaaacttccattctaaaatcagatgaactccagaaaggcatctccccctgcctccctcccgctcagcacatccaccccgcaactggcctgggcaaactttcctcaacccaaagctgttgagagagggactgcctgagtgttgcagagattcggctccccaaggcagactggaaggggcaccccagctagggaaagggaggcttatggagaagccattaagcgtggtggctctaaggttgggctggggattcaaatcctggccctgccatgacctctggcaggcaggtcactgatccttcacagaaaactgtgcctcagttttctttccaatgaaatggggtaacaggacccaccccatagagtgttctgagaactcactgacaaaatatacgtaaagagcatttcaggccaggcatggtggctcactcctgcaatcccagcactttgggaggccaagatgggtggatcacttgaggtcaggagttcaagaccagcctggccaacatggtaaaaccccgtttctactaaaaatacaaaaattagccagatgtgatggcatgtgcctgtaatcccagtggggaggctgaggcagaagggttgcttgaacccaggaggtggaggttgtggtgagccaagatcacgccactgtactccagcctgggtgacagagcgagactgtctcaaaaaaaaaaaaaaaaaaaggcatttcacagagtccagtacatgataagtgttcgtgaaattactattattggtgtaaaggaactaagacattaagttctgagtcctaggaaagcagtgtggtgtggcagacagagtcttggtctgggcattagggttaggcagtatcagtaggagtgggtggggtggggtgggccaaccacagaactctgtctgaggtgggatgttggtggcctcagggagtggccagaaaggtgggaggagaaaggggtgagtcacatgcacctaggagggctccagcccacatgccagcctgttcttgtcccctggtttcagagcttcaccattttccctttgcataggcctaggccagtgacagacctgagggctgctcccacactgcgccatcccagggattgttagatggatggagcttaaataagttaataaactaagagtaagaaaattatcatcgtaagtaacactaacgctatgcactgagacttactatcacattttttaaaggagagtttgtcaaggctcagaaaggtttagtgactggccgggcgcggtgtctcacgcctgtaatctcagcattttgggaggcagaggcaggtggatcacttgaggtcaggagttcaagaccagcctgcccaacatggtgaaacaccacctctactaaaagtacaaaaattagccgggcgtgatgatgggcgcctgtagtcccagctacttggtaggctgagacaggagaatcgcttgaacccggcaggcagaagttgcagtgagccgagatcgcgccattgcactccagcctgggcgacagagcaagactaaaaagaaaaaaaaaaaaaaaaaggtttggtgacttccccaaggtcacacaggtagtcattaatggtcaaggctgtgttaaaactcggtaaacctgtctaggaacggggccgtgaagttgtgcacggctccagacacagaaaacagaagccagaggaggctctcctagcgggccgttggcctccttgggcccgcggaaggcggccctttgggagcgcctctctgcaccgtcccagctccgctcccctctcggggaagttgtgggcctcgggggtgagaggacgactgcctgggttgtcgtggccgcagtgaccgctaggggtcgccttggacacgcgaaatacgtccgcgagcggagtccctgcggtggggaaggcgcgggctctcccagaccaggaggagggggacccacccacctctcttcttctgcgctggtaagtccgggggctccagcgcagaagcttcgggggtggggcagagaggctgtctggagttctagcagcagactccgccccgcaaccgattgactccagggtcctgccgcccccaagccccgaaactcctgacttcctcccttcacccctcacccccactgtccccagtaacagagccaatgtgaagtgcgcctaggcataatttacttgagcacatttcccgggcacctactgtgtgccaggctcggcccgcggagacacccgagttacagggcagggcaggatcagctccgcgaggccagggcgttttgtcctgttgttcacttgcagcccgggacacacagtaggccctccgccaggagagaatgactaactggtgcttagctcctgctcaggcagcctgcaggcgaaaggttcatcagtcactactgtgcgtgccccggggaggcatctcagacccagctattccacttaacctgagtttcttccccaaatttcccaaacccctcacagtccatttcacacgtggaaagactgaggcccagagggcagtctatacatccgtggcctttcttgcctttctaactggggggtcccaggctgcaacactcttcccctgtgctttgcccctggctaactcatgttcacagttcaggtctcagtcaaacggcacctcttccaggaagccttccctgacccactcactgcaacctggctaagcgtctgcctccccttctagagggtgaaaccctgagagcaggaagtacctgggctctgtctttcctcatctacattttgagcctggcttggtgcctggcacagggtcagaagctaatgacgtttgttgaatgaaaagtggaaggcaagcggccccagggccctgtgggcagcctccttctccctggtcagggaggcagaaggtgtgaggatccaggtggctgactttgtggtaccgccgaggcgtcaggtgggtcctcccctgccccgccctgcctgcgcctctctcaagtgcccatcccacttcctgggagaattttgtgtctgtaacacaaggacgtgggttttggggttaaacccagagattcctcagtttactcatttgcgagagtgacgcaagacggcctgtttgcaaatcactgtgaggattaagtgatgtaacagtaaagtccccagcccggggcctggcatggagtaggtacacaccagcgggcacaccagcctcagtgccctggggcagtcacatggtttccaagcctccattgccccacttggaaaggaggacatgaaagcctactaatggggaggatggtttaaggcacacagagcacagcttagcacctggcacctcacgggtgcttgtgaaactgcagctgatgttgagggagcacttcctcccagccagacactgtccaagtgttttatatgctggtctagtgtcattctcccaatactaagggtagttcccactctcaccctcctgtacagatgaggccactccgctagcaagggacagagctgcgtatctgaggagctggaccctagagttgccctggaaacctcctcagctgcgtgtccagcgctccctgaggccggggaagactgggcctctttttggacccccattgggtgcctggcacatagtaggtgtgcatcagagtttgctgaatggaatagaggctgcagcaccccgtgcgccaccccagagccctgtgggtgtgaaggtaaaggcctgggcccgtccctcgggggaaggacaggcaccttgggtgggttgtggccaggctctgcacccttttccagcctggtctgttcttctgcctgtgggaccccccaagtcccccagggcagcccagcctctcctctctttcagggccttggcaacccagccctcatcggctgcatgtatccttggagatgaggctctgggagcccaaacacaggccgcagagctgtgggaagagccattcttccctcctccacctctccctgcccctggggagctgtggacctcccagaaccaggcctgctggaaggaatgcatccaaaaggaggccaccacccaagttgcctggaagatcaacgatggccacaagtacctaagggaggggaccgtgcccaggaagcagctccagcaggccccatccaggtcagccttggtagcgggcccagtgcctgccaccagctcccgtgatagcaaggaggtacaggttggatggccagagaccaagggggcccagaaccagctgtccaagggagtgggtgtccaggactccccacccaagggagacagagtctggaaggccagaaaagcaactcaggggccagcaggtcagaccaggccggagagtttagaaatgaggcaggtctccccaagaatcctgcagctgctcttcccaggcatctcccacgatggccaaggccacgccctggacctccaggcacggcatcggctgaagcccgaggagaagttccagtacccagtcatgtcatcctaggagtacagctggcacgtgggtaagggccaccaccatcttgccattccaggcctctggcaggcaggcctggcctccctccccagcctcatccttcaccacccctcaccccggctcatggacctggatcaccttcctctgagcacatagaccttggggatgtgcttaggcaccttcacacttccaggccttttcatgctctggtctctccacttgggatgctcctcctgctgccccaccctgatgaaatttcacacatcacctcctctgggaagtcttctgagatgcctccaagcagattagttgagcccaccttcatgcttctgcaggtttttgagtccacagaagcactgggcacacggaatcaccattccttatatatccatctggcctggggagccctttgggttccaagacttcttagttaactttattcatgccctcccagctcccagcctggggctggtacttgactgtggaatgaatgaacaaatgaatgaacatggactagggatgagaacttgatttgcaatcaggaggtatgagttcaaatcctggttctaccacttctgagttgtatgatctcaggcaagagcctcaacttctctgggcctcaattttcacatctgaaaaatgggaataacctagtatgtgccttcctgtgtcatggagttttggggaaatcaagtgggaaagcacttggaataggaactgtcctcacaaaccccctgtgaggtaggaaccaagtgtgattccatcattcagaatggagaggagatctggagttactgaatcccagctctacctggaaatgagtcactgaacaaacaagcacagaattgtgaatcagtttaattaggaggcttgggtttgatttctggctcattcattcattcagtctgtcaatcatttaacaagtgtttattgagctcctggtatgtgtcagacacttacactttttgtccctgggcatacaacagagaacaagacagacatgatccctgccctcaccaaaggtagacaacaaacagataatgatgcggtgtcaggcagtggtccacactactacagagcagcccttttccatctttcctatgcacaggaatcagctggggtcttggtaaaatgcaggttctgactggggcagggagtgggcggtgatgggggaacttctgcatttctaacaagttcccagatggtgccgatgctgctggtccatggaccatacctcgaggtcaaggctaaaggagaagataagttagaagaaggagatggccaggtatgatggctcatgcctgtaatcccagtgctttgggaggccaaggcaaaataatcacttgagtccaggagtttgagaccagcctgagaaacatagtgagaccccatctctacaaaaaaatttaaaaattaaccaggcatggtcgtgtgcaactgtagttccagctacttcggaggctgaggtgggagaattgcttcagcccaagagtttgaggctgcagtgagcaaagattgtgccactgcactccaccttgggcaacagagcaagaccttgtatcaaaaaaggaagaagaaaagaaggagaaggagaaagagaggaagaagaagaagaggaagaggaagaggaataagaaaaagaagaagaggaagaaaaagaaggggaggaggaggaaggggagggggaggggaggggaggagggaggagggtggaaggaggaggggaaggagaaagaagagaagaaggagaaggaggac

SEQ ID NO: 1087 - DNA, 95615 bp, Homo sapiens
cacacttctgagaagcttggttgtctactttccaaacaaacagcagattggcacctgtgaactggaaccttagaggggattggtttaagtcttgttgaccccctctatggataatctgatgtatatttttctcagtgctaagtgaaatgtttcccagaatttcagcagcccgagattcaccctctggagctgcataaaaatgtagtcaatatttggtgctcagaaattgtacccaatattccaattacaggcttaatcactacagtgggcacagtgggagggcagtgccttccttcatcaggacagacctgtgcatctgtgtgtcctgcctgtgtgctcctgaccattcccgtgcattgcacctgtgttcaactaaaaccctttgccattgttcacctttaccaatgagtcctaccctcttcccaagtctttaacttatccccttgctaaataaaaatttctgaagttttttcttaatggtcatctttctaagttatttctggttaagctaatcttccagccctggcctaggacctgcccacattgaaacaaggctgacttgtgtgatcagtaaaatactgcagaaaaaataagacttttgaggctaggtcctaatacattgcaacttcagccttagtttcttggattacttcctctgggataagccaagaccacgttgtaagagttaagcagccctccacaaggagagacgccatcttgcttacactagttgccagccacatgagtgagccatctcagaggtggatcctccagcttcagtcccaggcaacatctggcttcaacctcttcagagacctgagccagaactgcccaaaagagctcttgaattcctgacccacagatacagagagatgcatactgttgttaagccacaaagttctggggtaattatgtagcagtaaatagctaatacagattttggcttgtaaattaagtgtgtgttgtctttttcatggttctttggcttgaccaaaggttaacattaagggtatgataatgggaacaggctgagcactgtgtctcctgtctataatcccagcactttgggaggattgcttgaggccaggagttcaagaccagcctgggcaacatagcgacatcctcatctctaaaaaaagagaaaattttaattagctgggcatggtggctcctgtttgtagtattcttcacatagatgaagaataaataagtggagaatatgcaactcccatgcagaagaattctaggtaatttacatcaatactctactgaggggtataactcccagtccttaagtgtggcctgtacacagtgacttgctttcaaagaggagagtatagaaatgggaataaaatagtaactacagtggagaaaactgacactttctcagccagatgatcaaggtcaacgtcaatagtgtcatgttgctaggaaatacctcaaaataggagaatagcactttacctttttggtcttctttccaaaaccctgtactctcagcttaatcatgagaaaaacatcagatataacctagccgaaggactttacaaaataccttcctactgtcaagatcatcaaaaagagaagcatgagaaactttcatgcctagaagggcctaaggagatgtggtgagtaaatgcagtgtggtgtcctggatagcatcctggaacaaaaaaaggacattaggtaaaaactaagaaaatctaaagtgtttagttaatatgtatcaatattggttcactaattgtaataaatgtaccatgctaatgtaaaatactaataaaaggggaaattaggtgtgatgtatcctcacaattttttctataaatctaaaactcagaaaataggccgggcatggtggttcacacctgtaatcccagcactttgggaggccgaggtgggtggatcacctgaggtcaggagttcgagaccagcctggccaacatagtgaaaccccgtctctactaaaattacaaaaattagccaggtgtggtggtgtctgcctgtaattccacctacttgggaggctgaggcaggagaattgcttgaacctgggaggcagagcttgcagtgagctgagatcactccactgcacttcagcctgggcaacagagcaagactccatctcaagaaaaaaaaaaaattaaactattagaaaataaaaagcctattttaaaaagtatataaccacattcaagtatcatactaaaaggataagtcattttgaatatcaaatacccagtcacctttagatctctcccaatggctaattttttttttctttcagttttttgattgtgcaacccaagcctggtacatcattgcatttgattggcatgtctcaagtatcttcaacacctggtttctcctctttagatttttttcttgcagtcgattgactgaagatttttggtctcatagttcccacgtgctgggctgtgcccttgcattcctgtgatgtcgtttaatttgtgcctctgctcctttcttacacattgatagccgtagttatgtaaatttttttagtttgatttgttgagaatttagaaaaaggttttgagacttccctccatgaggatgagttttccaatttcttcctgcaggtttataaatgttcacttcctatatatttgaggttaaaaacacggaccatgtttaaagttattattgcttttggttttgagttttctttaatgcattttgtgaacctttccctttgcgctcagcctatttgtattcaattattgatacatttgaggcctatttttactatcctgtaaagtttgacccacttttatttccttccttgacattgttttgaatgtacggttgtatttcccccctaataagctaaaagctttaactcccagtttctcccccatcacccctacctaccccaccccattccaaactcctgttgattcctggacttggggtcacattttcacttagcctattttttaagaccagactttctaaggtttgtgtttaccttcacttcatctatctattgcagtgcctccagtttctcctcttgtgttaactgtgtgcagtgtctgtgtgatgaagcttctgagatcttacatgtctaaggttttgttgttgttgttgttgttttgttttttgagacagattttcattcatgtggcccaggctggagtgcaatggcatgctctcagctcactgcaacctccacctcccaggttcaattgattctcctgcctcaacctcttgagtagctgggattataggtgcacgccaccacacccagctaatttttgtacttttagtagagatggggtttcagaatgttagccaggctggtctcgaactcctgacctcaagtgatctgcccgcctcggccttccaaagtgctgggattacaggcatgagccactgcacctggccaactaaggatatttttatcatgcttgtatatttgaattcattttggctatgcttacaattctgggttttaaattctttaatactttgaaaacactgtttggttttttattgcatccattgtttatttaaaatctgatgtcaatctggttcttgttccttgtcaggaaactttttttttgagacagagtcgttccctgttgccgatgcccaggctggagtgcagtggtgtgatctccactcaccacagcctctgcctccatggttcaagcgattctcatgcctcagcctcccgagtagctggggaccacaggtgtgcaccaccacacccggccaatttttgtatttttagtagagatgagggtttcaccatgttgtccaggctggtcttgaactcctggcctcaggtgatttacccgcctcagcctcccaaagtgctgggattacaggtgtgagccaccatgccttctcaggaaactaattttttcctgggtattttcaagcttctataatgtgtttaggtgtgggtgttatttgtatttccctttgttggcactctgggtttttcattctaggaaatttatttctgttctttgtgctaatatttcctctctcccatttcttctgttttttatccaaatgttagcatttctaagcaattcctatatctcttagcctttcttttatattttatatttcattttctttattcgtccctccaggagatttctttagtctggtcttctaattttctcatgaattcctacaatgtatccattctgctgtgtgtcctgtctattgagccctttatttcaggagttttatttttcccttcaaatatttctggttttcttttccaattgttggtatcatctttctagctttgttttactatttctacttctgttaggatctgtaatctagtatgttactattcttttaaagtctctttactcaagtgttgtggtatgttggcctgtgagctcattttccctgactaacattggctacccagcagcgtgtgcttgagacagcccagctgatgcactcctcgccagccccaaggggttcatgaaggacaggattgaatgaaccccggggaggagcacccaagcaataagagcaaccattcttcactctggaaaacgactcagtttagggctgtcaacagctcctttctcattttactgtctcacttccctgtgttatgccaaaaaaagcagtgtcctgccttaagccaaagtgccacccctcacatgcaagcttactcctgggttcctcatattttgctctgtgaggtggtgttttcctttatatgtactcaagttaatcttggtggaggtagccagtaaccaaggaagttgagcactttgggagggtctggcactggaaccccattaacatatatatgtctagtataattcaatcattcgaaacgtcaagagtggagtttcactggtgtttaagtgaaatgcataatgatcttatgtctgttgtttccagcagaaggacagaagatccataatgtaacaacgtcctgaccaatactgagtgtatttctattgggggatcccctgggcacagggagaaaacagtccatgaaagggatcctccattcttcctcccgttgccttgccctttgacacctgcttctctccaggccacctttctaaagcccagcctatgtcccttcctcagagcacagaaccctgcaggtctttaagctcgcagtgctttccattcatggacatttttataccttatttttgccaaacactgtgccaggcacaaatttatctttaaaagaaattgtaatgaagtaggcatatagaaaagtgcatgaaacttttaccatttaaagtataatttttatgcaaacacctgtgtcaccaccaaccaggtcaagaaggagattttgctagaaggcccccacattcctgtgcttgattacggctccatctttccctcgaggaaattgtctttgtgcctcttaggataatcagtaccttgttttgccagtcagtaggtgggcaatcttgggcacatagcttaaccctcttggagtttgattcttctgtaaaatggggatggattcactcctccaaaaggctgaatagcttctggctgaaagcacatattctggtgctagtctatcaggttcgagtcccagttctcctacttacaagctatgtgatgtttagtgattcacattgcctttcccgcactttcaatttgtagaatgagatgagaacaatactgacgtcttagagttgctctgaagagcaaatgagacaaaatattgcgggcacttaaaataccacctgagtcacgataaatactgtttcaaaaagatgctgattattcttttcataatgcttttgtgtatatggaagcataggaactagtggaagataacctatggaaattactatgaaaaatgatgtctatttatggataattttgtttcaggttccaaattggtagccacaaagtttctgagttccttcagccttcatctactcttaccccacatctcttcctcatgaaggagcaaaaattagattttctataactgaagtggcattttttaagataaaatttatgtaacgtaaaattcaccatcttaaccattttaaagcgtattgttcagcagttttcagtatattcacacaattgtgcaacaatcaccattatctagttccataaaattttcatcaccccaaaagttaactcttagccatcactgtccatttccccttcgccccagcccctggcaaccataaatctaccttttgtttctatggatttgcccattctggacattttgcctaaattggatcacataatatgtgctctttcgtgtctggcttcaacttagcataatattttaaaggtttatattgcagcatgtacattccttttatggtcagatatttcattatatggatataccacattttgttgatccattcattagtcgatggacattgggttgtttccgtgtttggctactatgaatgatgctgctatgaacatctgtgtgcaagtttttgtgtgaacatatgttttctgttctctcgagtatatatctaggaatggaactgtgaagtcgtatggtaactgtttaacgttttgaagagctgccaggctgtttcccacagcagccgcaccgttttacatttccaccagcgatgaatgagggttccagttgctccaccatcgccgtacatttttgagtcaaaaatagctttccagcacttggctcagcatcttacatctgaagctgaattacagagatgggcatgtttcattgtaaagtcttgtccagcagtctcctggcaaaggcagtgcttcattctagaatgaaatggccatttacaaagtaccaagttgcaaagggcccaatgggagactccttggcctttgatgtatcttgcctaagggagcctgctctgctgggtagcttcagggcacttgacgccagccccagtccatcattctgggctggctgcctcgtacagcttcaaccaatgctagtttcaatcctttgggggctccacatgagctgttttagagataaatttggctcctgagattgttaaaacctgtatgtctctaaagagtaagtaaaaaggaattcaaggaaatgtaaaacatgctttaatatctcatacctgactctactgaggaatgttaaaaaaggaatttcccatttgggactttcggctgaagccctgtttctcttgctcttttattacatcttttcttcatttgtaatttatataggtttctgtttgcaattcaagttgaatcttttattttaatgaggatatggagtgagacgatgtgataatgaaaacaacgtgcatttcaagtattttgaaaaaacttccttagtttctgcaaggtcatctttgtgtttcttctgctttatcagccttaatggtaatctttaaatgtttccaaacatgggaagtcccaacagcggtctttttttttttttcttaagagttgaattgtctcccttgaaaatgggattttttaattgtaacctgccacattccctatcacagtaatgggaacttactaaataggaagcaatttgagcacttaaatgtgctgatgtgatgtttcttaatcactttaatgagtttcataccactagaaatggaatagaagtttcaatggaaatataattaaatagaaaagtcatttcctgtacttgtaatttccccctgatcatttctttattcacctccatagaaagggtgccctacaggtgtatagtgatgttattatacagacttatttgcataattcacttagattattagagctgaaaacaatataaaatgtaacattttattacaaatcaagtgtagcaaggcaatgtaaaactttaaaacgatgatatttctttttaaagtctgattaacatttactagttttacctaatttttcttgcattgttgatttcttgcctaaatatagatttttcttttagtaatgccttttcaatcttgcccgcttaaaacaattctcgggggaagcaataacctgaatcaataaaaacggcaaaagatctttggaaatagttggttctcctgtttgagatcaggagtaaacaaactgtttagctgggagcttatcaagccatgctaaaagtgtcagctgacacaaagtaagacacattagattggggttatcatacaatggggtttccccaagacaaaactctatactatgctatttgctgagaaatgatcagtacaaaagaaagtttcatcattcttgcattgtgatgctaaaagaaaaggccttgtaaatgtgtttaatttgctattcgtttacttcataaatttaatgtatcactttggagaatccaacagacattttggaaaaggtggcatttttcctgaccttaagtggggaacttgaggttttttacatttcaacataaaagtaaaggggcttgctatccatttagttaatacagtccaactgtatttgcctaaactgcattttttaaattttttatttttgagacgaagtctcactctgtcgcccatgctggagtgcaatagcacaatcttgactcgctgcaacctccgcctcctgggttcaaacgattctcctgtctcagtctcccgagttatggggaccacaggcatgtgccaccatgcctggctaattgttttattttttgtagagacaggggtctcgctatgttacccagactggccttgaactcccgagctcaagcaaccctcccacctcggcgcctcaaagtactgggattacaggtgtgaaccacccttcccggcccttacactgcattttagggtaaatatttttaggtttgtagttaggcaagtggtttgaagcatcatcagtctcaacctaaagctgctctttccttatgtttttagatatcaaggctttaagcaagattcagatgaagggcctgctttaccagctcacctatgaatatggaagcatcagcttactttttgcagcacatgtgtctcagggggttgtcccttcccacagtgtgtagattggcatcgagatgacgttctctctccagggtgcagtgatgaccgacatatgtgagacagtcgtttaatatcacctttattttgtactttctgtgatttttaaaaaacatacagagcagctctcttggtgactattgggctgataaagcttaaagatcagtaataaatagaagtccaggggctgggtctgtatttcgctaaggaaacctcatctgagcttcatgccctgtaaaattaagctctaaaacctcccctaaatgagatagctaaatgtcaaagcattttataaactgtaaatcaattcaaatgggagttagtatttttttttttcaaatgaacatgaggaagtatctttctgtatttagttttaatattctttgccaggtgtttattgaaataccttctttcattgtacattagtatatttaaaaagtgctttgcatgtcttgtttattatgaactactaattttttactaataattatttccatttccactatttactattctgaatgtcacatttatttatttatgttttttgggatggagtcttgctctgtcccccatgctggagttcaatggcacaatctcagctcactgcaacctccgccttctgggttcaagccattctcctacctcagccttctgagtagccgggaccaaagacgcccactgccatgcctggtaacatttgtatttttaatagagacaaggtttcaccatgttggccaggctggtctcaaactcctgacctcaggtgatccacctgcctcagcctcccaaagtgctgggattagaggtgtgagccactgcgcctggcctgaatgtcaaatttaatcccaaagtttgtttcctcaatgttaaattgaaaaagaaatgacctttacagatcaggagtaaacaaactgtttagctgggagtttatcaagccatgccaaaagtgtcagctgacccaaagtaagacatgttagatgggggttatcataccatggggtttccctaagataaaactcctccatattatactattcaaatacttttaatatcttagtcatttttatttcccttgcaggcaatctctttgaacagaggtttattcaatgaaggaaaggtggagggaagaagggaagaattacaatggttagaaaagagcaactaaagattatttctattatacttctgaacggtaaactagcaattttaataaatattggggtccacttaaatctattaaagcagaaagtgtaaagctatctccattagtgaagagatgaagtgacaaaaaccaatcagtttttgtagcaactgatttagaaaatcttgtactgaaatcaacaattagacttgcacatcatagattttcaaatgtttgctgaattgaaaaagaatattcacaggaattatttcccccgaaggtgtcttatatcaaatagatgaacttcaagttgtggaatgtaaatcttttattaaaacagttgtctttccacagtagtaaagctttggcacatacagtataaaaaataatcacccaccataattataccaaattcctcttatcaactgcatactaagtgttttcaatacaattttttccgtataaaaatactgggaaaaattgataaataacaggtaagagaaagatatttctaggcaattactaggatcatttggaaaaagtgagtactgtggatatttaaaatatcacagtaacaagatcatgcttgttcctacagtattgcgggccagacacttaagtgaaagcagaagtgtttgggtgactttcctacttaaaattttggtcatatcatttcaaaacatttgcatcttggttggctgcatatgctttcctattgatcccaaaccaaatcttagaatcacttcatttaaaatactgagcggtattgaatacttcgaagcagaacaggcaatgtgcagccctcatttatgagaaaaccctcaggaaactcccagggtgatgcttggagaagctgtgagttgagctgaagctggagaacttcctccagagcaaagggcttaagaaagaaagaagaactctaagctgggtctgctaacatcactccagtttagatggatcttggcagagagacatgcttgttcctctggattggaaagatgatttactctcgggaatcttctctgtcagcctgtacatctaaaggcatgaagcactcaattgggcaattaacattctgttaaaaaggaagaaggaaaaaaaaattagtggcaaatactgtaaagtgtacagaaaaaaaaatgcggggaggtggggactcatgacagctgcttatagataggataatatttcttcctagtttcaagaacctagcagcatactgggcaataggagatgttcaagagttacataaattataacttaaactatattatggaatacagtgtttcacttaagtcatttatgagttgtttttttttttaattaattaaaacacttggttcattctgaagaaagatacctgtagaaagagactgtctagtatgagggaacacacttgtgctgctaatgcacttacagtgtttgttctctgatggtatctctgagaatactggttgtaggactggccagtagtgccttcgggactgggttcacccccaggtctgcggcagttgtcacagcgccagccctgagagagtagaggcatgaagtcaaatggggtttatgataacctgaggacatcgtaatttagtgtttgagttaaagaaaaatgtcacatcatatgcactggcaaaatataagcagttaatcactaagcaagctttgatgatgatttcatgcatttataactcttaatacattttggcttattaccatatcttatacctacatctgtctctctatgttgtttctttctcctgaaatgtctcttctcttcctattcaaaccttgcccatctgctgaggctcattccaatcccaacttcctcaacaagttctctgcactagatgatagaaaaggttttcaaagaatcctagcgattttaaaagggacttgagatcacatgaagaaacgttctcattttataggtaaggaaacagagacccagaggagaggagtgacttgcttagagggagcagggaagtcacacagtggaccactggtggagttgggcctgccgcccaggaggtggggtgacctggccatgttctttctaatgcaccactttgccactctcttcctaaacttccctaggcagtgacatggtagcctgtcacctggccggagatggcatgggagatggaaacgggaccaagctgagccagtgaggctcctgcctgaagtttttactggaaatgggaggacacacatgttctctttcactactgttcttaagctggcagggggtaaagcaagctcatggaggtcagtcatcaatggcaccatcagcagagaccccgctgaagcacgaagccagtgcatgggaaggcacgcggagcaagagggagtccgggcgccattgctggagcagcccctgaagccggtgggtcctgggactgttccattgtgtgggccatttttgcttgagttggacttttttcttacaactaaaatgcagccctaaataatacagtcactttcttttttatattagaatttaaatattttagacatatttctctgtttaagcacatatgccccttaatacctaacacaataccagtgactacctccttacagaatcactgaatcttgctttcatatgagaaagtgaacagtttccactcctgtcttaaatgtttcatttagcacttgagaatagaataagtgtcgcacatgaaaggtttcatgtgcataaataatgagaagatgctgaagtgagaccaaaatcaacttcccagcaaattcattctccatcacacaatttcataccagaatgactgagttctaaggtcatacaatcacagtcgttgtaagtgttaatgggagagagagagagagagagacagagagagatactgaattcaatctaaattccaatctccaattctcctccatcagaattgggagcacctccctccccatgtaatcactgggggtgaaacaagatcatagtagtttccatgggctgcccctggtggagccaagacaggcccctgaacacccctgctgccagattaattttcccaaagactattttccatcatgtttctttgcatcttggatacctgtaattggttaatgcatttggcattaaccaatgagtctcacccttgagtgtgaagcatgcccctcacccaccaggatttggggagttgctgggagggcatgtcttcgttgaaaacaaagggctgtcacattccattgcttttgagttacacataatttcattttgaaatttgaaatcatattagagaaaggcttattattttttgttatactgggcatattttagaaatggttgagaagtactggcttaaataatgggttgccaaggccctccataagccacttcttcccatctattttcttaccagaagacagcaggcagagggttggctcaccaaagcccacctgggccagctcctttctatcccagggggtgtgtctctctgctttctcccctcccaactaaaccttagtcatcgtaaacctcagccagttcatgcttctctttcttgctaattccagcctacccagaactgtatttgtcagacccacttagaacttaattagcttgactttgaaatgtatgctaatttaacatcttcaactatatcattaagagccaagccatttctcatttcctctgtttttcctatactacttagcacagtgctagacctataacaagcatctgttctgaatcaagagagaggttaaaagaagtggcattttcttacatctgagatattattcaaaatatttaacaacgttgccatgggacacctgtccatcagaatggagttggaggcctagagctacactgcacttaacactttgctgaaaaatagaagcagcctgagaatagtaggggaggggagggtctcaggctgcccaggatggggagaaccggctgaaatgaaacacattctatttaccactaattaatttgaatagtatctctgcttcactatttttcagtgtaaatagtatctctgacatgctagggagcttaggaaaatgattctaacatcatataaatgacaggtgttgctattaagaatgactcaagacttgtgtttttggtactctacatgccattcattcattctttctactaagagtaatagaaagaatgaatggcatgtaaggtagacatagagctgctctagagctctatgtcagcagttgtatgccaacaggaaatgtggtattttaatacttccgaagggtctctgcccctcctgtgtgtacgacacatccttgcaggagcccaccctttatcttatctaacttgtagggagcctggcacatccagtcttacccgctggcctccaaagcatgtgcaggagcaaatggcaccgagatattccttctgccactgttctcctacgtggtatgtcttcccatcatcataacacgttgcctcatctgcatatagacacaagacagatgcacgcataagctgagaacaatactgcagacttgatctaggggtgggttctatttctgtcctaaatttgtatcatcacagcgcaaacaccacatatttatgtgaatcatccctaagagcagtactgctatacagatcttagggtggcacttccaaaaattagacctaatacactggaaagggtccaacgggaagatggaaatcatattttaaaagttgaatctacagaccaataaagcttctttgtagcattttactgcagataatggtcaaaatactcaggttggacaagtgctaaagtgtcctgtaataacattaaatcatgactcatttttgaagcttgtctccactttcccaaatcaaaagattaagaaacccactgttcactcctcaaggagacctaaagtctccaatcatttctgtgaatgagagttacagcctgataatgaaagtgagaatgcttaataaggcactaaaaatgatctgtgatgacatacgagggtcacacttgaattctccttttccgttcccaagacatgtgcagctcatcatctggccattttctccctgacggtcccacttctctccaatcttgtagttcacaccattgtcatggcaccatcctgtaggggtggggaaagtcaggaccaaaaagttatttgtatattctgactcacaagacagtaggtgaactgggacgtgtcacagggtcttcagaaccatgatctggaaaaatagcaagttaaagataaaaacccctataatgggccatttattttatttatttatttactttttatttttttttttttttttgagacaaagtctttctctgtcgcccagactggagtgaagtggtgcaatctcggctcactgtaacctccatctcctgggttcatgcagttatcctgcctcagcctcctgagtagctgggattacaggcactccccacagtgctatttttttttttttttttttttttgtattttttgtagagatggggttttaccatgttgggtaggctggtctcaaactcgtgagctcaggtgatccacccgcctcagcctccaaaagtgctgggattacaggtgtgagccaccacacctggccaatgggccatttctttggttgaattttaaaatattattttttatcatttaccattttctagggcattttaagacccaatttattctgccacaatcatgtcatcagaatagtcaaatgaaatgactttcatttgaattctcactattaagatttaaaattgtggaaaactaaagtgggattggagtagactgttaggaatagatcctagatgaaaaatcacttttggatttgcagaaaccctggatacaaagtagttcaattaaccataaaacaaggatcagctgatctctacacgccaccacctgtttcatgtacatgggaagagtaaaaaatgaacccggataaaataaaacaaaagcaaacaaaatgctaaatcattggttattatccacatcaaataagtctggttctgtggaatatctaaaagtcacagttttatgcctttaactactatacataagggatgactttttaacctccagggcttatacaacaaaacacacctcagaagcttatataacaatatactactttttccattttatcaacaattcagcctgccttaagctacaaagtaaaataattagacaactgtgatatcaaaacaaagattatgtaagttgagccaaagagtcacataaatgaacttgacatccccgctcccacaattgcacctaagtgctcaaacaggtaataaacatacaaacttaaacgtagttcgatttcaggagttaaaaaccatctacttgaagtcaaatattaaaatttccagctcctaaacagcatgtgatgtttttagtgtttttcattttcagatggtcaaacatggaagtctatattgaaaacactggctggcttttacaacttcagtctggattaaatgatttcaagtatacaagttaagtaaaatactttgaaaatctcttttaccaagtcttatattctaattccacaggatatgatttctgtatgtctataggaggcttatttataggcataacggtcaacacctataaaaatgaaccaattgtcaataatcatcacatctcctaaacacaaagaataaatgaaaggtttataaattctaatcctaatctcaaagcataatagatatttcctaggcacattttaacttaaaaaatttgaaaattaaaacgtattagaatttgaaaatcaaacatttatcaattcaagttgatttttaatgatctaaaagcagattatctgttttttctttcatatttctagcaacgttcaagctacctgggctatgtgtgtgacgcaaaagtgtgtgcatgggtactatgatatgtgcatgtttggtttatgttgaaggaggctgtttttgagtctaaatgttcacctctgatctcattcaacactgaagattaaaagagatttgaggtttttctgtgtctctaatactcttaaatagacctggttccaaaagtctttatccatttgttttcacagaaaatttcaaaaatcaaattagcaccataatcttatgtgtaattaatagttgtattggcatacaacccttgaaatgaagcaatgtccaacaagtaaaatttcccatcatttttctatgatgcaaaatattacttcgagtcaaacagtattctcttgtttgcttcatgtttggaagaacctgtgtcttccaaacatgcttccttggcacatgagtgcatgcatggaacttgaggagacaaacacggaagtggatggacaaagcaactactcactagatgaatcacatctgaaatgaccacttccaaagcctaagcactggcacaacagtttaaagcctgattcagacattcgttcccactcatctccaacggcataatgggaaactgtgtaggggtcaaagcacgagtcatccgtaggttggttcaagccttcgttgactatgaagaaaaggaagaaaaagcaaaaagagacatcttattaatcgatttggaccataagaagaaaatcgaatgactgtatacaatgacttaatctaaaacaagaattccaggaggattaagaggcattcatctgttctatcaaggcattaactgctctaaaaaaccatggttagatgtgacacctgtcacaggcacccgacaggaagcccatcttttatttttcccttgcttctaagataattgccatttctgttgaaactacttcatagaacatggaacagatcttgaggcaattgaagctagtggagaactttagtgggatgcaaagactaatgatgcctctccattggtacctgagtgaccttgggccagctatttaataccactctgccttgcttccctcatctgcaatactagcgtaataataaaaatatctatacctcctggggaatcttgtgaagattatataaggccatgaattcaaaacattgacccttttccaagacttagaaaatgttcactaaataaagaataattattaaaggctgtcttttgcttataatgcaaaagtcttagcattttaatataccattataatgtaattttcacttttattattgtaatttttgcataatagtgcagaaagcctagattttggacattgttattatagtggtgagacagctttatcagtgaggtcaactgttccaaataagaaaatgcccttggaatatagatgatttaggaataagtaagggagtctcttcatgttacctaagatcttatctctttatgatttggaaaagcttattttaaaaaaatctatgcaaacaaagcatgcttcaaattattccctaaaaattagataaactaatttgacttaaaatcccactgtgtatttttctttttacagtgcaaaactcaaaagctcaaaagcagtagatatttgaggtgcctaatttttaaaaggtgtcacccttaaagaaaatagcgttttggagaactggtaagtctgagacgtctcaaagctgggagaacctggttagaatgtagaatactgctgctgggaataaggagtttaaaagaaaaatggaaggaacttaaattgttactaggggtttctatactcaaaagagccaggagttcaaattccatcctaactaaagttaaagagatggaatctttaaaaaaaaaaaaaaaaaatgacttagaaaagcacaaagacctttttgctcttgaaaattctgttcacgtggcattctactagtaaaaccacaaaaggcaaagataagcattactgtggatatgtaatacaacaaacacaaaataatctcctcccaacctctctccagccaaatgctcaactgcttaattcacaggaatttatacatgtaaagtagcacagtcttctatcagatgagggaaggggctaaaattaaacaactggccttaggaataaaatctgtcacttggcatagacaggacttagcactctctgttggtgtggagtagagaactctcctgttggaagattggggattcacggttttgattatcccctatctcatgtgccttggtgaattttcagctgctgcaaattgagcagccaggtggcacgctattgatttaaaaggatttcccaggtgctacaaagaagagttaatgatcttttaacctctatagaagcttttaacctgtatagtcagaaaaaaaaatggaaataacattggaaaaaaatggaaataacattggaataacattctctgcagacagaaatgcacaatgttggtagcattttatatcaggagcaaaagccaactgtccccatgtctgcagaaggggtattttctttataggtaatcgtttcagtatttaatcactcaagaggacagcagcatggtgagatggagagggtctgggaaaagacatcaggaaacctgtgccctatatcaactcagatactcagaagtaaggactcagagtgttgtactaaataatatttgaaatcccttccagatctataatcatatcaccatttgagagtctgtcaattacgtatgcattttgtgaagacaacaggatatggcaggaggtgggggagagattaatttaatataaagttgctcatttatttcatgttgatgtgttgcattaaatcccaaagataaaaagacaatggcaacaaaggtacagtcaacagaaaagcccatctctggtgtacagcagaggggagcctgtgtctaaatagtacgtgtttacataccagagttgcccacggtaacaacctcttcccgaaccttatgcctctgctggtctttcagtgcctccactatgacgttgtaggtggcacctctggtgaggcctgtcagagtggcactggtagaagttccaggaaccctgaactgcaattatcggtacatccaaagcagagagaaagcattatagtgaggaatgacacgggctctcctcttaccaataaccctcactgtttaaacaaagcaaaggaagacaaaaaacaaaaaacaaaaaaaaaaaaaagagggagggtatagtggtcctaaccagctgaggagagaaatggaacaaggataggggccatcgttcctgccagattttcctgccaacaatctacctacgtgctccgtagttaacaggagccctcgacaatactagagacggcctgccattgatcttgcttcagtcgcaggtctgcataagccctctggaagccctggccatgtttgcttcacataaaacctggacactgcgctatatgggagacacggtcatgctcctccaggtgacatctgaccccagtgtggagtccttaaaacagttgggcaaatcctcaaactcatgtttctaagctcataaatttcctacagtgttgtcagtttttaaattctgccactttctaaaagtaacaacacaataaaaattgatactgtcagtgggccgggtgtagtgggtggctcatgcttgtagtcccagcactttgggaggccaaggcgggcggatcacgaggtcaggagatcgagaccatcctggccaacatcgtgaaaccccgtctctactaaaaatacaaaaattagctgggtgcggtggcacatgcctgtaatcccagctatttgggaggctgaggcaggagaattgcttgaacctgggaggcagaggttgcagtgagccgagatcacgccactgcactccagccagggccatagagcaagactccatctcggggaaaaaaaaaaatggatactgtcaacacaaattaaataatatacgttttagagaatcaatcacttatcagctgctatgcacagcttcgcctgtttttttttttctttagatatgttgtagatagtggggttcttcaaggacaaatcgtaaaggtagtgttttagacttctgcacacaaatggaaattcaggtagaatatctttcttttctagaatcatctatcttactcaaaaaggaacctcaaatgtgtgagaataagagaaatagtttcattttctctatgaaataaaagctagtgactctctggtatgtcctccaaagtagagccatattgggatttaaaaaaaaaaaaaagcagggcttaaatgtgccatcttctaagaggttctaaaagtggagccacttttttttttttttttttttcaagagacgaggtttcaccatgttggccaggctggtcttgaactcctaacctcaaatgatccacctgcctcggcctcccaaagtgctgggattacaggcgtgagccatcacacccggccatgaagccactttttattcgagggctggtcacttcagttacctaacttattcctttctgtgctgccccatgagaagtgaagagaacaattaattacctgtaagggttcttcatcagtgccaacaggatgacatgaaatgatgtactcagaagtgtcctggaatggggcccatgagatggttgtctgagagagagcttcttgtcctgtagaggcatttggattgagtcccggaccgtgtgggtacaggtgatagtctacatcttccctggggatgtgaccaatttggatttcctcacctacattcggcgggtatggtcttggcctatgccttatgggggtggccgttgtgggcggtgtggtccgcctaaaaccatgttcctcaaagatcatttgttgcccaacactgggttgctgaccagaagtgccaggaagctgaataccatttccagtgtcatacccagggtgggtgacgaaaggggtcttttgaactgtggaaggaacatccaagatctctggtccatgaagattggggtgtggaagggttaccagttggggaagctcgtctagccgagagaggttagagccaaaaaagcaaagcgcattaagctccaggaagtagcagcaatgataataatcgattcaggcaacaatgactgttcatcaatttgataaaagccaccagaaaatgagcagttctgagatcacaaaacactttttccagaaagaaatctttaggatttttctcaaaggtttctttatagtttagaaagaaaaaagtgttagtatgaatttatcatacacacagctttaaaccgctgagccccgtagaagctgcctctgctcaaattagacctaatggaactgaaatgtgcagtctttctctttctctctttcttttttaaatttgagaagcaagttgtaggaagtagaatccagactaatcatatcagtgtcataagtatgagaattacagaggtttggctcaacagtttttcatggtttgaaatggtaaaaatagataaaacacacatgttcatttttgaaattttcctatatcaggaatacacattttcttgaaattaactgaaactggatgcaaaagtaagacattatttagctctaagttgtagaaaccaaataaagataaatgtgagaggtttctctccctcctttaaaaaaggaaacattttaaaattcaacagaaggtataaaagaagagcaatgatagctcttcttttacattttaacatcttgtttgaatttttaaaaggtgaataacaaggctttatattgagtggctgtagtaaagaaaaaaaataaaaccaaactctgcagtgcatgttaaattatttctcctattaaagaatacaatatatacactatgctgttagataaaaaaaatcacaagaaatgcatcaaaacatggagaaccttttcatattgcaagattgctcatttgttattagttttgtcctatctttctccttgttacctgcaagatactcttacctgtctttttccttccaatcaggggctcgctcttctgattattcttcagggcaatgacataaattgtatattcggttcccggttccaggcctgaagggagaatagaaccatcacattatgtcaatgggctcagctagtcaagtggaagtcggtctcaccagcagacgctactgggagcaggcacttcctctccagctggctgttggcctcttgaaggtaaaatcgacttcacttttcctccataaacacccaaatatcctgcatataaagtccgcatcgcaaactaattatcttactatcatatctgacgcctgaatagacattttttggctaacttttccagggtattcttttttttttttttttttttttttttgagatggagtctggctctgtcacccaggctggagtgcagtggtgctatctcggctcactgcaagctccgcttcccaggttcagccattctcctgcctcagccacccgagtagctgggactacaggcacccatcaccacgcctggctaattttgtttttgtatttttagtagagatggggtttcaccgtgttagccaggatggtctcgatctcctgaccttgtgatctgcctgcctcggcctcccaaagtgctgggattacaggcgtgagccaccgcgcctggcctttccagggtattcttttaacgtggtcttatttgcctttttgaatttaagaaaatctatcagcatcatataccaccactggaatataaatttgaaagagagtcctgcagattatatacatgaatctacttaggcctaataaccaagcagtcctcagtggcagatcaatgaaaagtgaaactaaaggcaagtgaagggtaggagagattggccagtgtttgtgcagcctctgtgggaagtgtctagttcaattcctctcatgtctgcttctattttcctgttccccccaattctaaaaagccagtgtctccttctaatgtctgtatgttctgtgggaattttaaagtccaggtgatactctatacagactgatatggtttggctctgtgtctgcatccaaatctcatctggaattgtaatccccatgtattgaggagaggaggtgattggatcatggggtggttcccccaggctgttctcatgatagtgagttctcacaagatctgatagttttgtaagtatctggaagttcctcctgtgtgcttctctctcctgctgccatgtaagacatgcctgcttttccttccaccatgattgtacattttctgaggcctccccagccatgcggaactgtgagtcaattaaacctctttatagcagtatgaaaacagactaatacagatagtttaaatatttcatctcttgggcaaaaataatactagaggcttatagtctttcccaccaaggtagacaactcttattccccattccaggcattcttccaatgtgggtggttgggactgctctgcctcaagacctatcctgtgatagtggtcaacaaggtcaatggcaggtggtgcactggcaagtcctgcaagattgccatatctatagagagctgagtgtaatgacagaatcacaatcagctagtatgctttgaaaaatatctttctccaggactgaattgacaggtatctggcaaacttgcagcgaaaggaaaacatgagtctagtcatgccattagtacagtcttgaaattgcattttccttcactcatgccttttgggatgtattaggctctaccactcctacacagagaatgctttttgaggttatcaggaacagagtttcgcattctcatgacacagtatcaaagacgctgtgggagtttgctaaggacttcatgtgtcctaggtagtaagaaggaaaatgacagcatggaagcagcaataccagtaatagtagcctctgtgacaccagggcggggccgagggaccacttctctgggaggagacccaggcttctcatacttgatgatgtagccggtaatcctggcacgtggcggctgccatgataccagcaaggaattgggtgtggtggccaggaaacgcaggttggatggtgcatcaatggctgaaagaaaacaaaattaagtctctaagaaggcaaataaccaagaaaattactcccacacttttctcccgagccgttctaaacacacttaaaagaatctgagaatactgtaaaccggaaacaagattctctggaatctataatacaaaaatatacgcctcacatttgttttttgagttcatgaaactgattgcatacaagtcaatggcatttcctcagtagaaggtatagttaccagtggaggcgtcgatgaccacaggggagctccgagcattgtcattcaaggtgtacaggtagatcttgtagtcagtgcctggttgtaaacctgggatttgagaagagatgatttttaacagttcttgctttttactaggagaattctcaagctagcctgcaatttttctgggttcttctatcatcccatatttatatagactaccaaagtggtccacatttgaacagtaaagtagagcatgctatggatgttaactgttaacaagaaacatatctcgaaagtgaatcactgatacagacaaggacactggtaaagtaaattctggaatgcaaaaatgctatgttggaagaggccctcttgcagaatgggggtcagccacttattgaggttttctctttaccgtaatcagatggtcaatagttgagccttggaatcacaattttaaaaagctaaaaaagacctcagatattgaatattcttcggttacaattttggcctttattaagtggtattgtttacttttatattaactatgctttttaatgctaagatctatacatcactgttttttatttcttttagttttaaaccttatgttacaattttttaaataagaaagggcacaatgatggaagatcaaacttgttgattgacacttacgcaatttccatgacaaatattacacaaaatcaggcattcaaaggacaaaactatttctgatcatagcatgaaaataacgttctaaaactgggttatgatgataacactgaaaataaattttatcagtgtcagtcgtagaacagttaataagcccgtttacattgtgggtatttgttaacaaatgtggttagtgcaatgagttccctgacctgtgatggtgtagcttctgacatctggcttgatggttctctggattggagtctggccattggctggaacggcatcaacttggaagccagtgatcgtctcagtcttggttctccagctaatggtgatggtggtctcagtagcatctgtcacacgagcccttcttggtgggctgacatctgcacaggagcatagctagagattagtgcctgcttggctcatccatgtaaagttttggtattttaaaacgtttccttggtatatatcaaattcatccatttcaagaaatatataactagtaatgtgtagattatctcctttggcattcagagagaaaggtcaactgtaattagaaaataggaaaatatctacctctcagacattttattttgaagagctgaaaagctttatagatactaccagtggttcccagggctggctttatagtatctacaaatacttcaataaatattaaaattattaatgtattataatgtaaaaatatgtgtggtaggagttacaataacatggccagctaacaattttgtgtgtgtgtgtgtgtatgtgtgtgtgagagagagagagagtgtgtgtgtgtgtgtgtgtgtgtgtgtgtctaatattacggcaagtattttgtattttctctcaacaggtacaatgccatccctcttttataaatgataaaactttgacactttacctgacttttgaaaaggcatacatcaaggtattgatataacagaagactagaatctaagcctgatttggtccaatggttactgtgctgtgatataatttggatatttgtccctgtccaaatctctgttgagttgtaatctccaatgctggaggtggggcctggtgagaggtgtttggatcatgggggcagatcccttgtggcttggtgccctctttatgacagtgagttctcaagagactgggtcatttaaatgtataaggtcctccccccccaactctctctctctctcggtcttgcttttgccacagccatgtgatgtgcctgctcccccttggccttccaccatgagtaagcttcccaaggcctccctagaagccaagaagataccagcaccatgcttcctgtaaagcctgctggcctgtgggccaattaagcctcttttctttagaaattacccagtctccggtatttctttatagtaatgcaagaatggcctaatatgcattgttaagatatagcagaagccagtggggtctccccaagcttagctctatgaaaacaaattctaacaagtagagcataaactagatgtcagtcatagtccataatatcaacattataagcttatgaagtgattccattttatgggtcagtagacccctttctgaaggagtataaaagatgacagtcatgcgtcaaaaaggcaatcaaattgattttcaaattaggactcattccactgttaacatataaatctaaaaaattatttattttatttattttattttttttaagagacagggccttgctatttgcccgggtaggtctcaaactcctggcctcaagtgacgctcccgcctcagcttcccaaagtgcttggattttagacatgagccactgaaccccactgatttaccattctttaatttttgtctatacagaaggtttgtccatatgaagacattttgttacttactctccagagtggtgacaactccctgagctggtctgcttgtcaaagtgtccttaagagcatagacactcacttcatatttggtggccacctagagaaataagggcatggtgagctttagcaacgtcctcaactgaaacccaaggagtttcactacagcattaggtaaatgcaatggttagaaaataaaaaataaacaaaccagcaaaacccacaaccttgaaaattcctagattaatttcattcctacagtgcaggtgataaatgtatttatcaattttaaaatgctcttagcggttaagcttaagtaagccatagattatatacttaaactaagctggtaaaaaaaatgagaaaagtgggtattagcgtatttttcttttttatgatctgacaggtgtaaatcataattttttccttatcatagagaggcaaagagaatgttccattttgtctctgaaccctctttctgtagtttcccctgaaattggccttatgttaagaggtacatcagtcccctaggttcctagcagttttctgcatgtatgtctggaaggattttaaaatgttttaatgagggtaggctcaaggtagactggtacaaactgtaaaatattctttaccaaggtaacagagctcagaaaatgcataactaagtcgatttatgcattcaaccaatggatatgtaaattgccccccacaaccttttaaaataagcacaatacatctaaaagagctgcacaaaatccaaagctatttataaaattctgtcccaatagtcatctggaaaacttaggtcaacataaaggaattccgttgatataaaattacaataagattatttgatgcagaggaaaagaacagttagatttattatgatattatattttcaccaccttagaaactgtgttagagatgatctccatctttattccaatgaacaacggtcatgtcttaccataagtcctgatacaaccacggatgagctgtcaggagcaaggttgatttctttcattggtccggtcttctccttgggggtcacccgcactcgatatccagtgagctgaacattgggtggtgtccactgggcgctcaggcttgtgggtgtgacctgagtgaacttcaggtcagttggtgcaggaatagctgtcgagattgtcattggttagaggttatcttataggaaatgggggaaaaggaaaataaagtgagttccaagaagtagaatggattgttcttgttgggctaggtgggttccctggtcaagcaaagattcagtacaagaaagtacgtacagtaagggatgcaaaatgaagaaagtgtttgctgagaaatgtgttttatatccaccaattctcagaatcactgaaaacatttgggtaaatgccaaaactctaagagattttaggttttacaagttttgctttcccttaaaaaaaaaagttacattggcttattggccattatgatttattttacttttgtatggaaaaataagcaatggccctttttctttcttaaaattgttaattaattaatttagaaacggtctctctgtgtcatccaggcggcagtgcagtggagttatcatagctcactgcagccttgaactcgtaggctcaagtgatcctctacctcagcctcttgagtagctgggactacaggcatgtgtcaccacacctcgctaattttttcatatttttttgtagagacggggtctcacttcattgcccaggctgatcatgaactcctggcctcaatcagtgctcccggcttagcctcccaaagcactaggattacatgtgtgagccactgcacccggcctcctttttctattctacataaagtatctttgtatggataaccatttcacgcagtattccatccaaaaaagagagaataatgtttttattgtctctttatttggaccctatggcagatatggctgctaaatttgacgttctctctgtaatgcggcgtaagaagaaaactggctcccaacagaagcagaaaagagaagcgaaaagcaataatacagactgtcacctctagggtttatgctgtcactaggatacatctttagcattctactctgcttcagaaataaagcacaagaagataaagtattatggaaagcaattgccctattgattatttcctaggtgtctaaatcacaatcatttaagctaattatacaccagcatatgatatctaaccagagaagaaaggtcttacccacgtgtgctcagaatcatgctgctatgaaatgcccgagtttgggttcctttttataagtaagctctgtaatgccaaacttcttttctttatacatagtgagggtaatcacagggagtcagagcttaggaaataatccacaactttagtatcctcttcaaatgtcttgctttatggtcttgtgtataagccaggatactccaaaatttcttttaatcagacttgtttccttaaatatcacctaagttttattgtttcttaccattcctctttaaagaggatctttcctaataattctttttcacccttacacgggaatcaatagcccagtgaagcataattcattcagtagggcataaagccgctgctcccatgggcacctggtggtgcaattaaccatatacctgtggactgggttccaatcaggggctggctctccatatcatcgtgcaaggcaaccacactgactgtgtactcagaacccggtctgaggccttgcagctctgcagtgtcttcttcaccatcaggtgcagggaatagctcatggattccatcctcagggctcgagtaggtcaccctgtacctggaaacttgcccctgtgggctttcccaagcaattttgatggaatcgacatccacatcagtgaatgccagtcctttagggcgatcaatgtctgttaggcaaattaatggtaagaggttatgtgaaaagcaagttgtgaaataagcatttttataacatgcaaagcagttttgcagataccattttctttgatgaagtccaattaacccactatcaaaaggaaaaatcacttaaacacttgcttaatttttcttggtttagaaaatatgcaatgttgcatcacttattaaaacataggtgtatgtgagataagcagataccctgcaaaatgtccccacaatggggatgtatttatattaatttaaagatattctaccacgatttgatttttacaatgtgatgttagtctcatagacctggattttctataccttggaagtggtaaagctgatttgcaatgtcagattcaaattgttataattgttttgttttgtttttttttgagatggagtctcactctatcacctaggctggggtgcagaggcatgatcttggctcactgcaacttctgcctcctgggtccaagtgattcttctgcctcagcctcctgagtagctgggattacaggcacgtgccaccgcgactggctaatttttgtatttttagtagagatggggtttcaccatgttggtcaggctggtctcgaactcctgacctcgtgatccgcctgcctcagcctcccaaaatgctgggattacaggcgtgagcccagccctataatggttcttacactcttcttttcccctctctattaagcatttatattacactctggtccagccatagcccttcaaatgccccaaacataaagctacatgaggcacacttcaatcaactttaccatccagttgtagaaaagacggtctaggaaaattttttgtagatttgctataggcaaataagatttcgctgaggccatttgagcaaaagaaattcaaagcacagcaactaactatggtggtttcacaacttctttctctgtaaattcctcgcttggcactgagaaggaaaaaagatgttcgtaaagggctcagctcaagacataaactaaccaacaagttcactttccctatgtgtaattgcaaaagacatgtcgtgggcattcagacacccaagaacaaaatttgactttgaaaatggaaaccaagcagtggttacgtactggttactgcagtctgaaccagaggctgactctctccgcttggattctgagcatagacactaaccacatactccactgtgggctgcaagccttcaatagtcatttctgtttgatctgcaaagggagtgaaaagcaaatgcaacatccacgtcatccactataaagtcctcaagtggcgtctagagtttggtagtaaacatatggtggcctagaatttttatttgcagaattgtaacaaaaatatggagagtcagactttgatttcctcttggacaaacctgttcattgctaatacaaattaccatatgggagtgaagtcacactcaaggataagatctaaaacttaatatgatgcccccaacaattagtgatactgctctcagaaaaaatgaaaattaacttgactctaataaattgccttaagatcctaatttcacaagtattctatttaaaaacaaagacaacatagctaaaaagagctgaaaaagtcagttaggccatttatctcttcttagtgtgaatgataaacaaaaccagaagggtgaatctagtaatttaagatgtccatatcactaaatagaactatccatgtaaaaacagaaatgcacttaagacttctactgtgaaaagggttgataatgatcttgagccctgaactcatgaatggggacaatgatgacataggacaaaaaaatacatagtactcacaacaaggtagccatttatataaaaaagaatattaggtggtcctaccccatctatcctgttgtatatgagatgcagattactctttttttttttttttccctgagatggagtctctcactctgtcacccaggctggagtgcagtggggctatcttggctcactgcaacctctgcctccagacttcaagccattctcctgcctcagcctcctgagtagctgggattacaggcacaagccaccatgcccagctaatttttttgtattttttagtacagacggggtttcgccatattggccaggctggtctcgaactcctaacctcaagtgatctgcccgcatcagcctcccaaagttctgggattataggagtgagccaccgcacctggccgagatgcagatgattcttacctggacctgcagttttagtttttgttggtcctggtccatttttgggagtggtggttactctgtaaccagtaacaggggaacttgaaggcagccacttgacactaatgctgttgtcctgaacatcggtcacttgcatctgggatggtttgtcaatttctacaaataaaagcagggagaaaccagtgaagccccagtccttggagacaagattggacaagtcctcctctctaggtctggtacatattcgaatgatcgcttacatgagaaaggtatttcttctcgaaagaatacagagagagcttttagagggatggggcaggcatctcaataccatttcctatttttgagatggttgcttcattcacaaagaagctacattccacaagcaggtgtctcttcctactttatcaactcatccattcttttcccacaaatacttactgaacactctctatgcctgtcgtattgcagacatgcggaatatatcgacaaaactgactgaacttcctgcccttggggtgcttccttctttatctggctcaaaactctgttcgctgcaggtgctagctgcaggttgttgctcattaaaaaggaaaatctattctacaattagaaaaataccttgggagaacattgcaaaacagtatctgaataagtaaaagctggtgtcaccccagagtagaagtttgtacctgttcggtaattaatggaaattggcttgctgcttgcggggctgtctccacggccagtgacagcatacacagtgatggtataatcaactccaggtttaaggccgctgatggtagctgtagacttgctcccaggcacagtgaactcctggacagggctatttcctcctgtatgaaaaagggttagttcagagtgtgaggggtttagagctacttgggtattactgattaattgaattaccacatttatagcagcatgtaaatcacatcttcttgcttattcccttttaaagagcgctatcttgaacagaaaggggtatttatgcatgtagcaaaccttggtaagtgtataaacattgagagaaaattacagttagcgctgttttaacatttcagctttaaaatgtcactgagtagtagagtagcattagaagtgggagaaggtaagccctcaacccaggattgcatgcattgtgtcctttttaaaacttttaacagaatacattccttttaaataaaatttggaaaatacagaaaagtaaagagaagaaaaaataaaaatcacttatttccaccactgataatatgtttgtgaatttacaatccttttatttcctcagctctgccgttccccctctagttgtagtatataaacaactttttatttgggttttagaacaaattatatcatctatatcttacgtattttcttggaaaaaacaagggctccgttgaatggacttgccaaagtttctttaattctttgttcactgttgggctttcaggttatccacaacagaatctgatttaatcagagtgtaaaatagcattttactgctgtacctgtctctccgtaagtgatcctgtaatatctcactgtgacagcaggagcatcccagctgatcagtaggctggtgggggtcgcagcaacaacttccaggtccctcggaacatcagaaactagaaaaaaaagggaaacttttcacatccgtaattttcaaacaatattcagatttactgtttgttcattttccagataattgtcttaatgattcttccatacaatcatgtaaatactacgtgtaattagcagaattttatattatgacgaattcaagataaggggttacagagcccattcaaattgtgataaaatgattatttcaaatttggggaagagtttttttccctcaacattttatttggaaaaatttcaaaactacagaaaagttaaaaaaaaaaaaaaaaaaaaaagtgatacaaggccgggcgtggtggctcacgcctgtaatcccagcactttgggaggccgaggcgggtggatcatttgaggtcaggagttcaaaaccagcctggccaacatggtaaaatcccatctctactaaaaatacaaaaattagccgggcgtggtggcgggcacctgtagtcccagctacttgggaggctgaggcaagagaattgctcgagcctgggaggcagaggttgcagtgagccaagatcccaccattgcactccagcctgggcgacagagcaagactccatttcaggaagaaaaaaaaaaaaaaaaaagtaatacaatgaacacctatatacccttcccttaggtatttgtctctggcttgacgacttgagactaaaatacagataacatgatgctactgttcccgtaagtacttcagcctctatctgctaagaacaatgacactattaccctaaaattatatttttaaaggtactttgaaacagtgttcagttttccaccttttttttttttttttttgagacagagtctccctctgtcaccaggctggagtgcagtgacacaatcttggcttactgcaacctccgcctcctgggttcaagcaattctcctgcctcagcctcctgagtagctgggactacaggtgcatgccaccacgcccagctaatttttgtatttttagtagagacgaggtttcatcatgttggccaggatggtctcgatctcttgacctcgtgatccacccgccttggcctcccaaagtgctgggattacaagcgtgagccattgcgcctggccctttttttttttttttttttgagacagggtcttgctctgtcacccaggttggagtgcaatggcctgatctcagctcactgcaaccttcgcctcccaggttcaaagattctcctgcctcagcctccccagtagctgggattacaggtgcatgccaccacaccttgctaatttttgtatatttagtagagatggggtttcactatgttggccaggctggtcttgaacttctgacctcaagtgatctgcccatttcggcctcccaaagtgctgagattactgacgtgagccaccccgtccggccaattttctacattttcaacaaaacttgtgttattagaaatgcataaatacccaaatcaggtgagaaatttcttgagaggaaaaaaattatcttctttactgccaccacgcccgggcttctttaccatattctaaggaagatgtttctccacattttctcacttccctctccatgtaccatgacaatgatctattttttttttttttttttttttttttgagagctgatgacagacaacagcaagctactttacagaatctaccaactgggtaggaaagtcttctgagtttctttgcagacaagaaaagttacctgttgattgttggccaatcaataagggactttcctctctgccattaagagcaacgatgctgaccacatactctgtgcctggagtgaggttggtgagggtgatggaattccgagagtggggcacccgatcttctcgaggtctcccactgaagtgctcgggatgatggcggatcctgtagccagtgatggtggctcgaggagcaatccagtgcacagtaaaagagttggcagtaatatcagaaaagtcaatgccagttggggaatcaagacctgtttttcccacccgggggaggaagagaaaaaaaaaagaaaagacaccaccagtttaggaagtgaggaaggtgtaggggaaattaacgtacatccaacatttcgttcctgtctcatcaataccatgatttgccataaaccaaagagtaagatgtactgattctaagctacatatgaattttaaaatcttaaattgactcaattcaaaatagccagctcaagcattcatttttttcttgtgctaagtaattcaagcagattttaggggttattacagtaagtttctgtgtcacatttggagataagtgttcaagatcttctgagaattgacattttcaaattcttcagtgttcaagtattctgtgtttctatcctgtaagtgtatccttccaagtaaagcaagatctgcccactctcaaagtaaatgtttgactctcagagaagcctcctaagctcaagaggaaatttatatgtcaacagagtggtaatgatgccaaacacaaaactttctgaaactaaagacattatcccagacaaattacaatgctgataattcctcgtgaattgacagttttgaaaaatgcatttttcaaaaatgcacaaaaattcagagtttgttgcaaattcaaatcacttagtctctgggacttccagcaaatttctgtttcagttacagcatttactagttcttttcaataagaaaccaaactaagatatcataagtcctttttggaagcaagtggactataaataaattaatgaatacactaaagtgtaccttttgaaagaaaaaattaaaagcattcatatttaagtatgtaatatttatgagattcaattcaacttccttctagtaaatgcatattttattaagtaaaaagaaaatgtaaacttgctggcttagtaaaggaagacaaatagatgacaatgagtgttgggtcagccattagacagagctgcctaatgaaaaggaatgtctgctaaatctaaataacaaagatcttcttagaaaatgttttttaaaaggacagacaacaaatttcttaatttgttagtgactgaaagtctaggtgattgttgagtaaggtatcttttagtttttgagaccagcgataaaatcatactgtgatgacaaaggtacacacaccatgacaacaaaaaatggagatgtatttttagaagtagcatttcatttgttatacagaattgataggcaaaagctactggatagtcatactgccaacaccactcacctgttttctgtcttcctctaagaggtgtgctctcatgttgttcgtagacactggagacactcactacatattctgtaccaggcaggagatctgtaggggcaaatggggcttattttaaaactctgctcaaaagcatgagaaactaaagcacgcccaggactatttgaactgatgaaatatccaaatgtccagtcctatagcctacttacacctaagtgaacactacagcgaagtgttcagtgaacagaccttgagaaggtctgtaattagatgataaggaagggtcaccttgccccatggcctctcgaagccctccattccacctgtgagtgtgactcagctggatttcgagtgggatgaagttgctgcaacagctggatatttctcgcatccacctgagagtatgtctctggagggcacatgataatccttgctgtggtgctgtggattgccatttatgcctcacaacaaccctggaaggtagtttgctccttttaaaagcaatttcttgtcatacaacgtactgcatatctttaaagtgatgggtttttacatatgtgtgacttgggagaccatcaccgcattcaagaaatgaacaaacctatcacctctaaaaatttgatttactacaattatctccattttgtaaatgaaaaaacaaaaaacaaaacaaaaaaaaactgaggcacagagaagttatcttctttaatttacttgcccaggatcatactgggattgacccaggccaggactagtggtcttaataattaacctttactggaaaaaagccacacttagaaagcaatcggttctgccatattaaaatgagagcagaatattttttaaaaaattaaatatacatccctgagtatcttgttccatttttttttatttttattattttttctttttgacgaggttttactctgttgcccaggccggagtgcagtggtgtgatcttggctcactgaaacctctgcctcctgggttcaagtgattctcctgcctcagactcctgagtagctgggattacaggtgcctgccaccatgcctggctaatttttgtatttttaatagagacggggcttcaccgtgttaaccaggcttggactggaaatcctgaccttgtgatccacccgccttggcctctcaaagtgctgggattacaggcgtgagccactgtgcccagcttcttcttccattttgatacacagtcaggcatagcttaatggtggagatacattttgataagtgtgtgatttggtgattttattgtgtaagcatcatagagtgtacctacacaaacctagatgggcttgtaatcccagcactttgggaggccgaggagggtggatcacttgaggtcaggagtttgaaaccagcctggccaacatggtgaaacccctcgtctactaaaaatacaaaaaaattagctgggcgtggtggctcacgcctgtaatcccagctactcgggaggctgaggcaggagaatcacttgagccttggtggtggaggttgcagtgagcccagatcgtgccactgcactccatcctgggcaacagagggagactccgtctcaaaaacaaaacaaaacaaaacaaaacaaaaaacctagatggtagagcctttgacacacctaagctataagctatgtggtctagcctattgctcctaggctatgagcctgtgcagcatgttactgtactgaacactagaggcaactgtaatatatggtaaatatttgtatatctaaaagatacagagagtgaggtttctaaatttggaactcctactcactaaaccctcattcccctgcacaccatttgcccttcagcgtttctataaagccccctacaaaagtttggaaaagtgccagaatggaggaccagatgcctggattccatttccaccatactagctggccagtggcaatttacttaactgctggggacctcgacggcttcatgtttatttgtttgtttatttttttgagacagggtctcactctgtcacccaggctggagtgcagtggcacgatcatggcttgctgcagcctcaacctccccaggctcaggtgatcctcctacctcaacttcctacatagctgagaccacaggtgtgcaccaccatgcccggctaatttttgtattttttgtagagacttggtctcactgtgttgcccaggctggtctcgaactcctgggctcaagcaattggcccacctcagcctcccaaagtgctgggattatacaggcgagagccactgcactggtttgcttcatctttaaaagaggataataatgactttgctaggagggagaggggctaccctgaggtcatctgtagcattaggattataataaggtcttagaacacatgattagcatgtgacaggtctacggctaagggacagacattgtgatgcaggggcttgtatactgggtgatgctgtaattagtgattccagggtgctctagaacagaagcaacagccctggggtggtggatatgccaatataaagatattcttgccctcagccacaaagtaagaaaccaagattatggtcacgctgagctgctcttctttgtgtttcattatctaaattatgtttgaaaggtagatgttttcagactaatacttggtaatgtacctaaatgtaagctatttttcccttatgtagaatcttttgctgttgttatatatttgactattacagtgaaaataataaaaagcactgtttatgtgaaacacagcaccatcttgcagcctactgttttattctttaacaaaagatgtctattctataatggttgggactagaaagagacaatttccataaattgttgttatttatttaatgtcagttttttttctaagctctcagtcttctgagaaatccttctaacagattctttttgaagtacaaattaaacttctgactctcttcacaacaacattctaatctagaccaaacaatcagtcacttttctaagtattcaaatcctaaatcaatcaactgctgacactttttttataaaaatgagaataaagcacatatggtgacactattttcagttctcatttttttctctaaagatttagatttagtcatataatttctcttgatattcacttatttttacgtgcttatttagaagcagaatttgtttgaagtcatggaactttcctgcaggtgtttttccactatgatttttttaaagctgtagatatcaaaagtatattaagatagcaacaaacattacatctttcaaaattaatggagctgtgcattgaattcagagtttagtttgtagcttggttgcagctctcttgctcttagctcctcctacttgagaatttagaattcatttgctatgctctaggttaatatttatggaacagatacattcaactgcttacttgttaagaccactgcattgtctgaaggagaaattgacaactctgcaacatcttcctcatttttcacaggtgagtaacgcaccaggaagttggttaaatcaatggatgggggtggagcccaggtgacacgcatggtgtctggaccaatgttggtgaatcgcaggtcagtgggaggaggaacagctggtttcgaacaagaaggaagactcagttaatgtaattttaaaattaaagctaacgaagtagctggaaaggtaaaatcaatatttcatgcataaaggaaacagaatcataatcatgcaaacagtctaatctaagtctattttaagttatagtgtactactgttaaaaataaaacactacacacagtactgttaggccccctttaacctttttgccatcattgatatatttaaaaaaaattttaatctactttcaaatatgttgactttatgtacattattaataccactgcagattattttatcccaggccgaagaggcttaagttgccacacagcaaagagaaacatagcagtactttacaaagaaatacatgcacacagacaaaaagacaagagggtcctaaacttccccccatgtgagatatctagagctacagttccattcagtgaattctacttacaagtgaacatgttcatgcaaattggttctcagcatgtttcttttcccatgcacagcagagaacctttaaaatgttgcatgcttgtccccagactgtggttaaagaggtgtttctttacctagtgacagcaacaaaacctagaatgctcccaagtttacttttctcctacctcaaaacaatgcccatccactctaccctaaattttgatgggtttttagctacaaagaaggagcatggtagagtttatcaaagggtagaaggaagatcatgatggtacattttggtgatatatttcttataattaattggtacttacgcaatttggtattcgtgtttggtatttaagacgaaaaattctaggtcttcaaattgaatgaacatttgctattttatatttaacagagcagacatctgtatttctctagctttatatctacttgtggtttaaatgagagtgtactgaagaatacttgcatgtgtttttctccaatcagtttagcagatgcatttgattccttatccccccaatccaccctatctgaatctttggccaattgctgacttcccccatgaaacatccatatttaaccggagtaactggtggcagcatgcaacaccatctatgtctcaaacgcagaagttttcaaaattcacccgtttgttgtgtcagtgtagtaggggcactctcgccgccattaatgagagtgataacgctgatatcatagtcaatgcccggctccagccctgtgactgtgtagtatcctactgaggagtccacaaaatcttcaaaaatagggataccttctcctgccgcaactactgtgatgcggtacccaataatggtggaagagtttagcggggtccacctcaggccgatgcttgaatcggttatatcaacaaagcttaggtcagtgagttggggcacctctattgagttacaaagcaaagggagggggaggcaaaaggaaaatagagggaaaaaaagaggaaaaaataaagcagtgtatatcaggttactagtagtaaaattggtggaatgttaaagcaatgatggtaatatgcaatctgttttaaattctctgaaaagacttcctaagcatcatgaacagtttgcttccctagaagaataaacaggaatattcttttagggaatatatatatatatatattttttacattttgaaaacatccttaaagggtacaatttgaactgttcagattcctaaaaatcatatggctgtttaggatgtcaaaaccattcttagagcctagacataatatctgaagtaagtatcagcaatgcttttaataattccaaaactgttttagtagaaaataagcttgcatgaagaaggttaaaaaataataaatgggtgataaattgattttttttctcccatacaaaactcatgacaacatcatggccataacgctaatgcattatgaatgtatggtgtgaaatgtgccattcaaaagcacattcaggctgaggaaagacaggcctaaggttaaggccattgccactattttagttcattcataatcaaaacatgtaattagcgttagtaaaagcattctactgaagagtccaaagggggacacgatctgtccaatgctttcattatgttataacccaatggacaaacaagcctatccttagacaggcctttgcaatgttgtctttcaagccacaagaaagaacaccctgaaggtgtgacttttacttcttttttttaaaatccaattttcaaaaagaaggatttgaaactgcaagatgaaaaactagatgtgtcaaccaaatgctgtttcagtgctcacatacagggacaaaactattttataggcagctgttggaaattgatatggattgtaaaatcgggcagaaatgtactgatgggatgcatttaccatattactttgagcctatcagtactgagtacagacacgtgacagtgttttagtcatacttccatgtgagcagacaatacagagttaaagccatggctgccactccattacatactcgctgcaacacacagcatcccagtgaagcacagacagtaaagcagtgttaacagcaagcatttgtccaaatcgctgctttgacttcttggttttggaaagtgcagctgggagatcggaattaaatcccaaatatagttgacacccttaagcatctggggattaagatgctaatccccactcttattggaagtgtcactctcaggatagcagcttatttttctattacctgggatgatggtatcagagatagggacactttccttgtcatccttgacagtgtaaacactgacattgtactccaggccgggactcaggttatcaaaagtgcaggagctctgatcagcatggaccacttcttccaaagaatttccctgctggccgtttgtaggggttgtggtaattctataaccagtaatgtctggagaaaaaagaaaagggaagttattgcacagaggatctgtgagccagagcatatttaactagactccaatgatggattcacagggcggaatgcaggacttggcatttactgaggactccactgtcactgttattcaatgcttgcaacaatcctttcaggcagtactaagatcctcactttatttttttatttttattttttgagacagtctccctctatcacccaggctggagtgcagcggtgtgatcttggctcacttcaacctccgccaagatcctcactttaaaggaaatcttgaaccaggggagtgattccccaaagctttctttgtttccaaatctcatggtcctatcactgtaccctgcttttccttaatgaatcatttgaagacagctgaggaatattcctttctacctgcctagtatagaatcgctctccaccttaagcacattccccagagagctctcctaatttaaaaggtctgaaactatgggatttataggaagagaaccaagaaaggagaaaaggtgagaaacaaaagtgctgatacttattctagaaagagtattgattgggaggttgaggcaggcagatcacctgaggttgggagttcgagaccagcctggccaacacggtaaaaccctgtctctactaaaaatctaaaaaatagctgggcttggtggcgcatgtctgtagtcccagctacttggggaggctgaggcacgagaatcgcttgagcccaggagacggaggttgcagtgagttgagatggcgccactgcactccaagcctgggtgacagagtgagactctgtctcaaaaaaaaaaaacaaaacaaacaaaaaaagagagtattgattgttgaagtcttcaggaatcacagaaattgggcagtaaaagagttgagagggatgagagacattcaaataaaaacagtgatgactagagatctgtggggacagattaaaatgagaaagtatattaaactttataaaaggcaaggagatgacagaatattttgccattaggaacagggtaaacactaatgtggcaaatacaaggaaacccaactgaatgagaaataaatattgagatcattacacttgctagtggtcatccatatgtgtgggctgggccattgagacgagatattaatgatcctgctgctaacaagcacgaagattgtcaacttaaagtttcaaattcagagcaactcagctggaaattgtatagctttggcttaaacaatgtttccgcagataatgaaaactttaccaaaatcactctacttcagagggagattaaaagagatattctgagctagtttcattctgtgtgtttgcatacattaatcagatttagagatgatagccttagctctgtgccccggcaaagataagaactatataatacttttttttaaacaaaaatttcacaagaattttacagtaaaattagaaatagctaaataataacctaaacatatcccttaaattaacaagtatatgaggtaagaatgcaatcaacattaattggaacttttatttttgtttaagatttttctccataggtttgttgagacttccatgtggttttggcaaaagtaatgggtatctaaaatttcctgttattgctatagtacgtcatgctgtttgaatattgttaacaactatctttatacattttagcattttataaataattttcaaatatatgtgaacaaggaatttagacaaatgcttcatttaaagctctaaaaatggtcaggaaaccccttaatcagaattttcagtttgcatagaatataattaaaaaaaaattacattccaaatatgtgacattgggtgtgagaaggagtctacaaacttaagttacaatcccagttttgtaacatttaaaatgtgtgactatgagtaggccaattttttctaagtctcagttttcttattctgtaaaatgaaggtatttctgcctttcatcacccttaaatatttgtggtgcaacccatgacaaaacattcataaaacttcagggaataataaacttaggctctgtaacaactcacaaaagggaaattacgtaatatgacttcaaccatttgtttggcaatttttaatgcactcagcaaaagccaccttccacagtgcttttcttcagccctacagctgtgtgaggatctgtcttgtccccctagactagtgtaaggttgttctgcttcctgtgattgaagtcaacgtgcattaaagcatcctgcaggctgctccatgatgtacatcatgtactgctatagtttttatggagagctaagcatttgtaatttgaatcccttctttctctgaaagaaacacagtttctaaaatctttgtcttgggaaggtatggtgtatacttgccctctgatccatcccaaacttacctggggtggtgctcctctcccaggagactgtgagcactccagtgtcagggtttgcctccagatgcaagtttgttggtggagacaatgctatgcagaaagaacattttaaaagtcaaagctgacacaaagctcttgacctgtgtaatctttcctccttccctacctccctctcttccatgcttcttccctccctccctccctcccataaaaatataggttacattatgaaaatatgatggacagcagtaattctctgacaaagacttctttatgattaatgattttgcaatactattgaaattattttcatcttgccagttcataaatattcttgacatggaaagaacatttctgatgccataaaatataaagcatgaattgaacctgctactccaaattcaggaatagcattaataatataagtaaggataagatatctcccctgtgccattctcataagtaaaaagtgatattgacactagcttttttcgaaaagtagaacagttttaaaaactaatagaaaagggaaaaaattcttcttacgtgtcaccactttgtttacaattggcgcatctctttcctgtccatctctcaggacttggatggtgtagacgtattctactcctggagtcaagccggacacaacgatgcttcctgagtctgaagtcacttctcgtggtgcctctcctccctggcttggtcgtacacccagctagaggaaggaatgcaaagtaaacaccaaggacaaatatttccagaggactgttactgctgtgaggctatgattatgctttaaatagtgtaaactcttcagaaactgcacagtgtacttttattgggaaatgatttggggactcttttatatactttagctggaaattcccccaggtgggggaggtatcttccaaactgcattaaggtggcttgtaatggaaggttccagagaaatgtcattacatactgttttgcttgataaagaatctcttgttacaaaccagacgtatacagggactgtgggtcacatggtagttcatttctatttttctgtgtgtgtgctagaaggaatgtctgagctctccctttaacgagttattcacattcaattaaccttttagttgccatttaaaggcaccagcccctgtagcaactgtattgcaaaaacacaccttttgaagagatatgtacatagcttcaactgcaggatgatacattacaagagaagaattagaataactatgcccataatttaaaatccttttaagattctatttcaaaaacttaggtaacactgttatccaatagtgttcaactctagagagatccttcacacatcataaggcttctgaaagtcagcatgacattattaagggaattaaaaggtatactggcactcttcagaaagttcttctatatttgagtagcataatcataaatatggccatttacaaactttatctttggtgtatttttttaaacgatcaaggggattgagtcatgatttccagcgataacaaatatttctctcttcacactaaatgccaaagaatggaattcttttaaacatattcatttgtattcaccgcttccctaatatcattactttaaagaagatgaatccagatatccacagggaaaccttaatcttaacttctattaagagattcaccctcagtgctttgaacagttggagatgaaactgattggatgaaaatgcgatttttaagtgactctgagtttaactggtctccctaaactggcttttgtgaacttgttcacactcatttagaacaacacatcaaataaagttttcccatgtttttttgaaatgtaattccctgcaggaaaggatagagaaaataagataacaataagcagcagcttcgtgctaatgttttatcctttgcaaaacactttcgcagcctccatctacccttccaacaattcagtgaggtaggcagggaaggactgttaggccctgacaatgtagtcaaagatgtatggacagaagcaggtgacaaaacccaggtctcctgactcctgagcaccctgtttccactacatgggaaccacaaggacagctcagggctgtatcacagagattaggaacatctgcagtttaccttaaaaccaattcttggagcaggcgtccatgtgatcacaatggtggtctcagtcacctcggtgttgtaaggtggaatagagctcccaggctgcactgtgagagagaatcaatgcacatattcaaaactcaaactcacagatgattgcatagcatatagataacaagtatttttatggagaacctcagtttaaccaagcagtggatagaggatgtaacatattttttcattgggtgagaattgggagaggatcaggcttctcaatctttaatgtgccacacacatcatctggggtctggctaaaatgcagattctgtttctggaggtccaacaaaaaactagggagtttgcatttctgacaaacacagataataccaattctgctggcccgtgaatgatacctgagtaacaaggggttagatgtttgctaaggtggtcctttcattgaaattatataatctaattcatgtctttttatgattgttgggatttgactttgatgacaataaatttccctatatcgtcagtgtaaaatcccttataaaatgtaaaactggccaccacaaactgattatcatattgtttcttaaccattaatttaagaacaatggtaaattatagaaggtgatctaaaaacagctttatgctgggcggggatcggtggctcatgactgtaatcccagcactttgggaagccgaggtgggtggatcacttgaggtcaggagttcgagaccaggctggcaaacatggtgaaaccctgtctctattaaaaatatgaaaaattaactgtcatggtggctcatgcctgtagtcccagcttcttgggaggctgagacacaagaatcgcttgaaccctggagatagaagttgcagtgagccgagatcatgccattgcactccagcctgggtgacagaatgagactccgtctcaaaaaaagaaaaaaaaaaagctttacgctgaattattccacaataatggtcagctatttttggttgcaataaaagatgctatataaaagttaaacaaaatctgccaccatggatgcactttgaagtctaaagatttgtactttaaatacgtgattattctttcagaataatactgcaaaaatttagtattttatcaccagaatcaggaattataacaaatttattttgcattttctagcatcctgacatcactgttatttttcttattgaaaatattactttggccaggcgcagtggctcatgcctgtaatcccagcactttgggaggctgatgtaggtgaatcacttgaggccaggagttcaagaccaacctggccaacatggtgaaaccttgtctctgctaaaaatataaaaattagccaggtgtgatggtggatgcctgtaatcctagctgcttgggaagctgaggcaggagaatcacctgaacctgggagatggaggtttcagtgagccaagatcacaccactgcactccagccagggtgagagagcaaggctccatctcaaaaaaaaaaaaaaaaaaaaaaaagaaagaaaataaaattttacttaaacaattttttttttgagatggactcttgctctgtcacccaggctggagtgcagtggcgcaatctcatctcactgtaacctcagcctcctgggttcaagtgattctcctgcctcagactcccaagtagctgggactacagttgcccaccaccacatccagctaatttttgtatttttagtaaagatggggtttcactatgttggccaggccagtctcgaactcctgaccttaggtgatctacccacctcggcctcccaaagtgctggaattacaggcatgagccatcacacctggccaaaaaaaaaaaaaatcttatttttaaataaaagatttgttttgggttttagcaccaaaaataagaaagaaagaaagagagagagagtgagagagaaagaaagaaaagaaagaaagaaagaaagaaagaaagaaagaaagaaagaaagaaagaaaggaagaaagaaaggaaggaaaggaaaggaaaggaagaaaagagagagagagaaaggaaggaaggaaggaaagagaaagaaagaaagggaaaggaaaggaaagaaaaagaaagaaagaggcatgtatatataaagttaagatagagatttccaacaaccttgcaaatcttattataaatgtagaaaggtaagatcgcagaaggccagatattttgagttgggtaagtttaagttcaagggtatcaagtgtgttcatagctctggtcacatgtttgacatctccacaattcttcctctctttacatctcaatcaaattttgttcccattgggaaaaaacctctgaatgcatttatactaaattatgaatggctggcaagacaaagaattagtctccagagttatacaaacagggattaaaaagtgttcagactccagtctcaactcaactccagtcaatttttttttctttgccatgtgggaatttagaatcaacatcgcaattctcgcatttttttttcagtctggattctaaggagccattttttatttttattttaaaaatattgtgtgagaaaaagccaaatatatgtgtgggccacttcataatgatagctctaatggctgaattgaggtactactggtttagtgggctgtttcatctatgtatgttattattttgatggtgtttggtggggggtggggggacatgactgggatgggtgacccgatgccttttagtacctctgaaattatacaccacttgactgctggtgactgtgccaaaatgccatggccagccctgtgtgaccatttttaatggcccacaaaaaacaattcagagaacagtcagtttctttcactgaacatctgtgaaaaccacaactttttttacaaattatattcgcctcaactgtcctgggctttaagactaggtattttctattgcttgagccagccacctagagtcttcccaagtttaagatgatgctctctgcctgggaaggccattatgggaaaatcaccaaaccacaaacccacaaacgatgtcaaacaaaggatgtgattctaagtgtgagctatgggttctggcaggtcttgttagggaagaacagcccagctgttaaagaaataaaatttgccctatcaatataagactaagctgaattttccccagaaacagctttttcccctaacttttctcacatttgctcttaagaatttagcacaagttataaaactcagaaaagttactcccagaattcagcttagtaagatagtaaaaaactacagaaatttagtaatttcaaaaacatgcaagccttgtggatgtttacagccttagggagtgcttaaagttcaaatggagttgtagaataccctgcttacattagtttatttaaatataagcttcatttagctgtttttattattattcctttctcaattatctattcaccaaatagtttttgaaagcatacaatgttccagacactatgttaacctttatctaataaaattagttttggctatcagtacttcagttaaaatcattatattttatatgaatgtattatgcaaagcataaaataatatatccaatatatcagtcttcagaagtacttgaaatatcttggcccaccaccttcccttaattattgttagcatcattaaaaatgctttttcttttataagcactgtgttcaacaaaagaaactacataaaatatgtctcatgttaaggaatgaacaagacaactatagaattctacattttagtaaaagacgacatctactgaaagggcgcattcactgaaatctccattctaattcactgaaggacatttataagaaatgaatatttacaagaaatataaagacattaatttcatgagagtagatcttagactatcttagaaccgtgtaaaattttagccaaattttcaagtaagcttatttgcaaattaaaagtgaattttacttgcttacgattaactattatttaggaaaaagccttcatgagccaaacttcatacagtaaatttaaatggaagtaagtttttcttaaagtatgaattcttatggggaaaagtttgtattttctttgggaaatcaattccatagttatttacaaactaggcttgtatggactttttgaatgctttttaacatccatacttttaaattagtcgaagagtaacatttgttgaaagctcttagaaaattgcaaactagtccatggttagaatatatgctgaaaaagtacttatgttaggtgcttctataattcaaaatgtcgagttgaaaataacaaatgatgttcagctagaaataaggagtctcataattctctgtaatgtaaatggaaatgtatttaataggaatcggtttgtgaatagaggttgttattgtgatgtagatatgtgggagatttaagaccacttcctttaaaatgttgagcaaaaggatagacatgaccaaaaattattgttagtatttttctcctctgaggaatttcaagagtaatttaagaaaagagcgattccgtctgcaaaagtactttaatcttctgcagccaacactcataaagaaatcatttccttggcttcatgttcaattagttggttcccattcaatccatagatatttttattctgcatttatagttactattcaatgcccaaagtaatagaatgtagacataggtgctaattttttcttgcgttaactagtgtttggtaaattcatttaatgtaatcgaatttaatttttctaataacagactgctttaaacccatgttactcaaagtgctggccctagaggaaagagcgagcttggcaatgtgtgcaaattaacacactgcttccttcatcaagaaaatctggcttcagaaaaattctcagctgtactaagcagtgtgctttgtgatttacgttctggcacaaccgtttttcttgttgcagactagcagcaaacaattaacgggccagcagccagtctatggagcacatttttagtatcactgatttaaattatgtactaattttttaatgttttttttgttttgttttgttttgttttaaagcatgaagaatagagaatgtaaatatagttaagaaaaggcacttaattttcagcttacgtgtggtaaagactccagtggctttggggctctcttggttgccctttatggccacgagggatacggtgtactcagatgcaggctgcagattcctcagtgggtacttggagacagagggacccacattgtactgcctgggctgtcctcttcgggtaaggcccacggtcagtcggtatcctgttatctgggcccgaggtggagtccatctcaccaggacagtagaatcagtttcattgacaaactggaggttagtgggagcatccagttctaggaaaaaagatgaaacatgccaagaaatatttagatcagtaatgatcataactcaagtcctgaaacttgattgaatgtctaagttttctctcctcaaggttgtaactatgtgaaagtcaaaaccctggaaaaactgagccagtaagagattgagtgctacacaaaactttgccaaaactctgccagtcatgagaaattgtggaaccattttgcttgactgtgatcctttgggaagtctaattttccagcaagactttcgcatcagtctcagaaattatagttacattaaagcaatggtatttttaaaaaggcaaaacaaacacttctgaagttcacagttagctctgagccaaacagattaaggaaaaagggatatgcctcctaaaatgacagcaagaagaagctctctatgggtcaaaagcaatattctgtgaatagccctttgctagagaaataaaagttattttcacatggttcagattagacagtaattacagtaatgataacgtatcctcagattcatggtaggatactggtgagtttgcactatcagaatcacataagttgtggagtttattcttgagaataataaccagcagttttcccaccgaaatttaaattacctttcaaatagaggaaatctttaagaggcagtcgagtataataattgagagcatgggcttcggacataggttatagagccagctctatcccttcctatctctgtgaccctacaagttgcagaacttttttaaagcctcagtttctttaagtattcaatacggatactagtaagaccttccggctgggcacgatggctcacgcctgtaatcccagcactttgggaggccaaagtgggtggatcacttgaggtcaggagtttcagaccagcttggccaacacagcgaaacccatttctactaaaaacacaaaaattagcagggcatggtggcacacgcctgtagtcccagctactcgggaggctgaggcaggagaattgcttgaacccaggtggtagaggttccagtgagctgagatggtgccactgtactccagccctggcgacagagcgagactccatctcaaaaaaataaataaataaaataataataataagaccttccttcctaaggtcaaaacaaagagtaaatatgagaataatgcttgtaaaaactgagcagataagctggtggctagtaatactagacacttgacaattgctattgttaaatgaattctactctaagtgttatgatcctgcattttaactttgatctagatatatttagttacacgaaaaatgcactcaaattagattctcttcagttctcccctcttagtacccttcagctggtacatgtattttagaaatgggttaccacttagcatccatggagcttgtctgagttttgttttcaagtttaatgtgctttgtgttcactatgcattcccttgccggctgggtatttccctctctctaagccatacacctctgagtgaatggtttactgcactttctcacaggctgcaagtgagggtggagaatttggaggggagatagagataggagaagacatactggttgtctgttgagcagtcagaggcttgctctccctcccatggctcactgcaaagactttgaagtaataggtgaccccaggggacagcccggtgacttctgcaaaggtgttcctgctgatgggcagcctctgcccgtgctcgccaggcaggttgacggggatcacatccacacggtagccggtcactgcactctcaggcggtgtccacatgatggtgaccttcacgtctgtcacttccacaaactgcaggtccctgggagagggcactgtatctgacagacaagagtcaactggtcattcacattctctgctgaagattacttttaagaagccagtttcttggatatgttaggcagttcattgagcctctcattcgagagttttgctaagttttgtctcttaatcagatcacattttcatggtccagtcatagtgcttaaattatgacatttgaaccttttatctaaaataggtaataagtgagttaccagcatatgaagtgtcatatggtggtggggggagagggttataagaaaagatactaaaaaattttttagaaaaagcctttgaaataactgcagaaaataatgtaacagtttttgttttactgaatcattttataatacttaagaatcaaaaatgaaatgacccttaagcttctaggggaaaatttgtagatggacgttatggtgtcagtttttaatcagaaaggccagtagccagctttgataagttacttatgacatttcagctaaatatcagaagtttagggaaaaactaatatataagatttcttgaatgagaggactgttgacagagacaaaacaaccctccttcaggaacaatcctgataagataacataggaagtgtcttcttaaaaaagttacctgagcgtggggtgccagtggtttcttgttgaatgacaacaggtgtactttcttgattttcttccacagcatagatagtgatgttatactgaacaccaggttgcaagtcactgagggtgacggagtttgcagtttcaggaaggttgagttctgtgctgctaccttctactgatggcgaatagactattctgtaccctgcagattcatgagcaaaagtaagatgcactgttttctttgagacagaggcttagaaacaccataaatcctcccttttctaatatcccttagcatcttgcttgattagtgaagagccagtgatactttttgactctttgaatattgccacttcttctaataatgactattcagcacgaagataaaataagaacagtcatgcgaacctttttaataataaatgtcatccttgaagacctgacatccttaataaatgtcaattagagatgccattaggtgaaaatattcatgttaagctgatttttcctctttgagctccagacgagggaagcaattaatgaaccagcctaagcagagttgtctagcactgtgtgtgtctttttggaacttcagtgatgaggcagttgaatcacctaatgagctaagacgacagctcagctttctccttaaggataaatcttagagcaacgttttcaggaaattacacctcttcaaccctgggaacacttgctttaataagccaatgagctggctttacaggttgtgtgtatgttgtggtgtgtgtgtataagggagttggtgaaatggtttcaaggggaaatgtgccatagaaaataactcccccacccccgccacacacacacacacacacacacacaaacccctctcccataaattatattggagatttaaagtgatatgcaggtccgcagtcagaatctgcgccctccctgctgatgtcattaagattaacatagcagccaaagagggggacgcttagctgacctgtgatgggagcctggggtctgctccagcgaacaacaattgaggtgtcatcaacttggtccacagtcgtgtcaggaggggcatcaggcgctaagaaagaaagaaagtggggcaaacagtcaggaagtgctactacaggcctgtgttttacagaaaaagattcttttaacactatgtagcacacatgtacctgttgtttgtgaagtagacaggatcaaactctgctccccatcctcagatatctgatagacatttacaatgtattttcggccaggaagcaggtcagggatgttcacagaagtggctgtgcttggaagatctttgaaatgaaaagaaaaggtaactaatcagagcaaactagtccctcaaatgactctacagcttataagaaggatattttaagaattatatattcatagggaaaagcgactagaaggtaatgtgctaatagctaatcagtgattattattattatttttacacagagtcttgctgtgttgcccaggctggagtgcagtggcacaatttcagctcactgcatcctctacctttccggttcaagcaattcttctgcctcggcctcccgagtagctgggattacaggtgcacaccaccacacccggctattttttttgcatttttattagagatggaggttcaccatgttggccaggctgatctcgaactcctggcctcaagtgatccaccagcctcagcttcccgaagtgctgagattataggagttagccaccgcacccacctaatctgtgattattaatgtactatgggaaaacaccacttcttgtctttctcctttctcctcctcctccttcttcctttcatttttccaactttttttctaaagacgtataatttttgtaatcgaatgccaaatttttaaaaatagctctctgcagtaagagtcagggtagtgattattggcggaagatgatggggtgagggtagagagatattcttttccttgatctgggtgctggtcttgtggtgtgttcactttataagaattcaaattcactgaactcagtgcttacgatggcacacacttcagtgcgccaatgaagttttttaaaggcccctcaccataacaatttgaaaagtatgagtgaccgtactgtgctcacattgtcagctgcagtcctggtaattacttccaccaagaacacagcttttgctgtaggaacttgtgcacaggtaggcgcatgatgcagctggcatcagggaccaggaacatgtgacagtggcttgggaaaaacccggccacttcttagaaagagtcagtccttcccttcctcatgccagagggtggtttgttcagtctgagctgtcaaccagttccaaaccacagataccacctgcctagaggccacccacccccacaaggagagttttccagcagctgccctgaacctgtcttgagcgacatattgagcttacccaggtactgtggctcatctccctcctcactcagctcatattccacccggaatcccgacacggtgtcggaagctgagacccaggagaccacaaagctactggctgtgatttcggtcacagattcagaagtggccacaagaggagaaaagggagtcgtctctcctgtcacggtgttgcctagagagtcacagaaaggggaaagtcagccttcagtcatctagaaaatttaccgtcctcgtcgccaacatcattttaaaaaacgttggtgcccctcctggaagaatatgaattgagaaggaaagcattgcctcaggagagcctagctctaggaacctcgggggtaggaggcatgagggtggttgtgtacatactggtcacaggtgtgctggtgctggtggtggtgaagtcaaagcgagtcacttcttggtggccgtactgctggatgctgatgagctggccctcgtataccacaccaggcttcaggcctttgatggtgtaggagtttaagtggcctggtatggtagcttccttccaacggcctacagaatttttctgaaaatttaaattaacacacacacacacacacacacgtgtttacaaggatgaacatttgaagatgatgttcagtaatcttcaaagaaaaatgacttaagcaggacttaggcagctccattctagaggaaaatcatggaaaactggattcccaatggttatatcgttagatatagttagatataatgctaactattgttaacatcaacaaactgctgcagtttacttactgatacccatactctgtgctgtttacctacattctcccatttagtctccatatccttctgatgataaggcaatggcattgttgctcccgttttacagacggaaaaacagagtgatatgtgatatgcccggggtgacatagttgcagacactgggcaccttcactttttttttttttttttgagacagagttttgctcttgttgcccaggctagagtgcagtggctcaatctcagctcactgcaaactccacctcccaggtttaagcgcttctcctgcctcagcctcccgagtagctgggattagaggcgtgtgccaccatgcctggctaattttatatttttagtagagatggggtttctccatgttggtcaggctggtctcgaactcccgacctcaggtgatccacccgcctcggactcccaaagtgctgggattacaagcgtgagccaccacgcccacccacaccttcacttttaccaagttaattgtgttatatcagtaacataatatgatgaacctaagctttgcctctctcacttattttttattcctaccacaaacagatatattcctctctgaagtacagaaatgccaatgccatatattttatcttttaactcagtgggatacaattcaagtttcttgtcctgaaaaaacaaaggcagaatgttgctttgtgactcatcatataccaggttcaacgagtctggttttgtgactcattcttggatatgagctaccccatcagaagtggttacccaattttggacaagactacagaaaaaatgcaattttggtttatttaatcttttgcttccagtttatatttcacatcctgttcagcttcattaatatgccatgggtcacaaaactcagtgcaataaaatgtgtatgaaagaaacacccttcagaaaagatgagactctttcaagtgtaaatactctaaactaatataagtcaaaatatattttttgtgcccagtgatttttaaaaattacccagtcaaccatttcctcaataattcaaatactcaagtgtccatttatatttttggaataagcgagagtgatcgtagtactcttcacagtgaaattttaactcaaatacactgtggaaaattttgaaaccagtcattgcaattagctcaaatttagtaatcatttttcaacatgagcttgtttggttagttattacaagaaaataacagaaaataaagtctcaggtggcatccattagaaaaaaccctgaatttttgtaattgttaaaaatctcaaaaaattcatcactgctgctttttgaagactttccaattcaatgtacttttttttttttttttttgagatggagtttcgctcttgttgcccaggctggagtgcagtggcgtgatcctggctcactgcaacctccgccttctggtttcaagcgattctcctgcctcagcttcccgagtagctgggattacaggtatgcgccaccatgcccagctaatttttttgtatttttaatagagacggggtttcaccatgttggccaggatgctctcgatctcttgacctcgtgatccgcccaccttggcctcccaaagtgctgggattacaggcgtgagccactgcgcctggcccaaagtacattttataccacttttaagtctcccattgcaatggtctcacataatactttggatatccttaattttaaagtaaataaaattaatgatgtaataagaagatgagagactagaagatattggatgcactgatgctgttgatttcgatcactggacatcaagttctgcaaatggccagattatggacatagggtgaaagaagaaaaagaatgacttttctttttttttttttcattcaccatttgttaagcagtgtgccaggtgctgaagcattctagactctacggagactacattgagccaatgagaaagacacgattcccctctttaagggaatctgtttccattttctattattctggtcttgcctccatgtagacaacatgcttacacctctatttgtttcatttgtcaacaataagtcatatttacagagtctttaatatgagacttgatgatttatttatatatttatttatgttgacacagggtctttctctgtctcccaggctggagtgcagtagtgccatcttggctcactgcaacttccgcctctcaagctcaagcgatccttccgcctcagcctcccaagtagctgggactacaggtgcatgctaccatgcccggctaatttttagccactgtgcccagacaaagttgaggatttagctcaataataccaccctttccttccagaatcttggacattcccagtgtctgacatttgtatcattatatttgttcttcttgtgtttatatttgtaatttaaagtattatattaagtatcttttttttttttttttttttttacttcatcagcttttggtaccatctctcaattctctattttgaaagataaagctgttatctcctctcttctccaccttccatatccaccatttttcatgtaaatgtttactttttattttgtcttgaagttgcaaccaagtttccatgacacatctatagaccgatcgcatcatgcattagaaatacattcttttcaatgagtctaacatcatgactgctgggtggatcaaagtttccagaatcaaggttcaatggaattattcctctttgtttttataccttaatattgctgcattttagtttgcttcgtataggaattattgccttataatacacttgggggttttttgaaacagaatctcgctctgttgcccaggctagggtgcaatggcgcgatcttggctcaactccctgcaacctttgcctcctgggttcaagtgattctcctacctcagctcctgaggagctgggactacaggcgtgcgcccccaagcctggctaatttttgtatttttagtagagacggggtttcgccatgttggccaagctggtctcgaactcctgacctcaggtaatctgcccggcttggcctcccaaagtgctgggattacaggtgtgagccactctacccagccacatttgggtttattatacattcctccacctgattgtcatgttgttattttaactgcattatttgcccctgtgattaattatccacaagcctactttttccatgaagtccctttttattcttggagacctcaatccctgatccctcaatcccatcctcatctttctgttccatctgtattggctgtcctctaagccagctacgcagttgttgcattgcaaagttttccacctctatcaggggtctgatttggaagcactgtttgctggaccccacaacttccttcatatttcactcttgtttttctggagtgtatctacaaatacccttaaagaaaaggatatatggaagataaactgcctaaaatctgtctgaaaatattattttgccctcatatttgattgataacctggctgagtatagaagactttaaaagtttctttttatccttggaactctgacacatcaaagatgcgtctagacgtggttctttccactaattttctgggcacctaggaggcccttttaaatctgaaaaattctgtccctccactttagaaatttagaaaaagaataattttaacagcttaaatttttcctgaagagtttaaatttaaccgcctgggttggtcaaattttgtttgtttgtttctttgtaattgtagaattcaatagctatgatttaaaatggacatttttttctcctgtgtttaaaacagtgtttctcaaattatgagccatgaactttggagttaaacagggcaggcttgagagagtaagagaaactaaagctaaattgaccaatatcctccttatttggtttcttcaatttctagtcacttctcattaggaaatcacagggctattgtttaaataaaaccaacttccatcctttatctaaacttccctcccatcatctcttttccttctatctaaataaattcagtgggtcaaaagtaaagttttaaaaatgatcacttaaaaagtgaatcaaaaaagaaatatattaatttggctttttttttcaaattatgaaaatgatgccagtaattttcctttgatgaggttgcaagacatataaaaaccttagattctcttcccacattgggcaagaacaatcttaagcattatcatttctaagtccttgcaaaaaagatttctgtaacataaagagctaaattcttccaaataccagcccccccaccgcaaaaaaacaaaacccaaaaccaaaaccaaaatcccctcagtctacaagtcaatttaattgaccacatattgtttgttcactaaacaaatatagtaaatgctataggaatagttaatcagagttgttggctcaaaagctgggaaaaaaagaaaccatcagaattgataagattaggagactcagtatccaaggtttctgggtgggatactcacaggtctccacctgagaatgtacttggaaatgtgagatggctgtggtgcattccactggatggggtgggagttgggctgactcggagtctcagtgataaatacttcgacaggaccacttgagcctgaaaatgaaaatgtagcatttaattatcttgaatattcactcacttcaacttaaaactgtgtacatggacagtcatcattataaacagctttgcttgtcgttaaatgtgagtataataaaattatctggcattaatcttttaaatatttacgttgaaaatcaatgcagcaaatccatttttagccgataattattattcttcacatgagaaatgcaaatcatagttgtttatagcaaataaaatatatttttaaaaaaaagtctcttggcttgcttttattttctctactatcaaagtaagaattgtgagaaaattgtgaaacgatcctacaaaaataatgtaatacagaacacagacttcatttacttattgtattgagcctcttttaaagcaaattctaattttggaaggttttcatcaagaatgaatctactacctaagaaggaaacaacattccaaaggccatatgagatgatgtaaaacaaacacatttctaaatgggggtagaatcttagacaaatagcaaaggtaataattaaagacctagttttatttctcatcagtctaagcagtctatcagtttggaaaaaacatcaagttttatttttattcaagaagtttactcccaaatcacaccattgatccatcaaattattaagtgattaaatttattttttttccaaaatcagttgtcaacagaaatgactttatgaagtgtatactaaattcagtatttctacaccttgatgtatatcactgttatcaacaaaatttaaagtatggttttggttcttttgtttaaaataaaaggaaaataagggaagtagcatcaatttctaagtagtgttaactccatttaagataataatgaaatagctagaaaatttatgcttgcagaacagaaaactatcttttcttaaaacactatctttatgatgtcagtcaatgtttaaattactagaaataaaaattgtgtcttatagtaaccttttcaagaatttctaactgacactctgtcaaacagagcaaaattttgtatgtgtaataaagcacttcaccagattattaacagatttaagttttctgaaagcttctaggaaaaaaaatacattgattttcaaactttattatctaagccattaaattctcttggaaaacaaagctttctgtagcagaaaaaatatataacttggatatccatgtagattcagaaattctaaaacaatatgctcacttccacaccagtaacaattcaaagttggttgaagattagcaaatactttgaatcttaattccatttaatgcacatatttccaagccacatgaacaccaaaattcatgcataaaattatgagtttttcattttaaagttgtatgtatttcacagaacacacaggatgtttgttttaatcaattggcataagtcaattccatgcctatctttgaattaccccttctgtttatgaagatccttacaaatgtaaacacatttttaaagacaactattcaagaaaaattttggagatgtgactatttaacgtacttccatgtaaatcaggaaagctaggaatatcatgtccttaattatttatgataattggcatagggctatttaaatattgatcctttaaataaatcctactacaatttcctccataaagagacacctgatatacactttatttagtcttgtcaatcatgattttgaggggggacaagcttatgatggataaatgtctattaagttttgaaaagataacataaatgacctttactgttcacctctaagcctaatcatatttctatgtccacaaggacacaaggaggaggataaaaatgggcagggaaaggaaagaaaaagggtacagcagtggtttttactcaagccaaagtggagtacaactacagaggtcccttttgctttcataagatttcgagcactggtgtgaaattccacgttttaaaatctagccctgtggcatagcccacctttaaaggaaatggactgaacagcatggaatttagcatgtttttgttcaggaagtaaagagactttgtgtcagttatttcttagatcaattaaattcctatattctagcttatactacgtataattactctagcttatactatgtatcctttaaagacagaaaagttaaaaattatgacatcttttacattatttagatttaaacttttgacagtcctttttcgctactggtagttggtataactttttaaattaacttaattggcatatactagctatcgccattgtgaaatctttactccctctcttattcaatatgaataaactaacaataaaatagttgagatgataccaaaaaaaggagatagtacaatgtctacacttttaaaattagtttcaaataaagtctaaatgaataatttccaatagtagtgtccttggagaagttaaacatttatgattttttgactcagtcctttttttctctatttattttgctgagatctgtgcttttctagttgcttattgacaaaccaaatgcctcttatcttttgctagtttgaacaactctaccaagttctctgtaggaggaacaaacaaggcaggactcagagacaatctgttggtaatctgctgttcccttattctcaccacactcttaaagccctacgtgctaggccacggagcaaaccagacatacagataagcaccaaagagcatatctgaggtcaaattccaatctcttccctccgaaatcacctctatgctcagtgggatcttgctgttctcctttttaaagagtaggagtaaggtcaacatgtaatactccaatactcaaggattccttcctttccagattttatctccaacatgtccacctaaatgcttccagcaagcagctatgtggacagccttatgttgagagagacgaagatctctctcaatcattcagaaggaaatcattttcagcaaattgcaacaccaataacaatcataaatatagaaaccacagagcatttttttagaagtttctaccatttaagtatcatttgcatcatataaacaaacaaaccattcatatacttatagtacttccacaatcagatttaaatatatattaagttacaaaaaattaagtgattcctacacctaaatcctccaagaaatacaatttaggaggttggtcaatctgtgctataagccttcaaaagtgaagtcaccttccccagcactgacagtgtctgagggttgggaaaagcagaatcttccaagttcctagaaaaggtgcatctgggtgtttagtatttaggatggaacattaaaggtaatcagctacaatcttcccatattacagatgaggaaatggaggaatgaggcttggctaacactacctttggccaagttgttcccatagcttgttctctgtcacagtgaatcttttatcacagagttaatcttaatttctgtcgcatgcagattctgacaccctgaaactcttttgtttctgaatgtaggccatattttcagtcaaacgttagtgaagactttggagactttgcacctcagcagttgctcaaataactgatgccttttaattagcctttcatgttttattaacatgttttattataatcactcagtgaatatttaaatgcaattttccccccaaatgaactaattacacctacagctaggcatgatgtctttgtgacctggaaaaacccagcaataaacatttgagagtgtttgaactgtgtgggcagagagttgaccaagttactcaacccttggcccaacatactgtgttcctggtggcaactgatcaaacaaatgaaaagtttgatgcaaagggagcttagatgacatgttgaatgaacacgtaccttatgctgcatttcatgccatctctctatgcagcttctctgttaagaatcataatataaagccccaaacctttactcccagcataactcacttggtggtttttatttccatgtatggatataagatgaaattagccagagtgtcttaacctaacagaatattttacagagttaagaagtaaaattataaacaggcacattttcatagccttctctaccttttacttgatagaggaagagagaaaaattattttaatcaaaaattcaattgattattagataataacaagagaaaagggtgggaaagaggggagacccccaacttaggcatgagagcattaataatcactgccctgttgttataacccaattggcagttctcaacttgcagtaatagagctacttacttggataggtctgtaaaggttggcaatgccactccccaatgccacggccatagcagtagcactggtatctgacaccatgcacatacttctcccatgaatctccaatttgataaaacgtcccagtctctgaatcctggcattggtctaaaatacatggaaggaaaagataaacagccttgaagacttataactacgaatttaatttcagggtgctagagcatacatttagcttaaatagaaatttgcaattgttcttacaaatatatgcagttaaaaaaatattttgttcacattctttaccttacaggacagtttgtagtaaaaaaaaaaccaaagtacctattaggaggaatatttagttttctaaaaggtaatatttctaaataaaaatgtaaagatttagatttcagtgtatattgataatctacacattaattttaaatattagttattatttttacccatattaatataactggcttaacatttaaatagcaagaaaaaaatctgcaataatttcattttccttacttcttcaaaatttaaagaaactgtttgacatttaaatgaatgaactagactttacgagtatacctgctgagcagcttctaagaaaacctctcaggcttctctctcagttctggtaatctcacgtcaaacaaacggatgttatcagtttgttttctcagtgagcaacctgtctcttttggtaaagaaatagtaatggatcaccttaaactttgtagtgctggtaacacagctcttttaaggctcagccttcactatttgcttagttctattttgaagggcggccaaaaaaaaacctagagtgttttggtgggtgatatttacaccctttgctcatgctgttacacagctggtaaggaagtgagtttgagaccagcctgacccacatggagaaaccccatctctactaaagatacaaaattagctgggcctggtggcgcatgcctgtaatcccagctactcaggaggctgaggcagcagaattgcttgaacccaggaagcagaggttgcagtgagccgagattgtgccatacactccagcctgggcaacaagagcgaaactctctctcaaaaaaacaaaaacaaaaacaaaaacaaacaaaaaaaaaaggaaagaatacttttaatagcatggattatctttatgattctaaacccaagaataaattccattcaattaaaataagcctaaatttgtcaccaaattcagcaaaaaccagacgactaccaatatcgagatattttggtccagtattagagagaagactttgcaaagttctttgcaagcaactgatcaaagtctggagccaacttcagtcatgtgatttcacatagcttttcttatctgaaacttgctaaccattccccctgtgcaaactcatctagggaaatagggctactcaccgacgggatcacacttccacctgccccgaccctgaccgaagcatgtacagttcagcatgtgcccctcttcatgacgcttgtggaatgtgtcgttcacattgtaagtgatgtcatcaacaatgcactgatctgtttaggaaacaggtgggtgagtgagaaactttttaaagttccattgatgaaagaaaaaaggtatgcttctcaaagcatacaactacttccacttaattatcaacaccttccactaaaataacttttctacaagcatagaataacatttttttcaaagtttggtcagtaatacaatttttgccaaaaaaatttttttcttcccaaaatgtgtaacttttgcagaggttacagtatgctcaagtaaagaatgtggtaaaatacactttcctgtgagaagccagtatttgaacaaatacatgtcttactttctgaaaatttcttgcttagttgataatttcctttaaatatctgcttgttaggataaataagaagaagattaaacatatttatctaacacccagcatgatgtggtggtctggtctctggaatagggggaaggggaggagatacttagatttgggaaataaaatgtcaacagtattcacaacgctaaaataaattaggccaactctgttgctcactctttgagagatcctgagaaaattactttttcctttttgggtctcagctccttgatctatatagagtgaggtctctatgtgttattaaggtctctttcagttctgcaacaccacatgtaattattactcccggatggtgttacccactggacaccacaaaaggagaacaaattcagaccaatatctacgcactagccacatagattattaatagctcagggttctcccgaaatattacttttcatatcaaagaaatggaaaactaaaacacttttaaaaagtcaatacttcctcatattatatagctgggtgcaaaggagaaaaactaatctgaacaaggaaagttagtcccctatgtatttgtttcctgaaatctggatctgtaaggatctgattttagaatagcaaggtcttcatttctttacagaaattatcctatcttttctagacatgaatccagtggcatagcctaaagctgaatggatcaaatgtttcattcttacttttgaagccatctttttggctcagcctaagtacttacatgctaggagtgtttcagaacattagcattgctatgccgcttgtcttagcaggctgcctgctaagcctttcaggcttatcttaccatgcacagtagactaatgaatgacgtggcattccatatttcttcccctgcttttggcatagtgcaagttttcataaaaaaaagtgtccctttctgtaccttttgccatctcaaatatttttgttaatcagccagcatacctcgaagctgcgagtaggcaatgcatgtccattccccacgaccattcccaacacacgtgcacctcatcatgtgacccatgtcatgctgcttatcccactgatctccaatgcggtacatgaccccttcattggttgtgcagatttcctcgtgggctgtttggaaatggataagaaatgcacttgataaatgatcaccaggtctaaacatgtatgtgtgcaaaaggatcagttcagtttggtcatcctaagaattctcacttgggaagaagctttgtgtgcatcaaagacatctaagtgctgtcaggtgaaggggtagaatttttgagccctggaggcagaaaacgtagtccaaacgtgtcatagaaaatagttacaggaagggttaggggatgttaaactaagataatatctacacatccacacaaagggttcttgctgttctagaagcctggatttaactacagcttcataacttttcccagttccagtttattctggatcaaataaaaactatgggtttggatatagaattacaagcaaaagtgggttttttcttctaaactcagcatcttcttttgttgaaagaaataaaagtataagcaatttctttgtctcatagtcacacttgacagtgcctaccgcccaggctcttgtttctacaactggaaaattaaagggaatctatggggttcttgaaatctgaaaacaagtaaaaggtattcgtttccatttgttcgccatctatacaaactggggacctttaaaaaaagagtgagattccctacctgttagaaaacattgagttttagtcactttggcacttattaataagtgatagagcttatgcccatcaaaccacaaccatgtgtcaatattgtagctctgtgactaaagccgtcatacatatattaaatgttgtaagctactcagttgtgtgctctttacaaagacaaacctgtgcaaattcatatttccagacttacaaataagtaattatatttttgacattaaatcatgtcaatgaggtttaaaaattatataaataattatctaattattcttcccaatccttatgtatatgatgtaacatcacacacacacacacacacacacacacacacaaacacacttcacatgaagttttctgttgtctcaaaattgtgttaatgaatgaaatgggagtaaactggacactagtctttagtctctactccctaaattgttgtcaaacaagacaacccacaagggcttcatcttaccagccatggggcagaacccaaacttctggtcggcatcatagttctgtgtggtcccacaccacttcatgttgtctcttctgccctcagaagtgcaatcagtgtaattgtggttgttgtataggaaggggaagtggcacaaggcaccattggaatttcctcctcgagtctgaaccaaaactgccaggaacaatacacaacaaagaaggaaaagattaccgctgagctttccaatgtacacagaattactggtctgagagagccaggtttctgcagctcattcacagacagtctatctcagaataaaaaatgtctgataatatagttctaagcttcttagcatatttaccttcacaccttcaaaacaggtttaaatcccactttcactgtcatttccccagcaccccccccacaaaagattaaatgatagctttgaataaaacattgttttaactggaaaataagctaaggcactaaaacattcatcctttgtattcctcagccctgtgggatcatctactgattccaaaatacaagtatctttaatcacatcataatcccaatgtgttaaatcaaatgaactggaaggctactcccttggtgtcatttcccaacagtactggggaagatggaagaatcctcagctgttacgtgagcgctgcgatctcttgagtccaaactgaacaaaagcgatgcttcttgggcgggttcaaaataaatggctagaatgctggcaaataaaactagggcatgaaagtgagtttttctcacttctgtggctcccccttgggacactcaccagtgtggtctgtgcagaaagagtatttctggtcctgctcataattcgaagttgtgctgcaccaaagatgtccgtcctgtcgcccttctgtggtgcaggagtagaacgtcctgccattgtaggtgaatggtaagacacatggctctccatttgagttgccaccgtaagtctgggttacagctacaatcataatcaaaagagtgtcagtaaacagagatgctttatctcccaccagcagctgcttatttatggcttcaatgagatactgagcttgtgccctcaaaggaagaagctatgagtatagatgatcatctcgttaatttcagtcaaaatgcattactcaggaatccatgtctactgtggatagaacgacacctgagttcttctgctgatgtccttcatgaccacttctgctgccatgcctcagtttctctatttgtaaagctatatttatacaggtcaattaaggatgctgcttaaggatgttgggataatatttatgactatatctatgccataaaattaatatatgagactattctgggggagaattgtgtagcaattgttattgccatagtgactaccatgtttgtagtgcagaatacatatattaggttattggaagatgtttacatcacaaagctgctgaaatttgagatttagaatataaaacattgatgattattcagaaagtagctctcttgtaacaacactttagacagataaatacaataaaatttttacccatgatatccatgaccagaaagaaaatacataaattaaaaagattggaagaaactatttcaaatgccaaccctaattgttatcacagggtggtaagattacaggcttcttgtttgttttattgtttcacattgaaaatgtattgtccttcaaaaactaaataataaagtcatcagtcctattcttcaaaaagataatgcatacctgtctcttggcagctgactccgttgcccaggcacgtgcaaagcatttgcttatttccttgtgtcttcagccactgcatccccacagagtagaccacaccactgtctgtgacacagtggccatagggaggaggctgggggtgaggctgcggttggtaaacagctgcacgaacatcggtgaaggggccagatcctaatggcatgaaaagggaatgtcacaaaactgggtgagagaagacaattcactactttctgcagtcaggatcttcaggatctcacagagatcactctgaaatctatgtcgctactggcctgggactggaaaaaaatgtcccttattcagcagtagcttttgcatttagcctaggaaataatccacaagtgtctaccaagtggtctccatcctccagctcagctggggctactgggattatatttctttttgtttgtttgttttttggttttttgggttgtttttgagatggggtctcactctgttgcccaggctggagtgcagtggcgcggtctcggctcactgcaacctctgcctcctgggttcaagctattctcctgcctcaacctcccaagtagctgcaattacaggcacgcaccaccatgcccagctgattttttttgtattttttagtagagacggggttttgccatgttggcaaactcctgacctcaaactcctgtctcaaactcctgacctcaggggatccacccgcttcggcctcccaaagtgctgggattacaggcatgagccacctcgcctggccgggattatatttctcaatcacagacatcatcctgccactccatacagcagataccttcaacacatcctcactcttctgagtaaccgagctcatcagagggtgccttcagcagctgtcctggattttctggaggtcacctccaccttccacattttatttctcctctggattatttgtgattctattgtgttttttctaaaaccaattgatcctcttaagacagctttcctttcagaataacacaacaggatgtgttgatcttttcttttttctttttttttttttttttttttttgagacggagtctcactctgtcacccaggctggagtgcagtggcgcaatctcggctcactgcaagctctgcctcccgggttcacgccattctcctgcctcagcctcccgagtagctgggactacaggcacccgccaccacgcccggctaattttttgtatttttagtagagacggggtttcaccgtgttagccaggatggtctcgatctcctgaccttgtgatccacccgccttggcctcccaaagtgctgggattacaggcgtgagccaccgcgcccggccgatcttttctttcaacttttagatatctgttctcttgaaggccagggcccaccgcagaacagaatcagggctgaggctagaccaaaggtacactgaattcagtgcctccctaagtgctgctgaacactagaacccaaagatgttcacagacaaagaatcccaaggtcaaacgtactagggagacatggcgcccatcccctacactctaccatggagagtatgatgtaaaggaacacacagattctgcagagcaggttccattttgtttaacccattgcttctcaaacttttttgaacaatggaatcttttcagtattggcaatattcatatatagctaacatttattgagtgtttatccccatttaattcccacctacacttttaatctattttggtagactgacatttataattttttttattttttattttattttatttttttgagatggggtctcgctgtatcacccaggctggagtgcagtggtgcgatctcgggtcactgcaaactccacctcccgggttcatgccattctcctgcctcagcctcccgagtagctgggactacaggcgcccgccacaacgcctggttaattttttgtatttttagtagagatggggtttcaccgtgttagccaggatggtcttgatctcctgacctcgtgatccgcctgcctcggcctcccaaagtgctgggattacaggcgtgagccaccgcgcgtggccgatgtttataattttttttggccagtagcaattttattaatgataataaaataactcaaagatattatcaaatctaatcttgttcaccttcataagtgctcaaagcaagacaaaaactcatcaaaagaagaaaaattagaacaattaatatttttaattgaaggatggctgagacactacgtaatgatgttggcacatcatatagtaaaaagttaatcaaaacatattaaaaataatgagaggagtgcacgtccttgttggccatatttctctcttcagatttttatgaaacatttatgacgtaaaaatctttttctcatgccaaaaatgattaaaacttgttttttaaaaagaatgcttagatatcatgtctttcatggccatctctaagtcctctctgaatttctaaaatttcgaatgccaatacatgaaggaaataattgtgtgttactttatagaatgtaacaaagtttgccagagcatagaaaccacatataaaggatggtttccactacaaaaagagttcaatgtcgggacagggaagtatatttcattcaaaaacaaacaaacaaaaaatccaaatgcactttttttgtcctttcctagcagaagaaccaggtagtcatataattaattataactctcatttcctttcaaatgaactttggatattcaaaatacgtgtgtgtgtgcgtgtgtgcgtgatctatccatggtaagttttatgatgctagcattctttaaaactcagttttatcttttggagataaatctggcttttttccccctaaggtttatttgtatgtcatttttctttttttctgaaaaatttaaaacttgacattaaaaaaagttttaacaaccaataatgtgtaaattatcttaggttattagctgaaacactgcaaattatcctcaaatggcatgtcaaaggaaagatggatttgcggaaatatttcttgacctgcttccccatttcccgcccctgctcgtcctgtgcctcaccgctcgatgtggtctgcacagaggtgtgcctctcacacttccactctcctcggccgttgcctgtgcagatgcactggagcaggtttcctcgattatccttcttgctccaggtgtctccaattctataggatgtccttgtgtcctgatcgttgcatctatctgtgtcacaaaggaagcacatacatacatcaggtcgagagtcgcaagtggtcaattcaaacttaaaaaaggaatgctatctatgcctggtaatctatttttggtaatatgttcatattcagctctggtgctgcaaggtattacacttctgaaagatgaaattacatttgttacagtggaaaggcagctgaatggtttagtctagtttcatctctctgtcaaataacattttcatttatctatttatttattgttttcacactgttcctttgactaacttcattctctggcattatatttcatctttttccttctcaggctcttccaggatttttcttagtcatcactgtttatggcctgcctttcaatagggaccttgctttagaaaactaaaaacaggctaagcgcggtggctcacgcctgtaatcctagtactttaggagggtggatcacctgcagtcaggagttcaagaccagcctgggcaacatggtgaaacccccgtctctactaaaaataccaaaaaaaattagccggctgtggtggcgggcgcctgtaatccaagctactcgggaagctgaggcaagagaatcgcttgaacccgggaggtggaggttgcaatgagctgagatcacaccattgcactccagcctgggcgacagggtgagactgtctcaaaaacaaaacaaaacaaaacaaaacaaaaaaaacaagcaaacaaaaaaaagcttataacaatggggaggcaagcaggtatcaaagggtcttcaccaatggctacaaagaagctataagaaggtggtagtatctctttcttcatttgttatgtaaaaaatgtagaggatgcacaatttctttgactaaaatattattttcccttcccctatacccaaacatctacagtatttaaaaatcactagcaaaatagccccaaattattcagtgttagccctccactggaagagtgggatcaacataaaatgataatttgtaactaaatgaccattagtctatgcgtgcatttatctggtaaatagattatttaaattataatccaaatttgctctgtgccacgatgtgagtatagaggatctgatgtctttgtgaattggatattgttgcaactcctgggttagagaaaaaaaattaatagttgatgtaggttcaaacaaatacacacccacatccatctaccacaagaatagaagtttgcatgaaggtataattactgattagagctttttcccaaatccccagcgaaaagtattatcatcccctgaacctccatagcactactttcagtatttctgttgaaatctttaatactgtgttttgcagatgataaatatgtataagactttctcatctccctgaccccctaagtactctttgaaggctgggctaatgttcatttcatatctgcacccctataataccttgaacaaagtaagtccttataaaattttctggaataaatgacttctctttgagaaacttttcccaacttgctatttaaagagttctaaataacagataaggtttgaatcagacatctaatttgtcttaagctaaaatattgccacaaagatcttggaagtctgatgatcacagtaacattttaaatgcaaaatatctaataaaccagcaagtttctgggaaagctttggtcaaaatggttaccacttttcatgagagacctatttttgttagcaaagaatttgaatttggatgatggctatgttaaaggtagttaaatgggttcagctagataaataaaacaggttcaaattatttggatttgattttaaacttatttacaacaccagtagttaatggctgttttacttcaacaaactctctagctgttattagtttacaatatcaaaaaaggagccttcaaacccaaaggcaacaattaagaccccaagacaatcttagaaggagcagtaaagacaccagaggccagcttctttacagcactaatcaaatgcgttaggtcagagacactatccctaactccagagtagataaatcattttaatttatgggataaattctttttaattttatcaatttagcctgtgaatgtgccctatttaaatttcaaacatagaaggaaacctaaaccttttgttcaactctatgtcagtggcagtgagctgagattgaaccttatcaaagtgatatgtttttctatttatgtagtcttctctgaagatgcggaataagttggttatgaaagttttcttgacttccagaagttaccaaagcatgctgatatactggatgtgttctgagtaacatagtattacccttctctctaggaatccagaaaacaatacctggcttaatctttaacataaagatgtaaaacatacttctagaagtgcaagtgatgcgtccgctgccttctcccaggcaagtacaatctaccatcatccagccttggtagggcttctcccacgtttctccgaccacataggaagtcccagcagcatgatcaaaacacttctcagctgtagggaaatttggaagaaaaacaggaaaaaaaggttattttgaattgtgcaagctccctgtaatttaaagtgtagtgtgtaagcaaaaattcagccacattttttttaagtggcactctgttcagaaagaatgacacacccagcatctaagcacacagtaagtagccaaggcaaaagaaagctcaagctgagttggcaggcagaaattccattctcctaataagtacatggactacatattttcagcgagccccaaacttcccagcagcatttccagtagcaaggatctatgtatgtatctagtctgtgggagactacatatgcaaaattccaatcttaattataaatgaccaattatgaattttgagtggcctaaatacaatgacaaagaaagctatttttaaatattggaaagcaaaacaatacaaaacaagacaaaaacctctaaattagaagacaagtaaacagagtaaaatttatagccagaaactttcaggcttgtacttacaaaattcaactgaggattgagatccaaagaagctcaacaacttttaatttgaaaagaaatgagcagagtgtgacaagcacacactatttcatgtttcggtccaggacattccatatagaaatgtgtccaaagtgtcatttttttttcttttaaataaattatatcttgacgaaggaggaatctgagatcagctattaggtaaaagaaatgactccattctaaatctttcaattctaccttatgcttttgaagcaaagttaagacttctatgtgtagtcagtactttttgatctaactcctgtaagaagactatggattatataataattcattatttcaaacaaaattcccatttctttattggttttcactggaattcaggtctatgacctatgtagatgtgattctggtccaaccccacattagaactaagcatcccagctcttgctcagccctaagactcacacacctatgggcttgcaggtccattctccttttccattaccaagacacacacactctaacatgtaaccaccagtctcatgtggtctcctccaggtgtcaccaatcttgtaggactgacccccttcatggcagcggtctgttgaagatacaacgaaaatgttaggagagggcagaacagatttttttttttggtctcatattccacccatggtaggtacttaggttggctaaagtagagacacagacaacagctttcccatcagagacaggggaaacgttaacaggtctggtcacttggagtcaattcagttaagtgtcttgcttagaacacaatggaaaaccacagagaaatctggatggcaaggaagaggtcatgaatcctgctttcccagagagatcacaggaaattgggtcctaagcagaaaagaaaggctgggaggcttggtcttcactcatacacagcaggctaagactgagactaattcagtgaaaaggccacatcaggcacagcactccagcttttgggagcatggagagcctgtattttaccctaggatagaaatgtcattttggtggaaagcaaacagacatatgcatataaagtgtggaaatcctggtagttttctaagttgttaagcccaatggcacattcaaatgctgaactagattgtaaacactatggacccttgcctcttgcgatttgcctgtgaacttggataaaccctaacatgaaatatggggaaagttgattgggcctattcacacgggacttgttcttttgaatagaagtctttaagacgacttatatttaaagaatggattaaaaaacttaaatactatcttaatagaatctattggtaacccagtgaatcatactggaaagagtgccttagctaaactagagttgagaatcagcccggttcccaaagttccttagcaaactctattgggttaataattttgtattatccctaggaatagtgacatctgcttcctgggtataacctactggtcaccaagaaaccagactgtttctgtgaggtgcaagaggtctctgcattgcaaacatgaagaccagacaacacatggctggttcactcttcatgaacaccttcccagtcactgcagaaaagtctcatgatttgtctagcttgaagatatccaggtgatttaaaatgggcaactcccctaagcatgtcttactgaaatggaacccaagaggtctcttggttctactatgtacagaaacacacacactcataaatgcacacacactcataaacgcacacacatcaaacactgattccatctgtgctcatacccgtctttaagaaacacaggaaccagttgggtgaccacttaagagtacctggtcaccaggggcaaacctcaaagttcggaatatccagtcatggataacagaaaatgacagtgatggtaacagagaaattcatatttgatattttggcatcattttacacaatctcttccttacttgcgatggtacagcttattctccctcgcccagccccgatgcaggtacagtcccagatcatggagtctttaggacgctcataagtgtcacccactcggtaagtgttcccagtgtacttgtcaaagcaagtctcttcagctgaggggaaaaggaaagtccatgtgagcctcacttaggtacaagcttttctagttcactaatcccctctaaaggaaaacccacttctctattccacaagtaacatggtacacctcaaagaataaaatgaagtgagagatacagatttttatcctaagctctaataaggccatggtttttgaccttgacatattgtcaaattttctgtaaattattcatattgtagaaaaatctcaggctcttaggaaaaggccatataaagtactaacttatgacagagctagatttgtgaagggtttcacattccaatctctgactcagaaagtcaaagcaaggttcacataaaaagcaaacgattggccgggcacagtggctcacgcctgtaatcccagcactttgggaggctgaggcgggtggatcacctgaggtcaggaattcgagaccaccctgaccaatacggtgaaaccccgtctctactaaaaatatgaaaattagctgggtgtggtggcatgtgcctgtagtcccagctactcaggaggctgaggcaggagaattgcttgaaccctggaggcagaggttgcagtgagctgagatagtgctactgcactccagcctggtgacagagcaagactctgtctcaaaaacaaaacaaaacaaaaacaaacaaacaattcgaagatccccacctcccacaaggccttgacagttgttaatcctatgatttccattttcccctgatcagtgcttctctgacagagttgctataatttatgagaaaaatatcattggtcctaaaggaatgagaactttgaagtggctaatggttttgtgttaactgccgctgacaaatcattttacgatgtaagtccccaaagtgttttctggctcataaactaacagtttaagatttgagactgctttctaataaattaaaattttataagcaattttttttgtcggaggacacacaaaatctttcatttttctcatcaaaaactttgggagagtaaagcaaaaagaagactctaggaactaatttgggaaagattcgtttctttgttttaaaggtaaaagcatgtgaaaagcaaatataagcagtttttaaacttaagaggaaatgacaggtaattctattagaaaaatggtgtatgtatttttacttactaatgcaaagtttaacaattaccacttcatgtattaaaagatactaactatggggcttgttgtcacttaccttcaggtttactctcgcagttaaaacctcggcttcctccataacaagtacaaaccaacgcattgcctaggtaggtccgctcccactgttgatttatctgatagtgttttccattgtcataacaaccggctgcaaataattgaaggaaaacgttacatttgcatttctccttttcccaaaattatggaattttcttcatgtgaatattgacgtacatatttttttccttttaactttgctaaaagttatatacaatgatgtcatttccatctggccaggggtctacataaaaaagttggaaacattttggaaggcagacaattgaagtcacatttttaaaacatgcaaggaacttaaatattcttttggagtaatagtcaaaaaggacaactttaagcagctttctcaaagcaaaaggagggtgtgtctttgaaaaacggaaagaattccaacctctgttcttggtgaagtatcctgagcggccctaaagaggtctgaaccaattacatctcttccaagttagttagaaacaagacagctatttcaataccccctttccacccccatgttgaaaatatttgaccaattatttaacagaaggaaataagtagcagtaaggaccacactaatcccagacggaaaatttatagacatgcatcatttttctctttaaaggcaagttttggttaattcctagaaggacaatctgaacgtgcagaatttattagaacacgggaaagtcgcagagtcctcgtcctccaatgcacggtcttatcatcccaggccctcagaaccagcgtgctcaaaactcggtccttttgtgtgcacagctggtttctctcagtaaagcgcgcacacactcgcacacacgcgcgcgcacaaaacttcagccccaactttggtcggctttagggtcccatccctgaggcagcctgtttcagcccgcggtcagtactcacgcttgctttgactgacagccaccggggactggggctgaaccatttgctgagcctgcctcttgctcttcgaggctcccgtggagggcaccgctgtccccaggcactggacggccagcagcagcagcccgggccccggacccctaagcatgttgagacggtgggggagagacgcccgcaccgggaggcaagttgccaccaagtttgcttcccttcgcaacctgcgggaaaaatcccttctaatgcctcccgggggttgtcgcctccaagaaggtgggggccagagggtggggaaggggacgggtggagggacagaagggatgcagaggaccagagaagttgtggctgcaggtcccctcttcccgctcgcgcctggggttccctctcctccccctgtgcagcacagccggcgcgggcgtccgagcgccgggagccggggcttatatgggacggtcccctcccgcccctctggaggcccggggcgcgggggaggagagacccgccgggctgtccccgccccgccccaccccacccgcccgcccgcccgccggccgccgcagccgaccgcgcgccgattggcccgggctccgggtgacgtcacgggggactgtgggttcgcagcgaacaaaagagatgctgatggcccgccaggactggggcaagacaactttttttcggtttcctttgcggtcatcaaactttttaggggatgggggaagggatgggaagcggctgggaggaaagggagtggctggacttgtgtgaagcgaaggggttgcaagacgctcccccttcccttttcttttttattgggggtggtggtagtgtttgaggacattgcgtcacctctcttcggggtggagggggggaatctctgcttataggagtgtattttgtgaggaagaaaacccataaaatatccacgaccttgcagctgttaagaatccagacttttcagtcccagggcggggctgcctttccccccatcccgctccctttctttggactaaagggtactgactcgggactcccttattttgtcttcacagctccctgttcggacttcttcccttctcagcgctgtgcctgtctggctctgagaaagggccagcgggcgaacggggagcaaaggggaacagagacctttaatgagcttctactaagtaccgggagttccgcggggcgctttgcagatcccggggaagttcagagaatgaagttttcttttgcaaggacaaagtaacagtttacttttttacacatgcaggaaagccttcctttcctggggatgggacgcccgtttccactgaaagtgaaatcactgtgaacaacctgaaaattggaaagttggaccagctgtggggagagaaaggtcttcgtgtcctttcccacgttcaccgtgccagttacacacaaagcagagatttttttgcttgaatcattaaaagccgggtgggtggggggcaccctatgtactgtcttgccctccttcggcccctttctcacatttatttgccattttctttttgctgacaagttccattacagaatgccccctccatcccccgccgccagattttttatatttcaattgttatttactccaagagtgtggaaagttctcctttaagattcccccgccttgaactctaaactcagagtggaaagggaatctgaaaagtctctcatttagcaacacatcacatcagtcctttttgtcagataaacacaggcacaattgcttttaaagatcttcagaaggaggagtccaccacttccacagtagatccagagagacccgaactgaatgctttgccttctccttgtgttaggagttcagaggttccatttgctttaaaacacaagaagctactaataaaatatatttatttcggcaaggtacctattttctccaaaagtttcaccttcagtaattgccacaggagtaattagaactctgtgttctataaaatgcctgacacattaaagacacaaaattagcatttgtttttattcatgcaaggatttaaaaccaaaccaaaacaaagcaaaacacccagcaaatatcagtttcctacaaatagtgtaaaaaaacctcttgaggaatctttgtgacccacactccaaattgaaagagtgccatggatttccccaaatttagaatcctgtctgggttagaggatttttttggaatttctcatcacttgacaaaacagttttctcttttcaaatataaaagagctccttgtaaaatgcttggtaaatttctgggaagccgagtgtttcttccagagggaaggatacctggaaatccggatgtaagcaagataaacctgtagctaaagctttcttaaaattcattgattctgggggaaggaaataagtgattagaaaagtatttggtcaaccaaaaccatgatagtttgatatatttactgcactgaaaatacactagaatcatatgcatagtggagcttgaagtggaaagcccaccttacattttggaagaaacttttatatttcaatcccatagatatctaatttatttaaggaaacaggatatctctgtctcataagaaaaaaaataacatctgactgatttttataggaatgcttgggagtttactcttttacttgaaaggttttttttttttttgcctttttttttaaactttagaaacagaggcgtttcttagttaagataacagggcttactacagtattctttaattatcaaggtcccttgtaactctaagtctgttatctctaattggagagataattaaatcttaaagaccactctgactctaattcaaccaacgtgtgtggtgtccaggatcgttggacttccttaagaattctattttatccaggtgggttcttcctcagtaaattgtattctcctattggtaggaaatactcttggatttctttctttctttctttttctttctttctttctttctttctttctttctttctttctttctttttccttctttccttctttctttctaaaactgtattcagagagagaaatgtgacaaaaaaagggaaatcaatagagacagaaagtagattcatgggtacccaagtttatgggctgggaacaggaattaactgtaaaagggcacagggaatcttattgaggtgatggaaatctgtgttctaaaactacattgcagtgatgactgtacaatttggtaaaagcttcaaaattctggggattatacacaaaatgagtgaattttacggtatgtaaattatgcttcaataaagttgtttttttcaaaagttgattttaaaaattagtatttgttcttttttactcttaaccatctcctgattttggtttcaaagacttgctctcaggtagcagcaacatacacaaggcgtcctcatttcttcatttttctgagaggaagtttgccttgaatatagtagtggatttcttctacaccagtaactccttctgaaacctactatttgtgtgaaggcatatatgtggtagagacagaacaaatcttcatttaggactgtgccttgtttcttcttggaattgccatagtgatagaattttcccagagcctcaggcaatttaaactttttgtaacaaaaagaagcacatatattttcgggaactaggggggtgtgggtggcggggggcaatggtattgggaaattttattattccagaaggttaaggaggagcatgagcaattatggaaatctgaattaaattgatttcatttgttttgaagattagcaatggagacatttgattaagcacaaaaaataattgatcagatccagtcatttagaaggactgaaataaaaacaggctaggtgtggtgattcattcctgtaatcccagcactttgggaggccagtgtggaagggtcacttaagcccaggagttcaagtccagcctgggcaatatagtgagacactcttaataataatgataataataaccagatatggtgacaggcacctctcgtcccagctattcaggagtctgacatgagtcctgggggatgactggagcccagaagatcgagagatcaaagctgcagggagctgtgatcacaccactgcactccagacccagcctagatgacagagcaagatcctgtctcaaaaatttaacatttaacattgaaatgttaaatgttaaaggttacatttaaatatgtcacatttagatgttacatttcaaatgttacatttaggtgtaacatttaattgatgggctgtttttcctgaaacctttggcttttatcctgttattaatttcttccagttctgctagagaggaggccattgactctggagagctcgaactttcatttcatcttcttctataggtagattagagggagataaattagggtagttttttttttttcttattttgaattttttttttttttttggcataaaatgcttcccttcttccttgaaaatggccacgtttacaaaaatgttactcattaaccacaggtgtgagaagttaaaaataaacttccctgcgggcagccctcgtaagtagaatgtctgaaaagtttgtcaagaattgacagggtgcctgcaaccagggagaaaatactggataagggctttaaattatgccatgaaagctaaccagttttcgcttaataggcattttgtttacattttaagtgactttattttttaatcagcactttttaaaagccttaatctatgctttttgcttcttaacaggaatattcttttctcattagagtgatgtaactcccaacaggcatggcaaaggtgtttaacttatccagtaaaatgggaactaactactgtgtagctggaacatgtaaccaaaactgtcttggagaacatttcatctttccaagcaaagtagcagcttcttgtaaaaattttaattttgtatgttatttcatgttgctggcattaaagagttttttgttgttgttgaaaggctgaatttaaaaaaaaatagaagttttgccatatttaaattattttctatcctttttgcattaacatactttaaacatctcatatgcagctaatcacaaaagttagttgagccaaatgcttaaaaataaccacaaacattatctagtaaataacaatttatgccaacaatagactattttgatatgagctgtcaatatttatgcctacctgtctaattagtgaattaattagttaaaataaattaagaatacattcaatcgaattgtaaagatgccatatacatgttattgtaaatttatattgaactattttctagataagtttgatatattctttcattaagtatgaccattttactgagataaaatggacatttaaaatcattactattttaaacattaaaaactaaggcactgctggccgggcgtggtggttcatgcctgtaatcccagcactttgggagaccgaggcgggcggatcacgaggtcaggagatcgagaccatcctggctaacatggtgaaaccccgtctctactaaaaaaatacaaaaaaaaaaaaaaaaattagccaggcatggtggcaggcgcctgtagtcccagctactcaggaggctgaggcaggagaatggcgtgaacccgggaggcggagcttgcagtgatccgagatggccccgctgcactccagcctgggtgacagagcgagactctgcctaaaaaaaaaaaaaaaaaaaaaaaaaaaaaaaagaaaactaaggcactgcttacatgcatgcacatttaagtagtcacgaagtcacaaagatttcagcacctagatagaaataaatagctacattttattaaacactctaaaccagatccagtactaagtgtttcatatgaatttttttcatctaaccatcaacaaacttttaaggtaagcactatcatcctctcctcttacagatgaggatataaagcttagaaaaacaatgtgcaaaaatgctactcattaagcacagatgtgaaaaggaaaaagaaaatgccctgaaggcagctcgcatgagtataatgtctgagaagtttgttgataattgacaaagaatgaagttttctcaatcacaagccttgtagaaattgtggcgtcaagttgtgtcactgtcaataccaggtgattagtcaagtgattacataatggtctccctcagaaccaaaggtatgggcaagacaactggctaaagaattttgtgggtgacttctttcacatgagattaatttatcaaaagatgtcacacaggactctgccaactgacacgctaccagtttccatctgttgtagccaaggccattcttctgggaaccaatttccttcaaacagcctggctgtgtttcagcattttgaatcaaatgtggaagattgttaccatcgactctccactgggctggaagtttgctgggggcagaggctctgtcttgtttcctctgtatgcccagcactaggtaccaggcacccttggataagtacttggcaaatgtcaaatgaatgaatggaaggagagaagggcagatgacaaacactctgagattcacattcagtgactatccagccaggcacagtgctaagtgctctgcatatgctattttattttatcttcaaagctactgccagaagtagatatcaatagtgccattttactctctgaagctcggagctgaaagatggtcctagagcttatgctgtaagaaagggacagagctgaaattgaaatcacggtcctcctgacacaaaattcttgctcttaccgaagacatacatggctttccccaaagagactttgccctatatgttaaaagaacgttggaaacactctcaggcagttactttttatcttcctctagatcgttctgccttgcttctgggccctgggcctgaccctgtgaactgcggggctgcttcctctgtttgctggaggacagaggacggagatgagagttgttcctgcccactccctccttgttctggcttcagtgccagagttctagtggcagctgcctttccctaggacctgcattatcaatggggcaacagtgccccaagagggtaaaagtgggttcttggggtagaaggggagtggttaaaaaatttcaaccctacctaataaaaattttattccttagttgtgaatttaacacttttttttttttttttttgacagaatcttgctctgtcacccaggctggagtgcagggacaagattttggctcactgcaacctctgcctcccgggttcaagcgattctcctgcctcagcttcccaagtagctggaactacatacatgagccaccatgctgggctaatttttgtatttttaatagagacggggtttcattatgttagccaggctggtcttgaactcctgacctcaggtgatccgcccgcctcggcctcccaaagagctgggattacaggcatgagccaccatgcctggccatgaatttatcatattagatagactttaaatttcatttctttcctggagggttgtataaggtagggcattaatacataaaagaaaaagggagaaacattgctctaggacagcagtcctccccaggctttggtcctccaaggctccagctatcgctggctccttccccatgatggcagccgtaggagtgacaaactgcctacattgctagtccctgggaacctcagcatcccttttttattccttggtcatgcccacactggggtaacagtgctttcacaaaattctcccgatggaaatcattttaattccattttctgctaaaaccccggggatccagattctttttttttcttttttttaagatggagtttccctcttgttccccaggctggagtgcaacggcgtgacttggctcactgcaacttccacctcccgggttcaagcgattctcctgcctcagccttacaggtatgcgccaccacgactagctaatttttgtatttttagtagagatgaggtttcaccactttaaccaggctggtcttgaacacctgacctcaggtgattcacccgcctcggcctcccaaggtgctgggattacaggcatgagccaccatgcccagcgacgatccagattctaaccatccaatgatgacatgagcagtccaccccatagttttaagtcttaaattatagcagaatagacttaggacacacgaattcttttccaaacttagcaactagtattaatcatgctgtgatttctttgtatttcccatgacttacatggtcttatttttttctctctactgaatgcatgcgcttttaacactctatctttcccaaagtaaaacgctcagatgatagaagcaaatgacatagtcatcatacaatgacggagaaaagaaaccagaattttatatttaaatttatgatattttagacagggtctcactttgtcgcccagattgtagtgcagtggcaagatcttggctcactgcaaactccacctctcaggctcaggcaatcctcctacctcagcctccggagtaggtgggattataggaggtgtacaccaccatgcccggcaaagttttggtattttttgtagagatggggttttgccatgttgcacaggatggtctcaaatttccgggcttgagtgatcctcctgccttggcctcccaaagtgctgggattacaggtgtgagccaccacgcatggtcatgtcgacgtcttaactgtcttggaaataatttgattttgtccaggtaatttggttcacgcaaagaagttgagatcggggcacatcagaaagagattcatcttttaaagtgcttcttaaatctacaaatgcaatatatgtaaaagctaaaggtttttatatatttttcacacatgtaaaaatgtaagttttgcctttaaattcattttagatatgaaataatctagctgagagcatgtaaagtcgaggaaagcttattcagatccgctctagttcagcatgtggtaaattcctaggtgttcacaatattagtgtacacaaattccttctcaagaaagaaaaccttggacagacctggtagactagtatcacttatgccttatagagactttctgtcaaaaccaaacaaaaatctgtcatatctttattcatagaataaaatgtgatattagggaacacaactgtttctggaatgcattgaaactgatagtattctatagatttttctacttaacaattacttattattactattattattattgttgttgttgagactgagtctcactctatcacccaggctggagtgcagtggcatgatctcagctcactgcagcctgcacctcccgggctcaagcaattctcctgcctcagcctccccagtagctgggattaaaggtgcccaccccaacgcccagctaatttttgtatttttagtagagatgggtttcaccatgttggccaggctggtctcgaactcttgacctaaatgatctgcccgccttggcctccgaaagtgctgggattacaagtgtgagccactgcacctggcctcaacttacattacttatttttcaaaaactagagaatccattaattttggcttgtttgaatttaaaagtgattataatatttttgttagttatatatgagcagtatttcactacagctcatcttaaagatatttgataatttatcttctatttttacagcgaaatggtcacatttttgtcagttgacaataaattctttttttttttttttttttttttttttttgtagagttggggtttcgctgtgtttggccaggctggtcttgaactcctggcctcaagtgacccacccggctcagcctctcaaagtgctgggattacagatgtgagccaccacacctggcagacaataaattcttgaaagattcctgatactttaccaacttacacattaagttaatcttcccattttctttgtccaattaagttttaaagcaaaataatataaatatttatagacccaaattgtaaacacatttcagttttgaagaacaatataaagtaaatatactatggaattacaattagaaaaccaagtttgcactgatatttttaaaacttctctggggaacttagtttttcaacttaaggacacaagtattaaattagaaggtattttccttcactaacgaaaatttttgttttttaattatctattcttgtctttcaaatttaagttttaatggcggaccaattaatgttgcttaaagttacaacttagacaaacagttaaaatagcttagcaaattgtggttctggttgttctcctataggtaattaagagggcaatgactcaagatttaaaaaattaaataacatgtccacacaattttctctgaaatgttcccttcagatttttaaaacaggtttattgagatataattgccatctcataagccccacatacctgta

SEQ ID NO: 1088 - DNA, 56626 bp, Homo sapiens
acggagtgcggaggggggcggctggcgggagggtgcgccatgaaaacaagggctggaaaagcgccgggaaccgcctggaccctttctggccgtgtgagtgtgtgtggagtgtgtgtgtgtgtgtgtgtgtgtgtgtgtgtctcgcctggaccttttctagccgtgtatgtgggagtgtgtgtgtcgcctggaccctttctagccgtgtatgagagtgtgtacacgcgcctacacacacacacgttgtgttaccggcgctcggccgccgggggaagacccaggccaatgccgccccccaccgcccccagcagtgggacctcagcgctgccctgctgtgaagacaggtgactctgcacgttttaagcaatgtctagggacgccccgagcgtggtgtttactttcaagtagcttcctaggtgtccgcgcactacacacgcacgcgcatccccgcccgtgtccacctgaacacctagtccgtggcccaggccatgcagaactcagcgctccagggaaggggtttatcaagggctttacgacagtttaagtcaatgttttccctctgtccctaacaccttttacactggtttagtgctacacgatgaggacttccatatagtaactttcaggcccaccgtcctaacgctggggtgggtgggctcctaaaggtctccacctttgcctcgtagccaatcctagttggccgcactttctcaaatgaggtacatagatacacacatacacattcacactcgcagacgtgtgtacgcgcaagcagacagttttaaattaatcagcatgaatagcccctagcaaaaaaggacaagaggacaaacaagttgcacgtgtgtatttttatctccaagagtctttgacaaagcaccaagaaaagaaaaaggtcttctagaagcacagcggcttacttaatagggctcgagtgcaaatatatagggacactggattattggggtcaagaaagatgacaaatgagtactacaatgtgtacaaatatgctatgactttttttttttttttgagacagagtcttgctctgttgtatcttggaggctggtgtgcagtggtgcgatctcagctcactgcaacctctgcctcccaggctcaagcaattctgcctcagcctcctgagtagctgggattacacgtgcacgccactacgctctgctaatttttgtatttttagtagagacggggtttcgccatactggccaggctggtctcgaactcctgacctcgttatccgcctgcctcagcctcccaaagtgctgggattacagacatgagccactgtgccctgcctgacatctttattttgtctcattcctactctaaaatcaaaacattctttaaaaagccagaaaagcacaccaaattatgatttttttaatttttacttagttggccttttttttttttttttaagagatggcttttgctatgttgcccaggctggactcgaacttctgggctcgaaggattctcccacctcagcctcatgaatagctgggactatacgcactgccatctctcttgggtgtttttattttatttcttcatttattgtatcccatcagcccaacaagccaacttctctcacataggaatgggggcctgggtacaaatttcttatccaggcaagaggggatgaaaggagatcctccttcttgcccttctgatggttgggacagagtcccttttatgcgcgtgggaggtgttttggtctggatagacactgggtatagattgacctagaataaatgttctcacataaattcataccaattgcacaacagtatggtttagaaatcttgaaagcgtattttaaagccccaaaattacctaagaggaattgaaaggcttcaagctcctaatactcagcatatgagtgaggaaatgataggacaaacctgcaaaagaaactgtacttctgcaaagggggcagccagaaggaaacggatcccctacttccagagaaagaaaagctgactgattttcgtcttcctttgctcccacagagcctcactctatggattttcccagactgattccttatgtggcatcttggctataatcagtcttgagacaggtctgtattgcagtctttggctaggggttatattttccctgggaatgttctagatactctttcaaatgaaagagtgaaaccattcctgcgttcagattccatgtttattagattccattttaaagcataagggcaagtattcccaggaagtatgtgacattgactactcgtctttgggcaatgctgaggtgggggagggaacaccagcctgaggcaggagtaactggatttgaatcctagatctatgcctgagaccttccaacaaccttacaaacatatgcacagtggacttttcactttccaagatgttttctacttgtaagagccaatggatgacccttttggcagctttacctggttggattctacaagtagcgtggcaccaggaagagaaaaaaaacaagatgcagggaatggagattgtatcaagagtctgaatggcctgtgttttctttccgtcttcattccccaggccaccaaacaaaaagcttttgattgccagttttcgccacctgctggttgtttcacagcgttactctcttcatccatccaagaaagttctttcatccatcatcaatataaatattctccaagtttatgaaattcaaaaggtacattattctaacatgaacatactaatgtttaatataggtatgtatcggccaggtgtggttgctcatgcctgtaatctcagcactttgggaggctgcggtgggtgtattgcttgaggccaagagtttgagaccagcctgcacaacatgacaaaactctatctccacaaaaaatacaaaaattagcggggcatggtggtgtgtgcctgtagtcccatctactctgaaggctgagataggacgatcacttgagcccaggaggtggaggctgtagtgagctgtgatcacaccactgcactgcagcctgggtgacagactgataccctgtctcaaaaaaaaaaagaaaagaaaagaaaaaaaaaatcatgtgtgtgtatcaaatcttcccagctagtaaactttttattgaaaatgtgggtagaatgagactattaactgaggatattgataactaataggtcagatggaagagtaaaccatggccccaacctgaaatggaaattaatccataaataaaatgagctgactagagagaataaaaacaagtagtccatatagtttgcataaaagaaaaatgaggccgagcgcagtggctcacggctgtaatcccagcactttgggaggcagaggtgggcagatcacctgaggtcaggaattcaagaccaggctgaccaatatggtggaaccccgtctctactaaaaatacaaaaattagccaggcgtggtggcggggacctgtagtcccagctactcaggaggctgaaacaggagaattgcttgaacccgggaggcagagattgcagtgagccaagatcatgccactgcactccagcatgggtgagagagtgagactccatctcaaaaaaaagaaagaaagaaagaaagaaagaaaactgcttaaaaaataacttctcagccgggtgcagtggctcatgcctgtaatcccagcactttgggaggccgaggtggatggatcacgaggtcaggagatcgagaccatcctggccaacatggtgaaaccctgtctttactaaaactacaaaaattagctgggcatggtggcaagtgcctgtaatcccagctactcgagaggctaggcaggagaatcacttgaaccaggaagtcagaggttgcagggagccaagatcgcgccactgcactccagcctggaaacagagcaagactctgtctcacaaaaataataataataataataataataataataataataacttctcataggcttagattagcaatccaaaatgccagtttccaatttcaagaatcttatacattataaatttgtgtggtaggtagtgccatgctctttcaaatggtttgcatacattgccagcaagcattatataagccccagtcatgctttttttttttcccaatcacttttgcttcagagcctgtcttctgccttaagtgatcacatccaagtcatccactctgtgcctgaaagtcattcttgtcataaccaggaaactctcttggtttctaagttaagccttggtttaacttagaaatccacctaacttaactcacctaacttaagtggaacctaaacctaaaaacaagacaaaaaaaatcggaataattaagcaataatatttgaagctaggcaatgagctacaaataaatcattctgctgtacaagtttaatagtgggcaaataatatttacttttggtttacaatggaaagcatagcaaattaacttgtgatttttttttccatttctaatcaataacttggtgtttaaagtgaaataagctaagggtaggaacttgtccatttttcagatgcctactgctctcgttggactgaaactgcagtgatagaaccaaacaaggtataataccatagtaccgggagggctgggtgaataatttacattcttacgtgtaataactaacttttattctcttatgctatttagcacacagcacgtctccaaggtattaattgatagtgaacacaattctaaactttaaggttaatatgtttcctagaactgccatgacaaaataccacaaattaggtagcgtaaaacaacagaaatttattctctcacagctctgtgggctggaagtcaaaaagcaaggcgaaagcaggcccacgctttctctgaagctcgggtacagtctgttcttgcctctccctagcttctggtggtggccggcaatccttaatgttccttgccttgcagcctaatcactccagtctctgcttccgccatgacctgtggggttctgttttctcccattcttctgaggtctccagtcataatactggattcaggcccatcacagtcacctcatcttaacttgatcgcatctgtacagaccttatttccaaataaggtcatattcacaggtgctggggactgaatttaaatatgttttggggtgacacaattcaatccatcacaatatgtatctaatatgacatttttaaaactaatgaggatcattgaccccaaggcctaaagactcagcaatattagaactgagtttcaagggctaccgtgacctctctaaagctaaaatctggctatttcatatttccactcaaagttcttgaaaacctaaaaatcttaactcttcacatggcatgatctggcccaatcctttgccacccccctccctacccctcatctcttccttttcccttcttgcaactatatccactttttgtggtttctggaatatgccaaggtctctcacgtctttcgcttttgcacatctgccggtctccctgaatggtacccagctttttcacctgacaaattcatttctttagttttggctgaagaatttcttcctctgtaaagccatccctgctgtttctgggccgtcttaacattccttctgtgctgctagaagacatttagtacggggctagatgcctaaaaatcagaatcaagattctcatcctggcttcaccattgagtagctgtgaccttgagccaagtatttaagctttcagtgcctgttccctcatttataacatggaaatataagtagtactattcttggggttagcttgtgatttcattgagttaatacatgtaaagcactcacaagtgactggtacctgttttcagtgttggttatggtatcttaatcaccgctattctcagatcagtgtaatctctggcatatatccttctcactagattataaactattcgagggcagggatcctatttttccttggagtctttccagcttagaacagtgcttagcatacaaagatttgaagcctaaaattcagaggctccaagccaaagaagaaaatggggaatggttcctctttgtctaagagacttgtaaggatatagcagagccatctgagggatgaaggatgggagaaggtgaagaaacaagaaaagtaattgccatgaggaaggaacaagttgttgatatataattgtatccccagcacctgataccaagctcatcattagtacccaacaaatatatgatggatgaggcaaaatggaggttataaaatcaggagtgtaacagaaatcaaaacataatttggggttgggcgtggtggctcacgcctgtaatcccagcactttgagaggccaaggcgggcagatcaccaggtcaggagttcaagaccagcctggccaacatggtgaaaccccgtctctactaaaaatacaaaaattagctgggcgtgggggcgcgtgcctgtaatcccagctactcaggaggctgaggcaggacaattgcttgaaccagggagtcggaggttgcagtgagccaagatcatgccactacgctccagcctggcgacagggcaagactccatcacaaacaaacaaacaaacaaaacacataattttgtcctttaaatatccaaacaaaaattacagatataatatcacatgccatttatgtatataaattgctcacatgtaaagaaagattaagcttgcaaaccacgatgtccaagaaatctcttctcaatgttccaaaacctttctgtttacgaactgataaatatcgaggcatgttcttttccatatcagtcttgtataatttgctgcccatcaggatctgggagatattacatggttggaatatcaggttttcgtttaaagtatgagaaatatatttgtatagaaaacgtacttgtttaagaaattttgctaaattcacatttcttaaacttttactcgtatatcccacatcatagtgatacgaacagaacctacttgacacaagagctcagaataccaagtatttactccacaaatattacttcctaaaaaatgataaaaatcaggcctggtgaaatgcttaggatgcaaagtcaggataacattatagaaaacatttatgttttgcccaaatggtctcttaaaaaacacaaacttctagataaataagtttgcaaatctgtaagtcttgttccccatttatttttttgttgtgattcagaaatacaaggtatgaaaattagattacaattctgccacaaaagcttctaaagtagcaaacacaactttgtgtatcaaaatagccatgtgcgcttttatcagttaaaaagtctttagagttatcacatcaagcaagtgtaaaatataatagctactatctccccttcaaaattgcaaatccacagttactgcactgaagtataatccgaagagcaagatttagtccagaatatggaaggttctggttggcaggtactttttaaagctgacttactaagaactaaaagaaatgagaaatatacaaagcatcttatgtcaaagagtatgaatatttaaaagtggcctcaagtgagtaatacatgtttaaattagaacctgatgtaattaaatgtttatgtaatttagcaaaaatatatatataattgctttcttctagaaagataaagacataaaattctttgaaccaaagcaatattaccaaatgttttcatcacctaaatactagaaacaatctctcaaaatttcacttgcaatgatcaataatatatggtttaacagatccagataaagattttttttctttttttttttttttgagacagagtctcgcactgtcacctaggctggagtgcagtggcgcaatcttggctcactgcaacctctgcctcctgggttcaagcgattctcctgcctcagcctcctgagtagctggcgcccgccacacacaggcgcctgccaccgtgtccagctaattttttgtattttcagtagagacggggtttcaccatgttggccaggctggtctcgaactcctgacctcgtgattcgcctgtctcagcctcccaaagtgctgggattactggcgtgagccaccacgcccggcccagagaaagatttataactaaatatatagaaaagaataattcccatgattttgtttttgtaaaaagaagtaaggattgttttctatatatttttcaattatgaagtccttgaacatatttggggatttttatggctcaatgttaattttttaatatacttgcaaatacattataataaaataatacaaccaaatcaaaaagcagccacttaaaaactgaaattcacaaaatgagctgttcttggctacatacagaaggccaacatttaaactgaatgataattaaacgtttactaccataggtaatatttacgcacttctgggtccaatagaaggtgttgaatcaatgtgatcctttaaaaacaaagtcattagtttccgtaacaatcacactcagggttggttctttttttcttcccccagcagaaaaacaagttgttcaagcattgaaccaaaaaatataaaaaatagaatttgccttgtaatattttcatgttttggatgaagtcagcccattatgtgaggctgcttaaatgcctacaaccccttatccaaaacccgctgggctggatgtgtttcagaattcataatctttggggttttaaaaaggcaatatgggcatattttgaatattacaaaacacctccacagcatctaagggaaaacctataatcaaatccatggatatttcttcagggaaaattaagtcacaatgaagtagcataaatataaagtacaatactctcacatcagttcaagtcagattttgctgccaaatgaattacggtatcaaatttagaaaaacacaaaccaacttagatttcgaagtttctttgctaagggactgtagccctttaacatctctgacaaggaaatttcttctctgacatgatggtctctgcaaatctgctctcatatttcagtggaaattgggatagggacaattgtcttctaccgcaaaacaggggctctcaacaggtgctcttaaatttattcgggtagtagattaccatctcactggaggcaacaggttctatgaggataatttgaaaaaatatattgaaataactatttaatgttattaaatcagacactttcttggactagattctaatatagatcagcagtagaaggtgccaacattcgaggaacatttatgagaaaagaataaaactgagaaacatccagacattaatgcaattgttttctgcaaattataaaaagctatgattccattttagcagctgcacaacgcaactcgatataatctgcaaactttggctctgtaagactgaaagatttatgaaaccattctggcatcaacccatccttacaagctgcaatgaaatcattccaagcaatttatatattaaataataatttcttctgtatctatcagtgtttaaaatatgctattctcagatcttaataaaaacatgggttaaagccataaaacatcttattttttaaaaagttaagtcatttaaagtcaagagcttcaaaaactcaagagcaaaaaaaaggtatgctataatttttaggtcttcaatttttgtatagagtttttatgttttttaagttttattttacaatttaagaaagtttcctcttcaaaaacagaggtcttttctcaccgaagtgatctggaatgtgctaccgtatatgcaaggaagacaggttacaagatcaaggtgaaggcagctctcctcaagtcagaggagtgtgaacaatgagcaggatgcaacggggaatgttggctaaaactcatcagaggcacttgctgtcaaaatccactaatgaacacagatcctataacctggaaacaacattcaggggccaagagggtttccagggctacagagttagatgagtgggcttccttagcatgtggtataaaaataatgtctgcaggttcagtgggagagtcacataaagaacaggtgatcattttatttcaaaagcaactctcttcaaaatcagccttgtctttttttcttaatgagcaaactttataccatcatcagcctttcctaaaagctacatatatgctccgagaaaaagtcacactttttaattttttcatttgctttaattaattcatgagttaagttaaaaagtcaagtcgaaaattttagctggtcttttttttcctttttttttttttttacaaaaatattacagcagtataagcaaaattggaaaggaagagatgggaaaaacaagtagatgctaaaatgggataggtgaacttcaggtcatcatggttattgaaggaactgtaaattcttaagcttctagattttaccgctcttcagaaaacatttaaggaggctgcctttccccatgaatgagaaatgaaacgttccctaagcatttgagtctaaagacaagaaagcattgcttttcctactggaaaatatctctttacttcccattgcactgccctctcccgtccccctcgtagctttatgggatcaaagagagagagaagccatgagtttccaccagcagcagagtgagtcctgagcacaacacagggctgtcagtgacattcagactcactggcaatgggtccaactcatcttgaataaaatacacaaagaaagaaagagagagagagagagagacagagagacagagagacagagagacagagagacagagagacagagagagagagagagagaacccgagaaaccgaaaattgtttttttatggaaggtttaaacaaagtcctcaagatttctttatgtgccagaaagtacatttctggacttaatctctaggggggcaaaaaagaataaatagaaacaaatttaatgatcattctggaatcctgttctttactttgttcacacgctattaattctcataccttcacctctctaccacaaagcctagaaaatcaaatggtctcctattccatatttgcatagtattaataatactgtcaggaggtgaacttctagccccttgcttgcagccacattcctgaagagcactggtccaatctgacgtattcgaaaacaatacataagtgtctataggccaaaaattgggtcccatttagcagcaagctgttcaaattatttggaaacagtcttcttccaaggggtaagaagattaggcagttttgtctgcattttcagatttttctctctgcatcatgcagcgacgaactatgctgtcaaaacttccaaggtaaaacaaagcaatagtgcggaaaaggcccatggtgaccacctgcaagataaagagagagcttttagtgcatccaacggtacaagactatttcaaggtacctaggtctctaacaaacagtttctaagacaaatcttctagtctgctctaaggatgaatataatgaaaactctgtaaatgtcagtaagctgtgagaacagaatgtgtgtgctctgcaccgctggacagcccagatacataacaaaatatttgtccaattaataaattcaaaccataagcagaataaaatatatattgcttgcagtcttagggttataatagctttaaaaagacccactgcagcatctcaaatagccaaactacaatcaaggcttttttggtttgcaatttatgttctgagcatgaaagcgagaccctatactaggtgctgtgaacactgtggtgagagacacagtccctgccctcaatgagcttattctcaggctggaaagacaagtaaaattgaaactactgcctcagggttgagacccgtgattactgatatcctgttgctcaggatggagtgcagtggcatgaacgcggctcactatagctttgacctcccaaactcaaaggattctcctgcctcatcctcccaagcagctgggaccataggcatgagtccccgtgcataagagaatggaaaaatcaggccgggcgcggtggctcacgcctgtaatcccagcactttgggaggccgaggcgggtggatcacgaggtcaggagattgagaccatcctggctaacacggtgaaaccccatctctactaaaaatacaaaaaaattatccgcgtgtggcggtgtgcgcctgtagtccaagctgctggggaggctgaggcaggagaatggtgtgaacccaggaggcagagcgtgcagtgagctgagatcgtgccactgcacttcagcctgggtgacagagcaagactccgtctcaaaaaaaaaaaaaaaaaaaaaagagaatagaaaaatccctttgtttttttccctacaccctcagagcactgaagccagtccttggatcttccggaaaaaacaatatttaaggtgagacctgaaggattagaagttggcaggacacagagaagattccaaaaagaagaagatgggtaaagaaagaaagaaaaaaaagagcctggaaaggtacgtggggtaggagatcaggtggtttatggcatgcgatggaaatttttttaatttttaaatcctttttagagacagggtcttgctctgtcacccaggctggagtgcaggagtatgatcacagctcactgtagcttcagacttctggactcaagcagaagtctcccagttgctaggaatacaggtacacaccaccacgcctggctttcttttcttttacatttttttgtagagacagggtctcactatgttgcccaggctgatctcaaactcctgagctcaagcgatcctcctgacttggcctcccaaagtgctgagattataggcatgagccaccatactcaggtgcaatggaatttttaaagctttatcctgatggtatcaaggagtcattgaatgttttcatgcaatgtatagttgcagtttagaaacaactggtgtggaaaatgtgagggtacactcaaacgcatccagggggcctgagcagggggttgcagaccatagtggttgcagggactgtgctcctccctcaggagcagctgccacctgtgcttgctgatgactgccaggtaagaatgcagactctgtgcagctaaaccttctgattttccaagaaaagtctgaaatctggaccttttatataaaacctaattttaaaactattttaaaatcttaaacacacacactcacaccagatggacccaacaaaactgctttacaggcccatgggaatcgtttacaacctctggctcaaaaagtgtgtaactcaagcagggggcctgctgcggcaacccaggcctgggctccagaagcactgccagaattgcagagaatggaagaatgtgaagaactgagtgacaaggatgacaatgatctctgacgtgagggacagaagcaggggagtccaggacaacacgccaggtgtgagccaccatgccagcccaaaaattaaaacataaaagaattcatgcatttgttcagctcagggattctggagttcctactaagtgccaggcgctggctgttaggggtacaacggcaaacaagaggtgtgggcctggtcctcaaagagcttacatctaacacagtgtcaacctctaagagaatggcaaagacagtaggtacattacagaatgaaaagaaaagagggcttgggaaagaccctgaagaaaaccaacaactaagtcatttatataagtctgaatgtggttgactgcacagaatttagtacttgttaacaactatcccatggctttgtctttccagagcattccctctattgtaacccctacttcattacactgcactactatctttttttttttttttgagacagagttttgcccttgtagcctaggctggagtgcagtggcttgatctcggctcactgcaacctccacctcccgggttcaagtaattctcctacctcaacctcccgagtagctgggattacaggcgtccgccaccatgcccagctaatttttgtgtttttagtagaaacagtttcaccatcttggccaggctggtctcaaactcctgatctcaagtgatctacccacctcagcctctcaaagtgctgggattacaggcgtgagccaccgcgcccggactactatcacctttttggtcagtgcattccacttgactgtatgcccctgaagctggagaggtcgccttccatctgattccccatgagcaagtacagtgcctagcacaccaatgaaacactgtgtatcttggacaaaataatacattctataagcgaagcaactgtttaatccatgattcgtgtctcactaaatttagctgtgtgtgacctgattcacctagaaaaggttttctagtctaatatcccagtactttttaagcaaggctaccccttactctagaggagtattccattttcaaaacacattggagcagtggttcttaggtgaaaatccaggttaacacctcaacagcagatacggtgttttatttctctatctgcaaggcccggcactgaagacttcttgccattctaaattcctgaagttatatctttaacctatttactcattcctggtggaggaagaggaaaagttgatagctccataaaaatacattgtcaaataaagttacttagttttcccttaacctcttctcatcaaggtttgatgaaaggcagtttttctcttgtccatcggcctgtctgattgctagcctaggcagagcttacctgctggagcccctcagtaatagaagttactggagccatcccacaggtcagggccgagagcatgtacccatctgagccaagggaactgttgaaatttccttgctaaaagagaagaaaaagaagagaaagagggaatcctagtaatgtggacagaaatcagtcggacacatcagaaacagtggagtgtgctcgttcactttaagtgagataaaatggtcacaaagcattgatcagcactcagaaatggacgcacggccttggcagatggcagttctcaacaagtgagtccacggacccctgcgggcccccaaggacaaatgattgtcctaataacactaagacattcattgtcttttccacagtgtgttgtatggaaaatacagttttgcctctgcaaaactgcagagacatgggcaagaaccacggggttcttgccaaactgtactaggagtcattgtcacctctactaccacacgcactcgcagtaataaataatacacaaagaaaatacaagttctaaaattcttttaaaaatcaaagtgtcagttttgctttaaaatcctcttgataaagcaggaaaattcatcattttgttcaatggcaaccctcgaggacatgtcttcttaatactctgtgtgacaaatgagaatgcgcccaacgcgcttccgcagcactgcattccagggcgggacaactgcctggaacaaaagtccttgtgcagctcctgaagtcaagggctaaactgccacttctttcatggagcatcatttgtattgtttatttatttattttcgacagaatctcactctgtggcccaggctggaatgcagtggtgtgatctctgctcactgcaacctctgcctcccaggttcaagtgattctcctgcctcagactcccaagtagctgggattacaggcatgcaccaccacacccgggtaatttttgtatttttagtagagatggggtttcaccatgttggccaggctggtctcaaacccctgagctcaagcaatccagccgcctcggcctccaaaagtgctgggattacaggcatgagccaccgtgcctggctggagagcataatttttatatgaaagaccattgacaggaaatctatagtaattcagacttaggtatgtggcagatgtgcagaaagcgaagcaagcaagtgtgtcacttcaggaaaaacaactggccacgtgtcatcaatgtgaaatctgagccttcaagaaaaaattaagatttggaaaaactagtatccaccatcacgagactgtcagctgcatacttttatgataagatcagcagtaatactgatgaaagcgatttttctgatcactcagtcaacccatattttccaaatgactaatgcataatgttacgaaatcatgaatggttaaaagatccattcaaagtacaagacggaccaatggaatttaatgtaacagagaacaaaacattcattgatgtagtttccaattctatactgcaactaacctttaagaaactaccatttgttgagtttgggtttgatatcaaaaaagaatgtccataattatctgaaaagcctagtaaaatagtcttccctttcccaactccgtatctgtctcaggccagattttctgtatatccttccatcaaaacaacattattacaacagatggaatgcagaagcagctatttgaatccagctgttaatgcagaccttaaagcaactggtgaaaatgtgaaccaatgccaccgtcctcactgaacttttgttttgaaaagtagtaaattttgtttaaaaaaagtcactttatatatatgtgactttatatatatatatatgtgactttatatatatatatatgtgaatatatatatatatatatatatatggagttttgctcttgttgcccaggctggagcacaatggctcaatctcagctcactgcagtctccacctcctgggttcaagcgattctcctgtctcagcctcccaagtagctgggattacaggcgcatgtcaccacacccgactaatttttgtatttttagtagagacggggtttcatcatattggtcaggctggtattgaactcctgacttcaggtgatccgcccgccttggcctcccaaagtgttgggattacaggcacgagtcactgtgcccagccatttttgttatttttaatgaatcaataaatattacaaacagcttccatttcaaatatggcaaatatcaataaatatagccatgtaaataaacaaaagttctctggggttgttgacaatttgtaagaatgtaaagtggtcaagagaagaaaagtttgaaaaccactaaactaaatgaatactgccaaaatactaagagctatttagcatcattagaaacactgaatgggctgggcacggagctcacgcctgtaatcccagcactttggccaagaggctgaggcgtgcggattacccgaaatcaggagttcgagaccagcctggccaacatggtgaagccccatttctactacaaatacaaaaaattagccaggtgtggttgtgagcacctgtaatcccagctactcagaaggccgaggcaggagaatcacttaaacccaggaggcagaggttgcagtgagccaagatcgtgccactgcactccagcctgggcaacaagagcaaaactccgtctcaaaacaaacaaacaaacaaaacaacaacaacaacaaaaaacaccaaatgcatttgctttgacccgagataagcaggaaaaataaagtctcacttgtgccatcttcctgagccttttaatgcactcaggacaaagttcttcacacatgtatatatttcaacagaattcactattctcattctgctcagttcagtctaatgtgacagcatttaggccacttcaaggctgtccaccatgtgctgacacctctcattccaatggtcctatagattttccaaattcagtgtgggtctgtggtttacagacatccctcataaatgtgcatttttccgcattaacagaaatgttgtcaaaaagcatgaggcacatatgttgttcttctacaaaacagcacatcatttcttaaaataccatttttgattctgaattaaaaaacatatcaacagggaagacaggaggacaggcccacggggctggtggcactttctcgttagctaacttttgggaaaatgatactgggaagcaggaatgggagagaaagcagccaggtgtatatgggacatagtatatatcgtttacactcataggaaagtctcattttctttttaaagaaccggtgtttccagacatccttctagtaaacctgttcctcagattaaggtatacaatcagttttcaggaggctactcactaatatggagtcaataaagcgtctaaaagaagaaaagttgagtccaatattagatatgacaaatctgacagactaaaaaattctaataattgatgttttgaagtaagtccttggacaaatatcttttcagaaatatagtactacaaacacaaatagtacagaaaacaaggattttacttactatggcatctttaacaatttgtttggccacctgttctggtttgcacacagatgtggtctctgaaataagtcgagtctccaaaggctaaaagtggaaaaacatgtacataacaatatcatgattgcccattacattaaaaataaattattcttacagcctcctgatttacaaataattccaattttctacctttgggcagattcctatttctagaataaggtccatctggattctaaatcagtgtctacctagttactacgtaaaattctacccagtagctaacacaagacaaggaggcctttgccattctcttagaacatacggagtcttggctccactgaggaccatcaaagctagagtgagaacacatcactggatacaagttcagaaagaccccctttgactcctcagtgctggccggacacctgaatgatggtgcttttctgtagaggctagacctgtgtccagagcaagcctgctcccaagaccagcaactccattctgaccatattcccaggtcagcagagggctgatccctggggatgaacctggcgcccaaggcagggacagtcgcaacccagcccccattcaacaactgcagatgcttcttaaaggacttgctgaggaggcaaatgcacaggacactgaaacagaaggagccacttaggagataaccctgagtggtccctagatgggctgcatgctagttaccaggctggagctgcagaccccaaatcttagccttttcttcctcaaaaggtccatctcaactcttacctaactcaaaaagccttccctaaatacctaactggcagtaacctctctctttcttctgtgaacatttctgttttaatacacattatagctacttgtgcatttgcattttacctcctaagtttcttgtgggcagggccttttttgtaagaaattatttatctttggcttttctttgcgatgtcttgcatatgtgtgctcaaaaattatttcagttagtttcaattagaagtgtcaaataatttcaagtagaagtgtcaaacaaaagccttaaactgcatgagactgtaaactttaccacgtaagcttgaaggaattaaagaaaataaaaaccagattatattttcttaaaataggaaagtaaagtatttcataaagatcaagtatttcttatgaacctttcttaagagaaaggctgttttgaaggagccacgattcattcttccagacccccaggctggcataaccacactaaatacacataagattctaaagtactatggcgccccctaaagggcccacacatcaatgtagaattgtatttacccccaacaagtctgcccaaaattttactgaaaaaaccccaacttaatcaacatcagaatcaaaccttaacagggaaatcaccaccctttgtcagctctggcttcaaactaaaagactgcataccgaatgttgcaaagctgcttagaagatctctgcttattctaagacaggacatttggcttaaatttacttctttgaaatagcagtaatttttaaaaaggcagagccaaagagaaaagaatagggggaaaaaacctaaatcacaaacatctttctacaaatatacagtctagggagtttaagtgccaatttttatgctgcagagattcacatttacaaagtattcgtataaaagagaaaaaaatatataaaactaaaattggccacagttcaaggtggtaagttctgattaattcctttcttcccgcttcacctattcatttgctcaaaaaagcaactactatgtgtcaaggcaaagggaatattccattgaaaaagtgtgaagcttatattcagctcaggatgactggcagtcattttatataaaagatatgtctgttttaagtgctatgagaagcttctgttataagctgtgataagtgcaatggagactcaaatcatcagaccccaagtcatctcctctacgatggcaaaagattagcaatttactaaccagattcttaattctcaccactaagagtagttataaggcactttgtagaaacagaaaaattaagcaaaagttggcacgtaggtggtgagctccccagccctcctgccctgcttgcctcccacaacacagacagcaagtcttactctcccaaaggcagaagaagacatgattcctcagtagggaaactgatcaaaccatgagaaaagtgagcagatgctggcatatgagaatcttctaatgaagtggctgcatcccctcctgatcatcctatagtaaacagctgagaagctagagatttacaattggcattttagtgcatcactcttaaatatggacaatcaaggatcaacagacatttcaggaagccggaaaaaacaacaacagagaaaaagaaagtaggaggaaataaataatacaagatatagaagaaattttcaaacaaaacaacagcaacaaaaaaacaaggctaaacatccagagtgaatatccttagacataagagaaaatatgaaatccatgaaataaggcaagaagctatttttaaaaactgttttaaatattcagagaaaagagatctaaagtaatttttatgtaacccagtagaaataaagatttcaacaaaaaggtttaaggataaagcgaataaaaacctagaagggagaacaaaaggcccaagagattaaaaaaaaaaagagagagaaaatagaaggaaattagaggatcagtccagaaagttcaaaaatctgaataataaatgctccagagagaatgaacacttgaaatactttgggaagaaagaagtgataaaaggagtaatataataaaatgtcccagaacaaaagttgataaaataaaagggctcatatgaaatgagaagatttcatgccaaaatccattaaataaggataaaaagggacacaaggtttccaaaaataaatggaaaaacaggttctatacaaaaggttgggaatcaaaatagcactggattccacagaaattctggaagctggaaatcaataaatgctcacagaaatctgaggaaacattatttccaaactagaaatctgtacttaacaaaacaatacataagaataaagaaaaatggccaggcacagtggcttatgcctgtaatcccagcactttgggaggccagagtgggccaggagttggagaccagcctggccaacatggtgaaaccccgtctctactaaaaaaaaatacaaaaaatcagccgggcttggtggcacgcacctgtaatcccagctactcaggaggctgaggcacgagaatctcttgaacccaggaggcagaggttgcagtgagccaacattgcaccactgcactccagcatgggtgacagagcaagactctatcacaaaaaaaaaaaaaaaaaaggttaaaataaaaataaaggcattttcagacatgttgtttctaaaacaatattacctctgatgtgccctttctcagaaaattggtggaaaatattatagctccaccaaaatgagcagataaaccaaaaaagtgagagtcatgggctccgtcaaagggaggggagaagggaacgtgcagtgtgaggtgaagacaagtcctgacaccaccgctgggtggcagaactagaacagaccaggaacggggacgaccccaggagaaatgtctgaggaaaaaagaatgaatctaatagaatgtccaatgtgctcacatggatcaaaaggagaatctcagttctgtttgaatctgggactgaattagttatagataattacaaagctaagcaaatgaaaaggcaagaaaggaaatgtcactatagaatggtccaagtgtgcataatattaatatgagcactaaacctgatttaactaaagagatgggaggagtacacagggaatggggaacagatatgagtcttaatgtttttgttttgaaacaagtcttactctattgcccaggctggagtgcagtggcgcaatcttggctcactgcagcctcgacgtcctaggctcaaactatctgatatggttcggatctgtgtccccatgcaaatctcaggtccaactacaatccccaatgttggaggagggacctggtgggaggtcactggatcatgggggtggatttccctcttgctattctcgtgatactgagtgagttctcacgagatctggttgtttaaaagtgtgtggcacctcccctctctctcttcctcctgctccgaccacgtaagacgtacctgctttccctttacctaagactgtaagtttcctgaggcctccccagaagcagcagactgtacagcctgtggaactgtgagcaaattaaacctcttttacgtgtaaattacccaatctcaggcatttatttatagtaatgcaagaacggactaatacactatccttccaccttagcctcctgagtagctggaacaattctaattttgcttatttttttgtagggaaagggtcttgctatgttgcctaggctggtctcgaactcctgggctcaatcaatcctcctgccatggcctcccaaagtactgggattacaggtgtgagacaccatggctggccttaaatttttatttttttatttttaattttaattttttttttttttagatattggttctcgctctgtcacccaggtcgaaatgcagtactacaatcatggctcactgcagcctcaacctccctggctcaaatgatcctcccacctcagcctcctgagtagctggaactacaagcatgtgccaccatgcctggctaatttttaaattttttgtagagacagggttttgttatgttgcccaggctggtcttgaactcctggcctcaagtgatcttcttgcctaggcctcccaaagtgctgggattacaggcatgagccacactgtgcctggcctggtcttaaattttatcttccacggtagaaagtcaataaataatttctaaatcttaaaaaaaaaaaaagcagtataaacatgttagttaaaataaatggctacctctagggagtaggaattgggaatgggagagatgaggcaaaggattgatattggactctaaaactgtgtgacatacttctttgataaaaatgtgctggaaatggctgggtacaatggctcatgcctataatctcagcacctgggaggctgaggagggaggatcacttgaggccaggagtttgacaccagcctgggcgacatagtgagactccatctctacaaaaaaattaaaaattagctaggtgtggtggcacatgcctgtaggcccagctactcaggtggctgaggcaggaggattgcttgagcctgagagtttgaggatgcagttagccacgattgtaccactgcactccagcctggatggcagagtgaggccctgtctctatagagaaaaaatctggtagaaatttaaactttaagaaaataaagtgagggaaaagaggaaggaaagaaggaatatttgcctggagaatctcaaggtcatcagaaaccagctaggcactctacccaacaaacattgttgattggtgaaaacgagtgtgagctgaagagtagaaagaaaatcagaaaagcagtaaacattagaggttcaaattgggacatgtaggatactgacctttgttctgttttcttcggcaaagccaggtgtgtctgtgtctggtgggtaagcaactgtgatgtagacattatatggcttcacctgcatttcaaaacaacacgtgtaccttcagtaaacaagacacactgaggtcctacactgccaacctgcactggctgccctgattcccaaaaagcggtgagaacaatggggtgattctgttaggcggggaactacaccaattgcattgagaaacccctctccatgatgattccagaatgtaggcaaaaagctcaccctaacctggaccccagaaaacagctggccctaaagtatggcaagtcacctcctttgcagtgtcttccactcctgctgcccagacagaggccctgggagccgtccgacgagggcagtgttttaaaaagagtccagttcccacacgcactgcacagcatccaagccctttatcaaggcaatgggaccagtctgcccctcctttcttcaccagactgtacatctgtttttccttcagactgcttctgatactcttgtgttgatttcatccacaaaatacattggggtcattaaaatctgctgccctatccctttcttgtgccctactccaaacccagtccagaactgtccctgagaagtctgcttattccagagctccctgtataaccggcctctgcacattaggaggtcaagagtcacttcctcctccactgaaccaacaagaaccactgggtagaacctccaagtcagaccagccaagtacctcccctgtggacaacctcaacctgcattcacatagggaaagccctctgccttatctgaaactctatgtggctcctctaaatctgacacttggagcaggttgttacacttgtgtgcctcaccaccatgcctgcacacttcacgcttcacgaccccactcatacacacacccccaacaattccagcagattcttctgctgttggccaggacaccccctcccacagactgctcagccacagccctgctgcacatgcttatcttgccctgctaattagcaactctaagagcaatggttcctaccatgaaaatctctttgccatgatttttatttggtattggctcacttttttgtccctaggaaacacctaagggatctggaagtggagaggcagctgatagatcagccactgcacatcttcagaagggtaccctaggctaaaaatcaacaccactgcctaatgtgacggcctttaagagtagcccaggggccgggggcagtggctcacacctgtaatcccaacattttgggaggccgaggggagggggtggatcacctgaggtcaggagttcgagaccagtctggctaacatggtgaaaccctgtctttagtaaacatgcaaaaattagctgggtgtggtggcgggtgcctataatcccaactacttgggaggctgaggcaggagaattgcttgagcccaggaggcggaagttgcagtgagttgagatcgtgccactgtactccagcctgggtgacaagagggagactccatcccaaaaaaaaaaacaacaaaaaaacaacaaaaaaataaaaacagtagcccagagtctcatcttatgcagccctttttcgccctggttccttcagtgaagcacagttttgagggctttaaggggagcttcaaggggaaggagaagcacgcacaggcctgcaagcagaagatccaggccagccatcctggaaagtgcagtcgtgaaagtgagatgtctttgtgggttccattccagcacaattagggtgtgggacagcccatccaccgggcattgccagggcatgcagcttcacggcccagccatgctcataaatagctctggatcggggccaggtagtaaggcagatgagccagaaactcgcttccacttgtttttgagatagtgacttataaaaaccttgtctcccccagccttgccctctgctgtgcatagaccagagaaaaacaccacaaaaaatccaacgagtggtcattaggcagcccacataaagactgacatcgactgcccagaaactcacgtctgtgctgcccctctgccttctctctcatggtaaagaaggatgctggctccaaagctaatggaagacaggatttcagagcagtgcttctcaaactcaaggttacggctgcattgccaaaggttaaaacagagcttttcagaacagcttcctcatgaggaaggaacacagatagctggggttgggagaaaccagtccagtcgcttcctagattggtattctcgctatgccatccaaccaaatgactctcccagtctctggctggatacctccagtggctagtcacctcaccatttacatattattttatttattcatgcaacaacgagcacttactgaattacttctacatgccagtatcgttctaagaacaaagcataaggttaagattctagtttcctgaaactcttggtcaaataatttgctaaaatctgaatatactaaaccacatctacatcttcttttaatctaccaatctcataaccctgtcataaaaaaaaatgagggtaggctggctttacttgttcttatgagacaatgctagctccctgagatcaccactctttctaagaatggatgagccaggtcctcactaactgagtcccctgctgcccggccactgcttctcctcatccctgttgcctgaccattctctgtgcccccgactctgccccacatccatcctactattacttcttcccttctccctggcctcaacctcaaacagaaagacaactgaccacttgttcaagaaccgatttgtgggccgggtgcagtggctcacatatgtaatcccagcactttgggaggccgaggcaggcagatcacctgagttcaagaccagcctggccaacatggtgaaaccccatctctactaaaaatacaaaaattagccgggcatggtggtgggcacctgtaatcccacccacttgggaggctgagccaggagaatcgcttgaaccagggaggcagaggtttcagtgaaccgagatcacacaactgcactccagcctgggccacagagtgagactccatctcaaaaaaaaaaaaaaaaaaaaaaaagaacagatttgttattaaaataatccacataggatgtgctgttccctattccatcaaaacaaagacaggggatgctggaaagaagatcacagctgtttacatgaaactccagaattcaagctttagcttactttcagaccacagaaggaagagatgggaggagaggggcatgatcagggtaagaaaagcagaaaagggagcatcagtttgttttttttgggcttggtctctgctaccacatctttagctataacccacctcagaagtctgctttccaaaagagtaacttttaaaatctttacctttcttcctaaaagactgagtaaaaaaaaaagactaaaaaatgccaacaaagcattcttttaaaattactcatagtacccttaacaatgccagggtcctaccttagtttgggggcaaagggaggtggacagggagacttcaaagttaattaaaccaaagaattgtcaaaaatatttacaggccagacacagtggctcacacctcctgtaatcccagaactttgggaggccaaggcaggtggatcacctgagtccaggagatcaagaccagcccaggcaacatagcgagcgagaccccatgtctacaaaaaataaataaataaaaaataaacaaaaaaacggtgaggcatggtagtacacacttgtagtcccagctacttgggaggctgaggtgggaggactgcttgggcccaggaagtggaggctacagtgagccaagatcaaaccactgcactccagcctcggcaacaaagcaagactctgtcttcagaaaataaaaattaaaaaaaaaaaaaaaagtatctggagtttgagcaattacataagatttcattgacagaaaacacacctaccttgaccaaattatccaggtttcaaaaaaaatgctactataattactgtagggacacaataattggtttgatgcaagttctactacgaacaaactacattttgatgactgcgttcgttttccccagaacctatttttcatgggataagttcattttattttcttttttttaagtgagggtatttttaatagagtccaaataaggacagaagtcatacagacttgagcgtgcaggccggctactcgcagtatgcaaatcacacttgtcacagaggttggggggctctgtctgtaccagcaatccactttctttttcctcttttttagcatctctgttctacttgaagtgaaaccaggccacccagattatatactttgctctaaattagtgaatgctgacacagctctgcaaaaagccctaatgggcagattcttcatcccgcaaccaccccttcacctacaaggattctaaaaccaaagtaaagggccggggcaactagccaggtgaagcaactagctggatgcatcatctgctgcaaaagggcagcagacctggggtcaaggcttggatcgtgttgtgatttctgtcactaagtaactatgtgactttgagcaacacactgaatttactgaaaactgggttttcctctcatcaggtggcatcacaacatctccctcacatactttacaaaactttataaaatggtggctgggtgtgctggctcacacctgtaatcccagcactttgggaggctaaagccagaagattgtttgagcttaggcgtttgagaccagctttggcaacacagtgagaccccttctctacaaaaaattttaaaaattagccaggcatggtagtgtgcacttgtggtcttagctacttgggaggctgagacaggaggatcacttgagccaaggagctcagggctgcagtgagctatgattgtgccactgcgctccagcctgggcaacaaagagagacgctgtctctaaaaaaaaataataaaataaaaataaataaaacagttattcacaaaaggacttttcaaagttaaaaacttcaaaagaaacaccagtattcttgtttgaaatttcacagacatcagtgtcctattggctaagcatattatcacgatatattattaagagtattaggccagttgataacaataaaatctgtggctggttcctatggtatgagaatggcatgatctatcagtccctacgcggcacatcaggactgtcgctgtcccagcagctcatctgtactgcaacgctcgtcccatatctcaccaatgtggtgctctatcacacaccatcaaggtctcttatggggtcttctaaacaggggtcagcaaattatggcctatgagccagatctggccctctgcctgttttttataagtaaagttttattggaacacagtgacaattgttcatttacacattgtctagtaaggctgctttcctgctatcatagcctacttaagtagctgtattaggcaccattcagcctttaaaacctaacatatatactgtctgccctttggtgaaagttctgtcaacccctgatctaaatcatcaaccaggattcccaaaagcacactcttactataagagggttggccacagtgaatactcttctgggctcttaacattttaggcatccactgggggtcttagctcacatcccttgcggataagaggggatgactgtacacagcaatagaaagaactttcccttgcctttttcagcatgtgatttttgggtagatacgtatgtgatgctctctaagcattcctgtgtgacaataatgtggaagtcggcttcaagcagctgaggtgtaaagttgcactcatcatgacagacgctattttgatgcaaatcctaactacatccttcttccacaaaatgttccattaactatgtaaataaaaagcattcattttcccaacaattctttaagatataaaaatataaatattgggagagtcaaattattgctttattccaaccctcccattttacagatgaggaaactgagagcaagttaaatgacttgtctaaaagctaaaaattagcagctgattcaagctcttccctcaaacatatactaatttcacgtattattcagtcataaggacaaacttcttgttaaagaaaaatctctataaaataaaatatctggttaaccttactcacattcacacagtattagactaataacactatgaagatatcactaatattttgtgtattaagttaaacaagcaaaaatcccattaccattttgcatctgtcgttaactatagtcttcatgcaatgaaaaatgttaactgcaaaactcagggttgagccaattctctttcaccaatgtcaaacctaaaaatctctaatttaatacaacaacacatgtaaagaagctataaaactaaagcggaatgtatattgctgagcggagaggaataaatacaaaaatgaatacaacttttacctccatctgcaaagcttctgccaatccccttatggcaaacttggatgcagagtaggctgtgaaaccgaataatcccaactgtcctgcctgggaggacacaaacacgatcctgcccacccggcgctccttcatggtggtgatcacggcccggctggggtacacgctgcccaggtaattgatgctcattaacctctgcagggaacaaagaggccacatgaggtcaaaagcctcaaggctgtgcacatggagaatttagtctgctttctggatttcagttcttcaatgcaagctcaagtgactgggaagcccaacaggcttgctgaatgaatgaatgatgacatgatgatataaatgaaatgtgatttgagacctagcatttgaagactcaggacctaccatttgaagactgtttcagtctagtcttgcattctgaccatgacagcagttaatgtttttcctgaaaactggtcaaagttagttttctccttataaaaagtatactgcatgtttgtgggtagtactttctgaaagacagttttaggaaagaggttccaagtatttgtagccctattagttctaagctataagaaaaacacagagtaggagggtgatttaaagttttggtttcaagccttgggtctcccatttattgcctatttgatgatgaataagaaagtcagacattctacttattttcttggctgtaaacaaggtcaacaagggtatgaccgcatagggctgttgcaaagattaaaagagaaaacacaagcgctagcacagtcctggacctcaagaaccactggctctcccattatgatgggtaagagtactaatagtgtattttctccttgtcttggaagcttttaatttttatttatttattttttgcttttttactattatcattttttttagagacggggtctcactctgtcacccaggctgaagtgcaatggtgcaaccttggcttactgcagtctcaatctcctgggctcaagcaatcctcctgcctcagcctcttgaggacctgggactacaggcacatgccaccacgtccagctaatttttgtattttttgtagtaacagggtccttttattttgcctaggctggtcttgaactcctgggctccagcagtactcctgccttgacctcccaaagtgatgggattacaggcatgagccactgcgcctagcctgagctcttaaaaaccttaaattttaactcgaaaatttaataatacttgcattaaaatgtttcaaatattcaaatatttgtaaaaatattagatcatcatgtaaataaaaactaaatacctcaattgtggaacttgagatcaatcataattttttttcatattatgaacagaacatgaacatacaatcataatatcttaattcaagagaatattagatttttttattgttgtttgtttgtatttgtttgaaatggagttttgctcttgtcacccaggctggagtacagtggtgtgatcttggctcactgtaacctctgcctcctgggttcaagcgattctcctgcctcagcctcccaagtagctgggattacaggcgccagccaccatgcctagctaattttttgtatttttagtagagatagggtttcgccatgttgggcaggctggtctcgaactcctgacctcaagtgatctgcctgcctcggcctcccaaagtgttgggattacaggtgtgagccactgtacttggcctagataattgttttaaatgatgaccagaaacactgggagtgacagggaaaaatatctatgctatttaagtttaaaaagcagaagctagactgtatatatgctgtaactgtaattacttcaaaggttaagtaaaagtacacatgctcagagggaagaccaaggaaatacagaagatcataagtgactgagttaggatgctgggattctcttttttttccaaaagtgtgttttcgtaacataatattgttttgataataaaaaatgttctaagccgggcacggtggctcatgcctgtaatcccagcactttgggaggccaaggtaggtggattacctgaggtcaggagttcgagaccagcgtgaccaacatggtgaaaacccgactctactaaaaatacaaaaaaaaaaaaaaaaaaattagccaggcatagtggtgggcaactgtaatcccagctactcgggaggctgaggcaggagaattgcttgagcctgggaagtggaggctgcagtgacccgagattgagccactgcactccagcctgggtgacagagtaagactccgtctccaaaaaaaaaagaaagttctaaaagaatatctgaaaaaagacgtcacactgaacgcctgtgtttactttggctccctttagaaaccttactaaaatctccgtaaagagatgttttttaaggcaagaacacacaagaacaaagaaaataagaataaaaataacagcaataaccttttggaagctgaagaacaggttgaggagggataactaacttagcagaccacaaaaaactaaatgctaagcggggagtggagaaactaaaaagccagattctactacagaaccccaaaaggctccagctgcaagagtctctggggtggagggaagggtgggctggcatggggctgagacaggagtagggactaagagtctatttaataagcagtcagctagacacagcccaaatggccatcgatgatgaatagctaaacagaatgtggtcgatccatacaaaggaatatcaccaccctataaaaaggaatgaggcacccatatatgctacatgtggatgagcctcaaaaactgatgctaagagaaagaggtcagacacagaagtgcacatatcatgattccaatcatacgaaatgaccagagacagaatacagattggtggttgtcagagattgggtgtgggggtgagcagggatggggagcaactgcttaccaggtgagggccgccctatgggtgatgcatatgctttagaactaggcggagggggtgggtgcacctcattgtgaatatgctgaatccctctgcatggctcactttaaaaacagttaattttatgttatatgaatttcacttcaaattaaaaaaataatgtaggacaatgaaaaaaaaaggcagttagatcttagatgtttttcccctctccacagggtagatctgtacccctcttccagcctggcaggagactggaggttctgtttctagggatagtaagtctagataaagagagaggtttaagggaaagtctgtctagacggcgcacacgaagacaccaacacactccccagcttcatcctcacaggaggctggaggacactccgcttgagcccgggaggcagaggttgcagtgagccgagatcgtgccactgtactccagcctcagcgacagagcaagactctgtctcaaaaaaaaggaagaaaaagattgttgatgcgatggcaactaaaaaacgttttccattttaaaaacatttcaggccgggcctggtggctcatgcctgtactcccagcactttgggaggtagaggtgggccagtcacctgaggtcaggagtttgagaccagccgggccaacgtggcgtaaacccatctctactaaaataaaaaaaattagctgggtgtggtgacatgtgcctgtaatcccagctactagggaggctgaagcaggagaatcacttgaacttgagaggtggaggttgcagtgagctgagatcacgccactgcactccagcctgagtgacagagtgaaattccatctcaaaaaaagaaaaaataaaaatttcaaatctagtgttcatttctttggtgctgaaataaattaccaagagaagttccttggtaaacctgattaaaaatagaaacatcaataagatgcagtatctttttatcttgatttgagaactctagtgagtctgtccttcaacttttttggtttctccttgttaataatactgatgtttgataggaacatccggcatctcttaggttacaaagtgttctcttgaaaatatgacctcagtgaactgctacagtaatctgtgtcagattagaaggtccattcccattttagctggttttctcagctgtaaaatgtctaaactcttaagcttcaatggtcctgacactgggatgaaaaccttgttcagcttcaccttgttcagccttcctctagagtcttctaaagcttccatggacatctgaatgcattcatctaattgattcttaaagcttttacccgtagcttgctctgcttttagcatatgtgctactgcagtgagcaaacatttttacttacttcaaaggtactaacttcaagatcttcaaattttcctgacactgccattcctgcacaatttaccagcatgtccactggacccagtttctcctgtgcctagaaaaatgtagcagagcaggcattaagaaacagagaagaaaaaccactcagcagcaaatccatgctgataaataaaatttacaaaactattaaacctatagagaagttgtgtccattccaagccacatagcaaaatggcaagaacaaatcaaaagtcaagcacattggtgaattccaattagcccaacctcttacttgttttatgacattctctacttggttatagtcttgagatacatcaactgatatgcaaagcaccacctgttaaaaaagaaaaaaagtgatcaaagttttgcaggtaccaaactatttcttaaagatattttttaaagaaaagacagttcattgaatacagaaggaagccaatattgaatgaacagatttcagtgtttgctgatgatgcaattagcagaatctaattttcttggcagcttttggagttaaaactctgaggaatctttttaaaaatatataaatgctcctcttgaaatgccactaatctatagtgacagaaggcagatcaggggttgcccacagccaggcatggaggatggaaggaactgtgaaagggcacaggccaaccctagggagtgatggaaatattccatataagggcctcagtgctgattcctttcaagaaggaatcctgtccaaatgatcaaaattcctaagaaaaggaaacagccctctttgcaaatataacctgcagcattctagtctagaggggttgcccttggttgtaatgtatacctagagtggattttatcccaacatcctcagatagaaaacattgttttaaaggtagtagtaatcggccaggcgcggtggctcacgcctataatcccagcactttgggaggccgaggcaggtagatcatttgaggtcaggagtttgagaccagcctggcctacatggtgaaaccctgtctctactaaaaatacaaaaaattagcctggcgtggtggtgggcacttataatcccagctactcaggagactgaggcaggagaattgcttgaccctgggagatagaggctgcagtcagctgagatcatgccattgcacaccagcgtgggcaacagagtgagactccgtctcaaaaaaaaaaaaaggcagtagtaatcatatgattaattttaaaacaagccttttcatgcagtattagatcagttactaataataaaatctatgccacagacaagtgaaatctcagaacaaaaaaatgttaacaagtcacacacacacacaaaaggtccctagaagcctggcagggcagaaggatcaagctcattctcgcctgccccagccctatctcccttccttgatgtgaaaggtaagttttccacctgacctaaagtcctttggtagatgaagaggtagaaggtgtcatgatgaggaagcccagagcggagacagtgttggcagcaggcaagactggccttggccctgaacactgactccatgacttcacaccatactccttcgtctatcagatattacaggaatacgggaaaaaacggggcaatttacagagctggtgtttttccaatgcttgtgggcttcagagaagggggtaaagaccacagtcttagagaaaaactcacatgtgcagaagatatacacaaggatttttacttgcagcacagactgcaattgcaaaaataaaaatacaaaataaaataaaaagaatggaaacagctcaatagcagggacctgacggaataagctctggtgtacttcaatcctaggctgcagcaatttaaggcaaatttacttaatgcacatggaaagatctctaacattctagaagggaaaaagtcaatgaataccacagtgaaatactattcaaaactcatcagaaaggcaaaaagtaaaaagtctgtcaataccaagtattggcagggatgtggcgcaacagaaaccgcattcctacttatgggagcttaaccactttggtgaggttgaagaactgcatacactacagctctgcaattccatttctgggtatgtaccattcttgcacacgtgcacaaagagaatactgaaagcttttctaatagtaaaaaacaaaacaaactaacaaaaatactgggaacaaactaaatatccaccaattgctgaactgatgaacaaaatgtagtctatacatacaatagaatactacgcagcagtaaaaaaaaaaaaatttactccaactttttgcagcaacataaatgaatttttaaaattatatatatatatacacatatatatacatacatacatacatacatatatatatatatatatatatatttttttttgagatggagtctccctctgttacccaggctggagtacagcggtgcaatctctgctcacctcaagctttgcctcccagatccaagtgattctcctgcctcagcctccctcctgagtagctggggttacaggtgcagctaactttttatatttttagtagagacagggtttcaccactttgtccaggctgatctcaaacacctaccttcaactgatttgcccgtctcggcctctcaaaatgttgggattacaggcatgagccaccgcacctggcctaaagaataatattgagtggtctgggaatggtggctcacacctgtaatcccagcactttcagaggctgaggcgggcggatcacgaggttgggagttcgagaccagcctgatcaacatggtgaaaccctgtctctactaaaaatacaaaaattagctgggcgtagtgacgcgcgcctgtaatcccaactacccaggaagctgaggcttgaacccaggaggcagaggttgcagtgagctgagattgtgccactgcactccagactgggcaacagagcgagactccatctcaaaaataaataaataaataagaaataaataataataatattgagtgaagaaatcaagttgcataagaagcataaagaaggaagttatacaaatctatagagaaagaaagtagatgagtgactgcctagctgagaagaggctgggaggaaatggcaagtgactgctaatacacatggagattcttcacggggtgaggaaaacattctaaaattgattttgatgacagttgcacaactctatgaatacattaaaaatcattgaattatatattttaaatgggtcaactgtatggtatataaattatatctcataaagctgttaaaaaataagaatgatataataaaagaagtagaactaagtatattggccaggcatggtggctcacgcccataatcacaggactttgggaggccaaggcaggcagatcacctgaggtcaggagtttgagactagcctgacaaacatggtaaaaccctgtctctactaaaaatacaaaaaaaattagccgggtgtggtggcacacacctgtaatcccagctactcaggaggctgaggcaggagaatcgcttgaacccgagaggtggaggttgcagtgagccaagatggcaccactgcactccagcctgggtgacagagagagactctgtctcaaaaaaaaaaaaaaaaaagaactaaacaatatattattatttagagttatgtgcatatatggtaaaattaaaaagaaaaagaggcagggcacagtggctcactcctataataccagcactttgggaggcagaggtaggcggactgcttgagcccaggagttgaagaccagcctgggcaacatggcgaaaccccatctctaccaaaaatacaaaaattagccatgcatgatggcacgtgtctataatctcagctactagggaggctgaggtgggaggactgcttgagcccaggaggtcgaggctgcagtgagctgagatcgcacccctgcactccagcctggatgacagattgagacactgcctcaaaaaaaaaaaaaaaaaaaaaaaggaaagaaaaaagaaaagaaaaagaaaggattaacaccaaaaatcgggttggcatttgcccctctaggaacaagaaaagagggacaaggctgctgtgggggcttcagagaccctgatcatttctacttcttaggctgggtgatgggtgtgtgattattaatttgctattatgttttatactgaaatataaatagcattttattcatcaaaaattccataaccaaataaattttaaatattcctttcctcttaagcatttgtataaagttcattaaaaaaaaaattaaaatgaaattatttgccagtaaaacattctgttatttgaccatttgtagatatgaatgtgtgtgggagtctattcattttgcgtgtgtgtgatattctgagttactagaccattcaaacaattccaccttttaaaaaacagtacatatatgctttcaattaactattcacaggtgaagtaactctgtttttcctttatacagctgtgctgagttatacagaaaatgcattctgaagacagagatttacctgtttgtcattaatagagtgcatttcaatttctttctttgcctgcagcagcttatcctgaaagcaatacagaataattagtcgtgatgaccgtctatatgcatgtccgtttattgcaaaggagagaaaaaaagcaattatttctatatgtatgtattaaattccagaaaacacacaaaacagtatctacattgcatagacagactgggccacagcctatgaaagaaagaagttgtgaagtatgttaagctatgaataagtgataaaagtttgaaaattaattagagaaagatagtagaaaacagataaacctcaaaatcccagttaacagtactaattgctgaggctgactctacagttctaataaatgtcttattatttagttgtgatataagacaagaacaactctattaatatgtactgctccccaaagttgagggtatgtgtgactccctgtcaatactgctttttgtccaatattttcttcttctactataaacccaaacatagtaagaatcactttctggatagactgggtaaactaggcctggctactataaaatactcttaagcaaggttacctgtgtaattatgtaattcttccaaggtcctaattttgtttgttttacttagtctcaagaaaacagatatcagattatcttaatttgctgtaaaaagtaacttaaataatatcatgcaatagagaggaaccaaaggagaggcgaattcttccaaaaggcatgcagagtttctaaacctgaatatgtctataatgaaataatattgtcctatgactaaagatacatacagcttgactttgcaaagactggaattaaaaattacattagaaaagaaagaatttctcagccaggcatggtggctcacccctgtaatcccagcactttgggaggccaaggtgagtggatcacccaagctcaggagtttgagaccagcctgggcaacatggtgaagccccgtctctaccaaaaatacaaaaacttagccaagcatggtggcgagcacctgtggtcccagatactcaagaggctgaagtgagaggattggttgagcctgggaggcggaggttgcagtgagccgagattgtgtcactgcactccagcctgggtgacacagtgaggccgggcgcagtggctcacgcctgtaagcccagcactttgggaggccgaggtgggtggatcacttaaggtcaggagtttgagaccagcctggccaacatagtaaaaccctgtctctactaaaaaaaaaatatatatatatataaaatatataatatatataataaaaatatatattttatatatatgtaaatatatatacacacacacacacacacaaatcagccaggtgtggttacacacacctgtaatcccaggtattccggaggtggaggttgcagtgagccaagacagcgccactgcacaccagcctgggttacagagcaaaactccgtctcaaaaaaaaaaaaaaaaaaaaaaaaaaaagaatgaattactcaacaccacaggttcttcattcagttcattcatttctagcaatgcaagggccccatatgagctcctgggggcctgaaatgctggccttctctgcctccacttttatttacttgcatcaaaactggtgtttaaaactcacaaaatgccatttcatcaaatttgtgttttcatttatgtaaggtggcttcaatgccaaagcaaattcattgttagaaaagtcaagctataaataaaaggtagctaattttgtctttcttggtttgcaaaagaagttatagacgtccaggccaggtgtggtggctcacacctgtaatcccagcactttgggaggccaaggcgggcggatcacaaggtcaggagttccagaccagcctgaccaacatggtgaaaccctgtctctactaaaaatacaaaaattagccaggcgtggtggtgggcgcctgtagtcccagctactcaggaagctaaggcaggagaatcacttgaacccaggaggcagaggttgcagtgagccgagatcatgccactgcactccagcctgggcaacagagtgagatgctgtctcaagaaaaaagaaaaaaataaaagaaattatagaggtccaagactaagtctgcgacattatttaaattttcccccaaggcccttcctggcctaccattcctaatgggtcctgtccagccctccacccatttgaggagttaccatactatcaccctccttgcacatgggtgaatccaagatccccatggaagtatgccatgctgacattcccaggcactccatcattcctcccttcatttcttcattcaacaaacatgtctgagcatgtactacgtgtcaagcactagaattgctgcagcggacgagccagctgtgtggtcactttcctccagtccccatatggggagcaagaggacgtcatgacagttcacgtgcacagtgtcactgctttgtgctctaaaaacaactttggcaagacaaaaacaaaccctgacaaaaaataaaaacagattctgtgttgacttaatacagaaaaacacattttgctaaacttctaaggagggacgaggttcctctatggtgtatagatttcactagagatatatatcatgtcctaagcaaatcgtagtgaaaaattatagagaaacacctacacaccttcaggtatcagctccagaatcactgcttccagcacttctgacctggccaagggccctccctggcttccaatggccaggtgtgctccttcaactagaccttggcctctcccatctcaggatctgcagtatctatgatgatgttgcctaatatgccaatggtactaaataaatacttgtggggccgacctgatttcaacagagaagtgtttggcctaaatactagagagaatcagtagttcaggaaacacatctcacatcaaggaagaagcgctttctaggtgtgaatgctaagatgtttagcacagcctctttgactaatttcaagtcgaagaagcaagtcagtaataatgaacctagaagccttacctcatttcgtgcaaccagagttataaaagctccttgtttatagcactcgatagcaatgcacttcccgatgccactggaacctcctgtaacctaaaacaaaatcataaaatattcttagcacttgaaatctcccctctgtaggaagtttttataaaaaacaactatgacaggctcttaaaatgaatctacaagaactaaatgattagctgttgttaacttcttcatcccaaacttaatgactggagtaagtgtaagcatgaaagatactatcagcaaggcctgctgctttgactgttttcttatggaaccataaattgcacacctataatatttttctgagttcactggtggaaaagtgccctataagtctagctcataaataatacattagtctgcctctgattccaaatccaaatgaatcttattttctttttttttttcttttttttttttttattatactctaagttttagggtacatgtgcacattgtgcaggttagttacatatgtatacatgtgccatgctggtgcactgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttgaatcttattttcttaatgcacatttatgcaagattagctctacaacagatgaaaagaatggccacctgaatatttatttgaaatgactgcttagtataaaagtaatatacaatcacaaggaaatcctgaaaagtaaagctcttcttgcactattctacccctatctacagttcagctatactggctttcaattatggaattattcctaatattcactgttatacataaatcatgctgggaggaagatctctgactccatgttaggattttaacatcattgggaagtgtctcctacgcaaatgcacctatctctatgggactcataggcatcccttacttctttttagcttcaacctgccaccactgaagagatttatttggtgggtaatcagccagttatcagcagaagattactgtaaaaaccctccaaccacagtaccttggcacatcctacttcccttgcaacgaatgctcttctccccacttcatctgacacctactcgcccatcaaatctcagctcaaataccacttcctcaggaaagccttcactgtctcccctgcccccacactgacacacttttcagcactgtatttcttctttatgacatgcacataataaacagctctagatttatttgtgtgattatctgattcacaaccacctctcctatcacctacccataaactccattaaaaataccaattatttttctgttctccactatattcctagcacttagcctggggagggctcaatatatattatatatttcactgaataagtgaacaatgcaacattatttttctttttttttttttgagacagtcttgctcagtcacccaggctggagtgcagtggcacgatctcagctcactgcaacctccgcctcccaggttcaagcgattctcttgtctcagacacccaagtagtggggattacaggcgtgcgccagcacgcccaactaatttttgtatttttagtagagatggggtttcaccatgttggccaggctggtctcgaactcctgacctcaagttatgcactctccttgacctcccaaagtgctgggattataggagtgagccactgtacccggccatatcgttctagtcactgtccctatgcaaattacataatattgcatagtattgtctcctgtttttaaaaaattatattgtaatgtcttatttgtcaaaaaacgaaaaggtttcacaatacttcatcaaatagctgcatcaaaacttcaacgtttccctataaccagacatttagatttttcctaatattcactgttatacataaatcatgctgggaggaagatctctgactccatgttaggattttaacatcattgggaagtgtctcctacgcaaatgcacctacctctatgggactcataggcatcccttacttctttttagcttcaacctgccaccactgaagagatttatttggtcggtaatcagccagttatcagcagattactgtaaaaatatagctgttgttggccgggcgcgatggctcgcgcctgtaatcccagcactttcggaggctgaggtgggtgattttctgcttttttcctgcaattttactaccgtaactagatagaaaacactagtatataaaattgttttaaaaatgaaacaattgttataagtttgttcttaattatgtatgggcagacagtttaaccatcagctccctctcccaacaataccacagtcaactcctaacaaatctcaagaacaattacacttttcactcttcttatgacattaaaaaagaagacagatggtgacaccatgtgaactattcatgtcattctcacattacttagagtgtgaaataataatcctgcgtattaaagcgggatggtaaaaataaattcttcttggtccacctgaacagacacagcatttattatctcacctatgacctgccgcgggatggggctggaaggactggagtcaaggctcagtgaaactgtcttacaaataaggaattccaattttcattctgcgtttagctttagtttttgcaaagttatgctctataaactcaagctctgaaaggatccaaggtttaaagccacgcttttgaggcagcagttctcttgcggatgtaaaactttcagaatttagagtgtcaagttttgcctttctcttatttattttttgtaatgaatccacactctttccccattaggaacaggaggtgttggaaaaagctaatagctttacaaaggagaaattaaacagatacattttctcattcacaaacccttgtacagatttaaagcatactaagaaaaacgaccatcttattttataccagctcagcggggaggctcggatctccggtgcagagataggacaggaagaggtgtgcggccaattttgtaaccaaccctccttactcctaactcctcgcctcactgtgcctcgggtttgggagatccaaacgagaatgctcgtgagaaagccactgcaaacgggaaagtgctgggcgcaggcaaggaggcattctctctgtttaagaaaggtgccacatttgcagaacagggatcgctgaatatgcgagcttccgccaagaaataaatcacacctatccacctctccttcattcctcgcacacaagccttgtcgtttagctcatccttcccactagaaaacagcaaaggattgcattggagcagcaatcagcagatgccacgctgagctcagagacaagcagtgtagacgggacaggcgtcccaataccgctaagccaccaccgccagcccgctgggttctgagcagtttccccaggtgagtcacttcctggaatcctctggcagcggctcttcccgtcactcgcacaggccatcttccagttccgagctgcctcggcgggtcccggcggctgggaccccacttccccgctgtctgcccccgcccggggccgcgcgccgcaccctgcacaccaccgaccgctgtgtccttggcaaagtttctcagcctctctgtgcctcagttgactcatcggaaaaactgaggacaaaacatccacatcccagggatgttgcatggattcacgagcagccacagaacccctggggccccgggaaccctgcggccggcggggtcccccgtcgcacgctctccggccctaggaggagcccgaggctgcggagggcgggtccgcgaggccgggtgccggggccgggggaaaagcgccggggtggacggcggcaggtgaccttccccatttggccatgccttcctggggaccgcggcctggaaaaagggacgtaggctacgcggcctcggcggcggaaaggccgcgcgggccggtaagtcggggggcagcaacaggaggccactcaccaccacatgcgccccgggcagggcgaggggcttggggctgatgagcggagacaccatgtacagcagcagcacgaaggccacgaggaaggcggcagccagcagcagcatcgctccgcggggccaggggcccggagcggccgggcgggggccgccgggcaaggcgcgcagggctgggctgcggcgaggcgagaatcacgcgcggcgggcgggcgcctggagtgtttgggtttgcgggccggggcgggccgcggcggaggggaagaggaggagccggcgcgcgcgccacccaggcggggcggtgcttccagggggcgagtaggccgccaccgccaccgccaccgccaccactgccagaatcgcctctcgggggtcgccgggtgtctcccactcccccggcctcgggacggggcccgcagtccgcagcctctcccgtggaaaccgggcctcccgtccctgtgcgtcgcgagcgggctccggacagcgccagatgcgagcgcgccgggaagggctgcgaagactcgctcttcgggagctcgaatggcttcttaggaccccgcagggcgggtttccaggcctgccacggcctccagtgtgggcgtgacgagcgctcctccctggagttcagccctcggcttgggactgcccgctgggttgctcggaggccccggagcatcggaaagggcggctggaggctcccggagcgggctcagcctgggagcccagcgactacgctctgaaatcccgggctccattccatattttttggcgtttttagaagatggtcacggcccactttcgcttttcagaggaccggaaagccttaacagggagttttgaggaatcactaaggtaattcaatttcattgagttcagagttcatctttaccaagcaggttcaaaacaaataaataacgcaaacaactcagctttattaaggtctcattcacgtactataccatacaattcccgatttaacgtgcgtaataggccgggcgaggtagctcgcgcctgtaatccccgacctttgggaggctgaggcgggcggatctcttcaggtctggagttcgagaccagcctggccatgatggtgaaacccccgtctctactaaaaatacaaaaaatcacccgggcatggtggcgtatgcttgtaatcccagctaccctggaggctgaggcaggagaatcgcttgaacccgggaggcagagattgcggtgagatcgcgccactgcactccagcctgggtgacagatcaagactccgtctcaaaaataaataaataaataaagcttataataaattgtctttaatatagtcacagttgtagacccatcactaccataaattttagaacatttttgtcacaaccccccaaaatcctatactcattggcagtcacgacccatttcctcccaagccccgcccaagcctaagcaatccctcatgtttctgtctctataatcttgcctattcgggatatttcacataaatggaatcatataatatgtagcctttttcatcctatctttcacttactgtaatgttttcaaggttcatccatgatatgaagtactacatgttaatacttcatttatttttattgccaaataatatcccattgtatgactatacgacattttaattttccattcatcaattgaggaatatttaggttgtttccactttttgactattagaattatgctaactgtaaatattcatttaccggtttttgtgtgggcattatgtttcatttctcttgggtacatgcctagtaggggagttgctacatcttacggcaactctatgtttaactatttgaggaattgccagaagttttccaaagtgagtacaacattttgtgttcccaccagcagtgtatgtgggttccaatttctctacatcttcactaacagttgttatcatccgtctttctgattatagcttttttagttggtgtgaagtctcattgtgattttaatttgcatagaggcacatatttttgtttgcttacttgcttttcatttttgttgttgtttctagaaatactagggagcgaaggagaaaaaaaagtttttcttttcctttttttcttgacttacagcagttagccaaactgcaaaatttgaaggcataatgtccaagacttctgatatcaatgcaagtttagaggttcctgaaccaccctcaggtttgatcattcactggaaggactcacagaactcactgaaagccattatgctcatagttatggtttattatggggaaagaatacagatcaaagtcagctaaggaaagaaatgcctaaggcagagtctggagggctccaaatgcaaagctcctgttgtcatctcccacggagtcaggctgtgttaccttcccagcattggtatgtgacagtatgcttggagtattgtcaaccagggacacttgtctgagcttctgtgtccagagtttttactgggactccagcacataggcttgatcaattgtccacttggttggactgagactccaactagactgatagtgcatgacaaaagccccctaattcacatacttggtctctctggaatggccagtctccaccctaaaatccagtttgcccagtccccatctaaacagaggtactcctatcaggtatgacgtagataacctcccataagccaagggcaaaagtcaaaccttctctttgggcaagactgaatcctttacaacacggctgccacctggcctttggccaaagctctcttacagtaaaatgaacatatatctgacatttggaggagccagtgtagagtaggaggcttttaactcaatttctcaatacattggccatcagtgtgaacattaaaacctcacttacaatcccagagttacactgtattatgatatggtagtaaacataatttgaaaaattagagtcaaaagatagtggcagatagatataagacttccactctgccatcaacaactggtccagttcatcatcatattgtatgaccaaaatgtctcccagagaaatgccactcaggcttgaaagttcccatctgatgctatcagtttccaaaaacagaagtggccttcaccctttaggtaccagactgtctttttaacatgttttgtccaccaagtatcctatagtttttaatattaacaacttgtgtgggctcagcaatcttactggttcccatttagcatgtccaatcaatattgtctgaagggcagggccacctgtcttgtgttttacattactaggtaaaggaaattttcctcaggcaatatccatccccatagtacattcatgtaaaggggatgcaaccactccaaatagagtctcttcagacattccagtttctatccaaactttcattttaatcccatcaaatgtattttcatatctttccaatctgttgccttggttagaatttcactaacagaaaaacagtgcatggggctcccatgtcaaagaattttagaaatgtttcttttccacccctgacaatttacccattcacgtacatttggtcttggaccccagccagagattaggccaatgggcctaggttctttcttcagtttttgtttgttttgttttgtttgtgtgtgtgtgtgtgacagagtctcgctctgttgcccaggctggagtgcagtggcatgatctcggctcactgcaacctctgcctcctgggttcaggcaattctcctgcctcagcctcctgagaagctgggattataagcatgcaccaccatgcctggctaatttttgtatttcagtagagatggggtttcaccatgttggccaggctggtctcaaactcctgacctcaggtgatccacccacctcggcctcccaaagtgctgggattacaggcataagctacctgcccggcctttcttcagttcttaccttgactactttgcatatcttcaccccaggtgattggaagtcaggtttcttacagtcatctttgctttgcagcttttaaaatttatccaaactaggttgaataaagtggatttgtttagcgcccttcaatgttgggggactagtaagggtttccatttgtccatccaacttctgagagtgctgcattaagacttttgtttcaacaccaccaatgcccactttatttatgatatctcttaataactatttttaaatttctatccattctctctcccttttctctttccttagtctcttggaataagtctgctctctgttgttttagcataacttttccctttggaggtggccctgaactagcagctatggctcaatggctagaattccagcttggcccagcatcaggttctgccccaacactatccctataatttagtgattacagataataacaatcaagagattccatgttcagctttctgacgttgttgttcctttgcatttattttggcctccagtgagccaattctctatgaatgagaccccatgatatctaaattccattggtaaatttacttcaagtaagataagtaaaccctatgactacctgggatttatttcaaggatgcaagactgtttcaatatttcaaattcaatcagtataatctatcatattaacaggtgaaagaaggaaaatcacatgatcatacatcaatcaatgtagaaaaggcatttgacaaaatttgacacccattcataattaaaattctcagaaatataagaatatagaggaacttcctcaactttatgaagaacatctgtagaaaaacctacagctaatggtgaaatactgaatgcttcctccataagatcaaggacaaagctaagaaacttgctctcatcattctcattcaacagtcctagaagttctagatcaataaggcaagaaataataaggctagaaaaggaagtaaacatcatacagatcagaaagtaataagtaaaacgactcctacttgcagatggcatgattgattatgcagaaaatccctaagaatcttgaaaaaagaaaaacacctagtagaatttaagcatctccagaaaatttgcataatacaaaaataaaagaatatacaaaaataaaatgcatttttatatactagccatgaacttgtggacactacaattaaaaatatgatttcatttataatttctgaaagaaatgaaataggtgtaatctaacaaaacatgtacaggacttgcatgttgaaaactgtgcaatgctgatgaaagaaatcaaagatctaaataaactgacatactatgttcatgaattagaagactctgtataataaagatgtcaatttttttccaaactgatatattattttaatgcactgcctattcaaactatagcaatatttttgtaaacatagacaagattactataaaatttatatgtaaaggcaaagaaattaaaatagtgaaaacattttttaaaagcagaataaagtggaagtaatcaatctacctgctttcacgactgattatatagctacagcaatgaaaactgtgtggtactggcggaaaggcagacacatagatcaacaggccccaaaaataaacccacaaaaatacacctaactgatttttgacaaaagtgcaaaagcaatttaatggaggaaagatacccttttcaagaaatgggactgccaggctaggcatggtggttcatgcctgtaatcccagctctttgggaggccgaggtgggtagatcacctgaggtcaggagttcgagaccagcctggccaacatggtgaaaccccatatctactaaaaataaaaaaattagctgggcatggttgtgagagcctgtaatcccagctactcgggaagccaaggcatgagaaacacttgatcccaggaggtggaggtttcagtgagccaacatcacaccatcgcactccagcctgggcaaaaagagggaaactctgtctcaaaaaaaaaaaaagaaaagaaaagaaaaaaagaaatgggactgccacaactggacgtccatagacaaagaaaaacaaacaaatagaaaaaaaatacctcaaccaaaagtttataccatctgcaaaacttaagaaagggtgatggctaattttgtgtgtcaacttcattgagccatgtggtgccctgatattcagtcaaacattattctgggtgtttctgtgagggtattttggatgagatttatcatttaacctagaagactgagtaaagcagattgtacctcctactgtgggtggacctcatccagtcagttgaaggcctgaatagaacaaaaaggaagatccttcctttcataagagagaattcttcctgtctgatgatctttagactaggacattggctttttcctctgcctttggcttgaactgaaacattagctctcctgggtctctagcttgccaactcgccctgcaaatcttgggattttccagcctctataattgcataagccaatttcttataataaatctctttgcttatgtatacatcctattcattctatttctcaggagtaccctaaataatacagagaggatcatggacttaaatctaaaactataaaatgttaggaaaaacacactttgagagctaggattagataaagacttcctagatttggcaccaaaagcacagtccctaaaagaaaaattgataaattgggcttcatcaaaatttaacattttgactctgcaaaataccctgacaaaaggaaaaaaaggtaacctgcagattgggagaaaatatttgcaaaccacatatctgacaaaggactagtatccaggatatgcaaataattctcaaaactcaacaataaaaaaattgaaaccttcaggtgcaaaggctcatgcctgtaatcccagcactttgagaggcagaggcggtggaccacatgaagtcaggagttcgagaccagcctggccaacatggtgaaaccccatctctactagagatacacaaaaaactagccgggcatggtggtgggtgcctgtaatgccagctcctcaggaggctgaggcaggagaatctgggaggtagaggttgcagtgagctgagaatcacaccattgcactccagcctgggcaacaagagtgaaactccatctcaataataataataataaaaccaattataacatgggaaatttacatgagatatttccatgaggaagacacacagataggaaataaacacatgaagaaatatgtccaacatcatctgccattagagaaatacaaattaaaaccacaatggtctgggtgcagtgcctcacgcttgtaatcccagcacttttggaggccaaggcacgtgaatcacctgaaatcaagagtttgagaccagcctggccaacatggtgaaaacccgtctctactaaaaatacaaaaattagccgggcatggtggcatgcccttgtaatcccagcaactcagaagggtgaggcagaagaatcacttgaacccaggaggcagaggttgcagtgagctgagatcacgccactgcacttcatcctgggtgacagagtgagaccttatctcaaaaaatatatataaaataaaaccacaatgatatatcagtatatgttgataaaaatggctaaaacaaaaaatagtgacaacaccaaatgttggtgaggatgtggagaaactagattactcatacattgctgatgggaatgtaaaaaatggcacagcctttctggaaaacagtctggcagtttgttgaaaaaaagaaaagcaaaaactgagcctgcaactactatgtgacccagcaatcacattcctgggcatttatcccagagaaatgaagacttatgttcacacaaaaacatgtatataaatgtttatagcaacttcatccaaaatagtaaaaaactggaagcaattcagatgtccttcaacaagtgaatggttaaacaaactgtggtacatatgtaccgtggaactcaacaatactcaacagtaccatgctacttgacaataaaaaagaatggatggcagagtacagtggctcatgcctgtaatcccagcactttgggggaccaagtcaggcagataacttgagtccaggagtttgagaccaacctgggcaacatggcaaaacaccgtctctacaaaaatacaaaaattagctggacgtggtggcatgtgcctgtagtcccagctactcaggaggctgaggcatgagaatagcttgaacccaggaggtggaggctgcagggagccaagattgtgccaccgcactccagcctgggcaacagagcaaaaccctgtctcaaaaaaaaaaaaaaaaaaaaaaaaggattattgatacacacagcaaccaggatgaattatgctaagggaaaaaagtcaatcccaaaaagttgacaaaaagtcaatcccacagtacatgctatgtgattccatttatctaacattcttgaaatggcaatatcataaataaataacaggctggagtggtggctcacacctgtaatcccaacactttgggaggctgaggcgaacagatcacttgagctcaggagttcaagaccaacctgggcaacgtggtgaaaccctgcttctaccaaaggtacaaaaacttagccaggcatggtgtcctgcatttgtagtcctagctacttggaaggctggaggtgggataattgcttgggggtgggcaggggaatgggaggtagaagttacagtgagctgagattgcaccactgcactccagcctgggtgacagagcaagattatctcaaaaaatttaaattttttttttaaaaaactaacatcattggccgggcacggtggctcacacctgtaattccagcactttgggaggccgaggtggatggatcacctgaggtcaggagttcgagaccagcctgaccatggtgaaaccctgtctctactaaaaatacaaaattagctgggagtggtggtgcatgcctgtgatcccagctacttgggaggctgaggcaggagacttgcttgaacccaggaggcagaggttgtagtgagccaagattgtgccattgcactccagcctgggcaacaaaagtgaaactccatctcaaacaaaacaaaacaaaaaatcaaaaactaacatcatttctaggggttaaggaggaagtggaacaggagggaagtagatgtggctataaaaatgggagcatgtgataataagaatgttctgtatcttgactatatctatgtcaatatcctggttgtgatatagtggtataattttgcaggatgttaccactgggggaaagtgggtacaggggatctctgttttgttccttacaactacatgtgcatctacaattatcttaaagtaacaagtttaataaaaacagagaaaattaaagtgaaagaggacagcaggagagtgggtgggtgagatgcagcaatgcaagaagaggcaggagagatcttaagcacaactaggactcaacccaccattgctgctttgaaagtggaggagggggccacaagccaaggagtgtaggtggcctcgagaaagtgggaacacctctcagctgacagccagcaagaacatgggacctcagtcctacaaccacaaggaattgaattctgctcacaacctgaatgaccaaggaaactaattctccctaggctggagtacagtgatgcaatcataacccaggctggaatgcagtggtgtgattacagctcactgcagcctcaaactcctggtctcaagcaatcctcccacctcagtttcctgagtagctgggactacaggcttgcaacactatctctggctgacgtcctgattttagcccagtgagacctgtactggacttcttactgacagaactgtaagataatgcatctgcattggtttaagccactaactttgtggtaatttgttacaacagtattacgaaactaatacaagttcttcttgcctattcagattcacacataccaaaaacacagaatgcatataacctaaattctggccacaacctactcgccatccatgaaaaccctgcaaaatacaaactcagaagcactatattgggtgactggctctcagcccctcagaacccagctgacaatgcaggttcttcttgatatttttatcatcctggtgatactgtgtcttacagaaagaatttttttggtctctatggcattatacccaaattttcctgtattggtcaacctgatgcagttcatcagcaatgtctttttttctaaaagttcctcactctaccttctgccttgtgagctggttt

SEQ ID NO: 1089 - DNA, 94484 bp, Homo sapiens
agtagggcttcattaatatttgttaaatggtgagtgatgtgccaccataagaaattagcctgggccaggtgtgatgtctcacgcctgtaatcctaacactttaggaggctgaggtgggtggatcacctgaggtcaggagttcgagaccagcctggctaatatggtgaaaccctgtctctactaaaaatacaaaaaattagctgggtgtggtagcgggcacccatagtctcagctactcgggaggctgaggcaggagactcgcttgaacccgggagatggaggttgccatgagctgagatcgcaccattgcactccagcctgggcaacaagagtgaaacttcatctcaaaaaaaaaaaaaaaattagcctgagttctctcagaatatcatagcataagtcctgttcccactttctaaaaacgtttgtacttgattctcacaatctaggaggaaaacatggcagtgtttgtatccccatttcatccatgaggaaactaaaatccagggaagttcaggtcttcttgcccagggtcgaccaatggtatggtgggtctaggacaggtggccctttcttttgcatacagcctccccctgatgccccataactcccacctcatcccaccgggtgccctgctgcctggtgcagcatttagcattactggcaagtcacaatcatcacagatgagcgaagttcatagagctttcattcagcgaagccaggcaggatgggatgaaagaggggagccaagaagcctggagagaagacaccatgtgaatgctctggcctgattctcctttccctgcaaccagtgactctccactatgcaacagtgtcaggctcagagactcaagcccagtctgcctgttagtgttctataataagcagggaatgggtcaggcatggtggctcacacctgtaatcctatcactttgggaggctgaggtgggtggatctcctgaggtccggagttcgagaccaggctggcgaacatggcaaaaccctgtctcttctaaaaattcaaaaatcagccaggcgtggtggcgtgcacctgtaatcccagctactcaggaggctgaggcaagagaattgcttgaacctagggggcggaggttgcagtgagccaagatcgcaccacttcactccagcctaggtgaaacagcaaaactccaactcaaaaaaaaaaaaaaaagcagggaatggagagcaagcaattatcccccacagatgggagacggctgtgcccccgccttagactgaatcactctgaaaccccaaaataaccctttccagagtcccaggcccccagacatagacgttctctgttggacaatgcagtcccacagacggatctaggctgttcttaaagtggttttccaagtaaaggcacttgtctccccgtgaggcgagggccatcaaagctccttttccctcaacgcctaccaagccacaacctattttaacaacacacacataaattagctcagttcatcaacaagatcacctctgaatagtagatgtagaaggttgaaggatagcaacaaagatgctagttatactttcacgtggaattcctgaccctatattctggtaccatattgcctaaggcaagagacaaggcaagacgggttcctccagcaaggggcacatcaggtccctgagcactggaagaaagtagtgatggtgttgatacttgcatcaggtcagaggcagagaagagaactggcctgcagtgatggccaagggtgaaggtaggggtactggctcccctcttctcccctaactcttgtcaaggccacccactcctctgtcctgcctagaatgtgaagggaggcacccagctcagctgcagggtcctgacttcccggtgatctgcactagcctgcagtcccctgaaagcccagacctggatgtgtgtgcctggccaccaaagtggccccggggtgccctctgtgaccacaggtgtataaacatgcctcttaaaagacaccatgaccaaccatgaggccaagtgtggggctagcattcgctgatgtctgtgttttgcacatactaattcacttcatcctcatggaaatctctgaggtaaagaagtatttgctttaatttacagatgaagaaactgaaactcaggttaaaaatagaccaaggacacacaggtagttgaggggcagagcagggatttgaacactgttatgaaaattatctaaaacttggaagtaaggcaaaaagattgctttgaatatttaattcaaagttagaccagaatagtggttctcaaccaggggcaattttactccttaggggaccttttcacaatgtctggagacatttttgattgtcactattgaatgggagagcagatactactgccatctagtgggtggagaccaagaatgctgctaaaccaccttacaatgcatgggacaaccaccacgacagagttagccatgtgttgcttaacaacagggatacattctgggaaatgcatcattaggtgattttgtgatcttgcgaacatcatagagtgtacttacacaaagctagatggtctagcctactatacgcctaggctatacagtctagcctactgctcctaggctataaacctgtacagcatgttaccatactgaatactatagtcaattgtactacagtagttaagtatttatgtatctaacatatctaagcacagagaaagtacagtaaaaaaatataatcttaggggaccattatcacatatgtggtccatcactgactgaaacagcattatgcagcacatgactataatcagtagaaacatcagtaaatagtcaccattgagaaactctgttccagcacagtgtgactatgctcgacttattatttgccattaattaggtctcaaggatgtcaatttttagaagacaataaacaaaaaaattaaaataaaaaaataaacagcaagcacagtagctgatgcttttaatcccaaaactttgggaggccaaggcagcctggccaacatgatgaaacctcgtctctactaaaaatacaaatattagccaggcttggtggcacatgcctgtaatctcagctactcaggaggctaaggcagaagaattgcttgaacctgggaggcggaggttgcagtgagccgagatcacgccattgcactccagcctgggtgacaaaactccgtctcaaaataaataaataaacaaaagagaaaagaatgtcagcttgtagaaaactggtaagatgcaaatgactcttgtctaagaaagtaaccccaaagactatagttttatagacctgaaggacactacccagttgtgtatctcacttagcaatcttacgccagaatgctctttttatcactgactattatagatcagtttcttccagcttcctttaaaccagtttgccttcctgctggctccctcttgtattttgctagggctgccataacaaaataccacagactggctggcttaaaccacagaaatctattttctcagagttctggataatggaagttcaagatcaaggtgctggcagggttggtttcctctgaggcctctccctgtggcttgcagggggccgccctcttgctgcctcttcctgtggtcttttctctgtgcacatgtgttcctggtgtttctttctcattttataaagacaccactcctttcacattaggacctacacttgagacctcatttaaccttaattactttttttttttttgagacggagtcttgctctgtcgccagactggagtgcagtggcgcgatctcagctcactgcaacctccgcctcctgggttcaagtgattctactgcctcagcctcctgagtagctgggattacaggcatccgccaccatgcccagctaattttttttttctttgtatttttagttgagacggggtttcaccatgttggccaggctggtctcgaactcctgacctcaagtgatccacctgcctcggcctcccaaagtgctgggattacaggcatgagccaccatgcctggccaaccttaattacttctttaaaggctttatctccaaatatagtcatattctgagtgtcctggcagttaaaatttcaacctatggactttgggagaacacacttcagtacctaaaactccactaattatttaatctttgatgcatgctcactacaaatttgcatgagaattgtttttaactttttgaaaattatgctttgcaaatacatttgtctaagcccacaaagtctacttgtttctactatactatacttcttgcatgctggacagatagagccaattcactgagacagcagtattgcagtaaagaaacagtttaattaaggcaagggctggccacatgaaagacaagagttcattattcaaatcagtttctctgagaactcagaggctagggtttttatggataagttggcaggcagggagttagggaatgggtgctgctgattggggataaaagcatggcaaacaatcctcatgtgctgagtccaccatagggtgggggccacaggactggctgagtcatgagtcgtgagtccaagtgaagtcagttggtgcccagaatgcacagttctgaaaatcatctcaaaagacgaatcttgggttctacaatagtgatgttatttacaagagcaaacggggaagtcacaaatcttgtgacctccagcatagattatagaaaggcaagctattcctacatcttagcagaattcagacccctcccataatcctaatcttgtggcctttcattagttttacaaaggcagtttcagtccccgaaaaaggaggggctcagttttagggagggactattatcattcttgcttcaaagtgaaactatacactaaattcctcccacagttagcttggcgtggcctttgttatatgcccaggaataagtgaggacagccagcctatgagactagaagcaagatggagtcagccaagctaaatttctctcactgtcataacctttacaaaggtggtttcattaggcatattaatgcaaattccttagttaaaacaagaatgactctctaaaggctatatttcagatacatcacatgcttctttcctcttgtcccctcaacagtaagcaagaagagtatttttgtacaagagagaggcctctgcctgaagctcccttaatctgtcagatcacagatcaaaagctatcacacactgcccaagggaccctaaagggagccactctcagaaaataaatccaaacctccttttttctggccactgaaacgttcaataattagttcattatctacatcattcacatgtttaatatttattgactttggaattattgattactttgctgagtatcttatgaatttaatctatattaatattaaggtgatgtatcaaattgcattccagagtgtggatttgactctagtgccataatcagtctcctgggacaaacagctgtttctcttccctcattatagaaaaaaattgcccttggcaaatgtcaaagaacatccttttatcaatctctcttaccaatcaatccaagcaaatgcagtgggatttcttttccccagagttgaagtcacctcctgacaggaagttaagtctttaggcactgaatcatagcactgagctgaagcccaggactaagcaagaatgagtgagaatttggagacttaaggtttggtcatctgtagaggattgggttttgtcttgttttgtttttgttttggtgtcctgcaaggtttctcactgcccttcatcaggtaatatgccctgtccctgaactggccaattgtgttaccccattcccttagcaacagtgattgctactgaagaaacaggaggccaacaaagaatatcactcattcaccagtagagtgtctatgtcagagatattagataaacaggaaaactaacaattacattgcaggctgtggaaacagagagaggtacctaaggcacacctgtgggaatatgaaagtttggtttcataaaaggattctggaggaagtcacctctgacatttgagttgagtcctacaggatatgaagaaagtagccccatgttccggttactatggctgtgtaataaattacctaaaacatactggattaaagctatgaaaacatcttttctgcccagagattctgtgggcctgaaattcacatggaacacataaggcataccttgtttctgctccatgatgtctaaggattcagctggaagactgggaggctgggggctggaatttatctgaagaatgactcatttacatgtctactggttgaccctggctgttggctgagggggcctcagctctctctacattgtttctctactttggctagtttggatttcctcaaaacatgatggctggtcctcagtgtcagcatcccaaaaagagaatgccggacacagtggctcacacctgtaacctcagcaatttgggaggctgaggtgggaggttgcttgagttcaggagttcaagaccagcctgggcaacatagtgagactctgtctctaccaaaaatttttaaaattttaaaaatcagccaggtgtggttatgcacacctatagtcccagttacttaggaggctgaggcaggaggatcacttgattccaggaggtcaaggctgctgtgagctatgaccacaccactgcatttcagcctgggtaacagaatgagactctgtttcaaacaaacaaaaacccaaaaaaaaaaaaaagagagagagagggagttagaaggaagatgcatcatttttatgacctggacttggaagtcaccaagcagcacttctgcagtaccctgttggttggaatagttgtagcccaaacccgaattcgaagggaggagaatagataacatccctgggtgacaggaatgtcaaagtcccaaacagcatatgacatgtgacaaatattggtgtggccttctttggaagatccaatcttccataccaggcaaagggatggaagactaaggaacaacatgagggatagccagagagggaaaaagcatcacttgttctaggaactacaaatagcttgaagaagcaaagatgtctagatgcctcccaatatgcagagtggggtgtacagaagagagtggtaagggcgctgggagagctaaggtgggcaagagagcttcctctgtcatgctaagaaagttggaatttatcttgatggtggtgaaagcagagggctatggttagattcacatttgagatttagatttttagatttaaaatgatcaccctggtgacactggcttaactcacaattttgcccaaggcctatgctaccacagtgcttctgaaactttaaagcacattagaatcacctggaggtcttgttaaaccatggattgctgggccttgaaaccccagagattctgattcagtagatcgagaatagggcctgagaatttgtatttctaacaagtttccaggtgatgctgaggctgctggcccagcgaccacatttgataatcatagccctctgataaatcctatcaaaatatcctaatggcagagcaagggaattctggtgatatcctcccctacccataacctgacagctattaggatctgcctacttgaggctaaaagcaaccaagagaggaacagctacagtgtaccacagagtccctcaacatctttgcccacgccacggtgccccagcttcttaccaagtgtgcctgattcctcttgactacctccaaggaagtggagaaagacaagttcttgcgaagccttcgtcttctctgatatgctattctatgtctatttctttggccaaaaagatggggcaatgatatcaactttgcagggagctggagcatttgctagtgacctttctatgccagaacttgctaagcatgctagctaataatgatgtagcacagggtgcggtggctcacgcctgtaatctcagcactttgggcggccgaggcgggcggatcacctgaggtcaggagttcgagaccagcctggccaacatgatgaaaccccatctctactaaaaatacaaaaattagccaggcgtggtggtgggcacctgcaatcccagctactctggaggctgagacagaatctcttgaacccaggaggtggagattgcagtgagcagagatggcaccactgcattccagcctgggcaacaaagcaagactctgtctcaaataataataataataataactaatgatgcagctttctctctctgagtatataatgcagttctgatgatgtgaggaagggcctcactgttggtgtggcagagtctgagaccatggctggcaatgaaaacactaccctttgatgcctatgggctctccctttatggtttcaaggagggcttctcaatcttggcagaattttggactggatagttctttgttgcacaggtggggggctgtcctgcacatcacaggatgtttcatccctggcctctacctactagatgccagtagaacatacccaccccacagctgcctgttgtgacaatcaaaagcatctccagatactttgcagggggaaaatgatttctccaggcctggcatatacataacagtatttaagcagctgcctagaattaattaaacacagaaggatgtctctcatccagaatgccctggaccacctctttgataggcaatcagatcccacctcctccaccctatttttgaaggccctgtgccaacaccacttcttccatgaatacttccttgattcccccatccctagctctatataaatctcccactcaacactcacacctgttagtttacattcctcttgacacttgtcatttagcatcctaagtatgtaaacatgtctctcttcacgattcacaaagtggctttggaagaactttagtaccttcccatcttctctgccatggaaagtgtacacaactgacattttctttttttttaagacagtatcttgctatgatggccgggctggaatgctgtggctattcacaggcacaatcatagctcactgcagccttgagctcccaggctcaagtgatcctcccgcctcagcctcctgagtagctgagatcacaggcatgcactaccacactcggctcacatttgacatcctctaaagcatatataaaatgtgaagaaaactttcacaatttgcatccctttgtaatatgtaacagaaataaaattctcttttaaaatctatcaacaataggcaaggcacggtggctcacgcctgtcgtctcagcactttgtgaggcccaggcgggcagatcgtttgagcctagaagttcaagaccaccctgggcaacatagcgaaaccccctttctacaaaaaatacaaaaactagctgggtgtggtggtgcacacctgtagtcccagctacttggaaggctgaaatgggaagactgcttgagcccgggagggagaagttgcagtaagccaggaccacaccactgcactccagcctgggcaacagagtgagactctgtctcaaacaaacaaataaatgaggcgggtggatcacgaggtcagtagatcgagaccatcctggctaacacggtgaaacccgtctctactaaaaaaaaaaaaaaatacaaaaaattagccaggcatggtggcgggcgcctgtagtcccagttactcgggaggctgaggcaggagaatggcgtgaaaccgggaggcagagcttgcagtgagccgagatcgcaccactgccctccagcctgggcgacagagcgagactccgtctcaatcaatcaatcaatcaataaaatctattaacaatatttattgtgcacttaacaggaacatgccctgtccaaaaaaaactttacagggcttaactcattttatccttaccacaatcctatgaagtaggaacttttataaaacgcattttataaacaaggcacagagaggttaattaacttgccctctggtcacacagctaggaagtgggcagagtacagatttacacaaggcatccgtctcctggccccacatacccaactgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcagtaagtatccgcgccgggaacagccgcgggccgcacgccgcgggccgcacgccgcacgcctgcgcagggaggcgccgcgcacgccggggtcgctccgggtacgcgcgctggactagctcaccccgctccttctcagggcggcccggcggaagcggccttgcaactcccttctctggttctcccggttgcatttacactggcttctgctttccgaaggaaaaggggacattttgtcctgcggtgcgactgcgggtcaaggcacgggcgaaggcagggcaggctggtggaggggaccggttccgaggggtgtgcggctgtctccatgcttgtcacttctctgcgataacttgtttcagtaatattaatagatggtatctgctagtatatacatacacataatgtgtgtgtctgtgtgtatctgtatatagcgtgtgtgttgtgtgtgtgtgtttgcgcgcacgggcgcgcgcacacctaatattttcaaggctggatttttttgaacgaaatgctttcctggaacgaggtgaaactttcagagctgcagaatagctagagcagcaggggccctggcttttggaaactgacccgacctttattccagattctgccccactccgcagagctgtgtgaccttgggggattcccctaacctctctgagacgtggctttgttttctgtagggagaagataaaggtgacgcccattttgcggacctggtgtgaggattaaatgggaataacatagataaagtcttcagaacttcaaattagttcccctttcttcctttggggggtacaaagaaatatctgacccagttacgccacggcttgaaaggaggaaacccaaagaatggctgtggggatgaggaagattcctcaaggggaggacatggtatttaatgagggtcttgaagatgccaaggaagtggtagagggtgtttcacgaggagggaaccgtctgggcaaaggccaggaaggcggaaggggatcccttcagagtggctggtacgccgcatgtattaggggagatgaaagaggcaggccacgtccaagccatatttgtgttgctctccggagtttgtactttaggcttgaacttcccacacgtgttatttggcccacattgtgtttgaagaaactttgggattggttgccagtgcttaaaagttaggacttagaaaatggatttcctggcaggacgcggtggctcatgcccataatctcagcactttgggaggcctaggaaggtggatcacctgaggtccggagttcaagactaacctggccaacatggtgaaacccagtatctactaaaaaatacaaaaaaaaaaaaaaaagaagaagaagaagaagaaaataaagaaaagttagccgggcgtggtgtcgcgcgcctgtaatcccagctactccagaggctgcggcaggagaatcgcttgagcccgggaggcagaggttgcattaagccaagatcgcccaatgcactccggcctgggcgacagagcaagactccgtctcaaaaaataataataataaataaaaataaaaaataaaatggatttcccagcatctctggaaaaataggcaagtgtggccatgatggtccttagatctcctctaggaaagcagacatttattacttggcttctgtgcactatctgagctgccacgtattgggcttccacccctgcctgtgtggacagcatgggttgtcagcagagttgtgttttgttttgtttttttgagacagagtttccctcttgttgcccaggctggagtgcagtggctcagtctcagctcactgcaacctctgcctcctgggttcaagtgattctcctgcctcagcctcccgagtagctgggattatcggctaattttgtatttttagtagagacagatttctccatgttggtcaggctggtctcgaactcccaacctcaggtgatccgcccacctcgccctcccaaagtgctggaattacaggcgtgagccaccgcgtctggccatcagcagagtttttaatttaggagaatgacaagaggtggtacagttttttagatggtacctggtggctgttaagggctattgactgacaaacacacccaacttggcgctgccgcccaggaggtggacactgggtttctggatagatggttagcaacctctgtcaccagctgggcctctttttttctatactgaattaatcacatttgtttaacctgtctgttccatagttcccttgcacatcttgggtatttgaggagttgggtgggtggcagtggcaactggggccaccatcctgtttaattattttaaagccctgactgtcctggattgaccctaagctccccctggtctccaaaattcatcagaaactgagttcacttgaaggcctcttccccacccttttctccaccccttgcatctacttctaaagcagctgttcaacagaaacagaatgggagccacacacataattctacattttctagttaaaaagaaaaaaaaatcattttcaacaatatatttattcaacctagtacatacaaaatattatcattccaacatgtaatcagtattttaaaaatcagtaatgagaccaggcacggtggctcacgactgtaatcccaggactttgggaggccgaggcgagtggatcatctgagatcaggagttcaagaccagcctggccaacatggtgaaaccccatctctactaaaaactagctcagcatggtggtgggtgcctgtagtcccagctactcgggaggctgaggcatgagaatcacttgagcccaggaggcagaggttgcagtgagccaagattttgggggattctgtgacatacaaaaaaaatcagtaataagatatcttgcatactcttttcgtactcatatacttccagcatatctcaattcacaatttctaagtaaatgctctatctgtatttacttttataaaattcacaattaaaaatgaaggttcacatagtcaagttgttccaaacacacttaaatgtctcctaggctgggtgtggttgctcacacctgtaatcccagcactttgggaggctgagatgggcggatcacctgaggtcaggagtttgagaccagcctggccaacatggtgaaaccccgtctctactaaaaatacaaaaattagctggatgtggtggcactcacctgtaatcccagctactcaggaggctgaggcaggataattgcttgaacccgggaggtggtggaggttgcagtgagccgagatcgcaccactgccttccaacctgggcgacagagcgagactccgtctcaaaaaaaaaaaaaaggctcctaataactttattactttattatcacctcaaataattaaaattaaatgaagttgaaaatccaggtcctcagtcccattagccacatttctagtgctcagtagccacgggggctggtgaccaccacatgggacagcatatttagtacctgatcattggttctcagatctggctactcagcagaaccaagaatccacagaaacggcttttaaaagcacagccccacagcccccagccccagccttacctacctggaggctgggaaggactctgattccacgaggcagcctatgttttttgatggagggatgtgacaggggctgcatctttaacgtttcctcttaaatactggagacagcttcgaggaggagataactggatgtgtcttagtccatttgatggagggatgtgacggggctgcgtctttaacgtttcctcttaaataccggagacagcttcgagaaggagataactggatgtttcttagtccattttctgttgcttgtgacagaatacctgaaactgggcaatttatatggtaaaaaattttcttcttactgctctggaggctgagaagtccaaagtcaagtcccttcttgctggtggggactttgcagagtattgaggcggcaccgggcgtcatatggtaaggggctgagtgtgctacctcaggtgtctttttcttttcttataaagcctaactagtttcactcccatgataacccattaatctatgaatggattaatccattattgagggaagaaccttcatgacccagtcaccgcttaaaggccccacctctcaatactgccacatcgggaattaagtttcaacatgagtttcggaggtgacaaacattcaaaccatagcatgctgtctcttaaatgactcaataagctcctgtggcatccacttctgcatgccttgggcagcttttagacatctgtccattttcctagagggacaagaccaccacctgtgatcctatgaccttttggctttaggcctaacaagcaggttataccctcactcactttcaaatcatttttattgtcttgcagacaatttacacaagtttacacatagaaaaggatatgtaaatatttatacgctgccgggcgcggtggctcacgcctgtaatcccagcactttgggaggccgaggcaggtggatcacgagttcaggagatggagaccatcctggctaatacgatgaaaccccatctctactaaaaatacaaaaaattagccgggcgtggtgacgggtgcctgtagtccccactactcgggacgctgaggcaggagaatggcgtgaacccgggaggcagagcttgcagtgatccgagatcgtgccactgcactccagcctgggtgacagagcgagactgcatctcaaagaaaaaaataaataaataaataaatatttatactgcttataaactaataataaatgctatggtctgcatgtttgtgtcaccccaccattcatatgttaaaacctaatcaccaaagtgatattaggaggtggggcccttgggaggtgatgaggtatgagggtggagcccatatgattgggattagtgcccttctaaaatagcccaacggagcccagtgacaaggcatcatctatgaaccaggaaactggccctcaccagacaccaaagctgttggtgcattgatcttggatttcccaccctccaggactctaagaaacacatttctattgtttataagccacccagtggctggtattttgttataacatcccagactaagacaaataacaaatacttgtatccctgacaccaggttaagagatagaatttgtttgttcctctggaggcccttgtcttcaccccatcactgccctgtcctccctggaggaatctgccagcccgaattctgttcatcgtaccctccttttcttagagtttgacctcctctgtatctcccccaatccatgtattgcttatatacaaggtattctgctgtatctgttctgctatggcttgccccttttgttcaacactgtttttgtgcgtcatctgcattgatgcatgcagttgtcctttatttgttctcactgctggatagtatctggttgggtaaatatatcacactgtaaatcacactatccaggttcctttaggtgacatttggttgattgcagtgttctgttgttacgatggtgctgctgtgactgttcttgtgcatggacagaagttcctttcaggtgaatttctcagaatggaattgctgggcaaaggggcagccaataatcaactcatttgatgccaaaagtggtggtgccagttcatcctcccctgcgaggtatgggtcctgattcactcttcaagtgctgtggtttgacagggccgggggtgacaaggggacacctgggaaggaaagctgggctccctgctggccatccaggccagtccttaccagggggtaggcaatgattgggtcaagtggttcctgaccactgggcctgagacttcaggcccagaaactatctaatatttcctcaaatgcatcccatgagcaggcactgtgtgagtgagcacacacatctgaagcctcaagctaggcaagcctaccatgacttgtggtccaagggctcacgggtgacctggagttagagggagacatggctgccaggtggctttagaaagaacactcatcatggccaggtgcggtggcttacgcctgtaatcccagcactttgggaggccaaggtgggtggatcatgaggtcaggagtgagaccagcctgaccaacatgctgaaacctgtctctcctaaaaacacaaaaattagctgggcatggaggtgcacgcctgtaatcccagctactcaggaggctgaggcaggagaatcacttgaacccgggaggcggaggttgcaataagcctagattgtgccactgcattccagcctgggcaacagagcaagactccgtctcagaaaaaaaaaaaaaaaggaagaacactcatcctatgaccttgacctccaagctttgcctccctcaagcagaacagaatggagcctcccttaggcagaggcggaagtttgcctctcacctagttctccattcttttgttcagagcctgaataccctcaggctctgtacttggggtatttctgttctcttgttttatgctcacggttgtgaggtttgttgtgagtaccacgatcccttccttcagaggagtaaactgaggttccaaaaggtttagcagttgcccgaggaatattaaattggcaaaagcaggtagaatataaagcaaggagtatttggcaacggttcttttttatgattaaaaacagccgaagaaagacttctacttgtgcctttgaaggagtaactgcatttgaccttcccaccagtaacaaccatcaaatctctattaaattaaacacacacacacacaaacaaaaacagctattgtgaaggtatcagcgactaagacaactaaggtttgaggggccaggatcctggagagatggaaacttccctgaggtgagccccacattctcagacacttttccttggatgttttgagcactgctttaattcctgggaaaacaattccttccactgtgcacagactctggggccagacagcttgggttcaatcccagctctgccacttaatgtctgtgtatctgtgtaggcaagttaccctttggtgcgtcagtttcctcatctgtaaaacacaactatagttgatcctcattcgttaagagtctgtacttgttaatttgctcacttgctaaaatttgttaccccaaaatcagtacccctagccttttggggtcgtttcaaagatgtgtgcagagcggcaaaaaaatgtgagctcctccaggctcatgttcccagccaaggtccaacaaagtgctgccctgccttcttatttcagctgtcatagtgtaaactgtgtccttttcacagtctgattagtgccatgtttttcagatttttatgcttttttcttggttatttctctgttaaaattgtctccaagtgtagtgcaaagtttagcacgaggaggctgtgatgttccttacagagaaaatgcatgtgttagagaagctttgtcaggcatgagttaaggtgctgttgtcctgagatcaattaatttgttgttgttgttgtttgagacagggtctccctctgttgcccaggctgctggagtgcaatggtgtaatcatagctcactgcagcctctacctctctggctcaagcaatcctcccacctcggcctcctgagtagctgggactacaggtacaccccaccacacccagataatgtttttgatatttttttaggtggaattttgctcatcacccaggctggagtgcaatggtgcgatcctggctcactgcaacctccacctcccggattcaagcaattcttctgcctcagcctcctgagtagcacagattacaggcacatgtcatcacgccttgctaatttttgtgtttttagtagaggcggggtttcaccatgttggccaggctagtcttgaactcctgacctcaggtgatccacccgcctccgcctcccaaactgcagagattataggcacgaaccacaatgcccggcctcatgttttttatttttcaagttgaaatgaggtctctctatgttgcccaggttggtctcaaactcttgagctcaagtaatcctcccaccttggcctcccaaagtgcggggattacaggtgtgagctaccatgcccagccaagatcagtgttaatgaatcaactatatatattacataaggtgtctttaaacagaaataaggttatatattgatcgattggtaacaatgttgtgaccagcagcttacagggtacctagccttgtatttctcctataaataatttgctcgttgagtgtttgtggcaactttgtagcacataactaccaagaataaggactgtaataagagtacgtccctcacaggattgtaatgaagactgagtccatttacataaaggctgagagcagtgtcaagcagatggagaacactgtagaatgtgcgatagctctaacagtggttatcatggctgccctctcacttcttcagagacatgtgtttctaaggtctgcactctgccccaccctccccatccactgtcccccagcccgtttcctcctccacttacttcccagccctgtgccttctgccttctcttttctgagtttgctaagggcactgctggctcaagagcagtaactaacagtctctcgcctcttctctccatggcaaccagtgacctttggagaatgtaaaccttatcaccaatctcttaaagcccttcggtgccttcccaggatgacgtccagctgaggtccttggcaagacccagggcgccccctcctcgctccatcacctcccctgtcacctcccctgcatctccctactccagctgcaccactcttgtgccccagtggctcttgtctgattatttccttcatctccccagctggtcagcagagctggtggtaatcaactcagaccctgtcacctggatgtccagcagttagggactaaaaaaaatcaacaggtcacattctgtcctgcagatcatgataataagatctgtcagacagcagtcagcagtcagagccaaatcttctggacttcagcaggattctgcctcttgctatttcctgttgcctctcttagtgaccttttaagagcattgtggatgcctcccagcctcctgctaaccaccctgtaacctgaacagcctgcagcagccctgcccagtagaacttcctgatgtgatggaaatgctgtgtctgcaccactagccacatgtggccacaggattctcgaaactggtggtgcagttgaggagctgactttatattttatctcattaaatttaaatgtaaatagctacgtgtggcttgttggctagcctattggaaaacacgggcttagagagacacagggagaatcactgtaatgcactaaaagaaggtaaaaaaaaaaaaatcctaagaaatattcctaaaatactttaatatagggctgggtgcggtggctcacatccagcattttgggaagctgaggagggcagatcacttgaggccaggagttcaagaccagcctggccaacatggtgaaaccccgtctctactaaaaatacaaaaaatcgggtgcggtggcgggtgcctgtaatcccagctacgcgggaggctgaggcacgagaatcactcgaacccgggaggcgggggttgcagtgagccgagatcgtgccactgcactccagcctgggcgacagagcgagacttcatctcaaaaacaaaaaacaaaaaccaaaaaaaaaaacttcagcatgattatttaaccaaaatgcaggttagttgttcaccggatgcagagtccaattaacaagagcaaggcctggtaccaaaaaaagtgaatttactccgaaactagcttgggtgaggggtacaaagcatcctgcctttctttaaaagtgctgcttccccttggaagtagaaagtggacacttttataaggtaaggggggaagtgtgcaagggcaagtgggggggtccctctgctagttccgtgcatactctacaggacagttgacttggcaccttcctggttagtaataagctgtagcagtggccaagtgggcatgctttcagtatgccctcccagtgaatgaaagtcctgaggcaacccccaagggtggaagtgccaggccaccacccactggaggtgaaagttccgtgatgggtttgctttggtctgcgaatctactgtcatgtggagagatctgtgctctggaagagcatacagttagaaaagcttgccctgaagggaatgtatggtgaaggggaggtgaaaggttatatttgcatttctgaagggctaagtaggaaaccgggaaccaggggagaggagaagagaagagaggataattttttttaagaaaagcaacatattccctttttcttagaaaaaatggagcactcggttacaggcactcgaatgtagaagtagcaatatataaattatgcattaatgggttataattcactgaaaaatagtaacgtacttcttaactttggctttcagagttcgaaccaacgtggcctcaaccagatttggaatgtcaaaaagcagagtgtctatttgatgaatttgaggaaatctggaactttgggccacccagggtaagataaaacaccttccacgtcataggtatcttcctctctccttccctgcctctcccattagaacctggttttcttcctgagcagcaacaatcttaggcatctttccatgtgactgagtatccaccacattatttttaatgaaatagtattagattgcatggatgtgacataatccatttaacccatcccctactgttggacattcaggttgtttccagagtttcaatattattttatttaataccctaatagttagagcaggccatgctgctatcacaaatagacccaaatatttaatagctcaaaccaataacgtttgtgtcctcctctctgggcagtacagggttggcatacctcctgaagtgaattaggaactacactcattccagcttccagtttggtctttatctgtcagtgccttactgtcctctgcattgttgagtctcagtcaccttgtccaagttccattggccagaaagggctagaagcacagaagggctggaagtggcatttgttcctcactcacattctggtgggaagaacttagtggtgtggccttagctgactgtaagggaggctgggaaatatagtctagcgagtgccctggaaaaagccggcacggcattccccatggaaagctgtcaggcacggctacagtctaccccctgccaaccagtatctgcatggaccctccttccacactcagatgcatttacccccagccccaagagagccaaccgatgcccatgtggtcaccacagccacctccgagtccaagatttccaggtgacatgcagtctcctctctcccagctttaggaatggcttcttctgatctacacacagacacagacacacacacacagacacacacacacacacacacacacacacacgatggagaggggcaggataactgcaactgtaactccattcagaaaagaggcacagcactagctgcccgcagcactggagccctgctgggcagcactggatcaacctctgccctggcagaggagcatgttcctccacaaatccctgcttcagcctctcgagaggctcctccttgtctgttattttccttggccacaaggcaggcaggcagtgggaagtgtgccctcctccggggcaaggagccttcacagcccacttcctgctaataacagtttggggttccacagggtgttttaagactccagtcagctattttaggccagactcatttctctctctctctctctttttttttcttttatgaaatcacaccctgagacccaggctggagtgcagtggtgcgatctcggctcactgcagcctccgcctcccgggttcaagcaatcctcctgcctcagcctcctgagtagctgggactataggcgtgcagtgccacacctagctaatttttgtatttttagtaaagacggggtttcaccatgttggccaggctggtcttgaactcctgacctcagatgatccgcccgcctcggcctcccaaagtgctgggattactggcatgagccactgcgcccagcccagactcatttttctttgagagtaggcttttcccaaaagtaggcttctgagctattcactttcaggcagtcccatgtgccaggaaccacatccaaatttcctccgtggatgggagtctcaggctgccttatctccttgcatgtccccatgcccagctgtctcagcctaagggcaggtaccttgaagtcaagttaaacaataagattggagaccagcaatgccctcagcctggtttttgcagcaggactgagtcccttgttttggctcaatgggaagtctttgctgttcaaagccttagcttctctggctgagtgcggtggctcacgcctgtcatcctagctctttgggaggccgaggtgagcagatcactgaggccaggagttcaagaccagcctggccaacatggtgaaaccctgtctctactaaaaatacaaaaagttagccaggcgtggtggcaggcacctgtaatcccagctactcgggagcctgaggcaggagaatcgcttaaacccaggagatggaggctgcagtgagctgagatcatgccattgcactccagcctgggtaacgagcgaaattccatctctaaaaaaaagaaaaaaaaaaggccttagattctccctttgactttccacgtttgtgcagccttttatctccaatgctccatttcattccatctcctggcttattcttttcttgtcacatctactaaaagcaacaagaagccaccggtattcaggaacattctacctgtccccagagctatatgctcagtaggcatacagttggccctccaggttatctgagactcagatttccagagggctttgcatggctcacaaggtctgaagaacctctgagcctcccgcctgcggtgtctgttcattgactttgccacagtctcaaagaggcactgcatgctgcatgtttgaggtttttgctttggtggcatccatttccagcctcggcttccggcattcctcccccagcagactctctgctgctttccccttactccttctggcagttctgggaggttgcatagggcccttgcaggatgccccaagtccagctgcctctggcctctgggaagcacacccttgacctgccatgtgtaggaagacagcccgcttctgccagggcccaactctgccggcaggtagcaccttccaacctcttcactttggactttataactgtcaggtataaagtcggttgtgtccttacgtttctcaaattcttcaagacacgtcaaccagcctctcctacgcattctctccagctcagtctcaaaacacaccctttctctccagctcactctcaaaacacaccctatcaggccaaccactctttttaaaggacagctcctcaccaatccagtcaggtagccttccccacattgtatcctggaagtgggtgatggactgggtggggaagagggtcatatggcaaatctgtatgtcttacagtaattgtctagcagcccctggtgtcttactttaggccccctggaaactttcagatagtggagttgtctgatacatatcttataacctacagatattaatatatcctcacaggggcacaaaagctcttacaaggatgtttattataataatatttttattgttataatttacatgccataaaactaaccattttaaaatgtataatgcaagggtttttagtatattcacaagattgtgcagctgtcactactaattccagaacattttcattattccagaaggaaaccctattcatattagcaatcactcccccattccgcctttccctaaaacccagcaatcactaatctactttctgtctctgtggatttaaagtaattttaaatttgaaaaatagtatctataaggaaatgtatctagtcacaagcatacagcttgatgaatttgtaaaaattgaacagtcctatgaacataccctgtaagctcaagacatagaatgttaccagcccctgcaagcaagctgcctgctcacttctagtcattaacccctccctcttttccttctagtcattaacccttcagagtaactattctgattaccaatagcatagattagttctgcctgttgttttactttatataaactgtctcattaagtataaacatgtttgtgtatacttgtgtatttctttctatcacaatgatgtttgtgagattcatccatgctgttcctatagacaattctattttgcagcgtagtattccattgcatgactataccacaatttatctgtgatattacaaaggaatacttgggcagtttccagtttggggctataggatagttgtgatacaaatattttagtatagtacatgtcttttggtgaacctgggtacacatttctgttgtgtataccccttaagagtggagctgatgatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcttgcagtgagccgagatcgcgccactgcactccagcctgggcgacagagcgagactccgtctcaaaaaaaaaaaaaaaaaaagagtggagctgatgggtcatagcatgtaaatgcattcaactttagtagatactgtccaacagttttccaaagtgattgtccaacttacttgcctatcagcagtatctgaaaagtctagttgcttcttttcttggccaactctttttttttttttgagatggagttttgctcttgttgcccaggctggagcgcaatggcacgtcctctgctcactgcaacctccgcctcctgggttcaagcaattctcctgcctcagcctcccgagtagctgggattacaggcatgcgccactatgcccggctaattttgtatttttagtagagacagggtttctccatgttggtcaagctggtctcgaactcctaacctcaggtgatccgcccgcctcggcctcccgaagtgctgggattacaggcatgagccaccgcgccaggccggccaactcttttttattttattttattttactttaaagacagggtttcactttgtcacccaggatggaatgcaatggcacgatcacagctcactgcagccttgacctccctggctcgggtgatccctcccacctcaggctcctgaggagctagaactacaggcatgggccatgcccagctaattttttaatttttggtagagacggggtctctgttgtctcagattcctgggttcaagtgatccttctcccttggcctcccaaagttctggtattacaggcatgagccactgcacccagcccatggccagctcttgatacgatctgtctctttcttttctttttttttttttaatttgagaagtgttaaataatctttctttgatattatacataaaccacaccaaaatgtctttcagtaagtaaaatgaaccattttagatacagaaaattctaattagattggcatagttaaggccaaaaatataaagttgacattgctaccttatcttcagcccttgcctttaagaggcaaatgaacacaaaatacaggtgaatcttgcttggttctgagacagtgaaggactttcccccagtatttaaatatatttacataaccagttacataaatctaaatattaaaaaaatctccaatagattttagatggcattcaccatctttgtgaaaagttgaacattactaatgaaatctgatcatatctttagaaggataaacagtgatagcatttactgaatcagaataactgttttttggggttttctttgagacggagttttgctcttgttgcccaggctggagtgcagtggtgccacctcagctcactgcaacctccgccccctggattcaagagattatcctgcctcagcctcccgagtagctgggattacaggctcgccccaccatgcccagctaatttttgtatttttagtagaggcgaggtttcaccatgtcagccaggctggtcttgaactcctgacctcaggtgatccacccgcctcagcctcccaaaatgctaggattacaggcgtgagccaccaggcccagcctattttttttttttttctttttttgagacggagtctcactctgtcacccaggctggagtgcagtggcacaatgtcagctcattgcaacctccacctccggggtttcagtgattctcctgtctcagcctcccaagtagctgggaactacaggcgtgcaccacaagcccagctaatttttgtatttttagtagagacagggttttgccatattggcctggctagtttcaaactcctgacctcaggtgagccacctacctcggcctccgaaagtcctgggattacagacgtgagccactgcactgcctggcccagaaaggactattaattgtagttgcctctgggaatgggggctgcctgcttctttctgtaaccccttctgtgctgtttaaatttttttttttttttttttttttgagacagagtctcgctctgtcgcccaggctggagtgcagtggcgcaatctcggctcactgcaagctccgcctcccaggttcacgccattctcctgcctcagcctcctgagtagctgggactacaggcacccgtcaccacgcccggctaattttttgtattttcagtagagacggggtttcaccatgttagccaggatggtctcgatctcctgaccgtgttatctgcctgcctcggcctcccagagtgctgggattacaggcatgagctaccacgcccggcctttaaatttttactttgggccgggcacggtgccttacgcctgtaatcctaacatttcgagaagctgaggcacgtggtggatcacttgatgtcacgagttcagaccagccactgcactccagcctgggtgacagagtgagactctgtctcaaaaaaaaaaaaaaaagaaagaaaaacttttactttttacatgttattttcatcaatttaatgaatttaaataacaaatgtataaatttgatattaataaaatggaagcatttggtaatcatgttttgggttttgtgcttcctctgcagctctctagatgagaccacctatgaaagactagcagaggaaacgctggactctttagcagagttttttgaagaccttgcagacaagccatacacgtttgaggactatgatgtctcctttggggtacctcttgacttcttttatttttctgtttccccctctaagaattttagttcactaaaatgaagaatttccctccagcagagctaagcatcaagtagcatgtagttgtaggtaggattaaaagactagggttccgggaggtgaaggttgcagtgagccaaaatcacgccactgcactccagcctgggtgacagagcgagactctgtcatagatggatggatggatggatggatggatggatggatggatagatagatagatagatagatagatagctggatagatagataagatagataagacaagactaggcttcaagctgcagtccagctctaccaggcttgttgtgactctgggcaagtcactcagcctctctgagcctcattttccagcttcagtggatacccatgaaggcaaatcagagaggggcctgagtgtgtatttgtccagcaggcagatggagggaacaacaaactagacccgtagttcttcagtagggataagataactgcccaaaagttatttagattacaaagacttgagccctgctcctgtgagacagtgatggggtaggtcgggtgcattcctgggaagcatatttttgaaaagctcacctgggattctaatgtgtatccctaggtcttattcctagagattttgattacttggtctggggtgtggcatgacctgggcagggcactgggatttttaagctccacagatgattccaatatgcagctagtatgagaacttgtttttttttgaaggagtctcactctgtcacccaggctggagtgcagtggcgcaatctcggctcactgctccgcttcctgggttcaagcagttctcctgcctcagcctcccgagtagctgggattataggcatctgccaccatgcccagctaatttttgcattttagtaaagacggggtttcaccatgttggttaggctggtctcgatctcctgacctcaaatggtccacccccatcagccttccaaagttttgggataacaggcgtgagccaccaggtccggcctggtgtgagaacttctgagttggatgaaacattagccccagatcctagaagccagggaagtgctggtctttatcgactggccaccaggtggcagatttgggcaagggtctgcctttgggtttagaattattgcttaggccttaaagtagttcttttttgccagtgggagaaaatccctcaaagatggttttctgggttggttggtttgtttgtctgtttgtttgttttttgagacagagtctccctctgttattcagcctggagtgcagtggcatgatctcactgcaacctctgcctctcgggttcaagcagttctcctgcctcaacctcccaagtagctggaattataggcacacgcccccacacccagctaatttttgtatttttagtagagacagtgtttcaccacgttggccaggctggttttgaactcctgaactcaagtaatcctcccacctcagcctcccaaagtgctaggattacaggtgtgagccaccgcgcctggctcctcaaagatgttaatcctcttgatggcaattgactaataccagaaaatgtcacgaagcgtgcattttggattcaatcatggaattgttgaggacaatcagccatcagactaaagcgatagaaatagtattggaaattgcagcgggagcactgaatggagaaggcactccacataatggaggaggcaaccaagtcttagagaaggtatcaagcctgactataaggacagtgagggaattgaaaaaacaaaaaaggagcaatggagcagggaaggattgaatgcctttcaagtagattcagtaattgctgttagcagcaaaaaatgcagtagtgcctgggcagggctttaaagtgcttgcacaggcagccctagagggccgggctgcttgggaactcttacaaactgacctaccaacttgagcatccacagcctgatcagaggtgggggagttaagggccttctctcccctagcctctactagagcctgtaactgcagggaaaccaagttgcaggctaaactctgcccacacatgcagacattgattagcaagctacaaaaacagtcatgaaacctgtttttataggattagtgaagccccagtttgaccagagtactttgcatgaatgttttgttagaagcaaatgtgccaatattctagcagctgcgtttggtttacttcttcttcttctttttttttttttttgagttgaagcctagctctgtcacccaggctggagtgcagttgtgtgatctcagctcactgcaacctctgcctcccaggttcaagcgattctcccgcctcaacctcctgagtagctgggattacagacatgtaccacaatacagggctaagttttgtatttttagtagaaatggggtttcaccatgttggccaggctggtctcaaactcctgatctcaagtgatccacccgcctcagcctcctaaagtgctgggttaacaggcatgagccacggcacctggcaaaagtcatcttttggtttacttctattgaactgaaaaagtcacaaatatatttatatttaattaaatatatttatataaaaatatggtatttagtattattatttttagagacagggcctcgctctgtcacccaggctggagtgcagtggcacaatcatagctcactgcagcctcaagcttctgggctcaagtgatcgttccacctcagcctccctagtagctgggactacaggcacatgccaccatactcggctaattattttattttatttatgggtctcgctatgtttcccaggctggtctcaaactcctggcctcaagcgattctctcacctcggcctcccaaagcaccgggattacaggtgtgtgccagcacacccagccacaaatctataaatttagaaaggaggactatttctaaagagggtcccactacctgtaggcaggaagcagagcctctggccataactgaaaaacaagcacttccaagaaggggcaaagggaacatgaatttatgctgagaggcgtagctaagcatacatattcaacagattatgggaggatctatgaatattcacaaagggaggatctatgaatatgcacacatgtggagtaagctaacgtgtgcagcatgtctcccatgttcaccttaggcagaaacttaacactaacatgtattacagggcaacaaaatgagactgcatatctacataacctagctatttggtaggctgaagcaggagcatcacttaagactgggagttcgaggcagctgtgagccatgatcgcaccactgttctccagccaggatgacagggcaagaccctgtcttagaccactctgtggtcagtggttatcaggaaggaatgctagtcagttgtgctgaaaccactaaaaaggaagggcagaattaggtgatgagttgataccagtggtgaagtgagtcttttttttttttttctttttgagatggagtcttgctctgttgcccaggctggagtgtagtggtgtgatctcagctcatcgcaacctccacctcctgggttcaagtgattctcttgcctcagcctcccgagtagctgggattacaggcgcctgccaccacgcctggctaatttttttatatttttagtagagactgggttttgccatgttgtcaggctagtcttgaactcctgacctcaggtaatccaactgctttggcctcccaaagtgctgggattacaggcagctccaaagtgctgggattacaggcatgagccaccatgcatggcctgaaataatttttttgaaagggctagtttctatttagcccttaggggaaaaaaaactaatggcagttagggagggaatagaacgagtcctgtttgaactcctttcccatcatggccaaaacttaaaattttttttagatatctctgggctccccttggccaaaagatagtttgttgagtcagttgggagcttagaattttgtttttatttctcacatcattgaatcaatttgaaccaggcgacaaaaccttctgctcccagtagtgggtcagagaaccttcctgattcctgccctgagattgtctctctgaagacaacattaggctagtaggctttccagattctgtaacccattctttcaaaggaagagatgcctatatttttctagccaattcatataccttgagtatcactcaagggcaaaattatttctaacaaatcatttactaattagcaaatgcttaagtgtagatttagaaagctaaagctatacagtggctgccatctatagtttggacttgtgattaactacattgaaatgctaactctgtaccctagagtatgaattcctgattagagtccttcaggtgctaactaatttatgtatttcatgtttgataatattattacttgagctttgtgggagagcagtcttttcctcccctgagatatagctagaagttacctcctttgtgaagccttcctagatactccaagcagacacggtccttcctttctcccttgcccagcactctgaggttgactctgtggagcactgatccctctgtgttataattgtctatttacacgtcagctaccacctataacacactgagttcctcaacagcagggacactgtccattctttgatcccagtgtctggaacagtgccaagtacatagtagggacttaataaatattgattcatatgtaaatgagacttttccaaaacatgctttcgttgatgcctctcagcatttatacaccttttaccaactcgctactggccacatagacaaatgaaagcagtaatccagatacacccaagaggacatctgttcttttttctctctgtggagtgggagacttaagtggcttcttaactggtgtgtcgtctgatcaagtggtccaggtaacaggtggatgccaatgtctggcccaggcatcaccccttactggcactggtcattacagaagacactctaccagagctgaaaggacctcttgtcactaggcagctgtggagtccgctctacttgacctagtaaaatctgcctggagactgttagagtcaccccactacctgaagttacctccaggctgacctcttttttttcccaggtggagtcctggcatcttagatattttaataaggatttgcttgttgacatgttctttattcactaaggtgtcagcatattactgtcttagaactgagggttcttcatcttttttggatcaggacctccctctaagaatctgatgactgctctggtccctctcccaataaaaacttccatactcacctgttaaaaaaaaaaaaaactttaaacaaattaacagagttttattcagcaaagaatgattcataaatcgggaaggctgcaaccagaataggttcagagagactccacggtgtgccacgtggttggagaggatttaggatttatgcacagaaaaaggaaagtgacatgcagaaaatgaaagtgagggcctggtgctggtgcggtgcctcacgcctgtaatcccagcactttgggaggccgaggcgggcagatcatgaggtcaggagatcgagaccatcctggctaacacggtgaaaccctgtctctactaaaaatgcaaaaacttagccgggcgtggtggcaggcacctgtagtcccagctacttgggaggctgaggcaggagaatggtgtgaacctgggaggcggagcttgcagtgagccaggatcccgccactgcactccagcctgggcgacagagcgagacttcatcttaaaaaaaaagaaaagaaaaaggaaaatgaaagtgaggtacagaaacagccaggttggttacagcttggtgtttgccttaaacttggtttgaacagttggccgcctttgattagccaaaactcggtgattggtacaagagtagattgcagttcactatgtacagagaagcccttagatccgaactcaaaataggtaaggaggcagttttagctacacttaagttaacatactcaggagtaccattccagcttcaagctggaagtgtctgcagccccctgagaccacttaatcccaagttaaaaacccctgctcagaggcagcatctttttttttttttttttttttttttttgagagagatctcactctgtcacccaggctggagtgcagtggcacgatctcagctcactgcaaccaccacctcctgggctcaagggattctcttgcctcagtctcccgagtaactgggattacaggcgcgtgccactatgtccagctaatttttttttttgtatttttagtagagatggggtttcaccatgttggcctggctggtcttgaactcttgacctcaagtgatccactggcctcagcctcccaaagtgctggcattagaggtgtgagtcactgttcctggcccagtgaggcaccatctcattggatatggagacaaaggatctggcttagcatcctggatttgtattttctttccaagagtccttaagtgatatctaacttttgcgagctgcagtttcctcagctatgagatgagtgacattaacctcctctcttcagatttataagaggatcaattaaaatggcataggtaaaagtgcatcctagcaagttggtatctactttagaaatgaaggaggtcatatgtatgtgaagtctccagacccaacatgccatcttatatgtgtctatttctacaagtgagctagtgacaacagtaattgctatttttgctcctacatgggtagggctgatcttgactaggaggagtcaataagactcaccagccgggcgtggtggctcacgcctgtaatcccagcactttgggaggccaaggcgggcggatcacgaggtcaggagatcgagaccattctggctaacacggtgaaaccccgtctctactaaaaaaatacaaaaaaattagctgggcgtggtggtgggcgcctgtagtcccagctactcgggaagctgaggcaggagaatggcgtgaacccgggaggcagagcttgcagtgaaccaagatcgagccactgcactctagcctgggtgacagagcgagactccatctcaaaaaaaaaaaaaagactcaccagctgtggccactgtctgtgctaattggctagtgcctgcatctcagaaactgctacatattttgactattccccctgcacttaagggcatgcacactcccaaaatagactcagattgtctaaggaataatgatgatgatgaagagaaagccctctttatctggtctatttgtagtcagttccaaaagcattaagaatttctgctgaactaatgcagctagtttctttcctgtcaccactttccttccaaaatagtttcaagatctgtgggggaaaaaatctatttacagtgaacagactggtgggaggaagttgagcattggggttttctgccctgtgtaaccttgccctaagttgggcagatggtatcacactacctggacatcatctgctcattcactatttgaccagttggtcattcattcacaaatgtcctttttgcaggagggatggaggtgctagacctgcagatgctagcatgaaaagacagatctcctgctgctaaggtgcttaaagtagtggaggtcaggggacaagcaagcagtcaggcagctctgaatgcagaggcaggaagcaccacgaggcaatgggacccacagaggggtagcagggtagaggtgagtgggtctcatgtggggagggaggaagttgactgcagagaaggtgccagggggtgaaaatagcttgagagctgtggagctagaagggctctcacatttgcttattaatatgccctttgaaaaagagtggcctgatacctggagtcactcaaaagatttccaattccgataggaaaaagtcaattttggcttcagtggttgcatgtgcaccccctgatttgctgtatgctgaggcattgtggtgatggacgcaagtgcggagaccttgagcacgcatctgcccctagttcttgccctgagtcctcgaaggaggcaggagagacatcaaggcagacaggcgccgctcatcagtgatgagaccagacctggaactcgcgtcttatactcagtcctctgccctttctgctggattgtggccccccagtatagggtgcaacacacaactggagcatttaagggccacaaagagaacaaattaccaatgattgtgtgttgattctttgagctctttttttttattattatactttaagtgttagggtacatgtgcacaatgtgcaggttagttacatatgtatacatgtgccatgctggtgtgctgcacccattaactcgtcatttagcattaggtatagctcctaaagctatccctccccccttccccctccctccaccccacaacagtccccagagtgtgatgttccccttcctgtgaccatgtgttctcattgttcagttcccacctatgagtgagaatatgcagtgtttgattttttgttcttgcgatagtttactgagaatgatgatttccagtttcatccatgtccctacaaaggacatgaactcatcattttttattgctgcatagtattccatggtgtatatgtgccacattttcttaatccagtctatcattgttggatgagctctttatctcatggaaaaataatttataaaactctgtatgagaggagtgggaaatagtattaacgggtgcggggtttctttttgggacaatggaaatagctggaattagatagtggtgatgtttgcacactttgtgaaatactaaaaactcctgaattatacagttttaagaaacttttatttatttgtttttgagagaagttctctgtgtcacccaggctgaagtgtggtggcgtgatcaccggttattgcagcctcaatctctgaggctcaagcgattctcccacctcagcctaccaagtagatgtgactataggtgcgcaccaccacacccagtgaatttgtaattttttgtaaaaacaaggttttaccatgttgcccagtctggtcttgaactcctgggcccaagcgatcctccctccttgggctcccgaagtgccaggatacaagcatgagtcaccacatgcagcctcagttttaagaaacttttaaataaatgaaatatagtcataccaaaacagtaaaaatgggtttcaggaaaaaaaatgtttttttaaacaaacttacgtattgtataatcccagcccttttaaaaaatgctttcaaaaactggcagtcaactcataaaaggacaaatacttatgattccactgatgaagtagtcaaaagtagtcaaaaatcacagaaacaccaccataaatgtataatttttattttcaattaaaaaaacatcttttttttagtcaaaatcatagaaatagaaagtagacaggtggttactaagggctatgggatggggaaattagtgtctaatgggcatagagtttcagtgttacaaggtgaaaagttctagagttatgctgcccagcagtgtgaatatactttattgttctgtacacttaacatggttaatatggtaaatttagcgttatgtgctttttactatagtaaaattaaaaaaaaaaaaaatggggccgagtgcagtagctcacacctgtaacataatcccagcactttgggaggccgaggtaggaggatcacttgaggccagaagtttgaaaccagcctggtcaatatagcgagacctcatctctacaaaagaaaaatgttaaaattagacaggtgtggtgtctgtagtcccagctctctggaggcagggactgagtcagaggatcacttgagcataggggtttgaggctgcagtgagccatgatcctgccactgctgcagcctgagcaacagagcaagaccctgttgtaaaaacaaacaaacaaaaactggcagctgatacctgagagtgaatatcttttatcgctggttaatgggattgagagaatgcttcatcttatagaaagaacagtgtctttggacccacagagacctggatttaagattagctctgccaattactgagtactctttactatgaacctctgttttcctcatctgtgaaactggaataatgaatcctaccgccaacaattgtagtcaagttggaaacaatttacacaaagtgccaaacaccaagcctggcacagtaggaaccgagtaaatagtggttaatatttttatcagtgtctgcattgctgacgtctccatcatttctatacatttgtttttgaatcagaaaaagatgttattttaaaaaaataacccagtagtgccccttgtcccattcctatcagttatattattattgttactaccctctggaatttcaataactctttgttttttgggttttttgttttgttttgctttgcttttgagacaggatctctgtcgcccagtctggtgtgtagtggtgtgatctcagctcactgcagcctcaacctcctgggctcaggtgatcctcccacttcagcctcccaagtagctgggaccacaggcgcatgccaccacacttggctaatttttgcatttttagtagagacagggttttgccatattgcctaggccggtctggaacttctgggctcaagccatctgcctgcctcggcctcccaaagtgctggaatttcaggcatgagccatgcctggcctaaatagctctctgtgtttgcaaaagtgtgttataagaatcattcagagcctctcgattggatggaggctctagaatgcacagaaaaaggctgccaccgtgtatctctgcaagtcatgcacaagatggggaacagcaggcttccccctgcttaccagttcaaatacagagaactagccctgtagctgtttctttcatatctcacccattctaaagagaccacaggccttagaagtaaaggactcttttgttgaaagagtgttttcaaatttaaatgagcatttattggtcaaagatgcaccaactagtcttttgaagaattcaaggctctttagagaaaaataaagccttggaggagtatctgagaagcttgttagatgcgtgggaagagtctggaaataaaaaacttcatctggagtttctgccttctaccaacagagctgaagctaatgctctcctaagacaagcaaagcagatggtttgcatacttccttaccttccttttacttcctctgtaatagacttgtcatgtctgatgtttgagttgacgtggtactctaatagagttagagtctgcattttttttatgtcctctagtatgttctggttgatggttgagggcaacaaaccagcagtcccagatgccagcaccaagacctgagacaggtcacttaactctccgagcttcaccaccattctcaccttgcagacctcacagggaacagggaaagctctatgagatacaacatcattatgattaatcctattctgattctgaaagcaaagctcttcctacacaaactcctatttctaaatactaaaagacatttctttatggtgtattttgtgtacttgtagaaatggaaagtgttgagataaaacatgaagcaatgatgacaaagtgctaactttttcttgttttaatttctttatgctttttttccacctaatcccctagagtggtgtcttaactgtcaaactgggtggagatctaggaacctatgtgatcaacaagcagacgccaaacaagcaaatctggctatcttctccatccaggtatgtaggtatgttcagaagtcaacatatgtaattcttaaagacttccgaaatgtgacattgtggaccatttaagaaatgtcggctgagcacagtggctgacacctgtaatcccaacactttgagaggctgaggtaggaggatcacttgaggacaggagttcagaaccatcctgggcaacatagtgagtccctgtctctgtaaagaaaataaaaataaagtcacagctgggtgcaggcttacacctgtaatcccagcactttgggaggccaaggcctgtggatcacttgagctcaggagtttgagaccagcctgggcaatgtcacaaagccccacctctactaaaaatataaaaattagccaggtgtggtggcacacgcctatagtcccaactacttggaaggctgaggttgagcctcagcctgagcccaggaggtggaggttgcagtgagccaagatcgcgccactgcactccagcctgggcaacagggccagaccctgtcccaaaaaaaaaaaaaaagtcatcgtcttatgttagcatccttgtaagtgagcctttcctgatattttgcagcctgtctcattctcagtagaaaagtttactctagttacataacttctccctgctgacaatttggatactgtaagcaggcatcaggatattaagatctgaagtgagtagcttataacttttccaaatccagcctagacagttttcctctattaaattattgccctgactttaaaagaagctacttttgaccttgtagcgtttgaacaagttgcactttgtcttcaaagcaagttaaagtttgacctctacttgttttgagcctctcaggtaaagggttatttgaattccctttgcaggttggggttgtgtaccctgtggaggtggtagagtgttatatattgctgctccagggcatttaatccctcctgccttttccattgatgtgctttcaatctagaggaataaaagattgtgttggagacacaatgtggcctgcatagcatctgaaagcctgagaacatgcagggagagacatccctcatccctcagcagcctggctgctgttgaagtggttgtaagaaagtaaaagagaaatgcccacaaaacgttctcagatccagtcattcattagcacttccaaagagagcatgttgactgtgaattgggaaagggccagataaaactagcatagaattctttgaaagactaacggtatttgcattttttaaaaattataaccttactctaccccctaacattgacatcatttttaggtaattaatattttcccatttattattctgtgatctctaatgctttgttcagaataaatagtgtgtttcctttccccacactttcatccaagaagtgtgctagagttcaacaaaaacagcactagaaatcactgtcattctaggaaggccctaattcacagattgtattggtttttagacccagttagtgtgctggaggttggaggattttaacctctgtgggccaactagcctctgtggcctcagtcattcttcctgaccctggctgtgcttgagcctgtgtgttcttatccttcatctccgggggaacgaagtggatcagctcggtccagcgatcacttttggggatcagtggctttgtagatatcgggcaggcacttaccccaaaagaactttccccatatctgaagactgaaaacgtccatatcgtatttggacacactgcccagcaatacgctctagctgtgttcagaagcatgggaatttggaaagatctgctgagcatgccgtttactgtcacagatactatcttcctcaaaaaaaaaaaatatatatatatatatgggggacggggcaggttgagactgggtgagactgaagaggtgccttggccagagcaggccacacccagagaccacaggctccccggtccacctcaggcccctccccttcctgcgccgtttccggcagatccagagtggccaccgccggatgggagtcgggggaagggaggcagagaagcgggccctgaggacaagctctcagtgcttctgtgggaagtggcggcaagacggcagctcccagcgggggatggaggccgagtcagtctgctggtcactggaggccaggatgctgcctaacacagccgtcccgctccgggcctcaccaccagggcggctctccccactcccggcctgctgcccacacagactgcggggttccgggggagcaggacccaggccgttctgcgcctgtcttcttggaaggagcaggccggagcgcgggagcgccgtgtagctgtacctgcgaaggcacaggattccgcgggaagatcccgcagtttcgggccgtcgtcattgtttttatacctgtggcaaatggcatgaccagacacacggttatgtctggagaaacccctgtagaggagcaggaggttgtggacatgctgtggcccggacagtggctgccgagcagttggagcctgcacccgcccaacttggctaaagaagtccccatactctctgtggaaaagatttccagaagctgttgtgtcaatatcaaagcctcaaaacaacaacaacaacaacaaaaacatgaaattatcaacaataaagatcatccttgagtctgctttgaaaagtagggtgaaattctgcagaggcattcaactggcaagataccaccctcatagccagatctgcaggtctcagccatcatgccagggaaaatgctccattcaccactcctcagcttctgcttctggtttcagaggtctctgtattggaggggctttaaagcaagaagggtctttacccacttactcttattcacagatgtgaatatgcaggtccagtggggaaagtgacatgtcctaagtcagaatagagtcaacaagaaaacagggcccaaaatgacttagcctctagtgtataatgggcattgatgagctactggaaatacagagatgaagaaaacacagtcccatcttcaaggagctcaatctagcaagggagacagactctttgtaggtgggaccgggcttccctgcagcagaaggaagcttgaaattggtaacgagcctcagaagggacagaggcaggccaccatgctaccctgagaggatcgcatgtggacacggggctatgacctggccctgctttgacccactagctgtgctgtagggccaggtggagcctggagtggcctgtgctaaggggctactatgagctctttccactcccccaaggcattgcataaataatgtcactttctgtttgcacagcaaaatcagggacacaattttctagaacatggggtgcctcccctccccccagcccaacagaagttctacaatgactgatgggcccttgtttttgtttgagacggaacaccccacagggttccgagtggtgatttgtggcccacaggccactggcaagtggaggcagagctgcagagccctcgggagccacagagggcctgctggccgccacgacatgccaactcagctgctgctggccctcctgtgggcggcagtgctagtgatgtgcagaatcttaggactagtgccaaggaacctataaataccctgggtgacccaggcgtgcactgctgtggtggccttcacagtcagaagatgacaagctgagaaggggagaatcggcccaaggtgagatccacagaaaggccagggccaagatgcggccagcacctcaggctggtggtggtcttacgttgaccatgccagaggccagtccttgattgctccaaaccctctgttcgagggttccaaatgaaatgagcaggtcctcgtgtcaggacctaggttagtttctgaaaaagcatgaaaagcaggcctcctgaacttccccgagtgactgatgcaaagtgcgtcctgcatgcttcacagcaccatggagaggatcttcaggggcaaactgcagactatctgaatgacggcactgaccatcagcaaaccgcagagctgcctgaccaagaaattgcgagacagaagcaatgcttgcaggcgaagaagaaggggccagacacagtggctcacgcctgtaatcccagcactttgggaggccaaggcaggcggatcacttgaggtcaggagtttgagaccagcctgggcaacatagtgaaaccctgtctctactaaaaatacaaaaaattcgccaggcatggtggcaggcacctgtaatcccagctgcttgggagactgagacaggagaattgcttgaacccaggaggcgaaggttgtaacgaactgaaatcgtgccacagcactccatcctgggcgacagagtgagactgtctcaaaaaaaggaggagaagaaggaaaggccaaggcaggaatgaaacaggccatgaatgttggagtgaagcaactggcctcctcgtgctaagcggctactgtgagttctttccactcccccaagacattgcataaataatgtcactttctgacactcaccccgctgaatgtcctgcctctgctcaagggtggtatgatggggacttggcagtggaggggaacagggaaaccagacatggtggtctccccgcttcctggctacaagtccctctgaagaaatccaaaggagtaaagagcttggagagtaggcctctgtagggtgcaagggcacagctggagacggagctcctgaggctgcagctgatgctgcccgctctgcctgaactgcaccaaaaacgtgatgaggccatagcgggagtccacggaggaggatgcctactgcccgacctctagcagagactaagcaaggtgcatgaaaacttgaaccacatgtgtcacacccatgaccactacatgaagatggcccaaaacctggcccaggaattgaagaaagactcttccaatttgctgtaagaaaatggcccagggggcaagcacggtagctcacacctgtaatcctagcactttgggaagctgacgcaggcagatggcttgagctcaggagttccagaccagcctgggcaacatggtgaaaccccgtctctaccaaaaatacaaaaattagccgggtgtggtgatgcatgcctgtggtcccagctactcaggaggctgaggtggaaggattgcctgagtctgtggggcagaggttgcagtgagctgagatcacaccactgcactccagcctgggtgacacagtgagaccccatctcaaaaaaaaaaaaaagaaagaaaacggcccaggaaggctggagggccgccgtgtccattgagagagtgctccaggcactccaaaaagaaaatgaccacaatgggaagaaaccagctgaccatgagaccaagttccaaccttttacaagtggcctgtggctcctggcgccccgcccacagctgacaggggctcagaagtgctagggggaccatgggccaccagggccaccaggagggaggcaggtaacgatgcgagggcttggatgcagaacaccagctggtttgattctgttttccctgtacctgggtcctgaatgcccagaggctcagggaaacaccagccagtgctgctgcctttaaagcacttttgactgatctcttgttaatttagcaactgttattggttgatgctgcagttgctcttattgaagtttgattgatagcattaggatggtaaggcactatttttcaaataaaggttgtttaatataaaaaaaattttgtttttttttctctcagcctttcacattggttcaaaatatctttcatctggctgcatttctgatttttgttttgttttttttttcttaattttatttatttttaattaaaaataattttttttgtcaacatggggtctcactttgttgcctaggttggtctgaaactcgtggcttcaagcaatcctcccacatcagcctcccaaagtgctggggttatgggtgtgagccactgcagcagcctgttttttttgtttgtttgttttttttaatttgacaagttttcaggtcctgtgaaatcagcagtcttacctcccaccttgcgcaccctgaggaggttgcagaataaaggagaattctagggacacgtgggcatcagtgcctgtgctcagagcacctcaggcagtgtggaggggtctagaggttactcaggctctgcctggcaacccgatagcagtatcagagtatagggccaaggggacggtccttgggcttggtgtggtttattagtccttttcctgtgaccctgatggtttggttcactcatttttatctccatactgggaacaggttcaagccccagcatttggttgataatgcaggaatccttgatacttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataagaagacatggcagaagccagcctccgatctgtccacacgaatacagcattcccaaagcaacgtgcatgtgccattattcactggatgagcttgaggtggatgaactagcccaccaggctctcaatgtcatgaatttaacactgaattaagaaaaatatgttttaaaaataatagtttaggtgattgctggggtgctaggagaggaaggaatggggaataactgtttaatgggtatagttggccttgtgtatctgtgggttccacatctgattcaaccaaccgtggatcaaaatatttgaaaataaaaaacaaaacaaaaatgatacaaataaaaaccaatataacaactattaacagcatttacattgtactaggcattataagtaatctggagatgacttaaagcatacagaaggatgtgcctaggttagatgcatgtatcgtaccatttcatatcagggacttgagtacccacggattttggtatctgcagatcctggaaccccttccctatggataccaaggaacaacagcactgggtctccttttggggtgatgcagatgttttgaagctaggcagaggtagtggttgcacaacattgtaaatgtactaaatgccaccaaattattcatttttaaatggttaatgtgttatgtgaatttcaccttaacaactaataatattataggtaaggcacaagttacatctgtagcacaaaaatggccctaatttttaaaacactgctccagcatagcaggtatcacatgtgaggtagcaaaagctggagatcaaagtgtgatacctggagacttatcagtaagggtcaaatgttttttcaggttttgagaatcattcttggaattgttccagaagatatatcgtataactcttcttagatgctaagataagaaggcagatatacactagctcattttgtgttattttctagagctttactccagtcaatttcttgggggcagcatttgtggaatcagtggttcatctgaagggctgtgctgtggaattactatgcatttgttttgtcttccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaattagccgggcatgatggcaggtgcctgtaatcccagctacttgggaggctgaagcggaagaatcgcttgaacccagaggtggaggttgcagtgagccgagatcgtgccattgcactgtaacctgggtgactgagcaaaactctgtctcaaaataataataacaatataataataataatagccatcctttattgtacccttactgggttaatcgtattataccacattacctcattttaatttttactgacctgcactttatacaaagcaacaagcctccaggacattaaaattcatgcaaagttatgctcatgttatattattttcttacttaaagaaggatttattagtggctgggcatggtggcgtgcacctgtaatcccaggtactcaggaggctgagacgggagaattgcttgaccccaggcggaggaggttacagtgagtcgagatcgtacctgagcgacagagcgagactccgtctcaaaaaaaaaaaaaaggagggtttattaatgagaagtttgtattaatatgtagcaaaggcttttccaatgggtgaataaaaacacattccattaagtcaagctgggagcagtggcatatacctatagtcccagctgcacaggaggctgagacaggaggattgcttgaagccaggaattggagatcagcctgggcaacacagcaagatcctatctcttaaaaaaagaaaaaaaaacctattaataataaaacagtataaacaaaagctaaataggtaaaatattttttctgaaataaaattattttttgagtctgatggaaatgtttaagtgcagtaggccagtgccagtgagaaaataaataacatcatacatgtttgtatgtgtttgcatcttgcttctactgaaagtttcagtgcaccccacttacttagaactcggtgacatgatgtactcctttatctgggacacagcacaaaagaggtatgcagtggggctgctctgacatgaaagtggaagttaaggaatctgggctcttatggggtccttgtgggccagcccttcaggcctattttactttcattttacatatagctctaattggtttgattatctcgttcccaaggcagtgggagatccccatttaaggaaagaaaaggggcctggcacagtggctcatgcctgtaatcccagcactttgggaggctgaggcaagtgtatcacctgaggtcaggagttcaagaccagcctggccaacatggcaaaatcccgtctctactaaaaatattaaaaaattggctgggcgtggtggttcgtgcctataatttcagctactcaggaggctgaggcaggagaatcgctgtaacctggggggtggaggttgcagtgagacgagatcatgccacttcactccagcctggccaacagagccatactccgtctcaaataaataaataaataaataaagggacttcaaacacatgaacagcagccaggggaagaatcaaaatcatattctgtcaagcaaactggaaaagtaccactgtgtgtaccaatagcctccccaccacagaccctgggagcatcgcctcatttatggtgtggtccagtcatccatgtgaaggatgagtttccaggaaaaggttattaaatattcactgtaacatactggaggaggtgaggaattgcataatacaatcttagaaaacttttttttcccctttctattttttgagacaggatctcactttggcactcaggctggaggacagtggtacaatcaaagctcatggcagcctcgacctccctgggcttgggcaatcctcccacaggtgtgcacctccatagctggctaatttgtgtattttttgtagagatggggtttcaccatgttgcccaggctggtctctaacacttaggctcaagtgatccacctgcctcgtcctcccaagatgctgggattacaggtgtgtgccacaggtgttcatcagaaagctttttctattatttttaccttcttgagtgggtagaacctcagccacatagaaaataaaatgttctggcatgacttatttagctctctggaattacaaagaaggaatgaggtgtgtaaaagagaacctgggtttttgaatcacaaatttagaatttaatcgaaactctgcctcttacttgtttgtagacactgacagtggcctcatgttttttttttttttaatctataaaatggagatatctaacatgttgagcctgggcccacaggcaaagcacaatcctgatgtgagaagtactcagttcatgacaactgttgttctcacatgcatagcataatttcatattcacattggaggacttctcccaaaatatggatgacgttccctactcaaccttgaacttaatcaaaatactcagtttacttaacttcgtattagattctgattccctggaaccatttatcgtgtgccttaccatgcttatattttacttgatcttttgcataccttctaaaactattttagccaatttaaaatttgacagtttgcattaaattataggtttacaatatgctttatccagctatacctgccccaaattctgacagatgcttttgccacctctaaaggaagacccatgttcatagtgatggagtttgtgtggactaaccatgcaaggttgccaaggaaaaatcgctttacgcttccaaggtacacactaagatgaaagtaattttagtccgtgtccagttggattcttggcacatagttatcttctgctagaacaaactaaaacagctacatgccagcaagggagaaaggggaaggaggggcaaagttttgaaatttcatgtaaatttatgctgttcaaaacgacgagttcatgactttgtgtatagagtaagaaatgccttttcttttttgagacagagtcttgctctgtcacccaggctggagtgcagtggcacgatctgggctcactacaacctccgcctcctgggttcaagcaattctctgcctcagcctcccgagtagctgggattacaggtgcctgccaccacacccggctaatttttgtatttttagtagagacggggtttcaccatcatggccaggctggtcttgaactcctgacctagtaatccacctgcctccgcctcccaaagtgctgggattacaggcgtgagccactgcacccagccagaaatgccttctaatctttggtttatcttaattagccaggacacttggagtgcatcccgaagtacctgatcagtggcccctttggaatgtgtaaaactcagctcacttatatccctgcatccgctacagagacagaatccaagctcatatgttccatcttctctggctgtatagtttaaggaatggaaggcaccagaacagatttattgaaatgtttattagctgaagatttatttagacagttgaggaaaacatcagcacccagcagtaaaattggctctcaaagattttcttctcctgtggaaagtcagacctctgaggccccatccaggtagaagtactagtgcaagaagggcctctgctgtccacttgtgtttctgtgatctgtgggaacattgttaacgccacatcttgacctcaaattgtttagctcctggccagacacggtggctcacacctgtaatcccagcactttgagaggctgaggcaggtggatcacctgaggttaggagttcgaggccagcctggtcaacatggtaaaaccccgcctctactaaaaatacaaaaattagctggccgtagtggcgcacgcctgttatcccagctactcgggaggctgaggcaggagaattgcttgaacctgggtggtggaggttgcagtgagccgagattacaccactgcactccagcctgggtgacaagagggaaactccattaaaaaaatgtaattcccgtgtctgccatcttaagtgtaaaggtggctaaattatatagaaaaataagacaatatcatttcccaattacattcctttcctaccgcactctatgatgctagctgagatttttccaaaagaaaatggcttaaataaaaccctaagagaaagaaaaactttaaatccctccaaagctcaaaagtaatagaaacagatgagtttggagtcaggatttctctgtaagattgcctaggctgtgtactgcacatctccaggtgccactgttgacagagattataactacaatgtgaagtgaatggtgccactgacagttatgcaaaccgtccagagcatagccacctgatcctgctgggattcctcttgccagtccatcagcagttccccttgaaagtttcaccaaacatcccttaaatctgccctctcctgcccgtccccagtggaggtcctcatcatttttcacctgcatttttgcaggagctttcttatatccaccttcctccttttctctcagcccatcatctagctacacagtctccagggtaagctttcagaaaggcaatctcttgtctgtaaaacctaagcaggaccaaggccaagtttcttagcctgaaaaatgtgcttttctgactgaactgttcaggcactgactctacatataattatgcttttctaccccctcacactcaacactttgactccagcaatcccaaatccccagatccctaagtgtgctgtgctattttcacgtggctctcagacttggccagtgctgtttccattttggtctttattccccacatctctgcctggggggtagattctaccctgaaaaatgttcttggcacagccttgcaaactcctcctccactcagcctctgcctggatgcccttgattgttccatgtcctcagcataccatgtttgtctttcccagcactgacctaccatgtgtcacccctgcttggctgtaccttccatgaggctaggactatgtgtctcctttgttgactgctgttgccctagcatcttgcacagttccttgcacacaattagagctctataaatgtcaaataaatgtgttataattatatgtttaagatagttgttcaaataaactctaaataaccccaactccaagagtgttagcaagaaatataaattttacagaagaatggttggaggtggggagggtgtccacggagtgagttacctcacacaggcacggaaaaacttgaacctcctaaggacatttttaagctctctttcccattttctctcctggattcccattgcctggtctcatttctctcttctccaccacaccacttcctcaaaaattcctttagggtttgttcttaagcttagataggtttcccattctgaaatacaaaggcctgataattagccaacttaccttgttggggatgtggaaggcaagactctcagactccatgactcaggtatattgcaacaattaggctgaaagttccttgagagtaagtgtccaaatcttttcatgtttggttcccagggctcactacagttgttggtatatcataggcactctaatatcttcttaaagaatcaatatcattaaaatggccataactgcccatagcaatttacagattcaatgctatttctatcaaactatcaaggtcatttttgttttattttttttctttgagatagaatctcgctattgtcacccaggctggagtgcagtggcgcgatctcgactcactgcaacctccgcctcccgggttcaagtaattctcctgcctcagcctcccgagtagctgggattacacgtgcctgccaccacacctggctaatttttgtatttttagtagagacaaggcttcaacatgttggccaggctggtcttgaactcctgacctcaggtgatccacctgccttggcctcccaaagtgcagggattacagcatgagccactgtgcccggcccatggtaatttttcacagaatcagaagaaactattctaaaattcatatagcggccaggcgaggtggctcacgcctgtaatcccagcactttgggagacagaggcaggaggatcatctgaggtcaggagttcgagaccagcctgtccaacatggtgaaaccctgtctctactaaaaatacaaaaatttgccagtcgtgatggcgggcacctgtagtcccagctactcgagaggctgaggcaggagaattgcttgaacccgggaggtggaggttgcagtgagccgagatcacgccactgcactccagcctgggcaacagagtgagactccatctcaaaaaaataaataaaataaaataaaataaaattcatatagaaccaaaaaagagcccaaatagccaaagtaatcctgagcaaaaagaacaaagctggaagcatcacattacccaacttcaaactctactacaaggctatagcaactaaaacagcatggcactgctacaaaaacagacaggtagactaacggaacagaatagacaactcagaaataaagccacacacctacagccatctgaacttggacaaactcaacaatattaagtaatggggaaaggactccctattcaaaaagtagtgctgggataactggctatccatatacagaagaatgaaactagactgctacctatccccatatacaaaaattaaatcaagatggattaaagacttaaatgtaagatctcaaactaaaaaatcctagaagagccaggcgcggtggctcatgcctgtaatcccagcactctgggaggctgaggcggatggatcacctgaggataggagttcgaggccaggctggccaacatggtgaaaccctgtctctactaaaaatacaaaaattagctgggcatggtagtgtgtgcctgtaatctcagctactcgggaggctgagacaggagaatcgcttgagcctgggaggcagagtgagcccagatcgcaccattacactccagcctgggtgacaggagcaagattccatctcaaaaaaagaaaaagaaaaaaaaaatcctagaagaaaacctagtaaatgcccttcttatatcagccttgacaaagaagttatgactaaatcctagaaagcaattgcaacaaaaacaaaaatttacaagtgggatctaattaaactaaagagattctgcacagcaagagaagctatcaagggagtaaacagacagcctacagaatgggagaaaatattcacaaattatgcatctgacaaaggtctaatatccagaatctataaggaacttaaatcaacaagcaaaaaccaaataaccccattaaaaagtaggcaaaggacacgaacagacatgtctcaaaagaagaaatacaagtgaccaacgaacatgaaaaaatcctcatcatcactaatcatgagagaaatgcaaatcaaaagcacagtgagatatcatttcataccagcaagaatgactattaaaaaagtcaaaaaataacagatgttgcaagactgcagagaaaagagaacgtttatacactgttggtaggaatgtaaatacattcaaccactgtggagaacagtttggagatttctcaaagaactgaattgaactaccagtcgacccagcaatgccattattgagtatatgcccaaaggaaaataaattgttctatcaaaaagacaaatacacccatgtgttcatcacagcactattcacaatggcaaagacatgaaaccaaaccaggtgctcatcaatggtggattagattgtgtacatatataccaccatatggtacatatacactgtggaatactatgctgccataaaaaagaatgtaatcatgtattttgcagcaatatggatgtagctagaggccattattctaaacaaactaacacagaaacagaaaccaaataatgcatgttctgacttaaaagtgggagctaaacactgaatacacatgggcataaagatgggaacaatagacagtgggggctattagagaggcaagggctgaaaaactacctattcggtgccctgctcactatctgggtgacagagtcattagcactccaaagctcagcatcacacagtatacctttgtaacaaacctgcacatgtaccccctgattctaaaataaaagtcgaaggaaaacaacaaaaacaaaaagaaataactcctgagttggggtctccatctcttagttcagcctattggcagtcccctttttcaagttctaaggagcctgtactagactactcttcatttagtcccataataatccctctttcaattattttgccttcaaacctatagggaagggattggaaatgaagtttcagtcattccctaagtaaaatgtatatacatattttaattgaaacaggatttcactctgttgcccaggctggagtgcagtggtgtggtcatggctcactgcagcctcaacctcctgggctcaagcaatgcttccatctcatcctcccaagtagctgggactacaggctcgtaaattttttagagaacaaaaacacagtctttagatttaaacatgtgaaagcagaaattttaaaaatacaatgaaagagttggaagacagagttgaaattgttcagaaattacagtaaaaatactaagagataggaaatagtcaacttccaaatgagaagaatcacgaaagagagaacagaaaagatagaaaaaaaattatcaaagaaataattcaagaacatttccttaaagtgaagggcatgagattccaggtatattccacatatagaaaaatatcccatacaaaatcacattgttatgaattttcataacatgagggacaaaaaaagataatataagtaaccagagagggaaaaaataaataaacaaaacaagacaaataggtcatatacaaagtaatattcatcacaatagcttcatagttctcaataataacaaaaagcctttaaaattctggttgaagcagttcagacaatgccatcacccaaaaatatgccattttggcatactgattattattagctgaaagcacttgagaaacagcagactgtacaggaagggctttccaacctcctcttttctacctaaaaacaggctagaaaatttcccatgataaaggtgccctccctctactagaaagagaaaaacatccttatcaccagagatagggaatcaatgccaaaatggatctgaacaaacttattggaataacccttgtcttccactacttatccccaatatagctcttagtaatttccccaagcccctttgtcttgtcatttcttcacaaatttatcatttctttgtctaaaacatatataaacttgtctgctatggtgacttcttcgggtctacatttgcttgtgaggactcccaggtacatgtaaaattgtaataagacttgcgtgcttttctactgttaatctttcctgtgtcagtttaattcttaggcctagctggaaacttaagagggtagaacagaaatttttcctttcctacatggtgaagggacattctgtaataaaactagcctcaacattaaaaaaatgtgatgtaataaaaaacaaaggaaaaagaaaacaaaacagaaaagcaattaataacactaggaaacacgaggcattgtacaggataggaaacgtcctgttatgttacacaatgcaacagtgggtattgttttcatcattattataatgaaaatgctaaatagtgatttgaccaacaatccagtttaaaacatttggaggaatgtgaatgtttatggccagaaaatggggagaaaaatggttaaggaaacaaaatctcatcatctagagtgggaaggagactgataattcctaatatgaaccaaaaactcaaacttttttttttttttttgagatggggtctcgctctgtcgcccaggctggagtacagtggcacgatctcagctcactgcaacctctgcctcccaggttcaagagattctcctgcctcagcctcttcagtatttgggactacagttgcacactatgatgtctggctaatttttgtatttttagtagagatggggtttcgccatgttggccaggctggtctcgaactcctgacctcagatgatcagtccgccttggccccccaaagtgctgggattacagacatgagccattgcacctggcctgaaaactcattttatttagatatgttaagggaaatctcaaaataatcagctagaaaaattgaaaatggttgcccatgaggaggggagaactgttattatttatgtcaaataaaatttgtaggaagccattgatttggactgtgctcctgcactaggccccaatagaccaaaccacatggagtcactcttgctaaagttccacgtcaccaaaccaaagctaagtagtttatcttaccttctgggaaattaggggagagaaataatagacaaatccccaaacaggccagttttagctggcatataaggaagtcctctctgttttaaccgtattaggagagtaactttgaaaagaccgtccactttttggtccctgtttctgttttcttctgccttttctgcctataaagctaacttcctctgcccagctcactggagtaccttctctgaatttttagaagacaggctgccctgatccatgaattgcaaatgaaagccaattagatcatttaactaaattcattgtaattttgtcttttgacatttgtaaacaagccttgtagtacttgctaaacaatgggctgggcgcagtagctcacacctgtaatcctagcactttgggaggctgaggtgggtggatcacctgaggtcaggagttcgagaccagcctggtcaacatggtgaaactccgtctctactaaaaattcaaaagttagatgggcatggtagcatgtgcctgtagtcccagctactcaggaagctgaggcaggagaattgcttgaatctgggaggcagaggttgcagtgagctgagatagtgccactgtactccagcctgggcagcagagcaacactctgtctcaaaaaaaaaaacaaaaacaaaaacaaaaaaacaacttgctaaacaacatatgtttattatttggtaaattataaacaataaattcaaaactttaaaaagaaaacattttattgatagctcactgaatacaaatttataaaatattatttatgcattaagtttcagttacacattttcacccatcattacagatgtcatatggagttgctagagtatgagaagagcttcttcatcccaacagctttcaaagtgaagaggcgactcatgcctgtaatcccagcactttgggaggctgaggcgggtggttcacttgaggtcaggagtttgagaccagcctggccaacatggtgaaacctcgtctctactaaaaatacaaaaattagctgggcgtggtggcgcacacctgtaatcccagctactcaggaggctgaggcaggagaatcacttgagcccgtgaggtggaggttgaagtgagccaagatcatgccactgcactccagcctgggtaacaaagcaagattctgtctcaaaaaaaaaaaaaaaaaaaaagtgaacatctgggtcccccagatctcttcagagatatgtaatgttctcctttttccaactacataactctttaagctgggttttcttcatatactccaatgaaaacaacatattgcaacagatggaatgaagaggcaagtagaagaatccagctgttttctattaagccaaacattacaattgtcagctgaagaattctgagattcataaatttggaaagaaaagcttcatttctcataaaagattgcagcctgcagggtggccattctgacaggctaagaaatgtagtctctggccagaagccaaaaacagacactgagggtcagaagaataagatgggcatttatgctgaataggatggccaaatatacatattcaataaactacagtcatgaatattcatgaaaggagaaacatgcacatgctcaattgagcttcatgcctctccatgggacgcgtgtgcaaaaaatggcagcattagcatgatcagagggtggagttttctgtcctctgatatcaaaaggtgaaacagaggacacagaaaccctcactgcacatcctctgtaaactggccagaaccactccattgtgggcagtctgttatcaggaaggaatgctggttagttgtgcagaaactgcaaaaggaaggggcagtgtcagaccattggttgatatcagcggtgcagctcgtctttccaaagggctggtttctgtttaacctgtaggaaggaaatcctaatggcgtttagcaatggagagggtataacaacacatcatggcaagaactcagttttcaaggtttctctggggtccccttggccaagaggtggtgcatccgtttagtcagctgggggacttaggatttcatttttatttctcagagttttataaaactctaaaataattatttgacagccaggtgggagggggtccctggagaaactccaaccagcctgcctactagggtggagccttgggagtttgcagcagggaggagcctggcgcctcctcttcctatgtgaacctgggattctagcagcctggtgggaagcactgtagcaggagactctggccttgcagaggatccctgttcccctcatccctttatttccccttttcacttaataaaaccctgctttactcaccctttaaaccatctgcaagcctaaatttttgtggctgtgggatagacaagaaccttctctttagctgaactaaggaaaagtcctgcaatgatcccattcttcacaccaaatatgttttgtttcaaaagtatagttatttatcataaatatgtcattaatattgttaaatcaaatttagcctaaagctgcctccttatatagtttaagcttgacctaaaggtttctctgtacttagtgaattgtagcctacccagatgtgtaaacaagactgtgaactactcttgtgacaaacattggattttggccaatcaaaggaggtcaactcttgacactgctttcaaataaggcaaatattgagctgtaaacaatctggctgtttctatacctcacttctgttttctgtacgccacttttctgtctctgtccataaatgttcttccaccacgtggctgtgctggagtctctgaacctactctggctgaggaggctgcccaattctcaaactgttcaattaaactcggttaaatttaatttgtctaaggttttcttttaaccatataaacaagtgagtttatgattgttatgtcttttttcttttcttttttgagacaaggtcccactctgtcccccaggctggaatacagtggcatgatcacggctcactgtagtctcgcactcccaggctcaagcgatcctccatctcagcctcctgagtagttgggagtacaagtgcatgcaaccatgcctggctaattttttttttttttgtattttttgtagagatagggttttgctacattgcccaggttgatctcgaactcctgagctcaagtgatcctcttgcctcagccttccaaagtgctgggaccacaggcatgagtcaccacacccagctattatttctaaattaatgaacagatgaacattttcaaaatttctcagttttaattttaaatatgattaaaaggatagatataacacacaaacaaaagctctatggagtcctctataactcaagaatataaagggtcctgagatttttctttaaagagaaccactgcactctcctggcctactagctctccgcaatccatcctgcttctccccttggcaggagagacctgttctagaccctcaaggacccctcataacatcacctagctattatctaaggaatctttctccatttggacttcccatttttttcttccccctttaaggtccccttattcttttcatctaattttgtgtgccacctgcagagtccttcttcttcttcttctccttctccttctccttcttcttctcagagtcttgttctgttgcccaggctggattgcagtggcacgatctcggctcacttcagcctctgccttctgggttccagtgattctcctgcctcaggctcctgggtagctgggactacaggtacccaccatcatgactggctaatttttttgtatttttagtagagacggggtttcacaatgttagccaggatggtctctatctcctgacctcgtgatccggccgcctcggccttccaaagtgctgggattacaggcatgagccaccgcacccggcgactaatttttttttttttttttttttttgagacggagtctcactctgtcgcccaggccggactgcggactgcagtggcacaatctcggctcactgcaagctccgcttcccgggttcacgccattctcctgcctcagcctcccgagtagctgggactacaggcacccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcccggccggcgactaatttttatatttttagtagagacggggtttcgccatgttggctgggctggtcttgaactcctgacctcaggtgatccgcccgccttggcctcccaaagtgttgggattacaggcatgagccaacgcacccggcctgagtcctgcttcttccagatctggtgcccagtcctgacgccagaaagggggtcttgttccagaccccaagagtgttcttggatcttgcctgggaaagaattcagggtaagtcgcagagtataatgaagttaagatagttaattagaggctactcaattacagagtagggcatcctcagaaaacaagaggaggaaggcgctaccttaaatgtagtgcttgcttatgtaggttgtataagaattgtgtactttattacaaaggcttgtgatcagcttgtgacaggctattggtactgttattttcctgttactattgatttcagcaagaatttatgagtacactattatatttaaggcaaaacctattccttaagaatgctttttgttcttaaaatactgggacatttccataagttctgagtctttagttagcaacattaactcattccctcaatcataaacatctcatgaccaagagtgcccagttcctggggaatgtaacccagcaggtttggctttattcggcctttattcaagatggagtcactctggttaggacacctctgacagtccctggaaatccaaaggaacccttctgtgtggcacagggaatggaagaaagaaagagatgaggcaggaaaatagggtctggaggcagaaaacataagccgattcacacttcagctatgacaggaaatatcctctccatagggcgtatgcctgtaactttacttcatcctcttcatttacataggacgtatcctaagtaaccaatggaatcgtctagagggtatttaaactcccaaaaattctgtaacagggcctttgagcccctatgctcgggcccgctcccacactgtggagtgtactttcattttcaataaatcccttcattccttccttgctttctttgtgctttgtgcattttatctaattctttgttcaagacgccaggaacctggacgccctcccctggtaatagagagatgagcctttcaaatgacctgactcctttatcccagccaggtgtgtgcccgaccctgaaaggaggaatagggagggggacgttcaacccggcctcccgctctgtgttagcagcgtctggatgggtcagggtggaggtgggggtgttctaccctgctatttgctcctagagaagcttctctgcttcactagtctcacagttctaaaggcaagaacagccctagtgggatcttccaaggattttagaaaagaatgaataagggaaaaattaaaatattgcagggtgccataaaaacatcccagtaaaacaaacacctttctagatgctcattggaacgtaaatggagctcagcccccatcccttcacaccagatccagtcttcatctttgtggttcactgccccctcaccactcaggaggaaaaccccagcttctgttctggctccccttctctcacttagaatttttcaccagagtttcagaaagatttgtcaggaccactccatgcccaaggtaaaaagtgtaagtggtacaaaaaggtagaaactcatcagacccccaaagagtgtcatttaaccatacaaagccctgataaactccagggcagaagaaaaagctgcatccttgactccactggggcattcttatgtaaactaagatccaagaactgcatcaggagagaaatcaagagccctggggatgttaggatgagccctagaggtgctaagacaggttatttgaaaaaccaaaaagtagactgagattcccttccttttcagggaagaattgagacctttcctttcttactgttcagagtgggggctgataagggtaattatttcctggagccactggctactgccctgggaaggaaatccgctgggttgggggagggaggaaggcagaaccaggcattaactctccctccactacatccctttcccgtacccctcccctcctctccttccccccactccctgcccccgccctccgaaaatgacacttggcctgagaaaggaggaaggtagaataggtggacacttcccttgtcctgctccaggggtgtctcagtgacaaggagatgtgaaaaaagaaggaatcccaaggctccccttggaaagaagggagatctccaggggctttgggaagtcaggttagtactgggaaggctgaagactcccagtagatagcgttcagggctgcatttggctgcaatcctataaaatacattcttctctaaggttggatacaagcatttagaagactggccattaaaaaaataaacagtattaataatattaataatcatgagtgtcagtagtgttgaattttttctggaatcctttcccaagttgcctaatgcccagagaaggaaaataacagtgtttagtagacataaattataggattagtgcaagtagctattgagatgatgagccaaggcttgtaaattggttttgttttggttttcctaattagatgtttgcgcctatctgtgtatgtgtgtgtgtgtttgtgcgtgtgcatgctcgcatgtggttaatttcatgacttttgcctctggctcttcctgattaaaaaaaatacttaaaatggtaggaagtggcacacacccttgatggacctgtgtttatattaaagaattggcttagtaaatttaactgggacaaggaaactgtgaaggactgtatttttgccattatttaataattcatatattcaaccgttactgattgcctattttgaaccaggccacgtgctaggatacaatggttaacaaacacattccctcccctcaaggaattcatggtctagtgaaatacagagatagaaaagaaatagaaaagtatatcaataaaatgcattgtggaaagagttatggtcatagtgtgtactatatgcttatagaggctgcctttgtataaacatacataagactgctttttaaattataaaaggcagtacataggccaggcgtggtggctcacacctgtaatcccagcactttgggaggccgaggcgggtggatcatctgaggccacgagttcgagaccagcctggccaacatggtgaaaccccatttctactaaaaatacaaaaaaaaaaaaaaaattagccaggtgtggtggtgggcgcctcatcccagctatcaggaggctgaggcgggagaatcacttaaacccagacggaggttacagtgagctgaggtggagccattgcactccagcctaggcaacaagagcaaaactccatctcaaaaaaaaaaaaaaaaaaaaaaaggcagtacatagtacaaactgcttgggttttgttgttgttgttttactgtaccatataggttggagatcattccacctagtagctgaacattttaagcagatcatctggctacaggcagtgagtaggatgaactgggagagtgatgagtgagttagagagttagggagggagggtgctgtcggagtgttaccggaaaggggtcccgatccacaccctaagagagggttcttggatctcgcacaagaaagaattcagggcgagtccatacagtaaagtgaaagcaagtttattaagaaagtagagaaataaaagaatggctactccatagacagagcagccccgagggctgctgttgcccatttttatggttattccttgatgatatgctaaacaaggggtggattattcatgcctccctttttagaccatatagggtaacttcctgacgttgccatggcatttgtaaactgtcatggcgctggtgggggcgtagtagtgaggatgaccagaggtcactctcgtggccatcttagtgttggtaggttttggccggctccaacaccggcttgttgttttatcagcaaggtctttatgacccatattctatgcccacctcctgtctcatcctgtgacttagaatgccttaactgtctgggaatgcagcccagtaggtttcagccttattttacccagctcctatttaagataaagttgctctggttcacacgcctctgacaagaacatcttcatgcctgtgcctggttgagagagggaggcctctgcgctgctgctggatctagtgaagattcactcagtctctcaaattcctctacagtttctctaatggaagagaaaagtggtgttattgctgctagggagcaacctagaagttattttatttatgccatagatatggtgggctaagcactgtgccaacgttcaataagtcactgcagattctccataaattattgtgacaagtacaattgtttgtaaggcttagatctaggtgtgtaagtccaaagaagggtgtgaagcatctgtatttctgttatgtagttattaggaaaaaggatgttggggccttaaaatggccatttttaacatttccaaacttgtgttgaattctaagattttataattgtatgtttccagttgagaagagctttgatattggtagctctaaataaataaataccgttgacctggaagagaaggtaaagtttagggagaggcctttttttagctttatatttaaacattttttataaatgtgattcatgggccaggcctggtggctcacacctgtaatcccagcacttttggaggccaatgcaggtggatcacttgaggctaggagttcgagagcagcctggccaacatggtaaaaccccatctctactaaaaattagccaggtgtggtagcacacacctgtaatcccagctactcaggaggctgaggcaggggaatcacttgaacccaggaggcgaaggttgcagtgagccgagattgtgccactgcactccagcctgggtgacagagtcagactccgtctcaaaagcaaaacaaaacaaaatgttattcataatgctcgggttgtaactatagtacttatctagcaaaagcttgcttttttttttttggctttgactaattgaaactgcaagagcttactggcagagtggtgtactggtcaatatttaaccaattctccaaaggggaaaaaccctgatttgtatgtaggatttgtcagtttccatggtataaatagtcttcccacagctggtagggtgaccaacttgttctggtttgccaggggctttcccatttttaggcctgaaagtcctgaatcccagaaaattcctcattccccaggaaatagcttgattggtcaccctaatggctggttgcaagctcccgatatgacagaactggacgagaagttgggcagagatgtgcacatggtaccagcctatgccaggagcagcggcctccagcaccccactgtcagggagtccttggcccagtagaggatggttagcagggcccggctgttgttcatattagctctcaaatttaccaccaaccctgtattagtttcctggagctgctgtaacaaagttccacaaacgggggtcttaaacacagaaatctattatctcacagttctggagggcagaaatagaaaattaaggtatgagcaggactctgctcttttgatggctctagataatccgttgtatgtcttttcctcagcttctggtttcacaggtaatctttggcgatccttgacttgcatctgtgtaactccagtctctacctccatcatcctgtggcattcttctttatttttctttctttttttcttttcgagacagagtttcgctctgttacccaggctggagtgcagtggcgtgatctcggctcactgcaacctctgcctcccaggttcaagcgattctcttgcctctggctcccgagtagctgagattacaggtgtgcgccaccacacccagctaatttttgcatttttagtagaggcggggtttcaccatgctggccaggctggtctcgggctcccgacctcaggtcatctccctgccttggccttctaaagtgctgggattacaagcgtgagccactgcactcggcccatggcattcttcttttggtgcctttgtcttcactgacttcttgtaaggaaatcagtcgtattggattagaggcctaccttattccagtatgatctcattgtcttaatttaactaaaacatctgcaacaaccttatttctaaatgaggtcacattctgaggtattagggtttagtacttcaacatatcttttttttttttttgagacagggtctcattctgtcactcaggctggagtgcagtggtgcaatcacacagctcactgtaactttgaactcctgggctcgagcagtcctcctatctcagcctcccagataggtaagattacaggtacatatcaccatgcctagctaatttttcaaattttttataggggctgggcccagtggctcacaccttgtaatccctgtaatcccaacactttggtaggctgaggcgggcggatcacttgaggtcaagagtttgagaccagcctggccaacatggtaaaatcccatctctactaaaaaaaatacaaaaattagccggatgtggtggtgggtacctatcataccagctactcacaaggctgaggccggaaaatccctggaacccgaggggcggagatcgcagtgaaccgagatcacgccatgcactccagcctgggtgacagagcaagacataaccttaaaaaagaaaaaaaaaaatgtagagatgaagtcttgctgtgttgcccaggctagtctcaaatgcctgggctcaagcaatccttctgcctcagtatcccaaagtgctaggattacaggcatgaggcactgcaccaggcctacatcctcttttttttttttttttttttttttttttgagatagagtcttgctctgtctcccaggctggagtgcagtggcacgacctcggctcactgcaacttccacctcctgggttcaagtgattcttctgcctcagcctccagagtagctaagactacaggcataatatctctcttagatatgacaaataatatcacagagtgtacacccactgtgatgttaggagtaatacctccctatgatattacaagtaatactgcctttagatactacaaataatatcacagggtgtacatctactgtgatattaggagtaatacctcccttagatattacaaataatatcacagggtatacacccacggtgatattaggagtaatatctctcttaagcgatcctcccatctcagcctcacagaattaaaggaattacaggaagagctgctatacctggctggatctatgttttaaaaatataacccagataaccctgtggtcagtgtctaagatgaattggattagaccaagggagaaaaactaaagatgggaatactagtttgggactttgcttgcttgcttgctctcatttagaaaacatttagtagttctacaatgctcaggcactgttctgggagtcacaaatataggattgaataaagtaaataaagcacttgctctcctggagctcacttttcactgggggaatgcagatagtagacacatacatctatagtatcagtaagtgctaatagaaaaatgaagcaggtgagatggatcatgctgagtagaatgtatcttcttttccttccttccttccttccctccctccttccttctttccttccttctttctttccttcctttcttcttttctctttcttcctttctctctctttctttgctttttattgtcttaaaatgtacataacataaaatttaccctcttaaccatttttaagaatacaattcaaggccgggcatggtggctcacacctataatcccagcattttgggaggctgaggcaggcggatcatgaggtcaggagtttgaggccagtctggccaatatgatgaaaccccatctctactaaaaaatacaaaaattagccaggcttggtggcacatgcctgtagtcccagctacccgggaggctgaggcaggagaatagctggaacctgggaggcagaggttgcagtgagctgagatcgcaccactgcactcctgcctggacaagagagcaagactctgtctcaaaaataaataaataaataaataataataataataataatacaattcagtagccttaagtacatttgcattgttatgcagccatcaccaccatccatctccagaatttttttgagtggagctctttttaatagagtagttgaaggcctctgtgacacagtagcatctgagcagaagcttgaatgaagtgagaaaagaatccttttgcatagtttaggggaagtatgttccattcctggtcctggaaatagttaagactatcacaatagtgcaggagaaagatgatacaatacagtttgtgtagctgaaaccccgtcttcagaatgtaaaggagaacagatgggaagtcatgttcctcccagaagtaattcatgtagcagagaagccaatgcagatccacgagacagacaattcagtgctctgcacaagaactgtgctttaagcatggagaggatttttgtatctgtcctgggatcctacatcaaacagcatgtggtgattgtgaacacaaacgtacaagactgtgaaccctaccaagtttccttcttccattagatatgaataaggagtcatgagtttcctttggaatgtcctttagcctgttggtacatgttttgcctgtgacgaatgcagttactcataaatcattgagcacattgggtacagagggcaaaagataaattcctgtatttcctctattcggtcaacagaaatacctctaggccataatccattcatccaatctaataattttgccatccataaaaccttcaggtgttctgaattcaacatctttttttttttttttttttttttttgagacagagtcttgctctgtcacccaggctggagtgcaatggcaggatctcggcttactgcaacctccgcctcccagattcaagcgattctcctgcctcagcctcccgagtagctgggattacaggtgcccgccaccacgcccagctaattttttgtattttcagtagagacggggtgtcaccatgttggccaggctggtctcgaactcttgacctcaggcaatccacccgcctcagcctcccaaagtgctgggattacaggcgtgagccaccatgcctggctgaattcgacatcttgcacctaattcctgttcagttaaagacccaaatcatgatctctgacttacctggatatttgaaagattaacttgctgtggtgataccatactagagtcacaaaatcaagccctaccctgccacagccacctaaaggaaattaggtgatatacaaaagaaattgaccatattgttgtccttttagtgactctcctaattttcttcccctgaaaacttacagagaaatttgagtatgtttgccttaggtggatgcttgtttttttattgatatgaaaagcagtaagaggaaatggagttttttggcctgttaaggaagggcagccactgtaaacacagttgagtgcaaattcacagtgttagaatgttgaagtgtatataatgattttgcaaaattttctacaaggctgatacagtatccaatcaggactaggattagatatattgtcatgtatgtttgcgcaggaaatgcagagactctaaggtgctacaactgcaatttgacatgtgggatagttcactggtaactgttgatctccctgaggtttaagtttacagttccacagctctttatctgaaactcttgggctatgtgttatggaatttagaattttttccgaaatacgttgcatatattgtatattatgacatgatacctccaagaaagacttggagtcacatcctataaacaaacacatgaatatatcccagtgaaatgtatgactatttttactaaaacaaatgagaatcataaatagacttacattacttcaggtcagattttgctgccgaattagtttgggcatcgaacttttggtttcagagacaaaactgtgaaattttagattatattatggggttgtggacccatgtaaccctcctctccgtaattcctaaaagcaagcaattgcatcaaccagtctcatgagtagctgcgattctagaaatcaagaatccggatctgaaattagccgggcatggtggcaggcacttgtaatcccagctactggggaggctgaggcaggagaatcgcttgaacccaggaggaaactgcagtgagctgagatcgtgctgctgcactccagcctgggcaacagagtgagactctgtctcaaaaaaaaaaaaaaaaaaaaaaaaagaatccagatctgggcaggaccgaattgctgacatgcccccggtatagcagagacgttttgcctacatgttacacacctgagtaatagttgtcagcagctgatgaagaagatgaatgtgctcttaatgtccatctttgatttccagtcattttgcttctgggtcttggcttcctgaggaaagaagtctccagtaggtgaatgcagtgatatggagaatactttcttctggctgcatgcagtaactcacacctgtaatcccagcacattgggaggctgaggtgggcagtgcacttgaggttgggagttcgagaccagcctggccaacatggcaaaaccccgtctctactgaaaatacaaaaattagctgggcgtggtgacagacacctgtcatcccagctactcggtaggctgaggcatgagaatcacttgaacttgggaggtagaggttgcagtgagccgagatcgtgcctctgcactccagctgggcaacacagcgagactctgtctcaaaaaaaaaaaagtgtgtgagagagagtactttcttcctgtttcctcataggccagttctctctggcatgtgagtttaacatcagtcacctccttcacacacagcgggtgcattcgtaataggaggtccttagctgggagtttttatggcacatcagtggggcgtgaaaacaccacataggagctaatatatctttgctggctgctttctccggctccgcagcagacagaaaccctatgaatcatatccaggggtcaggtgcaggcaacagacaactaatatctcccaagtgagttgaaaaggatcttgttacccagcatcctaaggaggttgtagccttgggaaccacaggcaagaataattaactcagctcctcggttagtgcctcttcagttcgagatggaatttatttgcaggcatggctccttaatatgccaaacccatgctcaagacatactccttctcctggaaggttaacgtggctcctgtggctgttccatccctgaggaaaagtgaggaccatgctctccaaacaggccatgtgctggactacctctgtttctgtctcctgggattccaatcagcaagtgagcaacgaagcaacccagacagtgtggttcataggatggctgggtaagtggctgtttgttttttccttactgtggatatgtatcagtgaaggaatctgtagaacattcttgatgggaacatttagtcatatcaagtcaataaattaatgtttaggctgggcgcagtggctcacgcctgtaatcccaacaccttgggaggccaaggcgggcagatcatctgaggtcaggagttcaagaccagcctggccaacatggtaaaatcccgtctctactaaaaatacaaaaattagctgggtgtggtggtgcatacttgtagtcccagctactctggaggctgaggcaagagaattgcctgaacctgggagatggaggttgcagtgagctaagagtgcaccattgcactctagcctgggcaacagagtgagactctgtcaaaaaaaaattaaaaaaaaagaaaaatcattattttatttttgacttattattaatataaataattatatcttggccgggcatagtgtctcatgcctataatcccagcactttgggaggccagggcaggcagatcacttgagccaagaagtttaagaccagcctgggcaacacggtgaaaccctgtctctacaaaaaatataaaaaattagctgggagtggtcagcttgcctgcagccctagctacctgggaggctgaggtgggaggatcacctcggcccaggaggtagaggctgcagtgagccatgattgtaccactgcactccagcctgggtgatagagtgatgagaccctgtctcaaaaaaaaaaaaaaaaaaaaaaagaaagaaagaaagaaaaaagaaaggaaaagaaatcatatattggtgaggagacaattcaacacatattttttattgaacacatactatgtgtcagggtaccagatataagctctatctacaaggattttaggagctggagtatgtgtatggggggatgtatgagtgtgtataacaaagacgactcctggggaagaagaggaagacaagccccagaggtatactgcataggcataatacacaacaggctagcaaagaagcaaaccatgggtatggtagagagaatcagaggatacattggggaccatgtctagtgagtgaggtcaggagagacttcaataatctgagtgaatttagacatgggccttgaaaagtggacaaggtttgttgttgttgttgttgttgttgttgttgttgttgttgttgttgtttttgagatggagtctcattctgtcgcccaggctggagtgcagtggtgcgatctcggctcactgcaagctccgcctcccaggttcataacattctcctgcctcagcttcccgagtagctgggactacaggcgcccgccaccacgcccagctacttttttatatttttagtagagacggggtttcaccgtgttagtctggatggtctcgatctcctgaccttgtgatccacccaccttggcctcccaaagtgctgggattacaggcgtgaaccactgcggccggcctaaatttgttttaaaagtacgcataggaaggctgggggctgtggcttatgcctgtaatcacagcactttgggaggccaagacaggcagatcacgaggtcaggagatcgagaccatcctggctaacacagtgaaaccccgtctctccaaaaaaacaaaaaattatccaggcctagtggcacacgcctgtagtcccagctacttgggaggctgaggcaggagaatcgcttgaatctgggaggtggagggtgcagtgagccactgcactccagcctgggtgacagagcaaactaggtctcaaaaaaaaaaaaaaaaaaaagtacatgtgggggacaggtgcagtgtctcagcctgtaatcaatcccagcactttgggaggctgaggtgggtggatcacttgaggtcaggagttcaagaccagcctggccaacatggagaaaccccatctctactaaaaatacaaaaattcgctgggcgtggtggcgcacgtctgtagtcccagctactgggaagactaaagtgagagaactgcttgagcccagaggtcgaggctgtggtgagcggtgatttcaccacttcagtctagcctgggtgacagagagagaccctgtctcatataaacaaataaataaaagtttatttatttattacacatatttattacacattattacaagaccttgaactaacaacattaacatgcatttgttaaaggaaaataaattagctcagatgctactacttttcataatacttgcacgattgatttcaatccctgttcatctgaatggagagttgcaggtatactatgcagctattctacttatattctgttttttaatgtaacagtattatttcttgatgtctctacacattttatatcactttaatatttaataaaaacatctaccataagttctaaaatggtaaaaggaagaatagtcattagtactgtcactaccctgaatgaatacaaatacagtttgcactagggcttattttgctcctgtcctttgcctgtgcatttcatttttgcatcgtggtaatcatactgggtgaattttgtattctgtaatttcaactgaatattatatcataagtgttatctacaagttccatgaggaccaaatcttctccacctttttcaccattttacttagcatggtatagtaaagctggctcaataaatatttgctgattgaataaatgttgttacatgctcttcctgattaacatatatatacgcatatacaattttttagtgactgcattaatttacttcattttttcctaattgttggatatttcagttgccatttttttgcttttatgaataatgtgttgatgaaaagatttgtgcatatagttttctctgcatttggactattgtctttttttttttttttaaagatagagtcttgtgctgtcactcaggctgcaatgcagtggcgcaatctcggctcactgcaacctccacctcccgggttcaagctattctcctgcctcagcctcctgagtagctagaattacaggtgcccacgaccatgcccagctatttttgtatttttagtagagaaggggtttcaccatgttggccaggctggtctcgaactcctgacctcaggtggtcctcctgcctcggcctcccaaagtgctagaattacaggcatgagccaccaacgcccagccttgactattgtcttaagatagggtgaaattacaggatcaaatgatttggacagttttgcaagtcttaatgcattttaaattaaaatgctttttaaaaaagctgggacagccaggtgcggtggctcatgcatgtaatctcaactcaggaggctgaggcaggagaattgcttgaacctgggaggcagaggttgtggtgagctgagatcgcaccactgcactccagcctgggcaacaagagcaaaacttcgtcttaaaaacaaacaaaaaaagctgggacagtttacaatgggcaatagccatgtaccagctttaccacaccttcacctgccctggtttttttgttgtgtttttcaattgttgttattgatttaagtgaaagaatttttttttttttttattgatcattcttgggtgtttctcgcagagggggatttggcagggtcataggacaatagtggagggaaggtcagcagataaacaagtgaacaaaggtctctggttttcctaggcagaggaccctgcagccttccgcagtgtttgtgtccctgggtacttgagattagggagtggtgatgactcttaacgagcatgctgccttcaagcatctgtttaacaaagcacatcttgcaccacccttaatccgttcaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccaccgttcccccctttctattctacaaaaccgccattgtcatcatggcctgttctcaatgagctgttgacagaatctcgctctgtcgcacaggctggagtgcagtggcgcgatctcggctccacctcccaggttcacgccattctcctgcctcagcctcccgagtagctggaactataggtgccgccaccatgcccggctaagtttttgtattttagcgtagagaccgggtttcaccatgttagccaggacggtcttaatctcctgacctcatgatctgcccgcctcggcctcccaaagtgctgggattacaggcgtgagccaccgtgcctggccaaatgaaagaatttttaatcaattagcctacttatataaccacagtttacatcacagggatactctgccaaataaatactcattaaaatgtgagcccattattttggtcatgtccctattatctctactattaccctatggataataagcaaagttgcaattcagctgtatctctaatttcaattattaacctatacgtataaataccagttgtattattacagaactatattattgttcacaactctttgaacatcacaatgagtaagtttttacattacgcactatcagtaatattaccttcattttctatgaaggcatccaatgaatatatctatgtgtatgtctatctatatctatatctgtatagctgtggctttctcactggaaattcataggtaatcccaacttcagagaaactatgcttttctatgtgaatttaaaattagttgtatttgccagaggcttaaataaaactacagtgatctttggactgttaacaaatggctaacacaaaatatttatttatgagttgtttgctaaagtccaaatgccataaagcaaacagtatgccacttacttgaactgatattttcttagaaaaactttttaaagatggctttaaaagagaaaaaaaaagcttgttaaaaatgtcttttaaagccattctagccatgaatctagaggtaaccactgactctaaactccatggagatttgtaaattgaatgacttacaacatcatgtcaaagtagagtggactgtaaagtgtgttaaagaggaccaaagtaatctttcacccagtgattgctgagcatggaggagggactgtcgttggctattcctctttcctttcttctcaacacctgactggtagtcacaggtcgggtgtttacctatttgtgccactgctcagagagaaggtggagcttcctgggaggagggacccaggttttctccaggctcaggagcagccctgccctcaggccaggcaggtgtggctggggaggggtaaggagtgccaaaagagcactcagcagtcatgtgacccttgtgaccttggccagcctgtttctgacaggtacagctgcccctatttagtcttcaggaagtaccagaacaccctaaaagcaacctctcactgggtccccttcaagactttctccatcccattaggatccctgcaagtgtcagccagtggtaactggcagatcttctagtccaccccattatgtttattttactgtatttggcttttaattaaattcaaaagagtacattattaaaaagtacaggtgtgggctgggtgtggtggctcaggtctgtaatcccagcactttgggaggcagaggtggatggatcacttaagcccaggagttggagaccaccctggccaacatagcaagaccctgtctccattaaaaataaataaatagccaggcgcggtggctcacacctataatcccagcactttggggggctgaggcaggcggatcacctgaggtggggagttcaagaccagcctaaccaatatagagaaaccccgtctctactaaaaatacaaaattagccaggcatggtggtgcatgtctgtaatcccagctactcgggaggctgagacaggagaattgcttgaacctgggaggcagtggttgtggtgaaccaagattgcaccattgcactccagcctgggcaacaagagtgaaactccatctcaacaaacaaataaataaataaataaagtacaggttcgtcttcaccactgttcccttactcccctaaataacgtctctcacctttccagttaaccactgttaaccaagatgctactcctctttccagcctttttcctacttattagcatatatgtgtatttactaaataaacaggtcaaactatatgtattgttttgcaaattgcctttttccttaaccatgtgtcttgaagaactttgcatattggcccatatggactagcttaccatttttaactaatggagagcattctttagagttggctggcagaaatacactaaaaagttgtgacccccaaatcaggaaaagccactaaagacaactaaaattcatttcaattcaatccccctccccaagtctttttttttttttttttttttttttttaagacagagtctcgttctgttgcccaggctggagtgcagtggtgcaatctcggctcactacaagctccacctcccgggttcatgccgttctcctgcctcagcctcctgagtagctgggactacaggcgtccgccaccccgcccgtctaatttttgtattttgtttttagtagagacggggtttcaccttgttagccaggatggtctcgatctcctaacctcgtgatccgcccgcctcggcctcccaaagtgctgggattacaggcgtgagccaccgcactcggcctttttttttaacatctgaaaacatatagactttaattacattttgttgaaaattcatgagccgggcacagtggctcacacctgtaatcccagcactttgggaggccgaggcaggcggatcatgaggtcaggagatcgagaccatcctggctaatacagtgaaaccccgtctctactaaaaatacaaaaaattagccaggcccctgtagtcccagctactcgggaggctgagtcaggagaatggtgtgaacctgggaggcggagcttgcagtgagctgagattgcaccactgcactccagcctgggtgacagaccaagactccatctcaaagaaaaaaaaaaaaaagaaaattcattcaactttggtgcttatccaaggacttataatgtaaatttctgacataaatcataaccctcagtacataatgtattttcaaaggaaacaagtcatcttaaagtaatatttttctatatgctaattgatacatttttatagtaaattgaaaattatgagtaaactgaaagtatgcttaacaacaaaataaatacagcatatatggttagcatatacatttcttagtgtaaaggcagcagtgaatttgtaccttacaacaaatctgtaactccagtagctttttttctggaatttatatggtgtctcaccatgttccacaatgctagaaaagtcttttttggcatcaatctatgcaaaaatttctgacattttccccaaatgacatgtaacttttttttaacttttccagaaaaatatggaaactttatcaaccacttcttaactgaacaaaaagttagagtactaccaaatgctcttttaattttgctctaacagatgttttaaaagttcagacatcgctgatgtttttaaggataactgcataaaacacactagatgattgctaaggatgaatcttagtatctgactcattcgagacatccttagtatccagaataaaatcagtagaaataaaagtaatataattttcaaagaattcatacatactggaagtcttagaaaaaccagcttctaaatgcaaggactaggagatttgcccatcgtactattaatagttacatacatttctcctcatgaagtaactgaagatttctggcttgtttgtggaactttagtttgtaggaaagcatattcatagggccaaatcttgttggtttctgttccagagaatgtttccaacaccccttttttctggtaatattccaggactggctttgtttgggtttcatgagcctttagtctcttgataaccgtctctggtttatcatcctcacgctgaatgagaggctccccagttagatcatcaatgcccacagttttgggagggttgaattcaatgccgtagacttggccactggtgggatgaatccccaaatttttatatagaaaaaatttcagccggacgcggtggctcacgcctgtaatcccagcactttgggaggctgagatgggcggaccacctgaggtcgggagttcgagaccagccttaccaacatggagaaaccctgtctctactaaaaataaaaaattagccgccattgtggcacatgcctgtaattccagctactcgggaggttgaggcaggagaattgtctgaacccaggaggcggaggttgcagtgagcagaggtcgcaccattgcactccagcctgggcaacaagagcaaaactctgtctccaaacaaaaaaaagggaaaaaaaaaaaggaaaaaatttcaaacataccaaatagtggaaagactaataaatgcccatatactttccactaggttgttaccacattcattgactgccattaatatctgatagggttttgtggttttaacatgagaagtatatgaaaagaagcagaactcatcaagtctcaaagtcttaagaattagaaagaaaaggcgcggtggctcatgtctgtaatcccagcactttgggaggccgagatgggcggatcacctgaagtccggagttcaagaccagcctgactaacatggaaaatcccccgtctgtactcaaaatacaaaattagctgggtgtggtggcgcatgcctgtaatcccagctattcgggaggctaaagcgggagaatcgcttgaacccaggaggcggaagttgcagttagctgcgattgcaccattgcactcgagcctgggcaacaagagcacaactctcgtctgaaagaaagaaagaaagagagagagagagagggagggagagaggaaggaaagacattatcaaatcataagagccaaaggaatgtaaaatccacttaatcgacctgggtggaaggtacaaatttctatgggtagaaaccaaattagtaatcctgggaggtgggctatatggttacccctttttgaaattatgaagcgatttaagtacaaacagggtttggtgagttccagccagatgtacttgctggtagctgtgcaacttcaaacatacttagaatgcaaaatccacaaattactggaatgatacatatatttgcttagtgagtgaaaagaagactcactcctatggtatacaaaatctaatcttgccgtcatctgaaatcttttctttaaagttcactaacaaagtagttgtctggccaagagtggtggcccacgcctgtaatcccagcactttgggagacttaggtgggtggatcacctgaggtcaggagttcgggaccagcttggtcaacatggtgaaatcctgtctctactaaaaatacaaaaattagctgggtgtggtggtgcatatctgcaatcccagctactcgtgaggctgaggcaggagaattgcctgaacacgggaggcaggggttgcagtgagccaggatggcatcactgcacttagcctggatgacagagtgagtgagattccatctcaaaaataaaatcaaaataaaataaaataaaattgaaggtaatcatccacctaggaggtgggcatctttttatccaaaggaaaatttatatatttatttataaatacataaaaataaaataaataaataaataaaaataaattttccgtgtcaggcatggtggcttacacctgtaatcctagcactttgggaggctgaggcgggcagatcacaaggtcaggagttcaagaccagcctggccaacatagtgaaaccccgtctctattaaaaatacaaaaattagctgggcatggtggcccatgcctgtagtcccagctacttgggaggctgaggcaggagaatcacttgaacctgggagttggaggctgcagtgagctgagattgtgccactgcactccagcttgggcaacagagtaacactttatctcaataaataaataaataaataaataaaaaagaaatacagctatatccaacaaccagaataaatcttggaaatataatttgcagtgaaaagagctggttgcagaagactacatagagtgtgattccatttttataaagaagctcaaaaccaagctaatccaaacaacatattgtttaggaagacatacatgtttgttaaaactgttttttttttttaaatgaatgcataatttaggatggtgattacctcgaaatggatggagaagatgggtttaggatttggaaggcacatggtagctttaaaagcaatggcaatgctttatgcataaattgtttggtgggttcatgtattcattttattatatactcctaagcttacagagatgttacttattttatatatatcaaatattgtataataaaatgtaagtgaaaaaatgctacttttataaaatggaataatcaagcaaacatgttaagttaaaacctagagaaagggttttagacttgtaactttaactaattggatactcattttggaaccaaagcaaacatctgaatagtccatacagaaaaacatttaacacatcatatagcgtaacattgtttatcctgccattcttttggtggctaaaaatgtaattttaatttttgctatttcagatacacaggaataagcatttttgaacttctttccttcttttttttttttttttgagacagagtttcactcttgttgcccaggctggagtgcaatggcatgatctcagctcactgcaacctccacctccggagttcaagcgattctcctgcctcagcctcccgagtaggtgggattacaggcacctgccaccatgcctggctaattttattattattattattattttagtagagatggggtttcatcatgttggtcaggctggtagcaaactcctgacctcaggtgatccacccgcctagcctatctttttcaatacttgtgtaagtattgttttttgagatagatgcttaagaatggagtgctgagtcaaagggtgaggagactgaagtgagactcggagaagttaaatgcataactcacatcacacaggcagcaggtggcaaagccaacagggctccttttggggctccacatcacccccattacaaagaaaacgatggttctggccgggcgcggtggctcacgcctgtaatctcagcactttgggaagctgagacgggcggatcacaaggtcaggagatcgagaccatcctggctaacacggtgaaaccccgtctctactacaaatacaaaaaaattagctgggcatggtggcgggtgcctgtagtcccagctactcgggaggctgaggtagaagaatggcgtgaacctgggaggcggagcttgcagtgagccgaggatcgcgccactgcactccagcctgggcgacagagcgtgagtccgtctaaaaaaaaaaagagaaaacactggtcctgcccagcacggtggtgcctgtagtcccagccactcaggatgctgaggtgggaggatcatttgatccctggagttcaagaccagcctgggcaacacagcaagaccccatttctaaggaaaagaaaatgaaaacattggtcctgtcaaaacgagtgctccactttccactttgatttgactctttcccattcttgtttgcccagactgcaggtgaagctcagtattgatttcaggacctcaggatacagaacacaagagctccctgtcacgagaggcacagaatagagctttgtctcttaaaaaggcttgattgcttctacgtgactgtcttgctgccagtggcagggagggaggctttgctgagcaccaagtcagaactcagagttcctgcgccatttttcatagtgctgcccttgtaacccaaggaggcgtcccattttatttccctgggcagattttgcaatgctcagtcgtcaaaatggaaatgtttattagctacggaaaatgctgttttgctgattacagaaaaacacagacaaagaaatacatacaacatggacctacaatgacaagaaaaacaaagatgtcagttaccacctatgcttgccagagtccctgtcttcctatctgaacacattccagaacaatccaattcttctttgaaatgttcattttatttcagatacagaaagaaattaaacaagattgggtgcggtggctcatgcctgtaatcccaggtcttttgaaggctgaggcaggccgatcacttgaagtcagaagttccagaccagcctggccaacatggcgaaacccccatctctactaaaaatacaaaaattagctgggcatggtggcaggtacctgtaatcccagctactcgagaggctgaggcaggagaatcacttgaacttgggaggcggaggttgcagtgaactgagatctcaccactgcactccagcctgggaaacagagggagactcctaaaaaaaacaaaacaaacaaaaaaaaaaacgccaggcgcggtggtggctcatgcctgtaatcccagcactttgggaggctaacgcgagcagatctcgaggtcaggagagatcgagatcatcctggctaacgcggtgaaaccacgtcgctactaaaaatacaaaaaaatttgcccggcaaggtgacaagcgcctgtagttgcagctactcgggaggcttaggcaggagaatggcgtgaatctgggaggcggagcttgcagcaagccaagatagcatcattgcactccagcctgggcgacagaatgagactccgtctcaaaagaaaaaaaaaaaaaaaaaaaaaagccaggtgcagtggctcacacctgtaatcccagcactttggggagggtgaggcgggtgaatcacctgaggtcaggagttcaagaccagcctgaccaacatggcgaaaacccgtctctactaaaaatacaaaaattagctgggcgtggtggccagcgcctgtaattccagctactcgggaggctgaggcaggataatctcttgaaactgggaggtggaggttgcagtgagccgagatcgtgccattgcgctccagcctgggtggcagagtgagactccgtctcaaaaaaaaaaaaaaaaaagaaaaattaaattagtatgccactcagacacaggtagtagcaacatcaactctatatactaaatcagtggtatgtgaataaaacatgccattaaataattttcctaaaatttttaccaacttagagaatatagaatttcttcaaatatctcataatttttcctagagttttttttttttaacccaagacccaaacaagatttacacattgtatttcactgatctctcttaagtattttagtctgtaggtttctcctccatctttttttttttttttttttttttttttttgagacggcgtttcgcttttgttgttcaggatggagtgcagtggcacgatctcggctcaccacaacttctgcctctcctgcctcagcctccagagtagctgggattacaggcatgtgtcaccacgcctgactaattttgtatttttagcagagatgtggtttctccacgtttgtcaggctcgtccccaactcctgacctcagatgatccacccaccttggcctcacaaagtgctgggattacaggtgtgagccaccacgcccagcctcctctatcttttttaatgccttgctgcatgttgaggaaactgggcgatttttcttttttctttttttttttttttttgagactgggtctcactctttcatccaggctggagtgcagtggcacgatcacaactcattgcagcttcaaccttcctaggctcaagtgatcctcccacctcatcttcccaagcagctgggaccacagcatgcactaccacatctggctaatttttttttttttttgagacagggtctcactattttgcccaggcttatcttgaactcctgtgctcacgtgatcctcctgcctcagcctcccaaagtgctgggattataggcaggggctatcacacccagcctgagtgatttttcttttagagttttttacatcctggacttcatttactgtacctagcagtagtgtagtgttgtttaacacattcctctatttcaagagtttttctaaacagttaattggatctagatgctgggtcagacactagtttgctctttttggcaagaatatgtcatttgtggttgtatatttctatcagatggtacataatgcctggtgatctccttttctgtgatgtgagtggctattcaatgaccactgcctggatctgttattttattagagttttacaaaatgctggtaattcaaatgtcattccttatttattgactgacataattccctcatcaagtcttcagttagttactctgagatacaagtggtacatacacatcttagcttgggtcttccaggaagcagagcctagagacaaaggcttgactggagaatgtggtgatcctagggaaagaagtgagggatggggaagcaggagagacaattcaagggagcctcactgaataggctgctgcttcaggttcctgaatggttggctgtgtgtgaccatatgagttgtatagaatgagtctcgggctccttcatcttgcggggaaaagggaggaagttttatcagttcctgtcccccactcgttaaaggttagaccatgaaacattaactcccccacacttcagggtgctgggttcatgggcaccctgatagcttccatagatccccacactgtcattaagagagaacccctggaatgggaggtaagaggtaaggattttttttgttttgttttttgagttggagtcttgctcttgtcacccaggctggagtgcaatgacacgatctcggctcactgcaacctctgcctcccgggttcaagcgattctcctgcctcagcctccttagtagctgggattacaggcacccaccagcctaggcctcccaaagtgctggagttacaggcatgagccactgtgtctggccaaatggtaaggttttttgttttttggttttttttttgagacggagtctcgctctgtcgcccaggctggagtgcaatggtgtgatctcagctcactgcaacctccgcctcccgggttcaagcgattctcctgcctcagcctgtcaagtagctgggactaacaggcgcgcgccaccacgcccagctaatttttgtatttttagtggagacggggtttcaccatgttggccagggtggtctcgatctcctgaccttgtgatctgcccgcctcggcctcccaaagtggtgggattacaggcatgagccaccgcacccagccaaccaagtggtaaggtttttaagggttgtccctgcatgaagtggtcagagcccccctggaacttgctgctgcagtagtggctggaataagataggtaaggccaagaagatctgaaatggtacataagaaatgttagatccagaaaaggcaggcaaaatgtgcaattcttttcctttatttaccatttgccagctttcaaaataatgaactagttctattgtatttccaaagttgagcaattaagatttttttaaaaatatcattatgactcatggatatacaaatatttgatatgtctcaatttattgctgtgatttttcttattgatgctcaaatttattccactttggccagcaggagtttctacaaattggttccagatgacatttcaaataaatttgtttctgagcgcttccttgctttctgaattggcaagatattccaggcttatttggcattcatcttactctagacctattatcaaccatgtctccaaggataagtagatccttttaagggaaaatggtattttgaaagcatagtgtgggatctgaggatacctattcctgtcaggttggttattgtttgttttcagtgagtagatcttggactttattaattttatttatttattttaagaaaagtacatcatgagttataagtaataattccaactcaaattttaatattgcttaacttctttgattttatatttatcttttacactgaaaagtcttggctgggcatggtggctcaagcctgtaatcccagcactttgggaggccgaggcgggcggatcacggggtcaggagatcaagaccacctggccaactggtgaaacctcgtctccactaaaaatataaaaattagccaggcgtggtggcgggcacttgtagtcccagctacttgggaggctgaggcaggagaatggggtgaacccaggaggcggagcttgcagtgaaccaagatcatgccactgtactccagcctgggcgaccgagcgagactccgtctcaaaaacagaaaaaaaaaaaaagaaaaaagaaaaatattgatatctaaggatattaacataattactgctaacattatgattattcaaaaaggttatagttttttttcttaaagttctctttgtccttagttatatccccaaaggctatagagtcaaataattgtggattttcttgttcagtcatccaggctgaagtggagttcagtggtgcgatctcggcttactgcaacctccacctcctgggctcaagcaattctcgtgcctcagcctccacacttggctaatttttgtatttttactttatttatttagagatggagtctggctctgtcgcccgggctggagtgcaatggcatgatctcggctcactgcaacctccgcctcccggttcaagtgattctcctgcctcagcctcctgagtagctgggattataggcaggcaccaccacacccggctaatgtatctttagtagagacggggtttcaccatgttggtcaggctggtctcgaactcctgacctcatgatcttcctgccttggcctcccaaagtgctgcgattacaagcttcagccactgcgcctggccttattttttgtatttttagtagagatggcctgttgaccaggctggtctcaaactcctggcgtcaagtgacctgcccaactcagcctcccgaagtgctgggatcaagagcatgagccctttgtccagcccaaataattaattgcgtctgtgtgtggttttttgttttcttttgagacagagtctgcctctattgcccaggctggagtgcagcggcctgatctgggctcactgcaacctctgcctccctggttcaagtgattgtcctgcctcagcctcctgagtagctgggattacaggcatgtgccaccacacttggctaatttttatattttttttagtagagatggggcttctccatgttgaccaggccggtctccaactcctgatgtcaggtgatccggccagctcggcctcccaaagtgctgggattacagggtgagccattgctcctggcaataattgtgttttaaaatcactttatataatttctcttcacactgttaagctaccaacttgataccagcattcatgtgttgcattttgctttttttaaatttaattttgtttcataagaatgtaaaaaacatttatatcattccaaagtcaaatccacaaaacacagtatattcttttttttttttttttttttttttgagacggagtcttgctctgtcacccaggctggagtgcagtggcgcgaccttggctcactgcaacgtctgcctcccgggttcaagcaattctctgcctcagcctcctgagtagctgggattacaggtgcccaccaccatgcctgggtaatttttttttgtatttttagtatttgtaatgattttgtatttttagtagagacagggtttcaccatcttggccaggttggtcttgaactcctgacctcatgatccacccgcctcagcctcccaaagtgctgggattacaggcatgagtcaccgcacctggccaaaacatggtatattctgagaagtctagcttcgatccttgtccttccatcctggtccctccctcccttataggtttccattttatttaataatttatccttccaaaaaaaaaagcaaatgtacttacgtgtgtttctgctttcctaggtaaacagtagcatcctacatacgcttttattactttgttaataccctagtttctgacaaattattgttcatctttcttaaaattgcagtgttcttcaggcttgatcttccctcttgttgaaataagttgttgatgggtatcatcagaagtctaacctaaatgaaaatgagtttttgtttttgttttgagacactgtcttgctctgtcaccaggctggagtgcagcggcacaatctcagctcactgcaacctctgcctcccaggttcaagcaattctcctgactcagcctcccaagtagctgggattacaggcatgcaccatcacgcttggctaattttgtacttttagtagagacggggtttcaccatattggccaagctggtctcgaactcctgacctcgtgatctgtccgccttggcctcccaaaacgctgggattacaggcgtgagccactatgtcaggcctgaacctgagttttataaaaagtactgttatccattctattacttctggcaaaagtttgcgtggggaagagtttggcagtcctaagcaaagttgtctggcgtgagtgatggcatcgatacccaggattttgtgtgtgtggtaaaatgtacatggcataaaatgtaccgttttaacttttttattttttgtttgagacggagtctcactgtgttgcccaggctggagtgcacagtgcaatggcaagatctcggctcactgcaacctccgcctcccaggttcaagcaattctcccgcctcagccttctgagtagctggtattacaggcatgcgccaccaggcctaggtaatttttgtatttagtggagacggggtttcaccacgttgaccagggtggtcttgaactcctcacctcaagtgatccacccgccttggcctcccaaagtgctgggagtacagtttgagccacccagcccagccctttttaaccttttgttttttttttttgttttttttttttgagacgtcgtctcgctctgtcgcccaggctggagtgcagtggcaccatctcggcttactgcaagctccctttcccgggttcacgccattctcctgcctcagcctcccgagtagctgggactacaggcgcctgccaccacgcccagctaaatttttttgtatttttagtagagacggggtttcaccatggtagccaggatggtctcgatctcctaacttcgtgatccgcccgcctcggcctcccaaagtactgggattacaggtgttagccaccaagcccggcccgttttaaccatttttaagtgtacagtgtaaggcactgaaaccgcctttgcaaaagtataactgaggaaattatgacagtgaaagaaatcagacctaactgactctatcttgcttctaacccttaagctgtccttgttcgttcctgggtgtaggcggaactaactttgggaaggaattccgttcatgatttgactctgaaacaaagttgctaacagccctttcctgaaaaagactcccttcttgcctggggtccagtctgcctttgcaggactaacaaattagctacaagattagaaattacagtttaggggtcttgctgcttccggatccaagagtctgaacctctccaaatttgctcctgtggataacatcactattgtaaaacctaagagcagtgcttgagatattttgcagaccctgcactcgatggatcagctgacaccacctggaccagtaacctggcccaaccagttctg

SEQ ID NO: 1090 - DNA, 80550 bp, Homo sapiens
ggcttcacctgagaaagtgaccttcaactcactcagtcttgcagtaaattttcaaattattctgggattgttactagctccacctaaggagtagtcaagcatatacctagtctccagagtcattagaaacaggcaggtgaggagagacaccttgacaccttccatttgcaaaattcctgatcgtattcccaccactatcagagagtatcataagtagctaagaacccttgtgagccttcagggccagaaattgtccaatgctacctagggggatgccactgggatccccacactgaagtcccatctgtgcatcagtaagttattatttacctacattaaaggaacttgtatcctctccgtgtgtctagtagggtctctgagtggcagacagcctgtttatcaaatatagtagtaaatgcattgtaatgaaatcagaaatgccaaagcctatgctgatttccaaaggacaagggaccacctcacatataaaatctttaatatggtcttaaatactacccacatcctgttaaatatataccacacaatgcaaaaacattactcagtgcaatctgttaaacagatgcagaaagtaataaactgtctcttcaatataattttcaagtcacttaattctatatttttctcccctagtgaatgtgaaaactataaataacctggtggaacaaaatcacttcaaatatcttgtccaacaatcactcacaatccctcaaagtgtttgcatttttcctagttgaatagcaattatcaattttatggagcatcaagttcagttttattggagaaggaaggagatggaggaggtgacagaggaggaggagtgggaggaagagtgggaggaaacacttcagaacaatttcaaattatctatggacttaaacagaagagctgttttcagtataatatgatcaaactataatactcctgaccaagaaagccaggctttctttcaagtgaatgtaaaatactaacaaaacagaagaaaaatcaagtataaggaagaaatctacctatgagcaaagactgtagaacaccatgatttctaaatcatgccttcgtgatttggagtggtgtaaatcacatcacaatgcttcgaccccccggcccccatagtttaaaataataccagtagacctgtgaggataataaaagatggtcctttttaagcaggttacatgtatagaggaatggaatctgccataaagcatatatatataatatatatatatatatatatatatatatatatatatatatatatataatatatatatatatatatatatatatataatatatatatatataatgaagttaaatccatttgcaaaataatttcatttgatgaagccatttgaccaaggtgtaaacatacaaggcactgtctggtcatctttcattgtgggaaacaataggcagcaaatcttattaagaaaaaaaaaacctcttctggtaagcaactctagcctagttaaatatttgaattaaatttgaaaaatacaaatgtttaaatcagcattagagagtaagagctggaaggtgtctcagtgattatccagcctaatttctttgttttacagaaagagcagcttcagtgattcgaccaaagtcagataaataggcagcaggtctggcattcaacctagatcttaggactcaagttcagtgcttttaccatagtgcttttccaggtgttgctgttggtgtgtaaagtaactttggccacttacaaagtgatttcacttagaggctctgatgagtctacttaattaatacaattcacggttactggtagccatctaccagtacagcctgtctaatcaaacatcaagtccttgatgatcacctattaatatgtgtgcagcaacacagggaatgtagaagtatacgacattctttatatccaaatacttcaaagctacttgagattaagctaacagctgaaacagggtctaaagcacgatgatgaatatgtggtgcaaatcacagatgatcctctacataccatggggctatattcagaaaaatccatcataagctgaaatatcaagttgaaaatgcatttaatacacctaacctactgaatgaacatcatagcttagcctagcctaccttaaatatgctaaggatagttgcattagcctgtagctggcaaaatcatttcaaaaaacacaggcaacacagtacactatagaatatctgttgtttaccctcaggatcacatggctgataggagatactgcttgctgccactgcccagtgtcaggagagagtattgtaccatatatcactagcccaggaaaaggtcaaaatttgaagtatagtttctactgaatgtgtatcatttttgcagcatcataaagttgaaaaatcattaagttgaaccatcataagttggggactatctgtcttagtgtcaaaatatttcagaaaaggacaccatctctacaaaaaaaaattaaaaattagccaggtgtggtagcacatgcatgtaattcctagctactcaggaggctgaggcaggataactgcctgagcctaggggttcgaggctgcagtgagctatgatggtgccattccactccagcctaggtgacagaatgagactctgtctctaaaaaattaaaaaaggctcatgatggccagatattcaagtaaatgaatggagagttccatgtccagccttgagggaataaaaactaaaactggaccagtcctcccactgtaaacaacagtttcagagagtagacagcaggaagcccagtactgtgatcagagaaaaacagagaaatcagtgaggtgcattttgtgatcccccatttctgtctggagccacttaccagattccagggcagagaggggaaatacagagtatatgggtcttgtggagctgtggagataaagatcagagttcaaagaggctgcagcacctgaaatttgcagtgcagagtatctgagagaagggtgctatgcagaaaaagaggttcagaaatctcagaggggggtctatttgtgtctttagccctaaactaagctaaacattcacagtgtgaaagcccttgggccagacaaagaataatcaggaaagtgttagctgaacaactatcaaaattatcagaggactagaagatatttaagatgtgaacaaatatagtggagagaactcatttagctcccagggaattccacgccttaagaacagggctagactagagctagaatgccccaggagaatcaacctctcagactgaacctgaacagggaaatagaaaacacatattttctgtatttggagagcttaactcttctcactcagtaattaacagtaaatgtagagagaaaatcagtaagtcatagacatcaacacgatcaactaacacgacctaattaatatttgtaatacattacagccagtcactgcagaaggcaaattatttttatgggtacactaagataaattgggtcataaaacaagtctaaatacatttaagatagttgaaatgaaacacaacatattttctaatcacaacagaattaagtttcaatatcaatgacaaaaagttacctggaaaatcttcaaatacttagaaattaaacattgaccttctacaataattagcacaaaggtcaaaaaagtacaagacaacttagaaaacattctgaactgaatgaaaattaaaacatagatattaaaatatgtgagatgcaactaaataaatgtttaaattttagtgttaaatgtttacatacttaaaaaaagtctaaaatcaaagatctaagcttgcatcttaagaaactagaataagagtaaatttaatctgaaagtaggctaaataataaaggtacaagcagcaattagtgaaacagaaaaaaaaaatctaagaaatttagaactggttctttgaaaaataaataaaattgacaaaatattaattagaccaataaagataaaaagaaagcacaaattggccatatcaggaatgtcttattgatattaaaataaaggaatattttaaacaatgttatgccaataaattagacaatttagatgaagttgacaaattccttaaaagacaaattgtcaaaactgacataagaaatagaaaaattggccaggagcagtggctcacgcctgtaatcccagcaccttgggaggccaaggtgggtggatcacgaggtcaggagatcgagaccatcctggccaacatggtgaaactccgtctctactaaaaatacaaaaattagctgggcatggtggtgcgcacctgtaatcccagctactcgggaggctgaggcaggagaatcacttgaacccgggaggcagaggttgtagtgagctgagattgcgccactgcactccagcctggagatagagcaagactcttaaaaaaaataaaaaaaaaaaagaaagaaaaattggaatagccctgtatctgttaaatcttctcagcctcaaacccactcgtttgacctgctttatgatactggagctgggtcctgccaacatttctcctgtgtcagatggcatacttaagctttatcagtgaaggttataaagacactgcaggaggaagcagcttctcttctctgtcccagtgtgctttttccttcctgcttctgtggcatgtggctactagcaagcagcatttgggacacccagtgaagcacctcttccagtaggagttggaacaaccagtggcacttactttgccgggattttcaccaacaatcctacaggtggtttcccagaaagtttcaccagcaccacaaagggtggtttcctagtgagtttcagcagcgccttaggaggagcttccccaggagtctgacacataccccagaagacagtttcccacttgccagccccagcacacagcatctcagcaaactctaggccattccagggtcacactatatcaacactatatcatctgcagttgagatctgagcctcagccatgtaaggaggatctcttccgagtttgttcccgctgtgagtactctgccccggcctaggaagtggctggtctctacatctgctcttcctgtattctttggagttctctctaccccttagctgctaatctcattactgttaataattcttaagattagattggtcctggcatggtttctgtctcctgactggaccctgactgatacaactgatgaattctaagatttaagaacctcacaaactttcagagaataaagaaggaggcagcatttccaaactgaatttatgaggtatcaccctgccaccaaaccagataaagacattaggagaaaataaaactagatcaatattccacaggaacacagacacaaacacttttagccaaatattggcagattgaattcaccagtacataaacagggtaacaaaccccacttcgtcatgacatatctcacaaatgcaaagttgctttaatatctgaaaatcaaaccatgtgatatatcacattaacgtaataaagaagatagtataactatctcattagatgtagaaaaaaagcatttaacattcagtactcattcataagcaagcaggaagtatgaaaaaaattccctaaagggaatctaaaaaagaaaaaaagaaagaaaactctagaactaacttcacacttaatggtgaaagagactcttcctaagatgaggaacaaggctgatacatctgttcttaccacttctcaacattgtacttgaagtccgggtcagtgtaataaggcaacaaaagcatcagaaacacagcagaaatattgaaaaggaagaagcagaattgtctatattcacagatgacataattatatatgtagaaaattctaaagaatttacccaaaaaaagctaaactaaaaagtgaatttcgcaaggcagcaggattgcaggtcaatatacaaaaaccaactgtatttctatgtatgagtaacaaataataaacactatttacaatagcatcaaaaacataaactatttaaggatacatttaataaaaaacatcttcaagatctgtatgctgaaaactacagaaactgctgagagaaattacagacttaatgtatgaaaaggtgtcactgctcctcagcaaatgccaaagaactgaaatcatagtctctcagaccacagtgcaatcaaattagaactcaggattatgaaactcactcaaaactacacaattacatggaaattgaacaacctgctcctgaatgactcctaggtaaataatgtaattaaggcagaaatcaagaagttctttgaaaccaatgagaacaaagagaacatacgagaatctggggaacacagctaaagcagtgttaagagggaaatttataccactaaatgcccacatcagaaagtgagaaagatctcaaattgacattttaacatcacaattaaaagagctagagaagcaagagcaaactaatccaaaaactagcagaagacaagaaataacatcagagaagaattgaaggagatagagacacgaaaagccctacaaaaaaatcaatgaatcaaggagctagttttttgaaaaaaataataaaatggatagaccactagctagactaataaagaagagggaagaatcaaatagacacaataaaaaatgataaaggggtatcaccgctgaccccacagaaatacaaactaccatcacagaatactataaacatttctatgcacataaactagaaaatctagcagaaacggataaatttctggacacatataccttcccaagactaaactaggaggaagtcgaatccctgaatagaccaataacaagttctgaacttgaggcagcaattaatagcctaccaacaaaaaagcccaggacaagatggattcacagccaaattctaccagaggtataaagaggaactggtatcattccttctgaaactattccaaacaattgaaaaggagagactcctccctaactcactgtacaacacatcatcctgataccaaaaactgggaagagacataacaaaaaaagaaaacttcaggccaatatccctgatgaacatcaacatgaaaatcctcaataaaatactggcaaaccgaatccagcagcacatcaaaaaattcatccaccacgatcaagttggcttcatccctgggatgcgaggctggttcaacctatgcaaatcaataaacacaatccatcacataaacagaaccaaagacaaaaaccacatgataatagaggcagaaaaggactttgataaaattcaacatctctttatgttaaaaactgtcaataaactaggtattgatggaacatatctcaaaataagaagagctatttatgacaaacccacagccaatatcatattgaatgggaaaaaactggaagcattccctttgaaaaccagcaccaaggcaaggataccctctctcaacaatcccattcaacatagtatcagaagttctggccagggcaatcaggcaagagaaagaaataaagggtattcagataggaagagagaaagtctaattgtctctgtttgcagataacatgattctaaatttagaaaaccccatcatctcagtccaaaaactccttaagctgataagcaacttcagcaaagtttcgggatacaaaataaatgtggaaaaatcacaagcattcctttacaccaacaatagacaagcagagagccaaatcatgaatgaactctcattcacaattgctacacagagaataaaatacctacgaatacagctaacaagggatgtgaaggacctcttcaaggacaactacaaaccactgctcaaggaagtaacagaggacacaaacaaatggaaaaacattccatcctcatggataggaagaatcaatatcatgaagatggccacactgcccaaagtaatttatagattcaatgctattcccatcaaactacccttgacatttttcacagaattagaaaaaactactttaaatttcatatgaaatcaaagaagaccccatatagccaagaaaatcctaagcaaaaagaacaaagctggaagcatcatgttagctgatgtcaaactatactataagactacagtaaccaaaccagcatggtactggtaccaaaacagacatatagatcaatggaacagaacagagacttcagaaataacaccacacatctacaaccatctgctcttcgacaaacctgacaaaaacaagcagtgggaaaaggatctcctattcaataaatggtgctgggaaaactggctagccatatgcagaaaactgaaactggaccccttccctacaccttatagaaaaattaactcaagatgaataaaagacttaaatgtaaaacccaaaccataaaaaccctagaagaaaatctaggcaataccaccaaggacataggcataggcaaagacttcatgatgaaaatgccaaaagcaattgcgaaacagccaaaattgacaaacgggatctaattaaactaaagagcttctgcacagcaaaagaaactatcatcacattgaacaggcaacctacagaatgagaaaacatttttgcagtctatccatctgacaaaggtctaatatacagaatttacaaagtacttaaatgtacaagaaaaaaacaactccatcgaaaagtgggcaaagaatatgaacagacactactcaaatagaagacatttacctacccaacaaacatgaaaaaaagctcaacatcactaatcattagagaaatgcaaatcaaaaccacaatgagataccatctcatgccagtcagaatggcaattattaaaaagtcaagaaagaacagatgcaggtgaggctgtggagaaatagaagtgcttttacactgttggtgggaatgtaaattagttcaaccattgtggaagacagtgtggtgattcctcaaggatctagaaccagaaataccatttgacccagcaatcccattactgggtatacacccaaaggaatataaatcattctgatataaagacacatgcacacataagtttactgcagcaccatttacaatagcaaagttatggaaccaacccaaatatccatcaaccatagactggataaagaaaacatgatacatatacaccatggaatactacgcagccataataaagaatgagatcatttcctttgcagggacatggatgaagctggaagccgtcatgctcagcaaactaacacaggaagagaaaatcaaacactgcatgttctcactcataagtgggagctgaacaatgagaacacaaggacacagggaggggaacaacacataccaggggctgttggggggtggggggcgaggggagggaacttaaaagaatgggtcaataggtgcagcaaaccaccatggcacacatatacctatgtaacaaacctgcaccttctgcacatgtatcctggaacttaaagtaaaataaaatttttaaaaaggtgtaactgctcatggatttgaagggtccatattagtcagatatcagttctctccagatttatctataatttaaatgcaatcacaatgaaaattccatcaggctctttgcagaaatagagaaaataattttcaaaactttttttttttaaaaaaacatgtatctggaagatgtaaagagctcttaaaactcaatggaaaaaacagaattttttagatgagcaaaatatttgaatagatattacataaaacaaagtacataaatgtccattaagtccatgacatctgctcaatagctttagtcatcagagaaatgtacatactatacacccacaattaagggttaaaattaaaaagaatgacaacatgaagcactgacaagaatgcagagtaactggaacttttaaacattgttgatagaagtgtaaaaccatacaatcattttggaaaacagtttggtagtttcttataaagttaaacatacaattaacataagacccaggaatttcactcctcagtattcatccagaagaaataaaaatatatttgacacaaagattgtaaatgtagacagttttaattgtagtatcagaaactggtggggaggaaacaaattgtggtatattcatacaatggaaaactcttcagaaataagaaggaacaaaccactgaatcacacaacatggacaaatctcaaatcattatgctgatggaaagaaaccattcataagaatacacagtacatgacgccgctttcatgatgttctggaacaaagaaaactaacctatagtgatagaattcctatcaatggctgccaacaattgggagtgaaaggaactgactgagcaggtatacaagagaaccttctggggtgatggaaatattctgaagcttgactggagtgttggttacatgggtatatcaatttatcaaaactcactgaattgtatatttaaagtaggaacattttattgtaaataaattacacctctataatgttcgttttaaaaaatattagatacatcagctggaaatcacttggttttaacaaaaaattttctctgtaatcttatttattctagcacttatcttcttgtcttcaaaagcaatgcaaaacttcactgtagctaagcctatgttagactcttacaaattcctaaatagtagaattagttcaatgagtaattcttataaataattctagatttactttacctacatgaataactgatttgctacatagagccacattaatgcttagtataaatcatacaacatgatgaacacgctcacgtatatttaaatataaacatatttggactttaaaaagtaagtacatcttaggagatgatccaattctgggagttagcaaatgtctaagtgctcccctccttccacacataaggagagaaaagcattcatcagctgtgtgagtctgttaccagtgcacatgtgaggacagaccacagcacagtgagatgaggctgaggaaacgactacaacagcattggctatatcaggttttcttccttcttccagccacctggaaaaacgttcacagagagttatagtggttacaagaccaaaacttggaatcaaaaaaattaaataatgcaaataacccaattaatctgctaatatctattactgcagaaatagtgttagaggtagtttattaaagaggcatttttaaaatcatcccactcatcatatcctgcatttcaaaagtatcatcttaaaaaggaaaataaaaaaatactttttagagcataaagcataacaggttgaagtggttttcaaaaagctacttctagtgttcttcagctttctattatggcagcatcatcttgtgatgaagacactggctcacttggacacacggtcagcatgcataaatacatctcagtgatgatcaagttactgccatctacaggaccgcttgcaaataagatgaagagagctacctcagtgttagcagcaaggcttcgaggtctgtactactcaaaccactcctaagggtatggccaatgcacagtttgaatgttagggaacacaccaggtaatgttaaagattcaccagttttccccttggaattaattctaataaaatcttccacagggtaaattaaaaataaatttctctccccttttactcttcattatttttagtctcaaaagcctcatatactgttccaatgaaacaagaattggctctgaaccaaaaccaaaaagaagggaagaaaatccagagtattctatgatgccctgttaagtattagcgtgtggcttccacaagaaagttgtcaaactgtgcaaattcaaaggagtgagttccaattgcagcccagccattctttggaaaattcacagggatgtctgtccacagagacttgtcattcagcatgccagaggtgaaatgaccctagagtagaaagaaacacattccttgaaaccatatgaaaatggtcctctgaagtctgtttcttgatcatgtatggcccactacttagtggagcaaatgtactactcactcaagacttaaccacagcaaaacacaattccacaagtttgagcaaaagtttaaaatacaggaaaaaactctaggaagaaattcttatctacctacttaaatcgttcccaaagtacaaggaatacctcaatatttcctgtgctccaccaaaatttaaaaccaacaaaatgcaaaacttttcaggcattattataaagttttagaaaaaagctcattaaaatttaacaaaagttatttataagtagtcacatgtacaagtggtgtggctaacagccaccagctcttcagacatgactgctggagtcaaaacatctgcttctacctcattgcttccttaaggttttcattaaggagcctctgcccagccagaagaaaaataattaaccttagtttttgtgttttgttgccatgaatagaatatcacttcaaagccatatgaagctcctacccttaagttggaaaaacagtaaccatcagttaaagtgatgctggagtagggtgcagcgggtggaagaagggaggcatctataaggtgtgacttactggtcactgacagtgaaagaaaaaattacaccttcctccgaatgttgccattctacttagctcagtgcctggcacatggtaaacaataaatctcagctcttattatctttatgatagtacatttatgagcacatattcacagcatactaactacagtcaatcatataaaactagctactctcagaaggtgaagagctcaaaactcaaagcactgggccaagaaccagaataaatctgcttttaagtcttggaagtataacgtaatgggccttaatttagttcttttattttatgcgtggaaacactgaggcttaatagattaaagctcaaagtcacaggttttcactccaagttacctagctccaaattcagagccacattcctattactacagacttgcacagctatcttcagctctagaagtgcttactgaacatcttctgctgccatcaaacactcaatattaacaccgagccaagggactcaaatcacagatcacattaagcacaaaacctgtctaacaggaccttatctctcctgactccccagacttcagccaccccagcctccaggctgctcttcacacaatgtcagctacacctgccttttgcacctgccacttggtctgctcaaattgttcttcccagcattcaggtctgcactcaagtactacccactcagtgaggtctttcctcacctccctggttagagaatcagggtaacagagctactttatctcatgactctattttttcttcataatcatttataaacttatttacaagtttattatctcaggatagggctcagcaaactatgacctacatgccaaccgccctttttttaataaataaaatcttactgaaacacagccacatccattgtctatggctttttttctcattattgtctattgtctatggcttttttactcattacaatagccgaactgggtagccacagcagagaccacatggcccacgaagtctaaaatatttactatctggccctttacagaaaaagttgccaacccctgtcctagaagaatatatgctctaagagagcaggaatcttgtctgtttcgttcgctgctgtatccctaggacttagtaaagtgcatacagtaggggcttaataaaaatgtgttgaatataagaatgaaacacatttaaccctcaaaacaacctcacagaagttatctccattttgcagataaggaaatggatactcaaagaggtggaataacttgctagaagtctcagcatgtgttagtgaggaaatacgaatgctggtctgtctggttccaaacactcctactcctaaaaatattaacttgactcattaagtgcttaccacatatcaggtactatatatatatatatatttatttattttctcattgaatcttcataagaaaagtgttcttcatgatatcatggatgggaaaattgaagctgtgcaatataaaatacttgcaagtagaatatagtagacttcaaagtccattgtgctacccaccatgcaacagaactgggacaagtcacctgacaagtgctgagaagaattcaacaggtggctgatagtcagtgacaaaatcctcacattagctgtaatttggaatatgggcaacatagaagatgatgttttgttttttttatttacgcaaagaagatttatatgtcaaatactgtttaatgcactgggaatttaagatgaacaagaaagacaaggtccctgctcttatggagcttatattctagtaggagatggacagatatgcacacacacacaaaatgagagctaaaagataagtagcatgtaaaaattaagccaggtcaaggtgacaatgggtgcctgacagactactttagtgcagatagttacagaagaccctcagagtatgtggcaaaagctgagattcaagaggaaacagaatgcccatagttgatgaaacacaaaataacaggagtaggggagtgaggtgggtgcaagccagcaaagtcctatccatcctagtagcaagacaagagccaatttttaaaagtaatgaatcacattgtattaaagacacaccagaagaaacagctaaaatagtgaagagtggctgtatcagaagtacaagacacagaatggggtcaagaagaaggaacaggatgtgaggcaagatgcctcacatcctattgatattttaaccaggtatgcaaagtacctgaaaaaaattaagaaaatttttaaaatctcattcatgatttcaaaaaaactcataaaattactaaaacaaacctaatcaaaagtttgcaaaaataaaactgaaggacatagtggcaaatcttaataaatggtgaaatatagcatgcttttgttcctgtgttctctcatggggaaacacattattgttaaaaaaaaaaaagtcattttttcctaaattgatgtgtaaatttaatgtaataccagcaccatttttcaagtaactgaaagtttgttttttaaaagtcaaatcgaataatatatatagtggaatagcaaagataattttgaaaaagaaacaatgaggaagttgccccaccagatatccattcattcatttaccaagtattattcggactcttgctctgcctggctgtcaggcacttttctaggtgctacagagccagcagtgaggaatatggagaaaagcctgtcactaaaggagctatgtgctagtgaagggagtaggaaaacacatgaacaattaacagaatatgtgtgatgtcagcttgggataaaacttttggagaaaaataaagcaacagaaaggagttagagagtgagatggggcgctgttttctatcaggtggtcaggtaagaaaactctgaaggaagcaagggagtagctgtatcatcaaagcttttagaatgtgaacaccaattaaaagcgtgattttggataataatagacaaacatcaatatggagaacagaaaaaagttcagaaacaagcatgtgcacatgtgctgatttgttacatcaaaaaggtagcctttaaattatgggcaaaaggatagtccattgtaataaatgatggctatccattttttaaaaaattatattcagtacttccccttacaattcacaagtaaatttctgacgtattaaagacttacacataaaaataaatcctaaactttgtttagcttgggggaaaaatgttcctaaccttgagaaacaagaaggccttatttaaaacatgaaacataaaagcaatgaataaaaagtgaaatatttgacagtatcaaaatgtaaaacttataatcatcaaaaataccataagcaaaattagaatacacatgaaggaagagcatagttgtgacgtatgtaacagacaatgggttactatccagaatacatattaaattcacacaaatttgccagaaaaagacaacatgatagaaaaatgaagaaagaagtgaacaggcaacttcagagaagagaaaatacaaatagccagtaaacattagatgtgcaagctccctaattatcaaggaaatacaaatcatatctatgagtttggaaaaaatcttcaaattcaataatagtgaatattattataattgctataaaatggctacaatttggctagtgtggtatagttaaataatctatgctacatccaaaccaaatcttcaatatacatattgttaatgctaaaaaataattagtgctgtcatttttggtggttgagagaacaaattccaaagttattggaatctgatttttaatttctactgcactctaaacaaaattgtgagagagctatcttgggagagaccaacacattatacacaaaaatttatctgcacagcatcccttggaagcactgtcgagcagtaactcatgatcacccagtgattctcaggaacatttttatatttctattatactaaaattaatctggtattttctctgactaaaatattcatggaaaccaatttctaaaaattatgcttataattgaaaaccaaattattcttaaccatcaaaaataaatgcatatggctttgcttacatctataagctccatgtacagtcttggttcaagcaaacttgaaaaaaatagttcaattattgactctatcaattatgcctcagtttaaaaaacaaaataaaattttttaaaaaaatagtgacctgataaagtcaactgctgatggttctcacataggttaccctcacacatgtaactatcctagggatgagtggcttcccggcaccaaggcagattctttgtctctcttcattatatgtcacactttccccctcctattttataacagaaaattatagaaatgcacaacaaaagagcattttacctccagactccaatcagcaatacttaccttaatagttaacgtgagtgtataccatttttttgctgtaacttcaacacgtcctaaagcatatataatccatccagctgtaacacaaaaatattatcccaatagatataattttgagatctcaatcacagaatcatataattcagtggggttcttgagtggcatctgtatgtagtaaagtcagcctcaacagagagctatgtcccttcattcccagatctacaactgagttaagccaaaacatttttcatttagccatgcatttaatagcatatactgagatcctactctgagccatatactatatgtgagctcacaacagaaccagtgaaataaacttaaaaaccagtgatagtatgaggtgttagcatctgtagttcaagtacacatttatacatgactggattgaatatggaagacaagagagacagaatataaaatttccagccagtctaattggtcacatggtaatagtattaacttagagggagaaaatagtaagttaatttttggaattagtgttatttgaatgcctatgagaaacccaggacaaaatttcaagtaggcggtttaaaacagacaatagggactgcagacacagatttaaattcctagttccagttctgccactaactagctttgagtcattaggccactcaattaacctcactggttctatgttttcgatttcagtatcactgaggtaagttcagattggtaatgctatgaatatgtaactcttgttctaatatccttactacctacttcctctttaatttttattttatttatggagtcaaagcaaagagcagaaaactataaaagagatatttttaaattaaggtaagacgaaagtcaagagactgagaatcaagaaaagtcactaccagtaaggtctagcttcaaaggagtggtgtgtatcaaaaccaatctgaagtggacacagttcaatctgaacatatttgaagcacctattctggataaaatattatcctacctaacacaagggctgtaaagatgactgagaaaagtcaagctattttcaagtattaactaaattcaaaaatgagatttttccattttaagccgatcaattcccctccttatatttctataggtacagcagcaacagtcgtatactcttgcttttatttatggtgcctcctgagcattctctccctaccaccactacctcagatggttttgatactatctatgcaaatcctatcctcacagcccagttcaactctacaatacccttaaaagctttgtacaattattttcccttccacagagctgcccccatctctaggaattaaataactttctataattgtaaactatttggtatttgcttacatcccttcccaattagatgtccaaacaccttgggttgaattctttttatcactcccacaaataacaagtaggtgctcaaagtaacatagcccataagtcatatgctattaaaaaaaaaaaaagtcagttacctaaatcacctgtaaccctgtaagatccatttgcaaaaatccagaagaaaattcctctggcacttctaatcaaaataccacctttatttactcttcctgcaatgaacacacctcctgtgtcaggggtctctatgtatacatcacactttatagtcagattggtcctgcaaaataaaacggttgattagtactctttaaaatatgccctttgtaacatagtacagatatgtcatttcacagcacatgcttccaaacttctaattgaggtgagaatgtgatttgctaagtctaagcctgtagcagagatgggcttcaagaatctttattgacaacagttttaaatgttacatgacttaagtcatttcattgcctctttaaatgattactggacaataatagttatgatttttaagtttcctgagaaaattttttttctacaataaaacaacttctcatcttaagaatacaatattttaaaatgctactattgtctatgaacacattaaaaagtaaaaagttccacacaattctgagggaaaatgtttattcaaacttccatcaacaaagagaggcaatgaaggcaatgctaggagcctttgagagaacacaagctattccggggccaacttttacatttaaatctaacaaaactttaaaactccaggagaaaagatctaaaattatttttctgcaaagaccacagagttgactctctaggagggcttctcacacctgaacagcactgaaatcacctggagggcttcttaaactcagttcactggccctaccccacagcgtgattcagtacatctggggcagccccttgaatgtgcatgtctaacaagttcccaggtgatgctgatgctgctcgtccaggaatgccacttggaggaccattttcccctatgaagtatctgtctataaggaagcaataaaatcctggttctaggctcactgatccacagcagtctatcaaagatgggaaaagattcagctgtccagggactaccagagcttttacagtgagctctcctccaggtttcctcttacaaatgctaccaggtacaacactttccttctggaatgctacaaccaccccaaaccaacatgatctctgaaaatatttcacttcctactcagtatctaactgcaagtgggaagaaaaagaaagcctgcacataaccaagtcataaatcaagcaatatatctcacataaaactggaaacaccaagaaatccattctggaaatgggctggggggaatgagatctagaattatgtggcttttacatttctgtgtcttatcagtgaattttgcacagtgaaattttactacataaaggaaaatattacagaagtacctacatcagctacacagggaggacaatccacacttaattatctaagcagagctggactactttacaggaagataaatgctaagtaactcaagcccagtctctcttgtatgtcctctgacatcagagggagttttctctccatagattatcaccagcatgaaaccactggcaatcaacactggtacttacatcccttacctcctttctggttcatcagaagtttgaaagtgctacaaataccatcagcaccataaaattattctatttagagttggaatgagagaagatcaaactttccttttctatataccacattccagaataagtgattcttgcatcagaacttgccaggcaatttcacagataatgaatgaaatggaataaaagtgtggtttattcttccacagccacaatctctcagtaatgctgaaagaacaaaaactagccaatacataaggcaaatttgatccaagagagttcatctgtgtgcagggaaaggtaattttgtgattgtctttaaaggattccaaccaatgctcactatcaagatagaagtagccagttatagtacaatctatcccatataatcaaattactgtgctggtaaatgactaaatctaggtataagagaggaagttctactcaaaacacaagtctaaaaactgtgagtagtgtgcactcattgagagcagatttactaaaatagcactacagataaactaaacaaatttctcatttcctacctttaggaagaagatgattaaaatgaggctgtgagatgtactccaaagagaatgggctactcagtcacacagacccggcttctagcccttgttctgccacttacaagtgaaatattgggtaaatcttattccaaagatgcagtttctcagtctgcaaggtggggacgatgatatctccaccataaagtggttgtgtgggaaatccatcaaagtgcctactattacccaatttttattccctccttttcccacaataagtgggcacagcagccagacaacagaaatgaacaagggatttgtgtggatctctgagcagatctggctgcctcaaatagagggtggaatactggaaaataacacataatagatgagaccaaattataaagggtcttggaaatcaagcctagaagtggaaaacacaggtagcaggacagagtcactgcatcttcctgagcaggggaataacatgatgaaaacagggcttcagaaagatgaaggcaggcctttcttgacacgcaaaattgcaacttcccggttcctttcctttcagaatatgtcactctcttcccttctacacccttccccatccctcgtccccacctccttacccactgcaatagatcctagtaaaaactgagtattgctatttaaattgtgaagatgtatatgaagattcaaatatatgaagatctgggggagtaaatctttggatggtgctatatctcacttctatactacaattaaggggcttctcaatctttttggagtcccagccagaaataagattgagtttgagtttagaaagagccctctatggtattcaagtgcatggggtataggggatgtcacagaaaaaaaagtttcctatacggcgacttcaaaactggagatcaaaacaatgggacccaggccttggacacttaaacccagccactggacttaaaataagaccatcagtcacaaataaggatgccaagaactccactaccataactggaaaatctaggtaaagtttccacctcagagacaatgggacaagcagaaattctgcgtaaaaacacaagccacaaatgtcatcctaaattaggaaggaattcttcactgcacctcaataactcttcatagtgttataagggttccaggggctctggataactaaaagtttcttaagacttatgtcagagcttgggactagaatcaggatttctaactgggagtaaggcacttcaggagggataaacactttctgcacactccatagacaggcaattcaaggctcttttcagaattcttttctcttccctctccagtttccaagcttcggatatggctttttggtggcttggtattactagtactagctctaaacctggaatgtgtatgtgtttcttttcccacagtggaatcatactagttataggaaaaaatgaaaaagaaacacatgacaggtggaataagtcagcacatagaaattctgtaactaaagaggaagggaaagttttagtttggcattatattttatgtgaataatataacttgtctctttaccagatgactaaataaaaagttaaattcactaggcgactaaagctgattagctttttactattgccatctactgtcacctggtaaatcttttaataaggctaagacggtgtaattctaagattggtccactagatggcaacaccagatcaacaaatcaactctccagcaaaacaaaaacttaaaaatacctcacaaatccgtctatttataaacaaatattaaattataattgggtccaaaagtccttagtttttatactggaatcaaattgctcctgtaataatcactattaaatagggcaaaaatgagggaaggacactggggcagcaaaacaatttgcagctttgtggtcatcaccatactattcaacaacccttaatattacatattacacatctattaggttcttgaaataggaggaccattgaaaactcttcacttcaaaatgtacctgacaatattacaagggtatttcagccagatccacattgagaacatcaatcttaccagttgtagtctcctataatactgattgtgttggatgcatcggcagcccatgtaatgggtctctggttgagaacttggcgtagcgtgaagtgatgctcgccagggtcttcaatatttgtaaaatattcaaatacaccagtttgatcagcaaagtttggagcttcactaaaaaatgggtaatctgttcagaatgtaagaaattctctgtttagtatcaaatccttcagaagctctccttgctgatattttatagtatgtctgaaacacttctgaaagcttttaaataaataaataaaatctaaaccaaagtttagggcctaggtctaataaagatacattaatttttgtatcatcattactaaatatcaagatgatgagttcgacatatagatgctgcataatatttaatccaggcatctggtgtagaggaaaggtcatgagttttgaagtaagacctagattcaaattcgagttcagtctgtcgccctggacaagctatttaactgccctgcatctaaagtttcttcatttccaggtttgcaggaggacaagagaattaaagaaaagataacaggtacataagccagcacctggcaagggctcaataagggatagctttattatttctaatatctgtcaagcaaggttccaaatcatgcgtcacaatcatctgccaaaagagcataagaaaggtttactatatcaagcataaaatttacaaattttcttctacttctaaactgcagcaaaaaccagttttgggcctaagttatcaatccctttttagttttactaaattaaattatagtcttacaataatgaatgctgtagaggagaaattttacatatcttatagctcttatacctcatgcttttccaagtgtttttgcattcattacctcatttgagacatttagaaccctaacaagtatctccagagcctagcttataatatttaacttagttttaaatttatattgtagctcataaagtattacattttatatttgaaggtttgaaattgcctcttagtcttcagggtcacaaaatattggtcttggtgctggcagttcttcaatctcattatctaggccatatcccacacagattcctcacttactgaaggcaaaagtcacttttgctaacagagaaccaagcgagcaacagattttaaagaccctgtgtttcacaaaattaatgggtttatctaagaggccatttcaaagagttgcagaaaaacaaaccaccaagctccccctgaggatcactgttgtctgtattatagttgagaggactccattacacagtccaaaaggccttatactccagccaactagatcatttcctgagaaagggaggcgagaccctgtagcagtgactgggaaagggtgataggagtgtccatctttggtggaacaagcagctctgcagcaaacaggagcttcaagtgatgctccagcaatgccagctccctccctattactctcctgctgctacagattttaggagcagattacaaagccacctgaccctgtctgtgagacccataaacctacagaacaccaccaagcagtcaacaaattttgttacttactcactaggaatataactacaatgaccatgtcttctaacttttttccaagtggttttcctaaatcacctataaccaaaaacttttctaacaactttaggacagatcttcctagaaaaccaagaaagctcaattaaaaaaaaagcacgggatggtatataatgagttggatcagccaaggacaacataactgcccataagcactcagttcactagcactgcagaaagacagatatgaatgtgtcttaacctccacacagaaggaagatgtcagtaatggctaatggggcagtagcaaagttacaaagtttaagtttcaccaaaaacaaatcagaactataactttcattctaacaatgaaccctatatttttttctgaaactgaaaaatacagggtcctcaaatttagatttaccataaagtaatgcaaaaaattagccctccttttaccgcatatgagatgtaggaggtaaatgaatgtgcttttgacagccactccatcatgcacccagtttgacaggtagaaatcaacacactactgttaaatatagagaccaagttaagttttagtgaaaaatactcaccaacattgaaatcatccttataggtacttgggaagggctgggattttggaggaagcgggtagctgcctttgcgaccagtggtgagagtggtgagtgtgaacagctcatcttcatgcaggctcagtgtgaaactgccatcgctgtcaaggagctgaaaaagaagacactactgtattcaggaccaggtactatagctcatctcatgtggacagaatagctttaaaaaaattagcttaaagaaaagtccaaatcatttctgttagaacttcctaaacatttgtggaaaactcaccaatatcaaggcccttggaatctttttttcctaagtattttagaaaactttataaaattatgctttataattttaaacaaccttacttcatggaaggaaggactaaataatctcaaaatctatttctattagcctattcttttccactacacagtaagctccttaaagcttggatatattcgatacatgcaactaagagacctgcttttttctctcagtaatttactaaggtaaaaaaattcataaaatatcactgtcgacccagctgttaatcacagaaatccttttacaattaagagagaaaaatcctgctcattttatgatcaatatatatttcaactagcaagttaggcttatgtcacacttacgatcttggcaacttaatctctttaagtcacaatctcctcatctacaaaatgaggaaaaaatacataccttatagactgctgtgaggattaaaccagataatgcttttaaagtgctaagcttagtgtgtgaccaatggaaaacgctcccagtatcaaagttgttctatgctaaatgtagatctctgaagacactggaatccttttatgaaatttgaacagtttttttctattttgaataaaaggagttattatccttgttttaatggtaaattgatgatcagatctatgaaatacctgaccgttatattcaggttgaagaataaccccaaatgacattatttttcttatgaggaaaatcaattttattatgccattcctagcaatttgttacacaaaaagtatgaacttttttttcagaacttaatacataataaggtgttttatcactgttagtgactagttggttatcagaacattaataataaccagaaaaagtggtagacttgtgtcaattaagtgaaataatgtgcttgtttgggccaattcgttctttgaaacctttccccagaaagcaccatggatgaggcactgtgggaagcacctgggatataaagctaaataaggcaaggctcagtcttcaaggtgtccagtggtgcaggaaaagcatttaactaggtaagcacatggccctaggtgaatatgagctaagactggtgaggaagcgtcagaggaaaagacacttgaattgagtctcaaaagatgacaaagttgaggagaggccattctaggtgaagaacacagtatgtgcaaagtcacagaggtaaataaacaggcatgctatgctttgaaaaatgtaagtttagtatgtgaagagaggccagtttagtaggacacatctctaggaagaagaccagtcttctaccttctgggaggataatgagggccatgtgctacactaaggaatgttaacttctaagaaaataatcactgaggtcctctgagcacagtggtcacaaaaatcagatctgcatttttgacatttcactctgtagcagtgtgatgggtgacctggaaagtcagactggaaaaacaagaggcagtttctgaaatccaggagagcgataatgaagaactgaaacaagaagtaacggtggtaatggagaataaggagtgagtaagagaaatgtgtggatacaactgtctatacttgaccactggcgggatacagagggtgagtgggaaagacagagagtctcaaatgggacttaaatttccaacctgggaagccaggtgatggcgtcaccatccaccaagacaaactaaatgtctaagagctaaacacatctataaacacacaaacttataaaaataaaaattcttaattaatgacatttctgtgcccttttactgttttactgttggaatacccaaaatataagaatttactttaaaattacccatagagaatccagctgcttaaaaagaaatctttcggatgtttttccaagtttggtataccatacctgtagctctggtatttcactctgtaaagaaaagacaaaaaagcatggctgagtaattcatcacatcctctttgaggatttccaaaatcagtaccagcaagaatgtaccaatgacaatattatctctatttatcaagagaaacacctcaaatattaaataataatatttttaaaaataggaaaacactgttcaagcaaatactttattctctaaacactaaagaattttggcaaatgataaaaaaattacagtgtctttgcttcaaaaacattcattactgtacctgtgtaataacttctaaattaaaataactttctggtattaaaaaacaattcttatgccattagtaatcagaaagggtactgcagtttgtcaattcaaacctaacaattcacagaaatagcaagtatctggtacttttaaacaatatttttggcatagtatactgtaaatatcaatgcttgaaagttccctagaccataaaatgcttctaccaccaagaacaactttcttgcaagtgacttttgtaagtgttcctcaaagtcacagagcattttacctcctactggcttctgtcctgctagattaaagcaagtcggaagacagaagacaccagggcctctgtcaattcatatgcaaactgttaaaagttcataatataaggcttcacttaagaactactggcctgtgacagaatatataaattcttaaatcaaaactaaaataaagttaaacatatttacttacaaaagatcccttaagaacaaaggtggcaaattgttgtgacacattgaaataaggaagaaatggccgtatgcacttagaatgtttatgactctgaaaaaaaaaaatcacatacattatccaaatgatgtataagctaccttaggggaaaaaaagttcaacagttaatgcccaagattaacagaaatttacatatactagataacaaatatgagtttatttcacatttttaaagacttttttacaatataatatttactgaatgtgtattgtatgttcctagtcaaatacaaaggtcaatggcgtttcaactggatcaaattttgaattcgtagctaaactgtagagacatatatggcatacagattaattttttgttataactgttttccaactaaaatacatcaaataaaaagcaaaagtaaggatgttttcactgaaaagacatctcatctaaatataactttcgttctcatgtaagaagtaaaaaatatatatatatatgtatgggtgtgtgtatatatagtatatatagatatcaaatacacactaaggtcagctaaatatatgtaacatagttctcacattgccatcactgtttactaaatagtcacaactatgggctgggatcaaaagaagtatgagacataatccctactttaagagattccacagtcacagaatacttatagtacacagttctatttcaggctttgcagaccattaaaaaattactttcataatcagagatttcaatatccatctcttagtaattgatagtacaactagatggacaatcagcaaggatataagagatttgaacaacactaccaaacaacatgccatctataaatgcctccatctagcaacagcaggatgcacattcttttcaagcgcacatggaacactgaccaaactacaccatactctgatccataaagcaagtcctcataaatacaggaagattcaagtcacacaaagtacttttttaaccactatagaattaaatcagaaatgaataactgaaaaccttctggaaaagtcaaaaatatttacaaactatcaaatttctaaataatcaatagatcaaaggaaaaataaaaagagaaattagaattttcagctttatgaaaatgaaaacacaacatatcacaatttgtggtatgccactaaagcaatacttaggaggacatttacagcactaaatacctagattagaaaccaagaaaggatttgagagttcagcttctgtcttgagatactagaaaaataggagcaaattttaaaagattacaaattgggttcaatgtatactgctcggggatgggtgaaccaaaatctcacaaatcaccactaaagaacttatgtaaccaaataccacttgttccccaaaaaactgtggaaataaaatttttttaaaaagtaaaaataaaaataaagaaaaaaccaaaataggcaaagaaaataataatgagcaaagaagaattaaacaaaaacaaatttaaaaaccacaagaaaataataaaaccaaaagctgattcttcgagaagatcaatacagttgaaaaacttctagccagactaataaaaaatcaggttaagagaaaacatacacttcaacaataagaaaggtgacattactagagattagagatttacctagggggagaggcaaggcatgaaatagcttcaaaccttttcttaaaggaattgatatttgacacagagcatagagaggtttaagactaatgttgttctaaaaaataatggaggttttggtgaaaagaaaaaagaaaccagtggcttcactataggcataagctaaaccacaaccctgcctaatatcctgttgagaaccacccagcctagtatcctgttgctccactaaaaatgacagtatcacaacacacagtttctttaatgtccgttgctgacccccggaaaaaaattcagcttttatacagtcaacattctttatatctgaaggatgaaaaacagcacaaaaatcttgaaaactatgaagtcccagaatctattggtctccagatcttagtggtcatttcttacttagcaaactgtatgaatagacatgttcatgtgaaagattactttgtacattctgtttctgaaacacagaatatagaatcccagaagattcactcctctagactgagtgaggtaacgagctctaatatgcaaatatgtggatttgaaagcatagttctgcatttaactgaaaagtatcaaaagcttctcagtgaaaataaaattatagatgaacagcctaaacatcagtcagatatctgtggtcagaactttcactcaaatttgtttcagttagaccacaaatgtgcagctatgttggatttggtttgtagtactaaacaaattaatatagggcctgaagtggtacaaagagagtgtgtgccaacagaatatcatgaaatacaaaaccagtgtttgggattattttccttgaacacagtagataagccaaggtctgaagtctgaagcagcagttaggaaggtctcagaccttaaaatgtcaactgatacggaatttctctgtataattacctccagccaggttgcttttttagctcaaaagaaagataaagggcggagtcctataaataaagggaatgtaaacatggagactgaaccaaaggcaagttacgggaagataagaatatctgaagagaattccattcaacttgatgattttacagaagcatatgaaagtggacaaaaccaagcatattctcttgaacattttagtcctgtttttcctaaaacagaaaatagccacattcacataaactctgacaaaggtcctgaagaaaatacaggatctcaagaacttttcagttctgaagatgaactgccaccaaatgagatacgtattgagttgtgtagctcaggaatactgtgttcccaactaaacaccttccacaaaagtgctattaaaagaagctgcacctctgaagataaagtgggccagtctgaagctctatctagagtccttcaagtagctaagaaaatgaagttgatttctaatgcaggagattctgttgtagaaatggatcagaggaatgtgtctgaatttaagggtattaaaaaaagtcattaataaaaaactgtgattctaaaagccagaagtatgattgtttagtcatggtgctatctccatgtcatgtgaaggaaataaacataaaattcggaccaaattctggctctaaagtgcctttagcaacagttacagtaattgatcaatcagaaactaagaaggtttttctgtagaggactgcagcattttgggcatatacagtgtttcttggagatataattttactcgcagatgttgttattcatgaggaccaatgggttggcgagacagtactacaatcaacatttagcagtcagttattaaatcttgggagttattcatctattcagcctgaagaatattccagtgtagttagtgatgttgtacttcaagacctactggcacaggtgtcctcaaaacattcctacctcagagatcttcctccgaggcagcctcagagggtgaacagtatagactttatagaattggagcaccttcagcctgatgtattagtccacacaatactaagagttgttgatttcactatactgacagaggcagtatacagttatagaggacagaagcagaaaaagttatgttaacagtggaacaggcccaagatcaacattatgtgcttgtattatggagtcctggagcagcctggtaccctcaactgcaaaggaaaaaaggttatatttgggaatttaaatatctttttgttcagcgcaattacacactagaaaacctaaaatcgcatacaatgccttggtcatcctgtgagtgcttgtttgatgatgatgtaagggcaattacatttaaagcaaaatttcaaaaaagtgcaccttccttttggaagatatcagacttagcaacccacctagaggataaatgttcaggagtggttctaattaaagcccagatttcagagctgtcatttcctattacggcagctcagaagatagctctaaatgctcacagttctctgaagagtatttcttttcttctcttcccaacatcatatatactggctgcgcaaaatatggattggaactagaaacagataagaacaggatctacaaacaatgttttagctgcttgccatttactatgaagaaaatatactataggccagctttaatgactgtagttgatggaagacatgatgtttacatccgtgtagactcaaagctgatagagaagattcttctcaacatttttgcagactgcctcaacagagtgatagttacttcctcagagatcacctatgggatggtcatggcagacctgttacactccttgtcggcagtcagcgcagaaccttgtgtatcaaagattcagagcctttttgtgttagatgaaagcagctatccattacaacaagatttctccctcctggatttttatcctgacactgtaaagcatggagccgatgcccttttctgaggccagaggaagaaatggcaggcatttcaaggaagaagtactgaaatgatttgtcttttgaagtaaataaacgatagggtttttgctttggattttttattaaatacattttacaaagagaatttcaattaaaacttttttctaagaaaatcctgtgaggtttaaaaagattatttttgttttttggtttcttcctttcttctggagaaatgatctaccagtcaaggcaatatgtagcagatccctgggaattaaaggtttgcccatttgttcactgtatttagtccctgctacgttccaggcattgtactaagtatgaggaaccacagggaagacattccctcagaaactgctgcagtgcttttacttatccctacctaaaaaccgtcaatgtgaaatcatttccttgattacaactatacatgataatggattagtttatataaacctctgtttagacaagttcaagacaagcgtgtctttctataaaaagcattgaaaacgaaggaaatgagatcatgtttcaatttattaaagcggggaagagcgttctgtggttagttcgtgtctaggatttgagtgccttactgaatgtatttagcaaacatgtagcaatctgttctctcactgtgattgtagaagaagctcatgtaaaatgatagtcattaatgaggaagtatagagtggtacttattctgtaagttcagagtatgccgagtattaatagattatcatactgcctgaaaataaatttatgatgaaatgaaaaaaaaaagtgacagtttaaaaaaaaaaatctcctgtggtcagaagaaaactaaaacactaacttcaaaccacccctgaaaatgagctggaatttaattggatcagtctttggaacaatttaagtccccagggcattgtttaaaacaatacagaaatccaccagcaattagtgtaacttacagtgaggtgtgatcaaggaaccagacagagtcctggaaaaacaaatcccagggtgactgtggatatgcccaaaaccacattctccaaggagcaacatttcaggctttacagtgtgtggaggggaagaaggagggaacagagttaactaaaatactccagcaaatcactaagtaaataaataaacaacaacaagcctcaagggggagaggatcaatgcccagagttgatagcatatattatatacgagttgctaccatatattatatataaggtccagtttccaacaacacacacaaaaaatgagacattcaaagaaataggcattatttcattctttctatgctgaagagtatttcatgatgtgtgtgtgtatatgtatatacatacaccatatatatatacacgcaccatatatatatatatacacacacaccatatatatacacacacacacacacacacacacacaccatatatatatggtatatatatatttcctttatccactcatcagttgatgggcacttaggttgattccatatgtttcaattgtgaattgtgctacataaacatatgtgtgcaggtgactttctgatacagtgacttcttttcttttgggtagatatccagtagtaggattgcaggaatgaatggcagatcaatcaatttagttctttgataaatctccacattgttttccatataggttgtactaacttcattctcaccagcagtggataagcattctcttttcaccacatgtatgccaacatctattgttttttgatgtttcttaatggccattctggctggagtaaggtggtatctcgttgtggttctaatttgcatttctctgatgattagtgatgttgagcattttttttaactgtttttctggctatagacatatcttcttttaagaaatgtctattcatgtcacctgccactttttaatgggatttgtgtttttcttgctggtttgagttccttatagattctggatgctagtcttttgtcagatgcataatttgtaaatgtcttctcccattctgtgggttgtctgtttactccaatgattctttgctttgcagaagctttttagtttaattaggtcccatttatttattttggttttgttgcatttgcttttggggtcttagttataaattatttgcctaggccaatgtacagaagaatttttcctagattttcttctagaatttttatggtttcaggtcttagattgaagcctttaatccatcttgagttaatttctgtatacggtgaggtgagaggtagggatgcagtttcattattctatatgttgctatccaattttcccagaaccatttattaaataggatgtcctttccccaaatttatatttttgaatgctttgtcaaagatcagttggttttaagtatttggctttatttttgggttctgtattctgctctgttgatacatgactgctagatctgataaatgaattcagtaaagtttcaagttacaaaatcaatgtacacaaataatgtatataaatcagcagcactgctatataccaataatgacaaaactgagaatcaaaccaataactcaatctcttttagaatagctacaaaaatatataagaatatacttaaccaagaaccaatagttctaaaaggagaactattatacaaaacatggctgaaagaaataatagatgatgcaaacacatggaaatacatcccatgctcatggattggaagaatcaatattgtgaaaatgagaccacaatgcccaaagcaatctacatattcagtgtaattcctatcaaaataccaacatcatctttcacagaattagaaaaaacaatcctaaaattcatatggaaccaaaaaagagtccaaacagccaaagcaatcctaaacaaaaagaacaatctggaggtatcacattatctaacttcaaattatactacaaggctatagtaaccaaaacagcatgttactggtttaaaaacatataaatttatgtataaagtaacaatgtcctattgagttcgcagcacgcagtgttgtgacatgtgtgctaataatagaacaaaaggagaaagggaacagagcaacaagggaattcagcataatctactgtaattcggttagtttaaatctgaagtgagtccaataagttaagatgtatatggtaagccccagaataatcactaaaaaaaactcacaaaaatatagtgaataattaatattgttaacacagccatattacccaaagcaatctacagatttaatgcaatctgtatcaaaatgccaaggacattcttcacataaatagaaaacacaaccataaaatttatataggaacacaaaagaccacaaacagtcaatgcaaccctgagcaaaaagaacaaagctgaaggcatcacactacctgacttcaacatatactaaaaggctatagtaacgattaataaaacagcatggttttgtctaaaagcaggcacacagaccaatggaacagaatagaaagtccagaaataaattcatgccctatgaccaactaattttcaacaaaggtgccaagaacacgctaggaaaaaggacagtctcttccataaacagcactgggaaaaatggatagccccatgcagaagaacgaaactggactcctgtctctcacaatatacacagtcaactcaaaattgattacatacttaaatataaaacctgaaactataaaactagaaaaaaaacaaagggaaagtgctttatgacaatgagctgggcaagaattttttaaataagacctcaaaagcacagacaacgcaaaaatagacaaaggggatgacatcagactgaaaagcttttgcacagcaaaagaaacaaagtaaaacagcctacaaaatgggaggaaatatttgcaaattatacatgagacaaggggttaatatctagactatgtaaagaacttaaacaacgacaacaaaatagcccagtttaaaattgggcaaaagactgtaatagacatttctcagaagaagacatacaaatggccaatgggtacatgaaaaaatactcaacatcactaatcatcagggaaatgcaaatcaaaaccacaatgggatatcacttccctctacttagaatggctattaccaaaaaaacaaaagaaaacaagtgttggtgaggatgtggaaaaaaagaaatacttacttcatgttgttagggttgtaaattggtacagccactataaaaaacagtgtggagattcctaaaaaattaaaaataggcggggcacgtggtggctcacgcccataatcccagcattttgggaggctgaggcgggcagatcacttgaggtcaggagtttgagaccagcctggccaacacggtgaaaccccgtctctactaaaaatacaaaaatgagccaggtgtggtggcagacgcctgtaatcccagccacttgggaggctgaggcagaagaatcacttgaacccaggaggcagaggttgcagtgagccaagattgcaccactgtactccagcctggaagtgcagagtaagattctgcctcaaaaaaaaaaaaaaaaattaaaagtagaactaccatatgatccagtaatcccactactgtgtatatatccccccaaaataaaatatatatgttaaagaggtatctgcactcccatgtttattaaaacactatttacaatagccaagatatggaatcaacctgagtgttcaacaatgaatgcatgaataaagaaaatgtgatatatatatacacaatggagtactattagtcatagaatgaaatcctgatatttgcaacaaatggaggaatatggaggatatgatgttaagtgaaataagccagacacaataagacaaatacctcatgatcacacttacatgtagaattaaaaaaaaagaagagttgatatcacagatgcagaaagtagaacagtggttaccagacactggggtggggctgggaagggaaggacaggaagaggtcggtcaacgggtacaaagtaactattggacaggaggtgtaagttgatatcacagatgcagagagtagaacagtggttaccagacactagggtggggctgggaagggaaggacaggaagaggtcggtcaacaggtacaaagtaactattggacaggaggtgtaagttctggtgttttcttgcacactagggtgaagacggttaacagtaaggttttgtgtattacaaaacagctagaagagaggcttttgaatgctttcatcacaaaggaatgataaattcatgaggtgatgggcataccctgatttgaccattataccacatgtatgtatcaaaacatcaaattgtaccctgtgtcaataaaaaataaaaatatgacaaagttgaaatactcacatttcctcacttcaaaatttatcagacagctacagtacctaagacagtgtggtgctcacgtcaggacagatatataagtcaacagaaaaaaattgaggttctagaaataaaccctcaaatttattgccaattgattttcaacaaggatgccaagacaattcaatgaaaaaggaatagtcttttcaaaaaatagtgcagggacaactggatattaaaatgcaagagaatcaagttggacacacatataaccccagttaagaaagaaaatggaccaaaaacctaaatttaagatttaaaactctaaaactcttaaaggaatacataaatataaatcttcagaaccttgaattaggcaatagcttcttagatatgacaccaaaagcacaagaaacaaaagagaaaacaaagtgggcttcatcacaatttaaaactttttttaattcaaagggtaccattaagaaaatgaaagacaacccatacaaagggagaaaatatctgcaaattatatttctgataaggaatttttatatagaacaaagaacacttatgactcaataataaaaacacaaatatcccaatttaaaaatgggcagagtttaaatagacatttctccaaagaagatatactactagccaataagcacatgaaaagatccccacatcattagtccctaggaaaatgcatattgaactacaataacatagcacttcacattcactaggatggctataatcaaaggcatggacagtaagaactgttagggaggatgtggagaattgtaagtttcataaaactgctggtggcaatgtaaaatggtgcagtaactttggaaaacaatttggtagttcctcaaaatcctaaagacagagttaccatgtgacccagcaattccactcctacatacatacccaagagaactgaaaacacgttcacagaaaaacttgtacacatatgctaatccacaccattagtcataacagccatgatggggttcaagacacactccccgcaaatattttaaagtgaaataatttgagaaaaatgtagaagcaggaagtttactctctgaccttctcctttctcctctgaagcaggtcataagaccctcactcaacaggtgctctccctattttccttatctctgaagacagtttctggtgaagaagatgagatgcctactcactctaagagcctgcagatgagatcctgagacactgacaaaaaggtggcagaaaggttaagaattctcaccaaggcctgctcttctggatctctgcctgaagtacccgatcgagagaagacaattaaacaaacaaacaaacaaacaaaaacctcctcatcccttcctctccaaatgcagattcgcagaagaaaaacattcgtttggtttgtgattcctgtataaatttagttttgggtgctcattacctgtagatcccttccttcccagggtcagctattgctttcctatttgtctcattttgtgtactgagaacctggcttgacttcccacctgttagggatgtgtgagctgtcagttttgtgtatgcaggcagccaacttcaagttgggggccccaagaatataaccagacaaaaatgtgattcgcaccctatttgcagccagtttaccaactatcgccagctctgacagggagtggggagtagggaggttatctgggtctttcttttgactatccttgggagtggttctaggtctttggaggatcacttctcaaccttttgactacgatgaagtgtagattctgggagggctgcatctttttacaccctcttttgaggatcctcttcatccacgataagacataaaaggcttattggtttgtgttgtgagtcacttaatagacacctttggtttgaaaaggtcaatactgccaggaatatttactgtttgtcctggctcaaacctgatagtaggatatttgaaagaatttgttttttaagagtctatggtcaggagttggccaaactgtaggctgacattcagaacctgatatgatacacacacacacacacacacacacacacacacacacacacacacaccatttttttaaggctactctgttctctgttttggatcttgcttctcccatgggaacttagttgctagaaatccttcttcacaaagccctgctgactatatgcacttcctattctgtctacctccttcttgttggaacttcattgacctctttgggaagcttgagatctccccacactggcacctctcagacttcttcttctctccactggcttctgcttctgcttccatgttttttcaccttcattctttcattcagttcccttgaatccttgatatgtctgctttcaagcccctacctcctcccatgcctctgtccacctgtcagacctattcccttcctactcaagcccctcaatcacttgaattttaagctcgttgctctcaacagacttaaggtctccccaaaacaacctgaggatgaaaaaggaaaaagccacagcctccatatacatatcagggcaagggaaggtcgtgaaggtcgtctccacaaatattggtacacaggtaaccttaattttatcccaactgccaggaacaaagtggagaaaagatgagagccaactattttgtacaaatcagtgagttgtgtgctatgttttacgactcatggctaaaattttttaaatgaaagccataagatcttggcatctgtctgtatgcttatgtatttacatgtaaaacaaaagtattcagttttatattttatttttccaatagtaaagaagtgagttaatccaatagcaacaacaaaagtttaccatggtttcaatgatgatggtgaggttccctaagccatcagtcagagctacgtagcttcctcctttctctaaatggccaactgtcttcaggtaataccagccaggttgagtaaactgagtggtatgagctatagaaaaacagaaagttccaaataagacaaaaatggtaataatagtatttcttttgggaaaaaaaaaaagctgtatatcaatttgagtctgattcatccaaacaagctattttctattttgcaggaatatatccgtcaacctcatgtttaaatttttaaataattaatctagataaatggtacaattgcaagaagattcctggaatgatgggtaaaaataaatgaacctgtcagttcaagaatatgatcagtcttttttttaagaataaaatagttattccccccccaaacttggttcatcactatttaatccatcctaaaatagctaccaaaaaaaggtttaaaaagttaataatgaatttcagaaactaactttatggtttcaaacatatttatttccaccacatgtacatttattggtcacctcctaagctcgtcctgaaaatgcactaagcaatataccatgtcccaacccttggaaaaatcacaaaattaagagtacattagttcatctagataatgtggggccaacaatttcaacattcaaggcgctgatatacaagtctaaccttaattttctcatataattctcaatattagaatatacaagtccaatatacaagtctaaccttagttttctcatataattctcaatattagaatatacaagtccaatatacaagtctaaccttaattttcttatattttttggaggacaatttaaggagtttagaataatatcatgattacatgattaatatgattacaaatctgtcttaggagagcacaactaaaagggaaaaccaccaaatttaagtttaaaataaaaacaaattcactccaaattcataattttcttctgaaagcattttacctttaaagaaattagctttttagaaagattgttagaattttaaaacaaaatggtaataaatgtttataatcttttacaaaaaaactgcagaaaagtttcaacattattcagcaatagattttgttactttgtttaaaatataatcactattagtatggttattatctcctcatgaaaaagtgacactatgccatccatccctgcataatctcaatttcccttgtgactaatgaatgatactgtagtaaaacttttgtgtttcaataaaaacggatgtattatctatagccctgttcattgtctctgagctatgtaaattatgtcttgtctggtagaaatttaattaatttcttccctgttgtgggaaacccaatttgcctccattgacaattcatctccaattcccttacactacgaaaatttgtgctatgttgacttttcatttcaactgtttctaacatctaccatctatctgccaggatccttcatatcatatgagtaacataaaatcttcagtacgtgctcacttttaaaatcttttgagctttacattgttacctattttgaaatttaccttttcacaacccacatttcacagatttaggggacaatataaagccatatttcacataactttcatatttacttattcatttgatgattcaataatacagtatttttaatcatctccctttgattttgctagcatacgattgtaattgaaactctattaatataagagaacaaaatgtcttcaaagctaatcttaagacttctactctgtttataaatacataatcttattagcaattatcatcatttgtaattatatccttagatgattatttatttgtgtctctatcactacacagctcctccttttcctctctctccccctcctctcctacacttttctaaaagcctggtcttagaataatcagagagtagtctagttacccaaaatattcttataaaacactggcaaatcttgcttaaaacttaaatctatacttaaaacacgcatagacacacagtttatataatcttctctaagtttttttctgctttgtctcttagagaagaatttagggagtgagagatggaactgaaccatacctgatacccagacaggagattctaccacgtagtgcccactccatggctcctgggccgtcatcaacccgcatctcccataaggcaactgttcatagtaactagccactaaattccatgcgattgtgctaaaagatttgataaaaaagaaacaccaagacaacttgtgataaaaatgtaaatgtctaaaaacctggagtaaaaagactttatcatagtaatacacatctacataaatgacaataaaaggatcacccaaaataagaaaatataagttgtctaaatttattcacattttgaaaaatccagtgtggggtacattgtaatatttttaatggtgaatcacatgataaaaaatacaaatgtattatgtgcaaatttttactgaactgtggtatagccagaagacgaatcatgccttaccaatacccaacacatcacaaatttgagtcaaatacaaataaaggctttgtgcatacctactttcctttcaacagtcagccttcttaatgccccagttttatgacataatttttatgaacttgactctgaactgttccaaagttttacaattgagaattattggagtcagactgcctgggtttaaaccatggtttcaccacttaacctctctgtaaaatgaggataataattatatctctctcacgtgagtttgtaaggattaaatgtactaatgcataggaagagtatggaacaaggtctgggccgtagtattgctattaaatatgattccacttcatctataagtagtaattggatctaattgctgatctgctttgtggcccattctttctcagatgatcaggccctaacagtccagagcaggtgctaaaccctaaaactttgactctctgcttctcaggaaatccaaggacaaaagggaagttattgaacttggtattgttgggtccctcacagattaaaaaaaacaaagcttacccacagaattttatttttcctatcaagtcctcatccagtataaaaaaaagagactgacattcttagcaaatcaaagccttctaattctatcagtacaaagtagaaataatagtcctaattttcaaaacaccttactactagtgaatattttaagttcttataattttgcccatggtttgcaagatgtgtggtatcctttctggctagtgatagatgtataactcaagacaagctttctggagggcattttgtaaaatacatacaaaacccttcaaaatctatgtatttctgaccattccatttctaagaatacagcctaagaaaatagtcatgggcatatacaaagatatttgtatacaattgaacatttcagtttgtacaaagctattaattaaaacagagacaacttccaattctaaaagaggagaatattcaataaacaataatatattttccacatcagtgtttcccaacttgtgtggcatcagaatcacttgagggcactgactagatggacagaataccaggagccttccctgtagattctgattcacaatgtctgggcagctgccaaggagaaggtataacaacgagtgtctcgggtgcttcttaaggcaagtctgggaaatggtgctttatgtaacaaaatattttaaaatgcattaaaaatgatgaagtagaaatataggtaaatgtgagaaaaagttcctaatgtcgtctcaagtgaaaagcagttttttaaacagattctatagtatggtctcaattttgtatttaaaatgtatacatgccaatataaaacaggaggacattcactaaaaatgtttaggatggttagctctggatcataagactgtaggtgattttgcttctttctttgtacctatcttcagttttctaaattctctgccatgaagatgccttacctttaagaccaaattaagttataaccaaactctcctaagtgtcttttctttcacaaagagaagaaaaagaacaaatacaatatacagcaacccacattaacatcacaacaaatacataaatattggtttgtttttgttctatttatcattgtttaaaaaaagctaattggaatctattcacaattcaagtgtttttcaaagcatttaagaaatgcttcccttaggaacaaaaatagttgtgttctcccttaagaacatctgttttttaaacaaacaattacacatatcaagtgatgccatgaggaatcaatcagacaggctgggaagcagacagtccacaacacaaccagcctggtcttttcaacagatcactgtcatcaaaaatgaggaataaggaaaccactctagattaaaggagacttgaggggtgtaacttttaaatgcaatatgtgtgtgcttgactattccttttctttaaaaaagctacaaatgacatttttgggaaacaattaggaaaatctgaatatagactgagaattaaaaacactctcatgtatgaaaacatgatactgtgatcatgtaaaagaatatccttatgttttggagacacatgctaaaatatttagagataaagtgtccttacatatactatttactttataattattaaaaatacaagtagcttgtcaaaaatcagagagctgcatgtattttgctacatataaattatacctcaataaacctgactttatttaatatagactatattcaaatatagaaaattagatatagattaggtataggtatacaaatagatgacgctaacaaggcaaaatgtttacaatcattgaatctaggctggaagaataaggaattccatttttttctaactcttatgtttttaaattttttttgataagaactctaaaaggtttttaataacttacgaagtcatatagccattgatataattctgatttaaaatgcgaccccagcagcctgcacccatgtcactatttaaagtgctaaagtcttcagaagaccaaagcttcttcccagtcaactttgcatcttttgctgaatgggttccaggataatgagccctagaaaaaaaaagggtggaagtcaatgaaaaaaggtcacgacgtggcacttatatacgtatagatttgttgagtatataaaaatacgagtcttctccaaggttttctattttaaaacagttgggtagcttccaggtagataatgaatctaagcatctgctttatgcccttttgtctcagcatgccattaaaatgacagcaaagaaaacaaaaggggataaacctacaacagcatacaggataggaaggaaaatcatcaatagataagaaatttcaatctatttctggagctcacaagatggatggaagcatgttgaaggatggaggtagcagagagggccacagcctagaacactccaagaggagaatgaagtaaagataagattcagacttcccaggggaagctaaggagcttggggcaatagtaaacgagtgaggaggaggccaaaaataagactagtgaaacctttatataaagtagtactctccccactactcctgtccttagaacacagaaagatagcttggcatttactcccaggccaaaaacaaaaaacaaaacccacacatggttatttcttgaataaaaagaataagctaccttgggaaaactaaattactgtatcagagcagtggcggttctcaacccagatgatttttgtccctggagggaatatttggcactatctgtagacatttttttcaaccgtcccacctggggtcagggatatttgctactagcatctagagaagagaggccaaaaatgctgctaaacatcctacaatgcacaggaccaacccctacaacaaaaaaattatccattgaaaatatcaatagtgcagcaggtgagaaactgccccagaaaatgaatgcctccttcactctatcattcgatgggaggggagtcagttggtggaagtataaatgcatattcattactgcaagagtaaaatactcccataatgatgattgtggaagacactgattataggaataaaaacaataaattttaaatgtaaaatagaaaatagattgacaatccaataagagagcacactagctaaataactgtaggaataagagcatctactttttagtttaaaaattatttacaaaaaacaatgcaagcaaaataatggagattaagttatatcataattctaatctttgtagtttggtgtagtagtatttataacatcaaaagaatgattgtgaatacttgttttactttttagttatttaattcccttttaggtcacaaatcttttaggaaaaaatcctatttggtaattctttatacctagtgaagatgaattagggcacaatatcaatttggcatcccaggatttcatgagtaagaaaataatatacaatatatactggagaacataaaaagaagtattagagaaaaatgaggttccactaagattttactgagtcactaaactcaggtgaaagcaggcatctattcaatattgcaaatctacactacaaagataccaacagaaatctagcatctaacagggttaagcaatcattgttctggaactataacgcccaacctgaaaaatctggctactagtcttttaaataatataaattcaaaaaattacactttagatttattcttctatcccacaactccattctatttccatgaaattcagctttggtacctcagccaaatgttaatttttaatactcatctagttgtcatccagttgtctagttgccaaatgcatgtttggtgtatttggttaaaatatatttctatattaaagaaaacactgtaaagtaatatgctagcatgttaccaataatcagtagatgttaggattatgaggaaattctatttttatacttttctacattttccaaattttctataatgagcatattatatttataaaatgaaaaagtaactttattgaagttataggaataggtgatatatccttcattcagaaaatgatgaaactgttaccacattcaaaacccaaatgatttattacatgatatgagcaaagaaaggcagaactaatactaaaatctgggtctttcttaatgtatagatttattactagtgcaacaaaatgtaaaggctctttaagaatataaatttttattgggaggccaaggcgggcggatcacgaggtcaggagattgagaccatcctggctaacatggtgaaaccctgtctctactaaaaatacaaaaaaaaaaaaaaattagccaggcgtggaggtgtgtgcctgtagtcccagctacttgggaggctgaggcaggagaatggcatgaacctgggaggcaaagcttgcagtgagccgagattgcgccactgcactccagcctgggcgacagaggacagagtgagactctgtctcaaaaaaaaaaaaaaaaaaaaagaatataaatttttaatgtatataagtaggcaaacattctctatcacttcacagcattatttttcaaacttcaataacagacaaaattaagatcaatgaaagtaaaccaactttatagtttatcctaacagaggaacatatttgtactttaaaaaattagaatttctggccaaggcagaacatgacagcagcccagtttctgaagctcctcagtactcctcctgaaaccaaactgaccaaccagataagggaaaggaaaaactcacagataacactgccatcaaaccaggtgacagggactctccccaggagcctcgcagcatcagaaatggcccaggatcagcagatggtatatggaaactagaagtgaaaggggactggccggtactcacacaaaaggagtagaccctaccctaagggggagcatagaagaccaactcaggaagatgggaacatcttcacaggcttgaagttaggggtcaatgctcaaaacagtgaattcattaggagatcaaacccaatactgtaacagttcaaaccagatctgtctggtagaaatatgatatgaaccacacatagacaattttaagttgtctagcagccacattaaaaaccagcaaaggtctttaccacaataaaacacataaatggaaaaaatttaattgaatttacaaagcagaaaaacatggagaacataattttaatgatatatttaacccaatatatccaaaatattatcacttaacatgtaatcagtgtaaaacaattgtaaataatatttttatattcaattttcaaaacccagtgtatattttatacttattacacacctaaactcaaactagccacatttcaagtgcttcctaaacatatgtgtctagtggctactgtattgaacaatacaggtttaagcaataacaatttcaggagaaggtagcaaataatcaggaatggtagagcttcaacatgaaaataagctgtttgaagtagaatccaagttgaataaggcaggaacgctttgtttgagggagaacaactttcagtcactaagaagaatggggcccagcagaaacagaccctagaaagtactgtaactgtaaaacaaaaatctgcagatatagcacaggccaagcacaacatgaatgaggcagggaggaatagtcttcctatgaagatgtgagccaagaaatatctcctgaacaaaattgcaatagcccaaaattggaaacagtctaaatgaccattaaaaaataatacacagataagttgtggtatgctacatttagcatccaacaattggatgctaaacaataaatatgaactacctctatatataacaacatgcattaatctcacaaatttatataatattggctgaaataacagctactataggatgccatttaaataaagtttttaaaccggcaaaattagtccatggtgtcagaggtcagattagtagttacctttaaggcaaaaagagagcttaattattggaaagatttccaaggaaaaatctttccaagaggagatatcagtaaccaagcttcttgggcactgataattttctgggtggctgttacataggtacgttcactttgtgataattcattaagctattatccgatgatttttgtacttttatatatgtatgtatgtatgctgtacttcaattaaaaattttaaagatgaattgttagcaatataggaaattaaaatgagagaattatagaagaattattttcaaaaacacactttggaaatgaaggctaaactagaaggaacataagacagaacagacactgtggaaaacacagtgaggaatatagaatagtaaggataaaataatagaaaacataaataaagagatagagaaaaattcagagaaatacaaaataaaggcatatgcaaataagaccaaagtataactggtgcttctaaaaagaaaaccaaagtaatggagtggaataatgatttaacttataacttaagtaaaccttactgaaataagaaaatacttaaatatagacattaagagagcatatactatatatctggaaatggtaaagtgtatacaacaactaaactttaaagatgaataaaaatattctttgggcataaaggaattgtgtcgttacttataaggaaaaggaaatatctctggagtcaaaattctcaatagcaacattttatgtaaataactaatggagcaaattttatgatatatttacacatatttgagaattaaaaaaggattatatccagtcaaactgtccttcaagtataaaggtcatagataaacatcaacaaacatctgaacacatcaagaaatattgtttccattagcactttctgagacatttaatagataattacacttctgatatccaagaaaatgagggagaaactttggcaaaggacttgaaggtgagcatttaatatgtttaatggtagagtgagattaaaagaaatagtaattaaattatatatataactattacacacttggctaaagtacaactaatacagctacatgaagtaggacaagaaggaaagaaggtgaaatgtaaactaagtttgcagattatttgggagtaaacagttaaaacttgtagctgtcaaatcaatatagtagaagcttaagttcatgtaagagtacaaaaattaaaactaagataattctggtaattaaaattccacggtaggggagaaaaagggaggaagaagttatcaaataattttagtattgctcatagtaaaccaacagacaataactaaacgaagaagaaaccaagagtattagtatgaagcagttcctcaacctcagcactattaacattttgggctggatcattttttgttatgggaaaactatcctgtgtactaaaggatgtttagaaacattcgtggcctccatccatcggattccagtggcaccgccctacctatttgtggcaattaaaaatatttccaggcattgccaaatgtccgtctgggaggcaaaattattctcagttgaaaatactggtataaatcagtataaatgtaattgacagaacaaaaaccaaaccttgctaaataacaaaagaaacacctccttaaataagtgcaaagtaaacaaatcacatagcagaatagcttgtattagtacatggatagtataaatcattcaataacaaaagacaatatagtagtatagaaaacacaaacatcagttatatttaaaaatgagtttaactcattcattaaaatataaagattttcagaggaactttaaaaaagcaaaatctaactctatgctatatgcaagcaatgcacataaaagaaaacggccttgaaaggtaaagaataaaagggcaaaaatatattaggcaaatcctaatgaaaagaaagcatagatctcttagttacacagaaagcagaactcaggccaagaagctttaaacgagacaaagaatggcattttctaatgataagaaataaatcataatgaagataaaacattcatcagtatttacataccaaataacaaagcagaagcttccagtatttacgtaccaaataacaaagcagaagcttccacacagcaaaaactgcctaagattgaaaggagaaatagaccccactaacataaggaaacaaacacacctgggtagccctgaacagttcaagtggacaaaatcgttaagatacaaaatacctgaacaatataaccaaaaggttatatataaactcaattctgtatcctaataaagaatacatcttaataaatcaaaatatgctcttgagatagtcaagaaaaaagcgaaggtattttttcagatttttttttaataagctcctgagaaatttcccaaaaaaatgtaaataatacatttggtattaaatggccacagtgcaataaaattagaaattaatgataaaacagccctatgagataaaactaaagcagtactcagaggaaaattcattacattaaaatacctatatcaataaaaaatgaagtacatatccaagtccttcatgaagatacagtaaaacccatattttcatgcaatatttttataagaaaatatatttaagattaacacaactttgttttccttcaagacttcaactatttatgaaagctttaacaacagcaaaactttcattttaatttcaatgtataaaatgtttaaatataattaagaaattttatcttgcaaaaaaaaattaagcctaaatctaacctaacctaaatctaacctaaactaccaatttcaaaaaccattgaaaaaggatagatgagcaagttatattaaactgtaggggttgaaatcagtaaaatccagactgacacaaagtttgtaagacaaacaaccccgttcttcaacaaattaaaagaaagaaaaagagcaagaacataaagattagaatagatttaaatatcaaccaatcaccatgcatgaattttaaatggatctagattcaatcaaataaaactataagataataatggatatttaatatcaaaaactattacattttaggtataataatggtattgtttatggtaagtagaaaaataatccttatctttggagacacatacacagtaatatttttatggaagaaataatgtctgggatttctttcaaagtaatgtaggcaggaaaggaagaggagtagatagacgcatggatgaagaattggtcatggattcacagttcaagaggttgagtgataagaacatagatattcattgtattattctgcctatttttgtgtacattcaaaattcttcattaaaaaaataaagcacatggagagatcaatcagtcttcacactggataaagaacaaattctacacacatacatacacacacacacacacacaaacatacatatcctatttttcaaatgtttatatcctgagtcatggtagaaaaaatgtaaattcactttttaaaaaaaatgaacccaatgaggtcagggcccagagtgctaaaaggcagaaatggaataaagagtaggcatcaaaactatactactaaggaggcatgacaaaagttattgtcagtgatcacaatgaaccatttacaaaagtgttcatgcaagaacttccaaccacagaatatctgagagtttgaaactaatttcacaactttgcctttataatttctaaaattaaatacaggtattactctgccccttaatctaaaacaaagccctgttttattattccaaacatcaacatgctttttaaaagctatcaatacttgtttgtcatagaaagatcctaaaatatatttaaaagagaaaataatgaactatgagccatgcatgcttcaggtaagtgaatacaggagagctaccttctgagaatgtaatcaaatggggagaaggcaagaaaaagatagtcaatacacagagcaagcaatcagaaactgctagttttccaagtaaaacatgccttaccctataacatcaaccaccttgaagagttcggcatcaaggagcatggatgcagagatggactcccagagattatcacttgctatgattttcactcgctggagaccttgataattcagcatttttcttaatatcttttggagtaagaaacagaacatatgaaaggatacaaatgaatttttagctgttgaatttatgaccaagatagataaagttatctttacaaatcagcgttctggataatagcttcttttgtttgtttgtttgtttgtttttctcagacagaggcttctctcgtcgcccaggctggagtgcagtggcaggatctcagctcactgcaacctctgcctccagggctcaaatgattctcctgcctcagcctcccaagtagctgggattacaggcacgcgccaccacgcctggctaatttttgtattttttagcagagacagggtttcgccatattggccaggctggtcttgaactcctgacctcatggatgataatttcaatactatattttctcaatagaaacatccctcctatggaaaataaaagcattacctttaagataacctacttcactaggaatgtaaaaagaaaaaaaaaacacaaggggtaaaatgttttagaggattttcactttgactttaaaattacgtttaaccatagaaatatggggggggggggatgaaacaaaaataatcaaatggtactaccctgaaataaccaccattattttgctatgcattcttccaggaagtctcctatgcagacacaataatcaaatgggtaacatactaatcataccatttggcaaaatgctttaacttatcattttaagtattttccacggtcttcaaatattctgccattattaaacaggagagcaaataaaatttacctgtaggactgtccacccacaaaaattaaaagtaacaagctaaattttaacaggaaataaacaaagcacaaacagtacctactttactactcagtactatgcttgggccccatgaggactctaaaagaagtatcagagggagccctcacccttaggtggcaaacacactcaacaggacaccaaaactaacagggcatactagaaaatcaaagggcaagtacataccaaaatgtatggattgcctatatgcaaatcaagagcagagaaaaggagacatcattttactcaggatcaggaagatcagatttcataccacaagcagttcttgatgaatggatacaaataagcccactactatagcccccaaggactcggaaatctctggcacatagcagcagatgctcaatactactggttgaagaaattaagaaagaacaaagaatttcacaagctctctcttcacattccaacttctctgaactagggcaatttccaattaatgtgctcttttaggacgcaaataataaaagctccaattaaatccatggtatacttttcaacagacagtttcttaaaatagatatattataggattttagaaaacggggtgaaaattagaggtggcagtctaagttcatctttcaaactggatcagttgagttctaggacaccctagaagtctacagcatgaacagatcctttgtagcaaaccgagaccaactctcaagattcagtaggattgagaacccctatccctctagcaggaggatcaatcctgaatttcatcaccctgaagttcttccttttctttgagacggagtttcgctcttgttgcccaggctggggtgtaatggcatgatatcggctcactgcaacctctgcctcccaggatcagcaattctcctgcctcagcctctcaagtagctgggattacaggcatgtggcaccatgcctggctaattttatatttttagtagagacagggtttctccatgttggtcaggctgatctcgaactcctgacctcaggtggtccgccactttggcttcccaaagtgctgggattacaggcgtgagccactccacccggcctctttattcttacagagaagaggaagagcaacttagtcaaatttgcatttttcactacggatggatctagtctttctagtcctagtcctagaaaatcccagtaagactgcttacttttttatacattgtatttgaataacattccaaaatttacaagtctacatgctatgatttctaaataagtttccatccataagtcattacgaacagcattcttttgagcagttttatctaacatattttcagattatgtttttgttttggaactttctcatccagaaaaagcttaaatagaagctctatttataagacaaatggaaatgaacttgttctggttgaagtgaatgaaggtccaaagacccaggcacttccatttccatccactatcctcagatcctagatgagattttccagacacaatttagaaaacttaagaacaccactgaaaaccacgataaatcttacatatcagtagcaaaaaaaaaaaaaaacttcaaagaaacaatacccttgtcatctttatataaattgctcctttgtattatatttatttctactattaaaaacaaatccttattctttccaggggtcatcttattatcccataaagaatatacattcattaaggttatccaatctgagcacctacattcgtcattattgaactctttgtgataggcatttctttttttttcttttcttttcttttgagacagagtctcgctctttttgcccaggctggagtgctcactgaaacctctgcctcccaggttcaagcaatttttctgcctcagcctcccaagtagatgggattacaggcgtctgccaccatgcccggctaatttttttgtatttttagtagagatggggtttcaccatgttggtctggctggtctcaaactcctgacctcaggtgatccacctgcctcagcctcccaaagtgctgggattacaggcacgagccactgagcctggcctgcaacaggcatttcaacaaacggaacacagatcccaataaaatcttgctggaaaaaaatggcaaacacaaagtaaaaagtttttgtatcctgagagattttactgcaagaaaactcaaggttcaaaaaaaaggaaatgaagtctgaactgtctgaaacactgaaaatatgtcttagagcaacaattagtctttcaaaccaggttagttgaattagaatgcactggagtcagcaacagactcttaatagtaaaaaagttcaaataacataaaatatagccctgtcttatttcattagtttaaaagaaaatggaaaccgtaatacttttaatgtttccctcaaatgaaatgaccacaagagagacatgtgtacaatcacaagaaaataaaacttaagctttgaaatgtcaaatttgggtatttaaaaagttcatcacctttcactatgaagatgctgtagcaacaccatctacctcattacagagttatccagtatacatgcaccaacttggcttctgctctgtccccttactgctcttatcagacctgtgctcacagcaggcatgactttccacttacaatccctgtgctccaatcttattaatagctccactgccccacctcccccacccaatctgctcccaccaccacactcccatcagcatacttcaacctggaattgcccttgagtacctagctctggctgcaatagatcttctcaatctatgccttctccacgcctacaactacagattaattaaaatatgccattattggctgggcgcagtggctcatgcctgtaatcccagcactttgggaggccgaggcgggcggatcacaaggtcaagaattcaagaccagcctggccaagatggtgaatccccgtctctactaaaaatacaaaaaaattagccgggcgtggtggtgggcacctgtaatcccagctactcaggaggctgaggcagagaattgcttaaatccgggaggcagaggttgcagtgagccaagatggcgccattgcactccagcctgggtgacagagagagactctgtcaaaaaaaaaaaaaaagccattattccagtgaatacattagcttactgatgggggtcagtgcccccactcttcctccattgtctaatccatctttcatgacttgtttttcccccatatccctttacctctcaatcttcagttctttgcacatgatatgcccctgccttagcaaagtggagagttcctatccatccgttcttgaagattcaaattacacatcacctcctctaaaagacttccctaatcaacccagggagaggtgtcatctcctctgtgcgccttttaagaaccctgtaggtgtattattccattatttgacacattccaaattatgacacattttaattgtctatatctgactttataaccaccctccccaatacaaaaaatccttttgggcagaaaacagtattctctatccttatattataaccatacacacaatgcctgacaaaccagtgttgagcaaataaatgctctatgattaaccgaatgaagagatgaaagaaatgtattgaaccttatctacttaagaacataaaacatccaattcaaagaaaatttttttctataaacacgcatgtgcaagtatcttttttgtataatgacttcttttcctctgggtagatacccagtagcaggattgatggatttgtgaaaatatggaaatagcccaaaaacccatcaatcagtacgagtggataaagaaactgtggtgtatgtatacaatggagtactactcagccacaaaaaggaatgcattaatggcatttgcagcaagctggatgggattggagactattattctaagtgaagcaactcaggaatggaaaacaaaacatcgtatgttctcactcataagtgggagctaagttacgaggatgcaaaggcataagaatgatacaatggactttagggactcggggaaaggatgggaaggaggtgagggataaaagactacaaatttggttcagtgtatactgctccagtgatgggtgcaccaaaatctcacaaataaccactaaggaacttactcatgtaaccaaataccacctattctccaaaaacctatggaaataaaaaaaaattaatataaaaatttttgaaaacttgaaataaaatactgtcccaaaattatatttcttagagaaaagatacatacaagaagacaaaaggaagtgaaaagtaaactaaagattagctccacctgaaaagtgaaactgccattttttttccaatggcagaagttattattctgtttttcctttcctggaaaatagcaattacagtagttacctcataggtaaggttgtgagaattaaatggagataaataggaaaagtggaacaaaaataacacaattggcagatgttactgctacctctttgctaatcacaaagagaaacatgtactataacacactccaatagaaaacaagaattagaatatatgccataagttttgacaaaagacaaagaaaaaaagctacatttcttgaagttctaaaaatctaaaatgatataattgtttcataaaatttatcagaattccaaaactaatgaattttaaaatagaaaaattcaacacaactctttagacaaaggtaattcggggctcacaaagaattacatatgctttaatatcaggaatataaacattgttaagattttgcttgaattttatgtcacaaccagcaaaataaataactgtagtataaaaaatacggtatttccaacacaaatttcctactattttctgtgttaggaaccataaggaattattcactaaaaagttaaaaacaaaaagatactaaagttgtacacaccttaatataattggcattatatgacctctcattccaaatctgcaaaacaaaaagtcaaaaaagtctgaattgaaagttacaaaatgtcagaaagcagattatcgttacgataccatttctctcatcatctttcatattatctgatacgccattttttaactttatgggatatcctgccatagaatttatagatagttataagatagcacaactttttaaaaattaaaatattatttttaaaaaccttaaaatatttagtgggtatttttcaaaaagtaatttattccaaagattttcaacaatggaatattcattaattcattcaacacatactgacagtacaatgtgtgccagaaactatactaggcattggagaactaatagacagggaaactgttacaacaattatgacaagatccctgaaagccaagtattaatatgtatactgtatagaaggcatatttttaagcatacacagagaatcacagtaatacactagtcacaaaagcaactctgaatgaggatggataaaaggaacatatatacatctattaggtttagagtcatgaagcatggggttttagaattgaaagaacttccataactccacagttgagaaaactgttaataacaagagacgattctagaatccaggtgcaggtctttttactccaatgatacaggaaagagtttatcaatgaacctcctcatcatagcatttgttatcatgagtctaaacaagatgtgaatcacccattacttgtgactgtaccataagagaaagctattagaccaaacctacatttagtctcactacaggttataaatgtcctgacatttaagaaagttctccggccaggcgtggtggctcattcctgtaatcccagcactttgggaggccgaggcgggcggatcacgaggtcaggagtttgagaccagcctggccaacatagtgaaaccccgtctctaataaaaagaaaaaaaaactagctgggtgtggtggcgggtgcctgtaatcccagctacttgaggcaggagaatcacttgaacccaggaggcagaggttgcagtgagccaagatcacaacactgcactccaatccgggtgacagtgtaaaaaaaaaaggaaagttctcaaatataaactaatttttcagtcataatttggaaaaggatagcaaaaactagtatattctttcttctgacttcctccagcccttggctcatcctcatgccctgtatcatcatgtagtattacagtttatatgttccagcatctacttctcttactgaacacaagagcttattaatcttagtagccctcaaatattacagtcacagttcctgcaacacagtaggaactcaataattgtttgctgataatctaagtcatgattgcatgaaaatgtttaagtattagttttaactgatggtatattaataagcaaatgattatggagacccactatgtgtgtgttaaggccctgtggggtacgatgcagcctggggcatgcctccacccagccaagagacaagctggacatgatatcatttttcatacttttcaaatccttaaaaggtgttaactaacagtttgtgacaggtgaacgcagatttcagccagcctgccaaatctggcccatcatctgtaattttacaacttgagagctaaaagtgtttttagttttaaatagttacattttaaatggctatatatttacctcaagatcctcaatattgccttttggcccacaaacccaaaactatttatgctctggccctttaataaaaagtttgccaatctttggcttaagacaacaagaggataaaatgagactaaccccccataagctgtataggaaacacaacactgttgtaggaaccagagaaagcagggaaagctttgaaggagaatttgagttgggttgatacaaaaaaaaaaaaaaaaaacccagctcagaggaaggaggtatacactcaacacagttttcaaaagtgggaacactgggatgggcaaaggggagcaattaaaggtcacaggtacttagtttgtgttattatcagacaccattagaacaaattagcctcatggcataaaatggttagtcaaaaagtaccacagaatcaaattattttctaaattacaaacaaatgtccaaaactgaatcatattttaaatatattactaactccaatataatcaatgtccaaatcatggtaacgcttggcgcccacaatccaggtcacgacataataggcagtcagctgaagattgacataaggccagtcgaaaccttttcccagccatccagggaatgaccatggcaaccctgcagagagaagggaggaggcaaaggtagaggaggtataacggtgctggcgctattgaaaataaaacaaattttttttaagaaaagcattcaactagcaaaaaaccaatacagatctgactaaaggaaagtttatataccatataaaaattattgaaatcctttccaatctatagacactataattccttattgatccctagagtcaggtcccataatttcaaatgttctttccaagaagaagaaaaataacaaatacaaacacctctctccaagacccttaccaatagaaagaaatgtaccatatgttttaacttaacatgtccactcactgttggaatgttcaatattcaacttctgttctttgaggtcaaatcaaagaattctaaaaggcttatgccaaactactcttgagttatgtataacacaaatttatcattcaattgtacatcttcttacaatttagggtccttaaaatattaatcagtcaggcaatctaatttagcaaaactagtttgttcttatatcactataaatgacaatgactccatagagaaatatacccttgttaagtgatacacatcaaataagtccatattcttccaataatcctgattatgtttaagtaaaaaaataagaagagtagaaaagtacttattataattctaaatttaacttgctactaatatattaaaataggctcaatagttaagttcctcagcaataaatatattaccaaactagttcaccactgaaaaaaataaaaatcaaaatgacaaaatgcttattttctaaactcaggaggaacacccaagtgtattacataagaaatgtgacattaaagtaatagaattcttgaaaacaatgaaatgctaaatgcaatctgaaggcctaccaagtctttgttaggacatggtttagcatgccatattttctacatttaaatgaggtctgaccttggaagcagtctagtggatatgtgctgaattcagtgatgcttttactgctcacagcatttctggaatctcttacaaaagcccatttataaagaacatacttactcctaatttcttttaacttagaaaatattacttttcattaacctgattgttgagaaaattattttttaaataactagaaatcaggtctttaaaatgaatcattaatttcatttaacttagtttgaatttaagcctgtttcaaaaaatcaaattcatttcaaatgatgaaagtatcccatcactcttgatgtttgaaatacttcacaagctctgtacacattctcacagaactgtgaaatgtacatagtcccatttaagcaactagccaatgatcctcccaatagaacctaagccccacaggtgcaggaattggggacgggattggcttcctgagtcccagaacagtaaccagcacattattgaagttcaaaaactaactaataaacaaaaaacacttttgtatgtaccttttctaaaaatagggttcactactacatgcaatatacaattttgtaactagttaggtgtactactgcatgtaatatacatttttgtgaacagtgttacccttttataaatactgatgacagatcttgtgaaggaaagtagtttagcatcataggaaacatggaattaggtgctaacaccgattttgccatttactaactgtctatgaccttaggtcagtggcataatcttcctaagcttctactgcttcttcctggaaaatggaaagagtcatgccttactccacaggtattataaggattcaacataatatacaagggcaaagaaaggatcacccctggcacatgctttgctgctggtagcatactggtagcattaatgacattatgagtacttccgtattaatagagattccaccaacacgattcagaatttaaaagttaaaggaaaagagactgaagaaacattgcaaacttcatttcttaccaatgagtgtaatattgggattcctcttcttagcttctttcatcaaccaccactcgtatcctcggaaataattctcatctagtgcataatgcatgtgggagggctcagtgccgtctgaatagaggagagcaaaaacggaagtaatgatccatgaatggtacttcctaggaccatctcactccccacccccaccccagacacacacttcacaaaagcagtattccagttctaatcctgaagttggggaaatcataatcttacacaactaaaggatggatgataaaagcatatcatttcatcctttttttattatcttaagcattgtaaaagtcttaataaaaccacaaccttctattacaagcagtactgagagaaatgttatcacctcatataactaaaaattcccagtattcatgcttctgggcttttgatctctctgtagttttcaaatccccatgtccaactttaagttctgattacctcaactttcagcttttcaacgctggatatgaatccctggactcgtgagccctgttctcagaacccacacctttagcctataatatgtcttgatataggaagagttttgaggaaaaaaaaaggaatgagtatacatatccactctaaaaataacaaaattctatactaacatctgcagttagtagaggttacattgtcttagcactgaggtaggtaattgctatcaaagtcctcgtatattcccacagttcaccaacatctgcccttgctaagtagggccttccgagaggcccttgcccatttcttcttaaaggtaaacatcagaattcacaagaactgcctgtttatgtacctctacctctaatttagcttcagcaagtgaaattagtccatcattgtcaattctgcctaaaaggttttaacagtaaaacgcaatagcttgaagaaagtttctgttatgggggtttcttttgtttttgctttgcactttttcttcaacataaacactaataccaccacatagacatatctgttcaacaaagagttacttccaaatcactagcaggaatacaagtaatactctagagttcattataatggaatctgttctgtaaataataagctatatctaatcatagagagaatttcttttcttcttcctggaaacaaaaggcctataaactgccagttgataacatggactacataaagccaatcaaaatagtgacaatgaagactgaagatttagtgattaaagataagttttgtttttaaaagaaaaaaaagctgtatcatttttaccacatattttaagttaataacactttttttgttctatacgaaattaaaatctttctaactgctcaataaaattcaaaactgtccctatgctctgtcctgtatatataggttttagaaaactgtggatttgtttactaccgattacttcaactaaataagcaatttgaagtttgaatattgtttttgatggaccagtcatattctatataatatttttaaataattacagttaaaaaatgaggaaaactctaataagcaacaatcaatctcaaaagtgttggtattgtttacacatattctgaaatcacagtccatatgctgaggtatagattaaaatgttgatgggagaaatcctatctcccaaattctcctacctgttgtctgcccatcaccacctatttccacttttaaaatatgcaaagaggcaccaaaattcggctgtgaaaagaagtaacagtattaacatagtgttgtattgtatgaagcttcaagacaattactaattactgccttaggttttacagacgcaaaaacaaaagcaaaacttcaaatagcaatttattccaaaagtaatgtgccattttttcaaaaactagaattgtgaggctaataaattctatggtgaaattcaccatccaatttctaaaatatcacaggtaccatgaaataattatgttttcattaccttaaagagataatccaatatctgagaacgatagggctctgggtaatttactagaagtcgggaggttgcctaaaaaaaaaagttttcaaaagtatgaataaaagaaatccagtcatgaatatctgtctacagtgttcacgcacaccacctggtatacacatatttagcctcaggcaaggtcaggctgaggaaaagttcctcacaagttgtctgtctgccctttctgtgccaatcattgggcaagtagggctgctgtctgtccgacagctaaaaaagttctcttcttctggcatgagggctaactgggaggtaagcttgctaacctcatgatcacaaacttatcttgaaactcaggttttctatcttgagaccacttgacaacaatatctcaggactaaaatgggagggatgaatgtcaggtaatttttccccttaacatcttccggaaaaacatcacaagcagcaatgctgaaaggaagcactactttccccatcctcataaattctacctgttactattaagaataactagcaataatctccagaccaggctgtactaagaaaacttaacacaagagtggcatcagaatgcatggaaagacaagggtagacagcgcagggaccaatactggatcatgcctggaccacggcatacaactatttgaaaaaagaaatcacaaaaccagtaactgacccataatctatcctttgggaggcaatataagcaaaaaataaataaaaagaggccggtttttggcatgaaacagtagcctcaggcttgtaaaccagacagtcctaggttcaaactgctgacactttgccaggtgtatgtatgatggttgggacaaaatacttttatggggttcaactttctattttatattctcatatatgctaccactgacattctggtaagtgcccatatctactctgtcacacccaaaacatccccagtccctaccagtgaggcaaacacccatggagctgctctctagccactctttccatctacctcaatatatcccaaaccaaacatagcacttttgcatgtatctgctccttttcctgaacttgctgtctcagtaaccaacacttgccgaaaccataaacttgggccaccttttgtccaaacttcccatgtaccctcagtcaccaagatatcctcaatagctctcaaatccctcctctactcttcaaccccactgacttacccaggccctcctcacttatgagaacagtataagtggtctcaggacatcccttctgcctctccctgtattctatcttccatgctacttacgagagtaaccttcccaaaatacaaatgtaatcacgaaactcttccatgtaaacatgctaagaccgtccctttcccaaaagctttcaggataaagttcaaatcgctcaattttgcacccaaatcccttaattatttggctcctaaccctgatactttatcccttatcactctcacaccttctacctagatgtatcaaacaacgttttctattcttatgcctggaatgcaccccacatcctctcttggacaactccaattcacctttcagctcaaattccacctctggaatttgaaggaaggatgccttctggccctgctcactgatttgatgtaagcgcctctcctttggcaccaggtccatatctttattacaacactttgaaccccggcactcctttatttttctgactcacctcttagttccttaaggacatggactgtatcttattcaagtttgtatcctcattctttgttattcaataaacacttattaaatattttatgggtcttttgttgcactggtactggcaacataaataggagtctttgagtcaaatggagtttgtatcctgatttcatcattaataagctatgtaatcataggcaaattattgtaaagtgggctatcttactcattcaactgctgtaagactaaaattagatgtatgtaaaggacttggcacattacctggcacatagtaagttctcaataaaggcaagtgttatatacacaaattttttaaaatacatatttctcaaagagcttacaacctagcagaggctccaatattaaaataggcactctttaaatgaacactgtataggcacactaatatatccttgaccctaggtaaacaatgcttcctgtcctacgctacgccattaatactgtgcgttttgctgtctagggtttcttttgccctctatgcactcccacatttaacagagaaagtatcggctttaggcaaacacaccaatcatgttattgcaaacctatagccacacctaacacaacagcataagtcaaaggcaatataaccaaatgttaaaatgcaccatctagcaatagcaaatcacgggattactaaccacactgcctgaatgaggcctggaactgtttacaggcccaggaaaaagccttggggacatttcatcattcagtggccttgaaataacttcctcctccctaatccctgaaaatggttattaaccaaaattagtaatgtgcaagacatcatcctaagtactttaggtctatcctcacggcgctcctaccatgcaggtataactgtatcccaaaaaaagaaagtgaggcagagaggagttataatagataacccaccaaggccacacagtgaagtggcagaacccagaagacactcttggcaatcttctctttagtctacattctttttgttttgtttcgctttggtttggtttttgggtttttttgtttgtttgtgttttgaacggagtctcactctgtcgcccaggctggagtgcagtggtgtgatcccggctcactgcaacctccgcctcccgggttcaagcgattctcctgcctcagcctcccgagtagctgggactacaggcgcgtgctaccaagactggctaattttttgtatttttagtagagacggggtttcaccgtgttagccaggatagtcttgatctcctgacctcgtgatccgcccgcctcggaagcccgaagtgctgggattacaggcgtgagccaccgtgcccggccctacattcttaactacttactgtaccataccgctttccctctctgacatgaagattaaatgacagcactctaaacacttactggcacaacctgggctaggaaccaaggactccacaaagaagtttaaagtggtatgcaaatataatgttgcaagaattttcattatttagtgagttcctatgaggagtaatgaactatatagggatactaataattgtatattctatcagattaggtaggagtttcctactttgaattacgaaatgattcttctcatcttagtaattttaaactgggcttaataaacctaatggaaacaaagacttccatttttcggtaagctcttaccctagatatagtatcacaagtaaagctataaaaaagatggggcctcactccatgaaatattggctgtttcaggtttagcccaaaaacataaaaaggagaatagtagtagcaaagaataaatgcattaactcatcggcccacaggtttcccctgaaatacacatcagcacggctggagagattgcaaattagggaatgaaaacataaaaatcaaaaaggatcagctaactccagggggaaaaaaatttcccctagcagaaggttatatcttgtggtcacactacagaccaggtcatccttgcagcaggcattcaagcttgttctgagttgaatgtaaggatgcaagctccatccaactcaaccccaaaaatccgagttcaaccttaacattttcaagaaacattagccctagatgtaatttcggatacaaaaccaaaaaacaaaaaccttctcacccaaaggtcggccaccatgaagcccatgggcccagagggagtacccggtagtttcaggccgctcgcttatcttccttttaaagagaccttgaggcaccagtcctgcctccaaacgaaatcctattcggcgctaccctctctggaggagcccattcttaccctgcactaacaactgcacgggacttaacgactccaccacccaccaactcctccaaaagggagagacacagccaaagcatcccactggggcgttctctttcgcacacggacgctcccgcactccctggccctttctggagcgacgctccccgactgccatctccgcgatgaagacagcctgtgccccactgcctgggacgagggttccagccccggctacttcactacttagacctgtcactttactctctgcacctatactctctggacctccggatcctcatttgttcaaacctaactgcctgtctggttcgtgttaaacgagaaagcacccgccccagccccgcagcgggcccgccccaaccgcctgctgactggcaccctaggggaatgcggcggagagtggagccggtggaaacgcagggcaacgccgcgggggcttgtggggctggccccacggggcgggctcttgccgccccccgcgtatccccgcagcttgccgctcaccccgccgccgctgaccgcgccgatgccgtcgaactcccggcccagcccgtcggagtcgtcgagcacgtacgcgccgccgggcgccagcagcgcacacagcagcaagggcaccgcggcgcggcccgccgaacccgcggccgcagtcatagctttcgctcggcgttgccaggaagccgagagtagccactcagccattgtgtgggtcacatgactccggcgcccagggaggcgggtcccgtcgccgccacgatagatacgggcaggaggccgctgatgctgacgccgccgccgccattttgagtgcgggtcaagggcctctgacgcagctggcggagtgttgagaaaagaagcagcgagctttttcttatcgctcgcgtgtctgtggtcagctactggatttcacatgtacttactgctggcttctcttccggcgtcacctggtggagcactttaacgcagggaaggtggattccaaggtccgccaaaggaagagggccatgagtggccctaccatggctcttccccagcatctcagggagtatctacctcgtgcgaggaccaggcttggacaccaggtcccgattccattgtcatcttggtggaatcactttgcttttggagcctgagttttcccttatgtgagatgaggcgagaagagcagcagagtgagggactgagagaaaagttaataagcactcagtacatttgaatgcattccacaagtggcaaatagctgagaaggttctccagtctggtaactaccccggcatattcaaagcttttagccttgaaggagttaataatataccacctcaaaatatgctgctgtggcatattgactattttaaattaaaggcacttaaaaacagcaggtgcaagatcactgtcatggatattatgtgtcttaaaaggaggagatgaaattcccatgtgaaagatgtcttccctataaaataacattgttatcttcaaggacagaaagttgaagtcgagggaaatctgtccaaacaaaatttgttaatccctatctttctagtcgcttctttaccccaagccccttcgccttatcatgtttcacaactactattttttgtccatttcactctataagcaattggctcttaactgctgctttaggtcttttttttttttaatgagggcccccgtgctatgtaaaataaacatttgtgtggttgtctcctgtcagtctattaatatcttaaatcaatttaatactagggccatgctgggaccctacagggacgaaggtgaaattttgcctcccctacaattttataaactatcttccactgtcagttgaagtgattccagacaggtaactctaaattggtaggaaagttgtgaattgccctgaatttctgccacatccagcactgtcctgagatttctgatttccttgttattgaagtaaattaaagagactctgaagagctgcagagaaagattttctgatccccaaatttctcttagcagaagtatggaactggttatcattgcctacacaagcccctgagataccacaatggcaaggaaaagacccagagactttaggacctgtgggatttgtctgcagaaccctatttggaatctgattattttgccccttaaccacaaacctaaatctaagtttcaagaactcaattatacttgaaggtcaaagctctgggcaatccaataaatatgcacattaagaacccgatatccctgggttcttaatgtacattagatatgtttgttctttctttctttttgaattgactctacgtctatcctggtttactaaggacagtcacaacttttgtctaaacataattactgataatgctcctttcaccctcagtagtcttctggcttggatcagttaaatagtcccctgtgtatgaaccacttattttctttggtttcttctttccccagtacaacacgaatctgaactctctgccttgccactgcaaccagtttatgatgcaagtcagtaattttcagttctgtggatttactgttacagaattcactctgatccatttgttctaacacagtattttaagcatgagctggagctcctgtggatacaagccacagtaaccattccatcaagtgaatgttaagcttctcttaccagctcttaacaagcgcataagacccacttaataccgtgactagatgggaaataccaaggtgatgacagaggaaactaccttacacataaaactaggaagttgcatgacgatgtatgaatacccagcatacaccatcctgtagtacgtcattgtgaaacgggtcagtggtcagtggtctcgttgtctgaggtgttatccaagcttgttgtctcacaaccaagagaattaaggagtgtggacaccagagtgaggttgaagagaaagtttattatatgaaagaagaaagctttctttctttgccattttgccacttttacagttgaatccaaaagcttttataagaaactcctctcatctctgtagctgtttgtgtaacttacttgtaaagctatctgtgcagctccccttatctgtgcagctgtgggtatgtcttgggtaaggataaagttcagcttctcttgtttgtgtaactgtgggttctaggtaatcaccctctccacccccatgcaagttcccacagagcccaccatgtatgtgcctgaaaaggggaagaaactttttcctgggaacctgctaatcacacaaagaacaaaaggcttctatgttgggccttcctttcttatcagggcagctgttgcctgagttttccccaggccactctatgtgtgcctgtagcttgatttttcaggctgtctttctgtttaaaagaattttaccaaagaccaactttagctgtctgcccaactaagttttcccttttctcgtccctcaattgcaccttgtagttggaatgcacgccacaaatatttgagcaatgtgtgaagtctacaaaagaggaagcataaactctaatggaaaaggtagcctcacttccaggaagtcccagtagttcctattagttcagttaccaaagaaattgcttaccagataaatattttttgtttctaatttctgatctatattcatgagagcagacatgaggtaagaaagtttctaataaaaggccaataaatacatgctgacagaaatccttggagtgctgggcacggcactcaaatgtgctcaagatgtgagataaagaaaaatgacagttaccccacgagtgatcatatgcttagcttcccttgcgtctgtggatcagggtcagtgagataagacggtaagaaaggaaggtcccagttttcagattttaaatgagtttaaaaagtaatgacagtgtttctctctctgtctttttaatctgaaacacttcaagaatttgcatgtcatccttgctcagaggccacactgatctctgtaacattccagtgtttgtaaatgtgctgccaaaggaaacacgatgatttttctcttaaataacaggtgtttctaagtatcacaactatacttcagccaccccaaatctctcctttttctaaataaaataatgtgatcaaaatcaaatagtctcttgagaaggatcagagatcttgccttttaatgaaaatttattgataaactctaatagcagtctggatttttttttttatttccccaagactatcataaaacggtatgatagcagtctgttgtctcacttcaggaaaaggctttacttttataaatcagtccacctccccttcagtctaccattgatgggcatttaggttgattccatgtttttgctattaggctgtcagaaattccagggcagaggccaagtttatttcttctttgtatgtcttaagcacagtgcccaaactgtgctaagtactcaataaatattagttgaattgaactaaaagacaaatcactgaatggtcacataaggggatacgaataaagaattatttacaaaaggagttggaaacgtttcttaaagtaggaatcccctgggacataagagtgtggagtgttttcttgaactgtcctgtaacatctgctatattttttaccttttattttaggttcagggtgcatgtgcaggtttgttacaaaggtaaattgcatgtcctagggttgatgtacagattatttcattacccaggtaataagcatagtactcaataggtagttttttgatccttccccatcccccatcctccacccttaagtcggccccagtgcctgttgttttgttgttgtttgtgtccatatgtactcgatgttcagctccgtcttataagtgagaatatgcagtatttggttttctattcctgtgttagtcttcttagggtaatggcctccagctccattcatgttgctacaaagaacatgatctcattcttttttttttttttttttttttttttgagacagagtcttgctctgtcatccaggctagagtgcagtggtgcgatctcggctcactgcaatctctgcctcccaggttcaagcgattctcctgactcagcctcctgagtagctgggattacagggtgtgccaccacacctggctaatttttgtatttttaatagagacggggtttcaccatgttggtcaggctggtctcgaactcctgacctcgtgatctgcccgcctcggctttccaaagtgctgggattacaggcctgagccacagcacctggcctgtcattcttttttatagctgcatggtattccaggttgtatatgtaacacattttctttatccattaatagaccactgatggagatttaggttgattccatggctttgctattgcaaatagtgctgaaatgaccatccacttgcatgtgtctttatgggagaatgacttatattcctttcagtatatatccaacatctgccatttgtctggtctttcaactctggacgtgtttcttgatggcaactgttagttatactgccctactgagtgacttctctctaaaatatgttataaggctctattcattcaagattttatataaacaaaatgaaaataagtcaaaggacagaatccacctaatgaaataaattataaattgcttactgaacattttcttaagtataactacaaataaaaacttctatagcaaagagcagtgtagtatagtagttagaatactggctctggagccccaggtctcctggcttcaaatctttctcctattgcttagcagcagtgtaattttggttaagttatgtaacttctttgggcttcagtttacccatccataaaatagagataatgatggcaatacattaatgtgaacattggacaagctaatatttttatagcacttagaagagtgacccacacatcctatgtgttatataagtgcttattatataaataataacataaatgacatacctatataactatcgtacaacttttgagtttactgctttccccacaattaattctgcaaaaacagattattcctgtctttgtattggtctcagtttttctttttgctgggttgttgtccacagtcatccaaatctatgttgtgtgtggctgattcctcatagtgagagtcttggtgtgaaagagaattctgcctccttcagaagttaaggagccagatcctctctcttactgtccttatcagtacaggctctgacaatgaccaggctttctcaatcagtttcttgaacctgcaaatttgaccttggaagagtaactagatgtatgcacagttgagaaatcccacaagagccatatcagagtccagaggaggcagctgcatagaggctccatcagaggtggcctcagatacctaaagtagtgggatcaagcagtgccattctcacctgaatgctcagacagagtgacctggctatctttttggtccttggactctagcccattttacaagtcttattctgaagtttctgcatcaatttgttccatatcctcatttctttctttctaagtcattcattttctgctcaggtaacccacagatggtttctgttacctgcagcaaggaaccctgatggacacacccggttataatccaaagctgatgtgataattgtaaagaattatcaggctccatgtctgcatttctccactgtaaaaactgccttcaccacctgtagtccttttgctggtaattgttacagcatagatttgctcaaataaaggaattccaagaaattgtactgtcctcctatgctttacctgtgatatttctactcttccttgtattgcaaatactcactttattgcactcccgccaggaaaagaattttagagtccacctagcgccaggtctcagacatgaagaaaatgacggtacaagaggttctcaccactcaaaatatttttgaaacatctatcacaatgctcttcaacagaaatatacccagtagtgagactgctgaatcacatggtagttccatttagttttttgaggaactgccagttatccacaatggctaaactaatttacattctcaccaacagagtgcatgggttccctttcctctacatccttgacaaaaacatcttcctctttttgatcacagccattctaacaagtgtgaggtgatatctcattatgttttcaatttgcatttcccttatgattagtgattttgagcattttttaatatacctgttgggcttttgtatgtattcttctgagaaatgtctattcagctcctttgcccatttttaatcaggttacttattttcttgctattgagctgagttccttatttattttagatattaacccctgagatgtgtggcttgcaaatattttctctcattgtgtaggttttctcttcactccattgactgtttctttggatatgcagaagctttttagtttaatgtaattccatttgtctgttttcacttttgttgcctgtgctttgggggccatatccaaaacgtcattgcccagaccaatgtcatggagttttcttctgtgatttcttctaccagttttacagtttcaggtcttacatttaagtcttaacccattttgagtaaatttttgcatatggtgtgagataaaggtcttatttcattcccctggatgtgaatatccagttgtcccaacagcatttatggaagagactgcctttccccatgtgttcttggcacctttatcaaaaataatcaattaactgtaaatgtgtatatttatttctgaactttttattctgctccattgatctatgtttctgttttaatgccagtactcttttgattactgtaactttgtagtagattttggagtcaagtagtgtgatgcctccagctttgttctttttgcccaagattgctttggcaattcagagttattttttattccatatgaattttatggttgcattatctgtttctgtgaaaaatagcattggaattttgataggaattgcattgcatctgtaggacattttgacaatatggacattgtcattttagacattttgacaatagtaattcttctaatccatgagcatgggacatatttccatttatttgtgccttcttcaatttctttcatcagtgttttatagttttcagcatacaggtccttcatctccttggttaaatttatttctacatatttttgtagctcttataaatggcattgtttccttgatttacttttaggatagttcattgttagtgtatagaaatgctgttcatatgtgtgttgattttgtatcctgtgactttactgaatttgtttattagttctaatgattttttggtagagcctttatgatttcttatatataaaattatgtcatttgcaaacaatttaacttcttttttaatttggatatcttttatttctttctcttgcctaattgctctggctaggacttccagtactatgttaaatagaagtggcaagagtggacattctgtcttgttctgatcttagagggaaagctttcaatttttcaccatttaatatgatgtgagctgtgggtttgtcgtgtatggcctttattatgttgaggtacattccttctacacctaatttgttgagagttcttgtgaaaggatgttaaattttgtcaaatgctttttatgcatgtattgagatgatcaaatggtttctgtccttcattctgttaaagtgatgtatggtgaaagatcctgttaatgtgctattgtattcagtttgctagtattttgttgaggatttctgtatcttatgttcatcaggacattcgcgtgtaactttttatcttgtagtgttcttgtctggctttgctatctaggtaatgctggcctcataaaataaattgagaagtattcccacttctccaaatattttggaagagtttgagaaggattggtatggcttctttaaatgtttggtagaattcagcagtgacgacttcctgggcttttcttcggtggtagaatttttattactaatcagatttccttactttttattactctgtttagactttctgttttttttttcatgtttcagtcttggtaagttgtatgtgcctaggaacttctccgtttcttctaggctatcaaatttcctcttcctataaggacagcagtcagattggattagggcctatccttggggctttattttaatttaatcacctctttaaaggctctatatccaaatgcagccacattctgaagtattgaggattagggcttcagcatatgaattttgggaaaggacacagttcagttcataacaccagctaagatttagggacttttcatgttgccaggactggaaggtggcttgacccttggttctcagaactgccctctatcaatgctggcatcccctgagacaccccctttcccttctggtctttggtagttagcccaggtagtattaacctgagttgtccctcatccgtgacacaaagtgccacactgggccactgaaagtgctgtgagatgggctgaggcttcccatcacttctttgtgcccctcattctactccacctgtgctatacgggcacagagggacttgatgagtgtcttagtttgttttgtgttgctataaaataatacgtgagactggataatttataaagaaaagaggtttatttagctcatgattctgtaggccaagaaattcaaggatgtggtcccagcttctggcaagggatttcatgctgcatcacagcatggcaaagaaagtccaaaggaaagtggacacatgcaaagagggccggagaggtatccaggctcttataatagcccactctctcgagaactaatccattcctgggagaactaatccagaaagagaactcgcttactacctcagaacagcaccaagccattaaggagggatctacccccattgcccaaacgtctcccactgggccccacttcccactactgccacactgggaatcaaatcaacaccagctttataaagacaaacaaaccatacccaactatgacagtgaggtctctcaggtacatactcctgagtctctccttggaaatgaggcacaggttcactctcctccccagatcacacaactcatctagggtgtttgtcacccacccctacctcagggcttgcttggaagtgagtacagcaatcaggatgcagggcccctttctcaagcactgaccacatctaactcttgaacatacttcctctctcacaacgttaaacccaacccccgccaagcaggacaatctttttcagttttgggggctgggaagctttactttatttcagcacatattctcccaagcatagtgtctgtgcctcagtcttttccaaggccttgaatttttgaaagtcaaaactcacattgtcttctttttttcccccccgcttgtgccagaaatttccttgaggcaataaatgcaaaatggctcactgattgtgtaagggtagggctagagtgaaaagaaatgtggctgggaaaatatagcattatttcaaaatcttaccctgccatatttagttgccgctttagctagtgaaattacacctagcagatagtgtggcctcacaaaggaccccttcatcagtagaacacactcttgcactgtctgcccaatggagaagttggaaccaggtagatccacaatctcctccccattaccccatgagtagcccaactggccagtgttgggtccccagattgtgaccacagaaaaccaaataattgactggtcagaaatgccaaccccgttaaggcagtgttctgaataactactaattgtctttatctcattgttatgttgttaaaatgtcacagtgactcaatgatttaaaatttctaaccgttcattataaaagatagccctatagttgaaaatacagtattgccatattttccatattaagaagcaaatttcttaaaagctggtaaatttcttattgtgtagagttggcaaggttttagcataggtcagctccagctttttctcctctttaatcagaagtgaaagtttgtgtttcttatgtttcttaatgataatctttttcttttgaaaagcaaaatacatgaatattagatatggacatgaaaataccctttccctaaaagcagaa

SEQ ID NO: 1091 - DNA, 59058 bp, Homo sapiens
taaaaataaaatgtttaagaaatgtctatgtggttaagtaggacttccccacccatctaacttgcccagctaacgctgcaattacggatgttgcaagaacgttgactcgacccagccttcccctgctacggtaaatgtccctcacccctccaccctcaggctggacaccagctccaagtctaatccttgtctttgaccatttggggcttgactttgcctttgaccttgcctccattgcctgccacatccttcagttagtgacaagcacaagatgggtcagatttggtgggttccaacactgggtccagtactaagtgtgtgaccttggagcagtcacctaacctccctgagccccagcttccttttctgtaaaatgggaagttacacataagcatacatataccccagctctgtgggtgccgtcagtagtgatgtcaccatcccattggtacagtgcctttgagatggcccttcagccgtgcttcctactcccagcccctgtgatcactcacttggaccatagaagcctcagccttagtccttccatttccaggcacttctacctgctccaaattaatgacctaaatccctgcgctaaccaataattcctctgctcagaaaatgtcagtgtgggaagctcaatacaccactagttcaaccaaaggcatttaccctgagacccaaaccctctttgaccttgtgcccacttacctgggtggcttcacctcctactgctacaacaatcgtgcctgaggaccattgctgaggtgacctgcccccacctccagggtccagatgccatgtggagggtattacatgcgtgaacccttatcgccataagggcctgagtctgagtgcatacccattctgcagataagaaaacagaggctcagtagcatcaaaccctctgcctaaggtcacacagaggacaatggcagagccaggattgtagtccaggtctccctgactccaaagcccagaatgttcgtatactcctttccggaggcactgagaccttccctgctcttttggccttccctgctccctgcccctgctcaccccagcccctcctctcggcatgcctgcccacctttctagatcctgccagtctttagggctcagcttaacgccacctctttcctgatgccatctgggtcacagcccccatgcaccctgcagacctctcctctgctggaggttctgacatttgcacaaggcctgcattcttctaggctctccctgttccttccttaggaaagtgagcctggcccttacggtgaggtcctctttccctgcttcacactccagagcggcaggccccaactttttggcaccagggaccagttacatggaagacagtttttccacagtttggtgggggggatggtttgggatgattcaagctcattacatgtattgtgcacttcatttctattattactatactgaaatacgtaatgaaataattctacaactcaccatcatgtagaatcagtgggagccctgaatttgttttcctgcaactaggtggtcccatctgggggtgatgggagacagcaacagatcttagattctcgtaaggaatgtgccacctagatccctcacatgcacagttcacaatagggttggagctgctatgagaatccaacgttaccactaggaggtggagctcaggtggtaatgtgagcgatggggagcagctgtaaatagagatgaagctttgcttctcacctcccgctgtgtagcccaggactgctactggcccatgcccgaggggtgggggattgcctgctctacagcatcatcacacatgcctttgccccatctaagtttgttgagtgagtattatgtgcagtcactgattcaggctctgaggctgcagccatgaacagagttcccacctcaaggagcggaggtccctgatgggcagagggctgctgaagcagcagcagacacacagatggtccagtctcaggtgacagctgtgagcaaatcaagcagggaggctggccatgcaggagaggtattattttgtgtaagtggtcagggaagggaccgtagtgaggcgaaggcactggcctggccagggtcagggaagggaccgtagtgaggcgaaggtgccggcctggccagggtcagggaagggaccgtagtgaggcgaaggtgccagcctggccagggtcagggaagggaccgtagtgaggcgaaggtgccagcctggccagggtcagggaagggaccgtagtgaggcgaaggcactggcctggccagggtcagggaagggaccgtagtgaggcgaaggtgccggcctggccagggtcagggaagggaccgtagtgaggcaaaggtgctggtctggccagggccagcgaagggaccgtagtgaggcgaaggtgccagcctggccagggtcagggaagggtgtgccaggcagggcaccccagggtcacaggccagtacagggaagggcttggtgtgctgagcatggcggtgaggtcagcatagccagggctgaggtgagtgcgggcagctgaggtctcagaggtcagcagggcagggtagaacccagggagggcctcgagggccatgagcaggtcttggccttttatcctaggtgtgttggggggttggggagggtttcaaggaagagagtgacatggtttgaaggactgcaggggaaaagtgacagtggaggtgccaggagggccttggccccggctctcaccaccatgcgggagtggtgcgggggtggggggtgttgaagcataggtttcactgttattcgggtaaagtgagaccaacagctcagaagattgtctttagccgggctcagtggctcatgcctataatcccagcactttgaggaactgaggtgggtggattgcttgagcccaggagttcaagaccatcctaggcaacatagcgaaaccctgtctctacaaaaaaatacacaaagttagctgggcatgatagcaggtgcctttagtcccagctactcaggaggctaaggtgggaggatcacctgagccctggaggttgaggctgcagtgagccgagatggtaccactgcactccagcctgggcatcggagtgaaaccctgtctcaaaaaaaaaaaaaaaaaaaaagattgcctttggcacaatggtttgttactcacagttcccaagaggaagagacacaccgggctatgtggggccactgggaagcaccgaggggaggaggcagagagagccctggggaaatggtgagccagagcctttgctgtggttttcacaggaagaaatggacaaacagcaactgggctatgcagggctagagctgagtttgaataattttatggggctcagagtgtctgggcttccaagtttctggcccctggcccgcggggcgactggggagctgcattgcccactgcaagtgctcaggaagggagatggtcggggtgggctgggattggccgttttgcacacaaaaggtgtgctccaagtgcctctatatctaggggttagctagtcccgagagggcagtccttcccaggccagcaagatgtcaaaggatcataaaatacagaaaatagtcaaccaaactaatacaagagtggtcaagatgagggggcagagccgggagaatggtggatcctatgaggcaggatccaccattggtctccttactatgaccaagtgagatcaccttactatggtcccttccctggccctggccagaccagcacctttgcctcactatggtcccttcactggccctggccagaccagcacctttgcctcactatggtcccttccctgaccctggccgggccggtgcctttgcctcactatggtcccttccctgatcacttacacaaaataataagacaggacggtgagagagtggcttgggaaggggcggggtggctgtttggtcagggtggtcaggttgactgggaagtggctgtcagcctgaaggaggaagctgggggcagagccttcccgcagaagagatggcaggagcaggacggccggcaagatgggttccagggtgggtgtgggcgagcagcgcccgggtagagctcagtgacatggcctgcatgggctggtcactgcgactgaagatggaaccctgctggggaggcggcttaggtggagagacagacccaagagctctgagtcattaatgctgggggcgccacctgtcacgcagtgggtgcaccagcctgcgctcagggctgaggtctaggagtcatcggcatagagatggcgtctgaggccacggactggataagaacagttatgggagagggctaaggactgagccgctgggcaccccgacattcatggccagaaagaagagcaggtgcagccatggaggcaggatgaggaccagcgaggagtccgttgttctggagaccaagtgagagtttcaggaggagctgccaacaaagtcaacagggccaggagattggattaggaatggcatctccagacgagcatctgcagagggtctgacagggtgcactcaacttgaccctcaatgaagcagcatgttacccactcccaaaagaaccccttgcttctcgtaagcagagctgtattaccaaaaaattgtactcaactattgtattttgaattccatctctaaatatttgtggaacctcttttctctgtgttacattagtacctaatatccctgtttttcctcttgggcccacaaagtctaatattatttaccatctggccctttatggaaacacttcagtcatcttgagccagagcatgaaagtggaggaggcattttgagaatggatgaggggccatgggacacataggacccaatgcaaggtacagtggcttcctgaggatcagggcatggcagccttgggggtgacctcgtaggtagaggcgctggtaggcctgaaacattctgggagtggtcttcgtgtggcctggggaaagctgggggttcagttccagcccagcctcctcttggggcttggtctctgaggcagatggggaggtcatagagtggagtagctggggaggaatgagggtatctcaccagaaatatgtcactgtccccagtatcgcccctcatgcctgttgcagttctgaaatgcttcaggcaatgctgtgatcaatgtcttgtctgtttctgatcaaaatctgtctgctgcactgcatgcaggcagggaccagctctgctctcccaggtgcctctaataccaaggacatggctggcgatccctcaatatttgttggaagaaccagtgaaggaatcaatgaatgagcaaatgaacaatgtcccaccctcaccacaatgcctggcccaatgactcgtgcatagtagatgttcagaaaatatttgctgagaaaattaaattttggcttttttacactttctagctcaggtgtatacgtttggtgcctttgaggccctgggcaaggccgagccctggggtggagcaatgtgcttctgatgtgactcagggctcaggggactcctcaccgcagctagcccatcacagctagcccctgaagtctgccttcagggaggcgcagacaactcacgccagccagcccagggcaggggcaatatccgtgccagcaagtctcggctgagagagccttttggcagaaaaagccatgtttatttcccttgtttccccctagaaatcccagtcatcacctagacccctgatgggttgagctgcagaaaaccctggcccaggtgaccccaaaaaccactggccttccctgagggaacttgaaaggggggcatttgaaatggaggggaaggagaactaacccttgaaatgtagacaggctactgaggatggaagcctggggctggtgctgagggtatataatgcagcactatggttaaaagcactgactcggaatgtctgagctgcattctgctctctttctggggatctgagctgtgtgacctcaggcacgcatgcagcctctctgatcctcagtctatatttgtaaactctgagacccactcatgagcaagacagacctgtgggtgcagaaagggcctgtggtgtacccaaggttaagagatggctctcccaggctctctgctgcggaactgggctttgaatccagctcacctggctccactcagggctcaccctcttcccacactgtccttgtcggtggcagagtttggtagatgtaaatcatagtcccttatggtgggaaaacagtcgaagggggatggctcatgacctgggggagatgggccagggtgcagggagaggcagctgggatttccccaccctgattccctggcccccacctttctctgccgtaccaggaagagaattcctcagggggcgttgggcctccgaccctgggcaagtcacaaggctcagggaggccgaggtttcagcctcagctgagacttgcccgcttctagatctgaccaggacctgactttaaaggggcctttcaaagcatgcagagctgagggtacaccccagaaagcccccaggatccccactggccctcaggcctgccaaggaccctgcatgaacccggcctcctcatgctgctggcagctctccactgtgggagaggaggcctttcacagtctctgtgtcccagacacagtgcccagcacctatagggcagtcagcagaggctgcccaggagggagtagaccaagtctcctccttgctttgccacaggttcaacaaggaagaacccaggtgcaagcctgagctgggtcctgggtgccccatggtaggaggacgcagccacttgcaggtggcaatttagagagccctgttgctcctccccagagtctctcgcaggcctgctgcattgcctgagaatccccaccttctgccttcgtactcagcccttacagtccaaggtcagcaacctgtgcagcctgaggctcccaggatggcccacagtgctcagcctcctgccctggacccgagtaggagcaggtttgtagaggatactggggatgagccagggggctggggacagggttggtgaggacagagatggtgggggtgagtccagcctgtagccatcagtgagaccagacaccagccttccaaagcccaaagccacgaggctgggggccacggaggtcaccaacccctgaatagggactggaaaatgttctatttctccaactttcataagctgctgcctttgaagtcaacaacagctgaacttcaaagcaactcaaaactacctaggtggctgatgtgtgtagtttacacacatcctggaaaactcacaaagtaacttcacaagaattttttaaaaagtaaaaaggtaaataactagtaagcactcaaaaattacttctaccaagagctggagaaattgtcctgtctccattgtgggggacaaggctgactcttggaaaccaggtgaccttccacgggaaaaacactgtgatgtgaattgaggaggaggtgggtctgtggcctgacccctcgtgtcaccctgtcccacctactccactaccccagtcacagggccttgcctggacgggaaggtgcgctgtcccaaaatagacgcatccagaagctcggccttctgctgagggcagccccctccccactcagacctgcctgagctgtacagtagagcacagggaaccagccacggggtacctcctccatcccacgcttggctgactggccagctctccacaccaccctcctgtgcttggccgaatacgggcctttgaagatgtccatgtcataatccctagagcctacaaatatgctcccttctatggcaaaagaggctttgcagatgtgatccagatatggggagatgatcccggattatctggtgggcccggtgtcatcgagagggtccttacgacaccaggagcatgagggtcagagaaggccatgtgatctctgaagcagagggagagagttagacttgaagatgccatgcttttgacaacagaggaaagaaccaggagccatgagagcaggcagcctctcaaagctggaaaaggtaggaaaacactccctttgagcccctggaaggaaccagtcctgctcatcacttgaatttagcccagtgagaccaacttcagacttctggcctccagcactgtaagatcataaacttctgttgctttgagccactaagtttggggtgatttatagtagctgctgtagtttggatgtgtgtaccccaaacctcatgttgaaatctgatccccagtgttggggtcatgggggcagagctcgcaagaatagcttggtgccatcctgggggtagtgagttgttgctctatttgttcccgcaaaagcaggttgttaaaaagagcctggcacctccctcccccggccctgccctcccctgtgacctctgcgcagcccgccctcttcaccttccgccaggcgtgaagcagcctgaggctttcacccaatgctcaatccttagccagcagaatcgtgagccaaacaagccttttttcctttatacatttccagcctcaggtactcctttatagcaacataaattcacaaagctcccaggccgacagctgttccggccgatgcagcttctgccccacgggacctattctgtctctgctgctctgcagggaaccttgcccggtgaagtactgggaaaacccgattcatcagagtgatgttttcctatcagtccccatgggatccacctcaccataggcagcacagctgcctggagggtgagatttctggagtaacaggaaaatagtcacccacataatccctgtctccacactcagggatccttggagttcctccacctggagcacagcctttgcttcagttcccaaatagggtcattttgtggggaagaggcatactcctcatcaggatccttcccgagggctggtttctcggtggggagtgggtggcctcacgggagaggctttcagaggaaatctgaaatggagggaggtcataccctcagccctcaaagatgcaccccagccgtcctgctcctgactcccacccgtcctccattccctgctgggtaaagccattcctgaccctcgcaggaaaagatggggtcttccctatttccagcctggacacacctgccccctacctcaacacaccactgtgggaggtggtgctggggagaaggctcccccaggaaggtctgcccagaactgggggacccaccatggtccacgctgtgctcaggatggcccagctttcagagccctaagcctgagatgtcccctctgtatgggctgaaaagtgtgccccaaattcgtatgttgaagtcccaatctcgagtacctcagaatgtcactgcatttgcagataaagttgtttaaagagatgatgaggttaagatgaggctgtcagagcacgccttcatccactccgactggtgtccttataaggagaggaagaggcagcaggggtgtgtgtgtgtggccacatgaacacacagagagaatcagccatcagcaagccaaggacagagacccccagagaaaccagccctgcagcaccttgatctcgggtctctggcctccagactgagaaaatcagtttccgttgtttgtggtcttttgtcctggctgccccacctgagtgcacaccacacctccttctgcgggcttgccctcagcaataaggacatgtgccagagacaccaggggtctcaaactcacagctgccaggggccaggcaggccaccggaatgaggcctgtggtcacttaaccttcaaatttgaaggtctgaagacaacgctaggcctgactgtggctgggccagacctcccaccctgactcacaccccaacaggactcgcacagggagtccctgctaacatctgaatccttttctctctggtcttgagttttcttctgcctgttgctcgcacaatcacacctcgtctctcagcagccagcacagctgtaactcctctttacacagagcctgcacaactcgagcaggtgcgacactaaaccactgcgattcactcatgcaccaggaagagcttggctgcagaggaagagcacgcgctccacaggcgtcactcttatgggtccatctttaattatgttaaatattaataaaagtacagcgtaactgcgattcacttaacataccttacaggactaagggagtacaatttaacacggtcacaacttttgagaacaaaaaggaacttcaataccatgttgtgagaaatgctccaatttgctttggttttgaatggcaggctcgagaaccaccgcccagaacggaacctattctgtcagcaagagccgggcctcgaatgagaggaagcagaggcagccgaagtgccctctggagagaaaggcccctggagggaaaaaccatgtctggatggcattgagtggcacagaagggatgggactgcatatataaaaaagatccgcataataaaccaaataatattggaaataataccttcagtaatacttctgtaagaagcagaattacaccacatgttattcacatgcataggagtgcataagaaaaatcccttgttgtaattatggttggtgtggaatagtaaaatatgtactgaaaatgacaagttaattggcagagaaattaatctataaaagggttgtgtccagagcggaggagcctcattagcaactgaacagaacccactcagaagacgcactcacccacacgtgcgcgtacacacacacacacgcgcgcactgtactgcaaataaatatacacacacactgaagtgatctctccctaaagcatccttgtgctcaggccagatttccctgctggcggctgctcccagtgccggctatagagaaggtggggactgtccctgcaagtgggagttcaggacacacgctccttcagtagcaaaaacagccctggccatcctggcgctcagagccctctgcacaccttcgaacgggctgtgtgtcccttctctgatggcagaaagacaacaccagcagaaagacggctgaacaactgcagatcctcctacccccgaagcctggtctgtctcacacatacaagttagagctgggtagacgggtgcttgcactttctggctttggtgggcgagaccttggcctgagaactttggttcacaggaagcttcccttgacaatacttgagtgcaaagcttcatccaggtcccacctgggctgttgccaaggatgctcaagcgttctcttcaatcttccctgtgacttccaagaaacgacaagatctctagcccatccatcggtaaaccaagctgccaagtggcctggaaaattccatgaagaacacggctcttagaaacctcattccaaatctcaacacgccacgttcagcccaagttcagcttgtgcattgtgttttggaattgggacacgagtatctatagtcccttgctgggtgaggaactttgaccacacgcagtggagaatgtggaaataaactatttccaatgggaaggcagagaaatggagcctgtagccggccagaactaaaaattaaaatcctctgtttctctgatgatcttgtaaacctgatgagggcttgaattacctagattttccaagaagtgttcaattccttgaggttgctcattctggcattaacagcaaaaatttctcttccaattataaactgaagttcttgagaaaacgtatgaagaggcagcagagagagagccaggactggttaaatgcagaaagtggttttgttttaaacgcattcattttctatgttaaacataagtccacaaggacagaataggaggaggtcagaaagatgaaggtgctgccaaaaactgacttatttttttccttttggaaacagtgacgttaacagggtttacatctgaagaaactggagggctgagtttggagtaaaggagaaaaaaaaaatgaagagcctccattctcgaaagactgcggttctctgtcccagtgaggttagcgatcgcaacaagagtgtttcagaagtgaatgtggtatgatcacacctgtgaagatagccattgaatacagacagtctgtgcaacacggcgagaccccatctctagggggaaaaaaagggaacgtgaagtgtaagttccagccaggcctgtggcatgacctctggcttgctgactcagaacccagaggctctccagaaggcggaggcgggcagggccaggctgccttccctaggtgttctctccacacccagtgcaggccagctggctgcatccccaagctccaggacgctcagagcagagctgaattcttgagaaactggggtctccaatggcctcggatagaggagctctgtgaggggtccattgctgagctctcgaacatcacgaaggaaattccaaaatggttataattcatgtgtgcctagagtggcagagtcctggggttttccataccatgagtgaaacagttccccgcaaagagatttgtaaaatcctgatgatgacggcattggcgggcccagcacgtgcagcaacaattcagctctcacgtcgtcttccacgcaaacgcctcatccgcgaggacctgcgccagcctagcgttgaagggcctgtagaaatcccgcagaatcttctgtgtgatgggccacatgggccccaggttccggtcctcgggacgccgtgcattggatgcggggctcttggtcatcaaagcctcctgcttctcacttaagggccctagaataaaagaagacgagtcccgtaaggcaggaggcatggcaggaagtaaaagggactttgcaaaaatcccagctatgcttcgtattcagacaggagtttcctttaagagaacatatttagggattaaaattctttggctggatccattttggaagcactgagggaggaaggtggaaacaccatcaggaaattgcgaagaaattctgcggcgggtgcaggatgcccaccctcgggggagcccagctggcatttaatgatgatacagcgtctaaggctgacctcaaggattcccttccaattgcccttggtgggctgctctccatgggtgtcagcccgtccttggaggaacgtgcggcctgccgagcacagcccacgggtttcggttttcctgctcagcagccctctggaattccgccatcatcgtttctacttcaggctgctcatgccaaggtccctgggcctgcacagtttcaccctgtgcgtcttgctgtgaagtggccatagggaggagggctgggaggaggccacttgtgcccagagcccccactggctgaacctccatctgcagcaaggagatcagggagaagaggcctgccggcaagggctgtcagtcacccccacgccccgccctctggagtgaggcgaggccctggaacaggctggcagaggttgtcagtcaccgccacgccccgccctctggagtgaggagaggccctggaaaaggccgggaggggctgtcagtcacgcacacgccccgccctctggagtgagaggccctgaaacagaacagcaagggctgcgaccccaacgccccgccctctgggccacagcttcttggtgtaacccatcactgctcaagcctctttaccgggggctcttgggatctggccaaagtccttagcccatagacagaaaaagcatgtcccagcatcctagggccatatgaaacacagaattggccttactatccatcttggggacaaaagacaagctcattaatgggacagagtcaacatgtggtcaaatcaaagaaagatgattctaagccttggaagggaaagaactcatcaaactccaaaaaaaggagaaacaaaatcaaatgatcaaagaggcccaagtcccagtggcaggcagatatattttcagaaatactcaattaaccaagttcccgggcaagaccattagtcagggctgcaggaggcgttctgggaaggagggcggcttgttcgagcctgctcagcctttcaagccatccctcggtgccccgtccacatgggcagcactcgctccgccagcacatgcctctgccagccatcaccatagtcagcagtgtggcctgtcaccacaaagtgactctcaggcccctgggggggctggtatccacaggctgagggcaggcgctcatgccccaggggcccagcatccatgatcagcagccaaaactcagccacacggctctgactcctggaatttccaagaataccggagatgatgcaatgatctgtctgttccctcctctaagccccaagtcctctgctccagccccccggtgacatcctgttggtcctacaaagctcagctctcaggccctttccttccatgaagccttcctcatccgtgcagtagctgggatcccaaaccatcagcacataccttacatgacagtgctgaccttccccacggcatcctacctgtcattcagttaggtgagctatggcttcctcctctcccttcactagaccataagctcccagaagggaaaccatctccttctctccagagaatccctcaccatactgtgcacaatgacctatgtacagctagtgctcaataaatggtacttaacaggcctcctgaaggacatccccaggcctcccagctcagcccattcccacccagctgaccaggtctgcatttgccccagaggactcccagaacaagtccacggagctcatgctttggcccgtcagtctaagcaccacactcatacctaggttcagaaactggaagaccttgtgcatggtgtacttgacgttggatgcatgatcttccaggcgaagaatgagaaactgttgcttgtcaaaaacgctgagccagtccagaaggtacacagcatagagcccaacctggagcctcacctaggaccacagaagaagggcattatttcaggagcagttgccccaacaccatagggcacttttccaaagtggtatggcatttcactgtaccacaaaagagttatcctagcaaagttactttcagaagctggattttaacacaaggtgttcttgcttctttatggggggttttgtgctacatgtgcaaagaattcctatattaggggttgcatttcatcctcacaacaccctgtgggtagcgccatgcctccatttcacaggtaaggactgaagtgcagggaagaggtcaaggttgtggccaccaatggtgtacatgttcctcgcacaatatcctggctgtttctctgttcccagtgtgacctctatgcccagcacacaacgggatgtgaaaaatcaaccacagacaccccaaagacaacctacatgagtgaagagccaaatgcctgatgccagaggaacatccttgactgtgagggtgtgtgtaattcagcatctaatcattactgaaccaagtacacaggaggatgtttctatttaagtcctttctactttccagtacccatttcccgggtcttcacccttctgttccttctctcgtgccttactgcaagccgtgtggtgaagatttaactctactcagagagaactcgggcctttccctcggctcctgggggtgatgtctgggcccctggatgtcctgcctgacagaagtgtcttggttggcctgagggctttggtcataggcaggctaacactgagattgatgatggggccttgggccacatggtatcagttctgactctggtaggactggagactaaaggtcagccacagcatctgcatgtgacggaaccctagtaaaaggcctggacccccaaggcttggcctggcaatactccacgaggattgccacataccatggccagtggcactaacaccgtccatgactccacagggagaggaggactcagagctccgcatttgggcccctcctggagtctgccccctgcacttcctctcccttggctgattttaatcttcatcctttccctgtaataaatcataaccaatagtgtaatagcctccagtgtgttctgagaatccttctggaaaattactaaacctgaaggtgggttggagaatatctctcctgaacttgcaactggtgtcagaagtgagagcagtcttaggaacagtttcctctaactccacagttcaccctaaactcttagcaaagcttccagaaaaaaacagcctcatccccttttgctgtgaggcccccttctccagggcttctccccttgcctcttctccaagtgcccagggaccctgctctgcctatctgtgtctgcccagaacttctcatctcccacctctccccagttcacaccactccctttgtttatgccccatctacacctgcctgaagctgatacagcctcctggctagtcctccttcccctggtctctgcactctcatatgcaccctgccaccagcatgggctttccaaagcagtgatctggccacagccagccctgcttaaagcctccatggctttctatgtgtagaaagtcctgggcctggcttaaacttccagctcatcctctcatacatgcagcacttcctggctccccaggctcctccctggagttcccattttttaggcagacactctcatgtcacatttcctttcctgcccaacttgacctggaccttgaccttgagggcagggactgtggcttctccaccattccctccttgcaaagcctgcactctggccctcaacatggttctcgggtgcaactgctgaatacagtgctaataataagacaatgaaagattgggcaaaatatgtacagatgctaactattcttttcccatttcattatttttctaaccatggaggaggatggagaggaagaaaagcaattagagtggataagttgccttcaaaattcattagctgtttccaacccacactgttgctacctcacatgccagctcagaaaaaagacctcaagctgggccgaaactaaagagaaaatgagaacgtgccggtctcagaaataaacatgtgttgtcacctccaacgcagacgaatcatgacgagaccaactcgctgttaagtcacccgcctcccggggcttttcagttgtctccctggcaggcttgtaggccgtccctcgtaggggagaccagtctgatgaggtttttcttttccagaggacgtgcctttcaacaggagaactttccagaaggaaagcagccaggtgtttgtggcaggctggggtgttttagagcagctgtagtctgtccgagcacctggctgggcacctgcacctgacagatagttctctgaaaccttgtttgtgtccatcctcatgagagccccctgtgctgtctcaggtggacacaggcctgcaccgcagcatggtcctcctcagcaggcagggctgagccaggaagcggaggaaaagaggaaaccgcaggggctgcaggcggcaaaggcctcctggcgctcggctgcttctcccggggctagctcccctcccgctttgtgccttccctctgatctatctgctccaaacgcccctcaattcccaccccaacccccagcccccttgccaagcagggggagtgtggtcacctgaagtgacagtttctggtgcaggcagtatcactactgcaaccatatgcaccatgaagacaggacaaagacagcccccagcagattttttttcccctcaccttttcccggtataggacagagaatcaaaatagaacaaaaataaaaagcgtatttagggcaagtgtccaatgtgcttaaaattagaaaacatcagagctgcaagaagcctttgaagttaaccgtgccagctgattcaccaatagaaacatggaggtgcagggcagggcggggggggctactcagggtcagtggccaatacccttggagccaggacctgaagccaggtcacctgtgcttgtggagcttgtcccccatgcagggccccagggaaaagcaatccccaccgagagccaaggctgagctgagcacagtcccagtccccacttctccccagacaggtaccaggccgagcctctccgtcccctactagggatttcagttgggagtccccagccagcctccccactagtccccattcattcatttggcaaataagctgagctcgtgccaccatgtgccaggcaccctgctaggcaatggtgatttgctgctaacagaagtggccctggcctcagggaggctgcaatctcatggagacagagctcaactggtaaagaaacagacttccgcgatcaccttgtgatgcatgcaatggagaaaaggagtgggtggagagagaagacagtcagagtaaagcaagccctggagcaagtctccccgaccccagagggcacgaaggagggagtggtgacgagccctggtggctctccaaccggaccccacaaacacccacctggagggcctgagaaacacaccatggccccgtacccagagtttctgattcaggaggtctgggactggcagagcgtttgcatttctgacaagttcccaggggctgtggctgctgctcatccaggcaccaggcttctcgggaccctgctctgaggcaggctcactggcccctctgagcacccctcagggtagggtgtgctgcggaacagtggcgggggctggccagaggcagaggggtctgtgctgcccctgcatccgggtgccacaggaaggcggtgaatgactccagcagggtgtgccggggcccagggtgccttacaaagctgccctcccagggctgtggcagggctgggattcacatctggagggaaaccggcttctcctcccagaaatgaaaattcacctctataaggagggtttctgattgcctggctctttctctggtgtgtgagttctccagggactgaagattaagggacaatctgttactgctgcacccctcctgtccactgagcctgcccctggggatctcctctgagcagaggcacctgctaagctactgtcttgtcatcctcagcaaaacgcaaaattgagcataaaagcccaggcctcctgccagcaaaaccctttgcttttaggagccagctagggaaggcaaaaactccctgagtgtcaaacgccagcagacccaggattgaaccttgagcctgcctgataccagctatggatgggagaactaacctctgtgagcctcagtcttcccacctgtaaaacagggatggatttcaggggatctctaatgagacgatgcattgaaagggcttgggacaggggctggcagtaatgaacaaaggttagatccctttcacctctcacagatggagttttagaaaccttttatcacgaagactcaagcatacacaacacagggaggatcacgatggtgcccatgaacttatggctcagtttcagctgtgctctccagttcacagtcggagtgctgacccgcagcaggagggcaggggcacaccctcccttctgtgtgggagaaactatccaagggcttgcccccagggcgctggatgggagtcggcacactctgcatggtacaaagtgcccggtagcaagcagactgtacgtgcatattagatattagctcttctgcagcaagaaacactatttaaagctattaaaataaactgtgccttgggtcaggagttcccccctgccctgcctctccctgtccatctaaacccagcccagcttaagccgcttcctcctaggagtccccagtgcaaagcccacacctgccccacttttcccagtccttttcaggcagcctcctgcagagagaactcagtggtcccagggcctgcaggggagggctctggcaccttctacgaccacattagccggataccttgcccctcactgtcctcatctgctgacagtgacaatgactgactcctgtcttcccacccacctatcgggtttgttttgagagtcacgcaggatcaccaagaggagaaagtttcaaaaggcacaatgtggtagaaacgcccaggtggagacacaggcctcattccaagcacacaactggtcacagcaccgtcctgcaccttctctcttggaccagggcctgccacgctgtgggtgcagagtagcaaccactgaagatcagatggttggggaaatgttgaagccaaacacacatctaggggaagctgggttaaaaggcctagatttgggtcctagatcctctgcttactggctgtgactccagaggaaggctgcctccctgagcctcagttttcccagtagtaagccccaggcatgggagggcctgtgttaaggtgtagtgccaggttggtgctgagtctacactggctgaatccatcacttcccatccgtactctgaccagcacacacagcctcctcggcaggctccacctggtggctcttgtctaccaggaggcacttgggcagagaagggagccaggcaaactgggtcacctggccggctggggccgggaaccaccaatgccttcctcctcctcatccctccctcagtcagggtgctggcctcagacaagccttgaaggccgtgcaccaagctcttccttccctgaaaggaggcccctatcaaagatgggacaacactcctatttggttcctcttggattttccttggacttttccctcaagattcattcctggaggggtcctgcaccccctgaccctcaggggacaaaggtgcacccttgcttcccacactaaagtaggcaaatcccccagccatgctttaaattcacctggagacagtctcctgacgatgtcacacattttgtttgtaattacagttgtttaggattccaattatatcatttaataatgctggggaatttcctctctttgctttgcatttataaatattggctgattaagtgagagcatgagtgccagccaaagaagtgagctcggagccacgaatccctgtaaagggaaattatctcatggtcatgcactgggggagacacagccaggcctgtctgttcagattcgcctctgtgcccccggatcttcagagattaggatgtacagggagggcacctctgctctgagcattttatggccagcttcagaggaggaggggacagggaggcaagaatggcctttctgcttctgctgttttctcaaatgccaagctgttatatttgggggcagtgtgccttgaaccccatcaatagtgatggcagttcagcatcttagaaagatgcctggtgcaacggatcaaggtgagaaggggtctggggaggggctgtctcccagagagagggaagctgtgcaggtggaggttacaatgaaagggccagtggctgaatcagggcaatagcagagggtagaacagtggagctctctagaaatactgggaaaaagagggaaaaggactcgtgggtggattgaatcaggcatggtaggatgatggggaaacccagtccgcgagcacgttccccgatttgtgtgccaacctcggcatttgacccataatagccctggctctgagctgctgctattactgtttatgccaggactgaaggtcctccatgcgaggcctgcaggatggaagagccacctgcaccaggaaagtgtagatgtggcacgaaatgggcctggcctgagtcacagctgcaacttgattcgtgtctgtcagcacactgggcacccctctctgctcagcatcatgatcagtgctggaagaaaccacaaccccaccttgaggcgtcatgccagcgcccctttcctcctgccagccccagccctgagaccgccctcagggagctgccttgaggaccgggtgggctgccctgcctgctctctcagactcactccgtaggggtccagggccaagagtcacagctgagagtggttctgggtcacgaagccgggtcgacaagctgtgctggtcaagccacacacaaatagagtttctccgagaccctgtgtcccctgtgacggtggccacagagccattgagtcattccccctttgacaatcatggccctctccccgactgctctcttcatcaaacccaagcacaaacacgcacaggtttcccgtttctccgggtctccgtttccttatgaaggctccctcccgggttacatgaaatttacgttaaacaagtatgtgtgctttctcgcgttagtcttttattataggtgcctcagccatgaacacagtagtgagatattccttttccactcctacactatcttctgcttaaaaccctctgaggggtcccatctctctcagggtgatgtctagacttcttctgaggctagaccaggtggtgcggccccatgtgccacgcacccaagccccctgcctcagtgccccccatctcccacaccaggcggctggctgcgttctgtatggtaggtggtgctgaccactgggcctctgcacacgctgctctcagttccctggccaactctccttcaggcctcagcacagacattccctctcctaagaacctgcctgaagccccgttctcaggtggttctctggtggccagagctccctgcccagcctccatcttctctccccgccagctgcacaggaaggcaaggaccacacctgtcctggcattgctgtggccccaggacccagcgtcatgcaggggacatagtggcaagaatgaacgcaggaatgcaagacagacccatcacaacagcctggtacagcagcattattaccccattgtatgacaaagcaactgagtctcagaaaggctgagacaactgcctagagtcacagagccagcaaatggccaagctggaaacctgacccacaccaatggctggttccaaagtgtactcctcctacctggcaccagagcaggctctggggttacctgtgtccctgtggcatcttccttgccaaactacaaagtccaacagggcagcctggaatcccacctgctgcccctgcatgctgcctcccagatcccacggcctctgtagtaagaaagagggggcagagcctcttggcctgaagtcccaccacctgggggcttccaagactccacagcaggcctgttggtgccttgctatgcgagacgctgagcagagcaaggcttgtaaagccactctggaacacgcagcggcaatgctcgctgcataagccctgctgttgaagtacacagccagcccagggagcccagcatggaaaactatcccggggctaaaaggtgctgaattcaccaataacagctttttgcattcaaaaaggctagaaatttacagacatagttctgaaggaagaacaagagatacgattgaggaatcaacagaaaatgtttttcaattgagactctgtcaaagaagcattgaaaatcattgatgggtagttttttaaaccaacaaaacaatccaccgctcaagagaatgctcttaagacaatttgagagttgggtgtcctcatgtctgccgattctaattgctgggtgtcttgctaaatggtaatcttcctaaaggcaccctcatcctcctgctgagggaggagggggaggtggcaggtgaccagcagggaggaaggcaggagccagaccaagagcccatcagttttcagcttttacatccatgaataatggggaacagcatttgcacattaaaacgcttctctctgttcctatgctgaaacgcaaacccacaatgccgcttgcataataacaacaaaccagctccttctgccaggggccagctcggggggtacggggggggggggtacacacaggcatggcgttgttgagggtgttgttgtagacgcaggcgcgcagtgaataatcaagcatgcaattttcaaacagctgcagtgcttctgtcactttctcatggaagtcgtccgcggatttattcgaacttgcaaagtagagatagtctgagtacaacctgtgaataaaataaatgcatatttttaccacccatgaacatgcaatcacaccatttgggcgacaatgaaaatcagtgtacaattacattatctagttttcctgattgaagcacaaccacccttcttctttcccttgcagatgagccacctccctcatccctccgagctcccgcccttctcgtggccacctaagctcttccagacccagacatgtctatactggccccacacaaaccaccagccgcttttatggtgttgcttgttctatcatctcaggcagcctctgttttcacagtaacagggagcttcaaacaataccagattacaaaaatggtacactagcaaagagaagccatgaaaattttatgcaccttctcattcctctctcctctactgaagggaacaaaaataagagcatctgttgctctcacaatattacaattccgcatgaaattcccactactttgcatacgcattcctgacattgaaaaaaaaatgatgagatgtatctttctaggttggtagggaccttgtttttaacacgatgtaaaagcacccccacatatgcacaggaatacctgcagacttacacgtttacccgtggacacagatctgttcctagacaccacacacacgtatggcagaatgctgccgcacgggaactgatcgtcttccttgacccacttcaggctcctctgtatcctcctcccaactagaccttaacttttttacctccaggtccatctctgcaccaccctattttagcaagaatcctgctgttaaataaaatgtatgagaggctactgttctggactgagcttctgcaataggcccccacaggccagaacagagtcatctgtgctaggtgccacgtaattgaactgaactcggaatgggccagtttccaaaaaaccaggggatacacagcaaccagtcagacgtcccctttgctttaaccctagaaggaaagtcactctgaaatgaacaatccactctccgttgcctgtttttgcttcttcagcccgtttctgcctataaagccagaacctggctgggcccacaggagcaccttcgtattacaggaatgggatgctgccctgttcatggaccgtgctaataaacaccagtgagatctctaaactaaatttgtcaaaatattgtttgttgacactgctatgctggtttagccagaatcccccacccttggttaactgaccacccttcttatctgatcaggttcctagtccaccacccccaggagatgcctggccacctggcctgtctccagcaagaatcccatcgggttggtttagccagaatccccaccccttcccccttgatgtttccccttagtaattttctagccaccaaccccctcgccctgctccttggcatttctttttttttttttttttttttttgagacagagtttcactctgtcccccaggctggagtacagtggcgtgatctcagctcactgcaacgtccgcctcctgggttcaagcgattctcctgcttcagcctcccgagtagttgggactacaggcgcctgcccaccaaacctggctaatttttttgtatttttcgtagagatggggtttcaccatgttggccaggctggtcctgaactcctgcctcaactgatccacctgcctcggctttaaaatccctacttttcctagttgtattcggagtctctctcctctactgaaaaactgtcatggcagtccctatacctaccacaatggtcctgaagaaggcctgcattgccattttaataaatgtcagggccaggcacagtggctcatgcctgtaatcccagcactttaggaggccgaggtgggaggatcacttgaacctaggagttcaagtccagcccaggcaacatagtgaaaccttgtctctactaaaaatacaaaaaattagccaggcgtggtggtgcgtgcctgtagtccagctattctggagactgaggtgggagaatgacctgagcccaggaagttgaggctgcagtgagccgtgatcatgccattgcactccagcctgggcaatgggagtgagaacctctctcaaaaaaaaaaaaaagaggtgtttttatcttcaacagaacattcagggtgtgagtttcctactcttttttctcctctatctctccttgcagccctttttgtctgttttcaaccttcctgccatatgtcccactctcttcttgcacacacacctgcatctctgggccaagggtgaaactgggcttatgaaaaacatggcctacgtggctccacagggtcacacttctctctcctcaaagctctatactttctattccttcaacttctccaacctggcttcccctctttccagggaaggcaattctgtgactctcattctgcacccatgcatccaggtatctgacatccatatttccgtcttcgttttttttttttttgaagcggagtttcgcttttgttgcccaggttggagtggaatggcgcaatctcggctcactgcaacctccgcctcccgggttcaagcaattctcctgcttcagcctcctgagtagctggaattataggcgcctgccatcacacccagctgattttttgtatttttagtagggacagggtttcactgtgttggccaggctggtctcgaactccagacctcaggtgatccacccacctcagcctcccaaagtgctgggattacgggcgtgagccaccacgcccagccgccatccatacttccaaacgctcccagaccttcagccacatactaccctgcaaaaactgtgctcccttatagcagggtctgttgcaaatgcgccttctccactgccctcccctctaattgaggtcatgatatgaggagcagcatttcttagggacaggcccagaagctatccacctccgtagcccaccttggcacatcgggtgcctctgacacagccctctagaattcatccacggccaatgtccacagaggacacctcttggaagtcttgagcagtttgagatctacccacagagttcctagaatcaaaacacccaccggaacaggagtgttccatctaccacagcctggccagccaaactgtccaaagagacagtcagcaaaggggctcggtggccactgagtagatttccccagatccacactcgcctgagaatattccccaagacaacaccacatcagcttattactggtgtccccaacatcacctgtgctattttccttcttcagaattagaagacacatcaaaactgaaacacggcatctgtcgccatagggtcgctcatggttactatgacctaaatggctggtcaataagtgccaaaatcagacacgcgtgaaccttcaagcaaggtttggctgtgtgcactgaggggtgccaggtggcaattggtctgaggggtacccttcctggctcacacatttcctatgagtcctgtcaataatatggctcagcccaagaaactacgtcaatgaaaagtaacagatgcttctgaaactgtcataaaatcccacgttaaataagtattcgaagcccagtttttaccaaagatgcccacagaactacccaaattgtttggtggaactggaattccatcacataaattacctcacacaaacccaaacactggctgaaggtttccatactgagaattttctttgtggtaataacatttcttgcagatatttggctcataaataaaacaaaagcacctaagcttgtcttgattttaaatacaaagtcacttcatgaggaatctgctgattccatacaattcttcagagatcaagaagtaatccctaggaaaaactgggacatacctactgttccaaccaggcaagcccacccctagcaggtgaaacggctgattttcatctgtttgaggtgggttaaagtgaactcactacctcacttcctgtgagtcacatgtacagcctttgagagccaggccacgctccttcctcggctggatgaaaagagactcctttggcctctcagtcacctctgggtactttggatctgctcagagaactggcagtgggctttgggagcccctcgaaccccactgcgagaaactatgctgggtccctggcatcctgctgtgtcacagacatctgaacagggactagattcaccacaagccatggccaccatctggattccgtagttggatggatagtggacaccaaagaattatgtccaagtctgaagcccagcccctgtgaatgtgacctttcttggaaatagggtctttgcagatgtcattaagtgtaggatcttaagacgagatcctcctggatttacggtggtcccaaatccaatggcaggtgtccttataaaaagaggagaggacagacagcaccacagaaagacggagacagagcctggagtgcggcgtctatgagccaaggaacgccaaggactgctggaggccaccaagagctgggagcaggggacggcttttatcccttagggccaccagagggaaccaaccctgcagacatcttgatttaggacttctggcctccagaatcataagagactacatttctgttgttttaagaagccaagtttgtggtgatttattatgactgccctaggaaaccagacagattttaaaccccaattctaaggaagaccaattactccaaggagttatttttgccaatacttctctgccaccctgagaccctggaacagtggccctgagggtaggggaggactggggtcatgtggccacatttcccagaaggaagcatgaaggaaggcaaatgcggacaggagcacttcccttcaggggagcactcagacaggggagcactgagacgggggagcactctttgggttctccccaagaattaagcgaatgcttcctaagattgtcttcaagtaacaaagctatcatttcccccttgactactctccaggggaaaagagtgagttaataatcttgggtgggggaaagccactcggataggttaaagccactcagaaaatgctgagaacagcaaacatatcaagaacaagtatccactggacgtcaaaaggccagacaggcacactgtggaacaagatgaaacgtacagaaacaaactgaaatgtctaccttttagtcttcaaaatccactatcccatgaggaagtgggggaaggagaccaatgtaatggaaaacacacagctcacgatcaatcatcacagaactgcaggggcacggatgcaaccccaggatgcattaacaggggcacggcatgaggaatgtgggagggtggagccaggcgacaggcagctcacggcctcagcggatgcttgctttcagtgctgggcaccaaacctggctgctctccctggagatgcaaaaactcagcaggaaggagcccagtcccgaactcctgaaggactgaccagcgggcagaaggttcgggaagaaagcctggttgcaggcaaggggaaatacctccagtcagggcaggctaacacgaggggatggtcctagaaggcaggagcagcctaggctggagggaaggagggctccaggatagcgtgggggccaggggacatcataccctcccagccctgagtttcagggctgcccagccccctccagctgagccacctcattttcttactctcaaaccatcccgaacagatgggtattacatttggccaggactgtttccaacgacaattccaaatataagtccaaatgcattccaggccttctgtgctgcggttattttagaaggctgtcggcgcggcccctcacactgggcccgtgctcatggggtactgctcagcccctttcctgtgcagtgcaggggtcctgggacccctggaggagcggtgggatgggaaatgtatgttagggggcatagggctccatcaatccagtgcctctgaaagtgaccatgtctctccccaagggacaaaggagaggccagcagtggcaaggccctactatgtaaaatctggatgattacagccaagaccactgctggattcattcagggacacttacagccaagaccactgctggattcattcagggacacttacagcgtgctgttctgagccagcgagcagaggttggtgagttgatcactattaaagcaggagctgctgctgctcctcccgccagggctctgtgtgattgctttccgggtttagtacctgcaatgttctcagtttccactcctgatgtggatgctggggggtagggagggccaccaccaccatgccctgtacagggtgctgcatgcatgctctgcgtctatcttcacaaccccataatgagatgtgggccaccccattttactgggggagaaggctgacactagagaggttaaggagtttgcccatggtcacgcagcccaggaagctccagggcagggctgggacccaaacaaacccaggcctgcctgaccccaaagcgcctcacccagctggatgtggcccctgccctccgagcttaggcaaggagacgaatccacggctgactagagtgggtgctggccgtctgcactgatagttttcgggttttgtttgtttaggtgtttttattattttaggtgcacggtgatttggaagagaaagtcaattcttctccagaactacttaataagtcacaggagactgataaacaattacaaatgtaatagagtggcaaataaacacttaggataaacgtgaggaactccaatgccacggtcgggaacagcaaatgtgtttacggaacatcacatccggcatctagaaaagtgacagcaacagcaaaagggaattcaggcatctatcatgaagccggaacacactgcgggatcttgtatctcttggaaaagctaatattccttggtgatcgcaatagctcattagagtttgatggttcctgttcctaagtgatgatgtggttgttcatcggcctggcctctatgtggagaactctgcaggacctggctccaaggccactagtttgggaaaacctctccccatagtgggttcctcctccttttgtatttttgttcatatcgtttttatattgagaaatgatccacgtaccgtagcatccacccatttaatgtgaacaattcgccagtttttagtatacaccacacagctgtgtgaacaccaccactccccagtcccaagatgttttcatcaccctgatgagcgactgctggttctaacacagcagttcccacagggactcatgtcagaagtcactgagatcacccagctcaaaaggcacccaaacgcacaagcttcaatctcagcttcagctcagacaagggcaggcgcttggtggccttgagctctgacatgtcctccagttactgctccacgtatgggacttctcagagggccacctttgagaaaagatcccaagctggtgctgaagttgcaggcggctgggagcaggtgaccatccctgggctggctcaccccggtgacgctggccccacctccccgtgctcctcaaacaccccccaaccccccagctggctcctcaatgacagttaccggaacggccccatttcctcaggcaggaggacccgagatggggacacactcatgtcctccaattcaccctcaacaacatcttgcagtgctgtggccacgtgagggttgtaatgagagggagccagggcacctggccttgttattctccatttgctggcatccgaatttaaatcactgatcaataattcccagcctgtgatatggtgccatcaataatgattatatatttttttcctaccaggaaaaaaaggccatttaatgtagctgagacggagcccttttgttccactgaatcacaaactgtgactgtctcatcaggaggctggatgagacaggactggccaggccagctgatctggagggaatgtccaaggtcaccttagactgaacacaggggtgacactggtgaggctcattttctgccagttacaaacatccatgtttggtcctaaaaacgcccaaatgaatggcaggtgccctgtttgttggggccattctatttcctaccaggccctaggttccttgtgcacgagtggggttcccagcccctctttgttccttccagagcatccaatcacagggccccggtaactgttcacagactgggaggcagcacttctcagaggcgacaccaagcatccctgacatctccgagcctggcgtggtttacaaagcaccttctcgtgattcaccagtgactctcatggcagatgtttctacaagcaagaaaactggggtgcactgaggattggcgggctacccctggttataaagccaggcgcagggtgtgggcccctcactgcagggcaatggccactgcacaccggggcggggccagtatgtgacatgtgctgccaccccctccttcaacagcgtcaacctcactaagcagcccagaactccgggtgagacaggtccctgaactgtggctgccccagggtcgtttctaagtgccctccctgatcccagcccagcgggcacacatctcaccttaggatctctgcagatacagacacaacggagctctttttccctatagtgttcctcctgctcggaaccgtcctttccaaacaatcatgtgggaatacacaggactgccaaggacttcacaaacatttccccaaaacataaacagtgttcagcacttgggagttttcagcttggtggtttttctcccaccaataacaagatgtggcgcctcaccaggcagtccctcctgaacagtcttcagagaaccccttcacaaagacccgagctgtccttctggcctgggcgctgccagctctccctccccgctctgtgatcgaggccaacccccttgacctcaggtggctcaacagctcagtcctattaaagtgacctcgtgccgcttccagggcccatatcaaggtgtgtcaacaggcagcttctgggaagcaaaatgcctgaacccaccaggaatcaataggcagcttcaataaagacaccgcactacagtagtcctcacaaggacccttgtaattcttaatcttccaaaatcttagaggaaaggaaagagtgagagctggagggagaggtgagaaagagaaatcgatccgtggctattgctgcaacctctacatccccacggctttctcctcattccgtctcttctccacagaggcgttctcctaatttccctttgagatggtttaaatcaataatgaatccctcagtgctaggaacagcctgcgttttaatccttgtgcaaatctgttctagagaaaacatcgcatgacattcccagtgccaggctctcttctgattgagaacacatccagggctttcaatcagtgcttctaggggctgggggaagttgagctgtttggagaggggcttccggtgctgcctgaatagcaagagagattctcaagtcaaagttccgctgcggttcgaaggcatgaatccggctcagctcccttctgtgtgtgctggcttttgccctagggcgggcatcctgctccctctgatgtggaagtaggtgaatgaggtgcatccaggcttaggcatccacaaataccgggtccttcctatttacagagctttgcaaaactggggagccatcctgctaataactcacagcccagtccctcctgggaacgagcctcagctgaagagaccaccagcagcaaccaaggttaagcctccacaggtggtcctgtccaatgatgggtggatgggagaagcctcacccagagatagctctgaggggctgccccagctcagtcatttacatgaagcctggccctactccctcaactagacagaggctccatgagagcaaacgggatggattttcctctcctatgtacagcttgcatctagcacatcaagggtgttcaataaatacagccaggcgtcacttaacagcagggatatatatgttctgagaaatgcatcagtaggtgatgtcattatgtgaatgtcatagagtgttcacagaaacccagatggcacagccccctacacacctaggtggcgaggtacagcctactgctcctatgctgtcagcctgtaccgcaggaatcctgtgagcagttgtaacataagagttagaatttatgtattgaagcatagaaaaggcacaatgaaaacacgggattataactttacggggccaccatcatatatggggtccactgttgaccaaaacttggttatgtggtttgcaactctggggagtgagtaaatgagtgatcagtttattgttattattagtaataactgatacctaataataataatagttacatattttccatttgtcaagcactgtttaaacacgttactacaaatattaagtcatttaactctcactaccctggaggtaggactatcttcccccattttaccgatgagaaaataaggcacagagaggttaagtttcttgtcccagtttacagagcagtaagtgacagggctggggttccaatgcctgtgttcctgccaccatgaccccggtacacctcccagacactcagcgggtgaaagctgtgcaccaccctgaggccccctcacacactctgcagacagagtgaaactgatgaaaccaggattcctgcccaaatgttcagccctgctattcctctgtgtccccatgagtgactgcctataacagaatccatttcattaaaagcctgcttcctttcctagtttatcgtcataactgaatcatttgaccagtccaacgggttgtttaaaaaatcagtttatataagcagatgaagaaaagaactagccaggttccaagactccaggggtttgggtcaaaatcgagtttgaattcttcgccaagctgagttctccttccctttggactcatcatcacagaatgggaaaatgaaccattcctgtggtgggttgtttctgggcattgcattaagactacacacagaatcaaaccccaaacatagacacggtaaaatccttaacagatggtacatgaccccactccaaatgtcccttgaataaaggaggaatgcaactaggttggaggtgccagcaccttccacgcatttttcacatttaacgggggctataactgcctctgaattaagagacaaacactatcaactgtctcacaaatgaagaggcaggaggctaatgtgagatgcatttgaaaagaatagtctttaccacttacgaatgggattaaataaagaaaaattctgcttgcaattggtggcttctttttaattaactgggccaatttagcataggaatgcatcaagctagttttaaattgtcatgatctcttacagagaggaaactggaacatgaattcttggctggcttctttggccatatgaaccatcccatccacttgtttccattattcctctgttctcctccagaaaaaaaaaaaaaaaatggacttgccacttgactccttctctggaaatttaaaagtgatttgactttgcttaaaattccaacattttcaaaccctctactttggatcaattaggctgaatgtgaacctaaaactaaaaataaaagtggtatttcccctctccaagccaatttatagaaggaaaagaacaacttggaccaatccaacttgcagccagcaacccccaaaatctcctgcttccagaagtgcaaggtcacagaacagggctaatggcccaggatcccgttagactgatggaacttgggctcagagtgtttgtttcttcaagagtgacctaaacacacagtatttatcatcctttctggctgagatgggaaacgcgccaaccatttcagacaggccatgggtcatgggcttcgaaaaagaagaaattcctattgttacttatttttataaatgtttaagaagaaatgaaacagctgctatgtcagtaacttacacagaaaatatgcacataaacacacttcctctgccactagagctgggatcaagctggaagctactctcccggctgcaaagcccaggccccagtttcctgaggatcaggtgcagaacgggaggtggctgactcctaggacggtcctcagtgatccccggttcttggtattcacaccctgtagtgtcttcccactgagtgtggctagacctcatgactcacttctaaccaacagaatatggcaatgacgatgggatttcacactcatgactaggttagaaaaaatcgtgacttctaatctgctagcagacgctctagcttgctggcttggataaagcctgcagccataccggagaggccctgtggtgaggtatggagggtagcctctcgccaaaagccagcaaagatgtgaagccctcattccaacagctcttgaggtgctgaattctgcccacaaccatgtgcgcttgggagcaggtccttctgcagtcaagcatattgacgacccccagcctgatgacagctaggtcacagcctcatgagagaccttaagtagaggacccagtaaagctgcacccaggttcctgacccccagaaactgtttgaagctgctaagttttggcaaactttttccgcagcagtactaattagtacagcaggcaatgcaaggcctgggtcagcgtcctaacacacgctgctgccctggcatcctgcccttcccctcagcaccaggacatgagccatgacgaagccgccgcccacttctctgataaagcaccagctaccagggggtaggcactgggtcgccactgttgttcaccagggcacgtatgctcagtgcccagcacagcacccagcctgtggcaggggctgaatatgtgtttgaattgaccaactatttctgttaggctgaggaccagggaggcaagaagctttcacattcagttcctaggatacatagagtatttgttattaaaagaagaaaacacggtgactacttggggggaccatgctgtgaactgtgagcctccttctagctggcagactcaggctggggtaagagagaagagtttggcaggtcttgctccttgctgagccgcttgcacctgcacggtgctgctgtcttctgttccagcactcacctttgtggtgttggtatcctcagaggtgggaccagaactccaggaagaaagaaacatactcagggaccctggctccacccctaacagggaccctggcttcatcccctaacagggaccctggcttcatcccctaacagggaccctggctccaccccctaacagggaccctggcttcacccctgataggtaccctggctccacccctaacagggaccccggctctaccccctaacagggaccccggctccaccccctaacagggaccccggctccaccccctaacagggaccccggctccaccccctaacagggacgccggctccaccccctaacagggacgccggctccgcccctaacggggaccccggctccgccccctaacggggaccctggttctacccctaacagggaccctggctctactccctaacagggaccctggctctacccctgataggtaccctggcttcatcccctaacagggaccctggctccacccctaacagggaccctggctctaccccctaatagggaccctggctctaccccctaatagggaccctggctctaccccctaacagggaccctggctctacccctgataggtaccccggctccaccccctaacagggacgccggctccacccctaacagggaccccggctccgccccctaacagggaccccggctccgccccctaacggggaccccggctccgccccctaacggggaccctggttccacccctaacggggaccctggctctaccccctaacagggaccctggcttcatcccctaacagggaccctggctccacccctaacagggaccctggctctacccctgataggtaccccggctccacccactaacagggaccctggctccacccctaacagggaccctggctccactccctaacagggaccctggctccgccccctaacagagaccctggctccacccctaatagggaccctggctctaccccctaacagggaccctggttccaccccctaacagggaccccggctctacccctgataggtaccctggcttcatcccctaacagggaccctggctccgccccctaacagggaccctggttccacccctaacagggaccctggcttcatcccctaacagggcccatggtttcatcccctaacacggaccctggctccaacccctaacagggaccttggctccaccctaaacaggagaacatgtggtgttttcctttgcacctgtcctcctctctgcctggaaggcttcatcttaacccaccttcctgccttgtttacacagcaaactcttattcatccttcaaaacccagtctggcatcagtcttctccaggtcagttccttctggatctccccactctggagccccactctcctcacctcctactctgcagaactgcaaccaaccacagccatgcccacgtccccactgggagctccagtctcccagggcccagagcagggctgacacacaccaaacccagtcccgacagatgggcccccacctctctgtgcccagacagtacacaaggctgctgtgtgcactctcggcccctgaggttaaggcgtggtctgacctttctcagaatgaggaactaagcagcagcgacaggaaaacatttgatgagcacaccgagcacttgcgcccttcagctgggggccgtgtcggggagggaggcagagcagctatgcaaacacctccgggggcggcgaggggtcagctcgaggtgacagttatgtcaccatgagagctcggctagtgtgcgtcagccctgctggatggagggagaccactcagcagggccgatttctgcctccaaaacacgggaaccagcaggtgggacatggcaagggacggcaagtcagtgcctgcctcagaacagagtggaagaagtcctgggctgggagatgcagagagcagggagcgaaaccacacctggcacctgctagaaggcatggcaccgggacagccaccaagagctcaggctcagagcgctggggctgagggagggcagatccagcctctccctgaccaggtcatactcagagcagcgggagccatgcagactccacaagagggacatcagctcagaagtgtgaccagagcagactttaaagcatgtttctggggggcaacaatgcaaagtgaaagaagcaggacataagactgtcctgtcacacccatgtgcacacacacacacacacacacttatttgcatagaaaagtctggaagaaaatacaccaaaacataaatagtagttatctaggtgagaaattaatagtttgaaaacagttttccaatatatgttccaaaatttccacaacaaacacgccttattgttataattggcaaatacgtggggccaggaaggtatgccacctgaagaaggggtcccaggggtcagtttcccggggctgccaggacaaatcaccacgaactcgtggtgcgtaatgacaggactttcttccctcagtgtcctggaagctggagtctgaaacccaggtgtggggcagaggtggttcctctgggatgccaggggagaatctgttccactcctctcctggcttctggtggctgccggcactccttggcaccccttggctggtggcagcatcactccagcctcgtcaagaggcatgctccctgtgtcttagggtgggtgagggtctaccctgatccagtatgacctcattttaaccggagtgcatctgcaaagaaagatcctatttccaaataaggtcacagtcatacacactgggggagacaacttcagcttatctttttggggggcacaattcaatccataagaagatgtagttggcccaaaggaaaataagacacaaagggctgtggtccctgtctttaaatatcgccagcctctcctgttttggaaggattagacttggtctgtctgactctatggagaagaaagaggaccaatgagtggatgtttccccaaaacagacctggtctcaaaataggaacacagctgtcctaagctacactggccatcttgcgcggagaattccctgactcagagggcctcggattagacaggtgcccccttagctctgatgtggaagtattggagggagcactggaccaaataattttcaggtcctggcagccctgagattctgcattcacacaggcataaatgatgcaagcagtgcccagtgccagccaggccgccccatagtggctgttcaatatcccactaccctggcctcacccacactgggaaacccttgatcttaaagcaaagctgctctgctcagcattgttcttccttttggtctctcaaggaaagctggaaactgtacattcaacgcagacaaggataaaggcatcaaccacgtggagagacacagaattctaggagttaaaccacgtggagaagcttacacccctgattctaagggtgtttccctcgccttgacagtaccaaggaaccgtcctgtgcccctggtcaggcctgctggggctgaagtcacacagaccaggatcagaatggttaagaaaaccatctgcaacatgtgtcaactcagtggggacagcctcaagaataacacttacgtaagaaacagcagtaacgttgcaagttccgtttatttttgtttgtttttattttattttatttttttttttgagatggagtctcactctgacacccaggctggagtgcagttgcaccatcttggcccactgcagcctccgcctcctggattcaagcgattctcctgcctcagcctcccgagtagctgggactataggagtgtgccaccacatctggtaatttttgtatttttagtagagatggggtttcaccatgttggccaggctggtcttgaactcctgacctcaggcgatccacccaccccggcctcccaaagtgctgggattacaggcatgagccactgtacccgacctgtttaattttttctaaaggagacaaaatcttatttgtcatgagaggggaacactgttcttcaaaagttcctcttctcaccccaaatacaacacacagaaactgctcacctctccacagggtccctgagcatgacaatcagtctggcatttggctgaaaggcgtggatgaagtcctgcgtcagaaacggtggctcgccatccgtgctgttgtcgtagaagaacgtccaggcattattatcccacatcgtggaggcactggcctcccctggaaacagaaaacactccaagtgagcaggggtgtgattcaggctcccacggagtggctctaggtgccagaggccacacctggccccgatgccttcctcttaagcagcgggagaggccaagctgtcagcctttgcgggcatctgggactccaaagagagaaggttggatgcccccccctgccacagccacaccccacctccaccccaaaaacttctgtctggaagtccaggcgatccatgcaacactgagtgcccccacccctgagctcctctttccaaggggagcaaaaatgaaaccttccctagcacctgggcccccagtttcacagtatttaactttgctcacagtgcacagctctgtggcattttaagggcccactgagaatgcagtctgtcagaaaaacacgccaaaacataaacagcagttatctaggtgggaaattataggtggttttgaaaatggttttcctgtatagtattccaatatatgttctatacagtagatggttctagtaataatagatggagttctctctgaactgggggcccaagatgatgaaaggccttgacatttctgcccaggatctaacaaagagaaagagctggggcagagctgagccacatttcagagccgggaggagccgagaactggtctagcagaccaggagcctggagctggtactagatgatttccttccaaagcgtcaggagaaaggaggagggtgggaacactaacccttatgaggaatttgagtgtgatttccttccttgaagctgtaactgttcatcacagagcatactctaagactaaaagagagaggggctttgccacagggctcacacgccctgtctcctgcgaggcgactgctctgcacgcagctggcgcctactcagtgcagcctgggtgaacgggaactgggtcccagccagtttcacatttcatcatggtcctcacgagtgaaggatgtaaatggcaaacacacgtcccagcacagaggtgatgccaagacacaggcaggcattccaacagcacagactctctcagaggatgaagccaaatttcctgagggtttgaggagagacagtgtgtgtgcgtgtatgtgtgtgtgtatatgtgtgtgtttaggaaaaaggaaattcatcaatcagctctacacttgatttcctgacagtttgccaaggaccacaggacacatctgaaagttacttatctggggagagactgagccagatgactgagtctctttggtcagtgacaagtgtatcatatccctgcaggcccctatcatttctgtcggatgcgtaatcacatccaggtgaacagctctgttctggccttttgttctttctttttttaaagagataataccctaggatacagaaaaaacgagtcaatcagaagtcccttgaaaattctactcacaatgaataagaatataaaggacaagtgaactctctagctaaattggcacaaattctgtcagatctcaaaaatgaactggttttagagccatggaggcgtttgtccatccacctgactgtcttccttccatccagccaccatccatccttcgtccatccaggaagcattaacttagtgtctaatccgtgctcagcattgtgcttggcaccagggacagatcaggggaggaaagcacggcccctcctctctcggaccttaagacataagggggacgatggcaattcaagaaacaaagagtaccacgatgggtacctgggagtagaggcaggagactttcaacatgtctaaagctccggcctcaagttcagccatcacgttcaggccacttgaatcctgaacctcttgtgtgactctagctgtcaaaaagacagcagaagaaaggtcctctctgacctaggggcccaagatgatgaaagatcctgctgtttctgccccgaatctaacaaagaggaagcgctggggcagagctgagtcacatttcagagctggaaggagtctagaactgacctggtccaacaatcccactttgcagaggtgcagacagagtccaggaacaggaaaaatgaacggccgcaaggcacagagctggccgctggcccaagcagggctagatacttgtcacaccacaagactaccatagaactcaccaaactctgctttaagtaaatatcagcacagtgattttatttttcattctttttaaaatcttggagcaagcaaaattaggagaccaaactgaggctttcctttttcattcattatcttagtctctgtttcctggccggagaatacatattttcatctctttcataagaacatgtgattttcccagaggcatatggtataggagtcacaatgaaatgtaagtcagacttgagatttggggagtttggactcccaagtttgcaaaaaactagataacagccaaatcatactggaggtgactcccagtgacttaatttctttgagtttaaaagaaaaaaaagagttaagtcaggacttaggcacataagtctgtccccttggacaggagagtcttaagttaaaaagtcatctttcgaagggctgattataattcctcttagttgctaatagatttatttaatttggagattgcaaatataacagatctaggaaaattaaaaaatagatcactatctaaggtaaacaatttaagcaaaacgtgactcaatttctcttttagaaggcatcagtggataaacgccttctaagctgaatccaataaaaagaattatgtcaggcaaataacaagtctagagatctaaggtagagcatgtgcactgtagttattaatcctattaatcctgtattgcatgctggaaattttccaagacagtatatttcaggtgcttttaccacacacacgcccccctccccacacacaaaggtaactgtgaaaaaaacatggctatgttaatttgctttactgtagcaatcatttcactgtctctatttccatcgaaacatcacagtatgctgtacaccttaaattatacaataaaaaataaattttaaagagtaaatatgtatgtttacttataaaatattcttgtgaatatttaaaacaaattattattaatcaacctcactttgaatgcccaaaggcatgaggttgacaggggctaggctttttaaacagcaattagttataggcgatgtgtcagagctgagtctatttcaggagaagctgcctccgtcttatatggtcccagtggccagggattacaaaagccccaagcagcaaatcgatgactaaccagttaactgcacttataattcccccatccaaacttatcagatcagtacatcaggaaaagaagtcaatatccctgcttaatttcttaaaaacaaagaaatggcaacttctcaagaaagccatcagctgtccttaagtctccaaagaattagaaagtcaacatttccactttatagtaatgttcaagtgatgtgaacattttatgtagtggtaagagtgacagccaggtggagaagtggaggctcaaaagaagtttgctgccaccatgtaaatgttctggaggtgaagcagagctgggctaggcctggagccagagccaggaccccagggagggtgctagccctgccagagtgacacagacgccttaccgataatgattgtattcatcttgctctgctcctttgcagagctggcctgcagtccttgatggatctggtgtgcggccaggtcaaagaggtccagataatcttccacgggatagcggtctcgcagcccatctcttaggcggacgattcctatgagaaccaagaagcaggagatactgaggacaaagttgctactgctggagcgatggcctcccagacagcaaccaaagagagatggaaaggcctaaagggcctggcgacagcagcaagaggctcagcccaggtaagcttcagaaagggctgctggggatgggggtgggggtctatgcggcctggctacccacttcaatccatgcatgcttcaagggctggaagataccaccactaagctagacagtggcagattaaaggctggaacacctactcaagagctagaaacatgtctgcttggagggacaaagtctggggctggttaacttgtgcacaggtgggactcgtaagtggctgggcagcgatgacacccaggatgcatgtgttgtgtcaaacagggagagaggaccgagggctgcccacaggagagagaagggcagtatcctataaactccatgatgccttcctcatggggcccagccagcacctgcctgatgttctctctcctccccctgttcaatcaaataccctgccctttgtccaaacagtaaggggaactgatcatactctagacagacatggattctggcatcggccacatacagcttaaattcaccccctgcctgaaaaataaataaatttcacttgcaaacatttaaaaatccacttcccaacaccacaactcctgaagtcaatggaaattggaaagagaacatccgtggccaaagtaacaagaggttcaaggtgacattgaagactagattccagaggcccgcctctgttcttcctcctttcctgccggtagaaagctggttttcattaaggggaaatcactgtgagcctcgggggagcaccctacagcaagggagtgtgttcagacacgtccagcaaatgcatagggatgtgaaaccctggctcctacagtggcggctgctaaaccacaaaagaaacatttacactttagctcactgtaggacgaacatcaaaaggatgaaagcaaacgtttgtcaggaaacacattaagagttggtctagggaaaactttgaagattcccttctagtcaacctgagtccattactggaaaacaccctcgtggcctgccaggactctggttgacaataggcacgtatcacccctcagctccagtgaccaaacctctcctggcacaaggaaaaggttacagagaggaaacagtgatctgaggaccgcagggtgcatggggttaagctggagcagagagggatgggcagtggtcatggtaagcctgcggcaaagggctgagagcaaggcctccagaatgatctccatgtggttatcatatggaacccataaggcagatggggcaggtcagagaagctgaggcctgaagcaactcagtctcccccaggtgcagtgactgcagctggaacagcacatagctgagaacagcacagagcagaggaacagcacagagcaggggaacagcacagagcaggggaacagcacagagcaggggaacagcacagagcagggagcagcacagagcagggagcagcacagagcagaggaacagcacagagcagggagcagcacagagcagggagcagcacagagccaaggaacagcacagagcaggggaacaacacagagcagggagcggcacagagcagggaacggcacagagcagaggaacggcacagagcagaggaccggcacagagcaggaaacggcacagagcttgggagcggcacagagcttgggagcggcacagagctgggagcggcacagagcagggaatagcacagagctgggagccaagagcccggatcacgcccttcttgctggcccttactggccactggcacttactgctgactgctcgggtcatgtgcccgggctttcggaacaagaagagctgccagttctgactcgtccccgtgtcctgcacacagctggcaatcaatgctcactgcatggctgggaaccgagttccagaccctgctgggtctttgcctgggaacagcctcctaacaagggaattgtgccatctctttctgccgccctcgccccccaaccccagcgctaacgttgcgggaggaatgaacgaatgaaggaacgagaccagacaggagccctgggacccagcactcaccaaagcgcttccgggtccaccagtgtggctccttgatggcggagaacttgacctcagggtgcagccgcaggcggtcatagaggtctgtggtcccgcacttgggctgccctatgatgtagaagtgcggcaggcagcgcaggcggaagtgcttcccgtgcgcgtgcgccaggtggccccagaaggccttgcgcagggcgtcgaaggtggagcggaagcgcttggagtagagcacgtaggagttggtgaggtaggggtcggtggtgttctgccccgagaactcctcgtaccaacaggggctcttactgtttggaaggaatttgttggggatgactgaaaacatctgcaaggaaacagaggaggagagacacagaggaggggaaaatgagcaaagacacaatctaaccgcaatgggaacctgccctgagactgacgaccgtgttcaaatttgaactaatatttgacaatgattaacaaataaagcaaaacttggtagacggtcaatgactgtgctttcctctcccccgccgccccacaaaaaaaaaaaaaaaaaaaaaaaaaaaaaaaacttggagagaataaagataaaagtttaattaaaatccattctaccataatttacctttctgacacttacacaacacacacgcacacacggtaattaagcagaatctttttactagttgtatatttaaattgccgttagagattaaaatgtagaatagaagcagaaaatcaaatttaacgcaactttaaaatcccaaatgatggtgatctgcaaaagcaactgttaactaccacgaccacatatcaagcaagaagtcctggaatgcaataatgagagccagcggcccttgaacatgcctagcccagcgttcaggacagcagattcccttcctggcactccatagcgtaagcaaacagcactctctcagtgcattcaaatccataaggctgtcaaatgatccttgctacatctaagacattttttagtcattttccttctgtgttcccaaagatggtgatagaaagaaaagcactcatttctaaaaatcaaccaatcagtcaagattagcacaaagctactcacatgcaactcctgcttcttaaggtcttctaagtctgggagctgtctggtcgtgaactcaatcctagttgtgatgctgttgataattaatttaatgcttggatagtccttcatgtatgaaatattatttacagaggattggtggtgatgctcctttgtgtcacttgggttttcgctgtccatcaagctggggttgctggggaagcctccgtaatggaaaggtgatgagatcagaagctcttggtgggccccagaaaggatgtaagaagccattaccaaggtcattattatcagtccaaaaacgaggctacatcgcttcccctttttgaagcgcaaaaacccaccccagttttcgttcccttcagtcctcacttcgagaacagcaagcaagttcatctgcttactgtccacacgaaacagaattttgttttctcctttgcacgtggggcacgcctggtgaccgtgatgggggcccccttggcagttgacctgctgcttgtgtgcgccgtcgggtaacagctgtatgcagcaattaatgcagtgcctcatggtagtgccagtgccctgggctgctggcttaccgagccatgggtgggccccccacgagtctggatgtccgcaagtcgtgctagaaaaccttaagaatgccttgtgatcacagaagatggatggaaagcacaaatacaaaaataagcagacaccacagcactagagaaagagggtgcacattctttggttcagctccgaaagaaaacaaaaggaagtgatgtcccagagtcatgttctacaagagccgctgcaacctcagagaaggtcacaagttcgggagcagctctgcctgcccttcaggtttttcccatggcacaaaaaaaggtggaagaattctcactggggaatgtggaaacacacagaaaattaaaagaaatcatggtcttctcattgatggatggattgccatgccatccacggaggcatctgtgaagatctccccttttacatcctgagtacctttggaatatttcctctttgtggggcgcaaactttaaaaaatgccagatttcctacacagaaagacaagaagctttattacattgtgtggtaatagcaataacccaaagctcatcctccaaggagagacagatgctcactctcttttccacctctaagtccagccaagccagcctggttctaagcaagtcatagaaaatcgcgagcataaaggaagaggtttcaggttcttgcagctggctttggggctcaatttctgccaccaaacatggccccaatcccagcaccaccagcgccacatcaaacgtctcacattgtgcatagtctacatctcccctaatccctctgccttgatacttctcaggtacaggatctctgaatcccaggatgttgtgatcattctcagagtcatgcacagtcaatgactacaaatttgagggatggattgaaatatcagtgcttttcagtcaatgaaaaatctcaagaatactaaggaggatggttagaaagggagcaggcagagaaaatgtgttttttccctctcactggcatcagcagtctctttcttagagttaacctttattatcagattaggaagcaaaagttaatgaaaatttagaaacaatgaaatgagtctctccttcagtagaatgtatcatattaaaaaactacttgactttaagttattaagcaattaaatccaatgtataggattccctcgagtgacacagagcttcagaacctgacataatttttcactttcatcatctcgagcaagatatgattcttaaaaacccattaatagaatcctgtggttataaaatatattgttgcccaaatgacacttctttgtagatgtcgtagaaagagccatggataagcataaaaggagacctactcagtttctagcagtggtagatcaccactaattggctgtgtgaccctgagcaagccacataacctctctgagctttggtttcctcaatagtaaaattaggataataaggacaccttaacaggtgctaaattagctactacatgtaaacagtttgaataatgcctgccacatatttagcataccataaaaggtagacagcattgataataatagcatcatcaactattatgatgatgatttttcattgtcagtgaatgccaaaaacatttgaaatggaatcaaagatgagagatcctataccacatgattattctttagcaattgaaaattacccaagagtggtagactcatctccaactctacccacgccacccctcaaacaaccctcactgtctccatagaggcagcattaactaaccgcgcatcaagatcgccatgtactggctgaaggattaaacaatcagaactcaacagaagaaatgttcatgccccttggactgaaaacttcatgttttctcaaaatatggtggccaagaaacagccaagctgtgtttcccaaaatgtcttcctcccacaaaatgttctgcttgccgttggtgagtgttctgtgcttaaattatttggagaaaatgtggaatggacaaaattacacagaattctttacagctgaacttttcagggcctttgatatgctaataagccctgtgaatccacaagagaggaatataatacacaaagttggaagtacctaattggccaaggaatctcactagggtatcaaggagccagtttgagaaaggctggtcagtagaggctgagacctgagtcctgcagaggcgctggggcggggatgcagaaggggccagttctgggaagccaggccagacatctcaggccctacccccatctcttatccctgagggcagctggagggacatgtcagaaacctcaaggatcaacctctgcttcaaacttgctcaaccacccctgacccatcgcttgctacaaacaattcttccaaactaaagaaacaaaagggcaagatcccctacttggaaactccatcattaaagccaagaaaacattttttcacatgtccaagacagggccaagccggggttaaaaatgagactccaaccagcagctcagcggggagggaattcgcaccctcctgtctttctgctgcagaaaatcgaattagattctttaaaaagcaaacaaaacacggactttgaagctccaagataggaatgtacataatctggacccaaacgaatgggcaaaacattcctaaacaagggcaggggcagctcatttcaagcaaagtaaaaacatgagcagccgacagtctcaacagagaggagggaagatggggtgcccggaccgggtccacagagcatgtctgcggggcagctgcccccaccaaccagcccggcctctgcgagtcccgcttcctaaacagaaagacctgaggaggcaattcgagatgctgcaagagccttagcaaaacactcagatacagtgttttctcagctcctagcattctttcattcattcattcatttgttcaacaaataccttttgaagaacagctgagtgttgcgcatgtccaggtagggggagaccaaaagccaatacaagatgagggatgtgatgtggaaataagagatgagtatttggtctctatcctcgggtactggtacacaggtgctaaaatccttggaatttttctgaatgatggggtgagagaagcacctttcgtcattcatgacaagcccctttcagccatacctgagtgtatcctgatgcggtgacactttgcgggccaggatagctccaggatggaggctggtcaccagaaagaccaagcctcagtgagcagctttcaacaaaccccccaaactccgggtagggaataagggctgcagattaagtcaatcaccagtggctgatgatttaaccaatcaggcctttgtaatggaaccgccatcaaaacccttaaaccacagggctcaggcagcttccaggttggtggatccttcgaggtgctgggagggtggagtggaggaagagggcatggaagctccacacaccctcctccaccatacctcgccccatgcgtctcatctgctggctgtttctgcattctatgctataatagactgatgatgagtcaagcactctcctgagttctgtgagtcattctagtgaattactgaacctgaggaggttgtgggacactcttgcctttttagccaatttggacagatgtgcgggtaacctggggacccaatacttgggactggcatctgaagtggggcagtctggtgagaccgagccctcaaaccggtagagtctgaggctgcctctggtaggggcagacttgaattgaatggtaagataatcagttaggttctggagttggaggatttgctggtgttggaaaatacccctgggctgcggtgggcgtgggggtgggggcctctctgagaaaaaaacataaaactgtcttacatttacaagtttttaccaaaatcgatagccactgtatagtatgtcaaatactcagtaagatggacaagcaatctgaagaccaggtgagtcccttgtaagtgaaggccctagagcccggcggcttccagacaagacctcccctgacgggcgcgagtggtgcagggctgacccagagaggaggcctgttcccaagtggagcttctgtcccaccaggggtaggggctgcagggcacaagctataaagaagtcccaaatgaataagataatcacagatgctgctagataaaggctatgcagaaaagaataaagaaaagggggagagagcaatacaaccattggaacagggttttggaattctttgtgccgtcctagggctggcccatgctttgttgtcagggctgtcccgcgcacagtaggatgcttagcagcaccctggcccccacccactggatgccatagcaccccttcccctgacatgtcacaaccaaaaatgtctccaggcattgtcagtgccccctggggtgcataatcacccctgggttggagctactgccttaaagaagtgggaggtatgatacacagggtgacagggaagacctgatttcagaggggacgttggaggagaaacctgaacaagaaggaagccagtcacgtggagaccaggggaagcaaaggccccgtagagagacgctgtggggagtcccagcccatgagggctactggcagggtaggccctggggcacaggctggtgggggtggaaacctgatgggagaggaggcagggaccaggctctgtagagtcttgaaggccaaagtcaggggtgggatttgctcgagtgcaagaaggaaggcatactacatattcttttttttgttttgagatggaatctcactctgtggcccaggctggagtgtagcagcacgatcttggctcactgcaacctccgcctcctgggttcaagcgattctcctgtctcagcctcccgagtactgagattacaggcatgcatcactgcgcccggctaatttttgcatttttaatagagacggagtttcaccatgttggccaggctagtctcgaactcttggcctcaagtgatccagcccgccttggcctcccaaagtgctgggattacaggcatgaggcaccacgcctggcctcaaaagaatttttactatgtatagtaaatatacatagtaaaatatgtatagaatagtttactatgtataactattaaagaacataactcagggaagaaaaatccaattaatggggtggtattgaaaggaaaatggattgctgttacgttctgtatctggccttttccgtaggccacaaattatcccaagaacagtcattcagaaacctaacactcaagtggttcttccttcagaaaggagtcatgtatgccccctgcacttcacctgtctggaatgtccacatttggtgccggtcgactcagacaagacggggcccttggcacttccgttcatgtattaaaccaaaggattcaggtatacatttcagtgagattgcttcccacctgggctcaattctgagcctgatggctgcagaccatcactgtgggaacctggcaccaggagagaaatcagataacgggtcccaaaatagaaagtgttcaattacccagcccttgcttggacaccccctattaacctatgcacccaagcatcattagcaagccatttataacaaaattgtaattgagagacccagaaataccactttagattaagtaattgaatgccccctcagtgtaagatcgataaagggcatccaatttcaccctaggaaaaacttattaaattattgtagctataagctgatatagcagaagaaagatgtatgaaacttcagaagaaatctggatggatttaaacaaatagcttcatttaggtagaacatttacatttgccctctggggacagagagggaaaaaaatagctaattacattatttttcttttatgttttaaggaaaaaaaattcaatgggtcttaattaacctttactaaaacacaaagccttcttctgattagtatgtgtaactgctgacattcctctctaggctatatatatggaaatatattttttcaaggactattcatcaacaagtaggagaaggaacatttttcacatgtagctctaagatagaaggttgttgctgagactgagaagaaagccaacaagactgaagagttctgtacaaattataaatcatcagattcagtcttctatctggacttcgacagttttgatcacatcccagtcaataagcagaataaagccacaccactccgtcaacattcactggcccatagcacagcggagaggacacagcagtcacatggattaggattccaagtccatgtccacccagcggccttggacaaatcacttaaggtttctgggcctctgtatttttcaaaagaagtccccgctagcaacagatcacgtacagcactggagttaagagcccgagtgctggagccaggttgcccaggtttgatcttgaacaagatattaaacgtctcttctccccatttctttggatacgacttaggaataatcacaggacctgtatcatggcagtgctgtaagcattcagtgaactcattcatgtaaggtgcttaaaagagtgtctagcccggccgggcgcggtggctcatgcctgtaatcctagcactttgggagtctgaggcgggcaaatcacaaggtcaggagttcgacaccagcctgaccaacatgatgaaacccaatctctactaaaaataaaaaatttgtcaggattggtggcgcacacctgtaatccacactactcaggaggctgagacaggagaatcatttgaatccaggaggcagaggttgcagtgagccaagatggcaccactgcactccagcttgggcaacagatcaagagtctgccaaaaaaaaagagtctctggcccatagtcagtgctcaataaatgttagctggtattacagatgcacagtcctggcccacaatgggaatttgatagtcatttattactctttaccatagattgcattattggtctcaattttttcttcttcccatgttcacattctttgccactttggagggccttcagctacaggagtgacgtatttctccacccttcggtttgagttgggtggctcactttggccagcagaatgaggcagaagtgggcttaaagctggcacgtgccaggccctaagacatgtcctgtgtactcatttgtcctcttgcacacttgcttggccaggaggagggggagacaggtggagcagggccacctggctgagcccacccagagcagccaatacccgctggatcccagccaattcctaaagacaccagagacataataaagggttgatttttcttttcttttttttttttcaagacagagtctcactctgttgctcaggctggagcgcagtggtgtgatctctactcactgcaacctctgcctcccagaggttggctaccaccagcagccgataggccaatgtaatgatggaaactcagaggggaggctgggcgcagtggctcacacctgtcatcccagcactaggcaggcggatgactcaagcccagggtcatctagaccagcttgggcaacatggcaaaaccctgtctccacaaaaaatacaaaaattagctgggtgtggtggtgcacacctgtagtcccagctacttggaaggctgaggtgggaggattgcttgagcctggggaggttgaggctacggtgagttgtgatcacaccactgcactccagcctgtgcaacagagtgagaccctctctcaaaaaccaacaaacaaacaaaaagaaactcggaagggagctgttcctgaatcaagacacaatggctgaaacatcagaaaataacacaccaggttattttctgacaaaatgtgtttatgacaaccacagctgttttgttttagttatccactgccccacactcccccacctcctgatgaagaggccttcctccttgcctcttttcagttactaatttcttccttgcttccttcctctccctgagcaagcccttcctgtaatctgatccttacggtttccttgccagatttcatccttcctgatgactgggacacatcacccgtgctttgtctaaaacaggtattctcaaaccacaacctgagggatcttcctggctggcccaaaatctgtgcatacaaaacccaggcagttttttaagcttatttttaaagcacacttgactctctgttaagttcgtcatcaacattggttttggttaatcacaactaccttacatgcatacaacgtacattcaatgctattgttttagtccataagccatatccataataaacaggcatttccccaagatcagatctctacaatatgcagccagcgcctcccctgcgtcctgagctcactgattctcaacttggtagaaagatgggatgtaggaaaaatggtttccaagcagtcgaaaataagacattatgccaggcttgggagttgggcagacctgcatttcaacccgaatcaagtctgtaactgctctatgatctcaggcaacgaatttaaccattctgtgactaggtttcctcatctgtaaaatgggaataaaatgatctcagtctcctactgtggatgtgaggaagaaatgaggtcacatacacaaaatgcttaacccagagtctagtaccccgcacaccgtggaaggatgagccatcccaaaacatgccaaattgatatgttgattattttgagtcgaaaacattggagaaattatagtttcagaaagggccagctgacctgtctcttcctgcatactccaagccatagactcctctgggaggagtacccttcccctgccaggccaagaaaatggccctcctcagcacagcctgggaacttggggctgcaatgacccaggataaatacacttcacaaagtaacccttctcttccactgccgttacacatcccatagatctcccagagactcccctagaaatgtatattactccaccaggtcccttctgttctgtctcttctgaaatggattgttctttgtctaaaaggtctaaaaacatcttgctttggccactccttcaaacttcactctctcgtgaagattcctaggtccaggtaaaactaacaaagtgtgtttgcttcccttttgtttgtctgcctggtgtcaagttggcttctagatgcagttcaggagcccacgtaagagctcacaaggagggggttggaggtgatctctggctcccctgcctctcggtaaatgacccggattccttgcattattactggagagacccttgggtcctcactccagggttacttgctttcagtgtgcatatattataattccagacaccggtgtccaattttcctgtctgccacttatctgaggggatgccctggaaaaggcaggtggccacacagatgcaggaagtaacacccaagttctacagtagaacaaggtactaaaaagctgagctggccaggatcattcgggcacccctgtcaccagggcccgtagctctggcgagcctggcgcagctgtggggaaaattctggaaaagctcacccccctccaaatgaccatgctcatccagaacttgtttcagtgctcaacaacaagggccaactttccagaaacgcacccatccccaaagatccagggtaaaccagccactgctgtacagatgggaaatgcaagacagtgaagctcctgggatccctgaggattctactgcagtcattcacagtaagaaacacccggaacccctcaacaatgatggtgggtacactcagacccagggcaaaacccaggtgggctccagcaaatcatcagcttgccagtacaaacctgcgggtacctgcatccagcctgccttttatagaggagaaaccaaggccagtgtggtctgtacttccccaaggacatgcagcccattatagaaagatgggtcaagaggcctcaggagcctgacactcagtcttccaccatccctcaagagggagcccatcctaacctctaccccaccacccaggcctggcctcagacagtccagcggcttctccaggcccttggtgcccttcccccttccaatcttttgaggaatcccttccgagaatacagatttgcagtctcacccagagacacaggacaggaaggtgagggaagcatcccaggaggcagctgatgggatgaaactcccctacctccttcaatctcctttgaatgccctgtcggcctggggcattgagtcttaacctgtctcaattcagactctattcatcactcaggcttgtctcctgcagccaggaaagtgtgctaggagacaggtacagctccaggacagagacaagggatgggggaacggagatgtgtagaggctggcctggtgccaagtgtggggacaggggaaggaaggacagaaagaaaggcgggcaggggcaggggaggaaggagaggcggggctgtcccttgtcagttacctttgcagctgagacaatggacaggaatggaactggccccatgcacaggaggcaggccccggtgcgcagcccccaactcctattttgtccccgcacatcaaag

SEQ ID NO: 1092 - DNA, 30246 bp, Homo sapiens
gacttagaggccagacgcgatggctcacacctgtaatcccaacactttgggaggccgaagcgggcggatcacaaggttaggagatcgagaccatcctggctaacacggtgaaaccccgtctctactaaaaatacaaaaatttagccaggcgtggcggtgtgcgactgtagtccccgctactcgggtggctgaggcaggaggatggcgtgaacccgggaggcggagcttgcagtgagccaagatcgtgccactgcactccagcctgggtgacagagcgagactccatctcaaaaaaaaaaaaaaagaaaagaaaactaagacttagagaagttaaatatgtggcagagtgaagcctaagctcatatctgtcctaatctaaattccaagcagttctgagtcatcaggtcacacagactgcttctcacatgcttcaggaatgccttttcagtcttccttaaaggttgcaaacagttgcaaagcaaatttcatggttcctgtttcttcaaaatctcaaagctcttcattcagccaggcatggtcgctggagcgtgtatattcaaccacttgagaagatgaggatcttttgagcccaggagtttgagacgaacctgggcaacatagggaaagccctgtcacctaaaaaaataaataatacaaccagctcttcatttagaggcaagcacaaaataggtgctcaatgtttgttgaatgagtgagttgttaccaaccataccccattattcaaggtcctgcttgtcagtgtttcaggaagtgttcttggcaaaggagtggtgaacttcaagaagaatgatgctgactccgaacacaattatttatttatttatttatttatttatttatttatttatttacttattgagacagagtctcgctctgtagcccaggctggagtgcaatgacgtgatctccgctcactgcaacctctgcctcccaggttcaagcaattctcctccttcagcctcccaagtagctgggattacaggcgcccgccactacgatcggagaatgttttgtatttttagtagagacagggtttcgccatgttggacaggctggtctcaaacacctgacctcatgtgatccacccacctcggcctcccaaactgctgagattacaggcttgagccagtgtgcccagcctgaacacaattattaaagtcaaagtgagacctaacagtggaactttggttgcggctacaggaaatatggattcaaatactgaacaccagctgggcacagtggctcacgcctacaatcctagcactttgggaggctaaggtaggaggacagcagagcccaagagttcgagacaaacctggccaacatggtaaaacgaaaaaattaaccaggcatggtgatgcacacctgtagtctcagctgaggtgggaggatcgcctgaattgaggtagtggaggctgcagtgagctgtgttcctgccacagcactccagcctgagcaacagagcaagaccttgtctctaaataaataaacacaacaaaaataaaacaaatactgagccaggtgtggtggctcctgcctgtaatctcagcactttaggaggctgagatgggcagatcacttgaagtcaggagttcgagaccagcctggacaacatgatgaaatctctactaaaaatacaaaaattagctgggactgatggcgctaatccctgctactcaggaggctgaggcagaattgcttgaacctggaaggcggaggctgcagtgagccaagatcacccccactgctctgggttgcagtgagccaagatcacaccacctgggtgacagagcaagactgcatctcaaaaaaaaaaaaaagaaagagaaaagaaaagaaagagagagagagagaaggaaggaaagaaagaaagaaaaagaaaaagaaagaaagaaagaaagaaagaggaagaaagaaaaataaaagcatagagagtgctggagcagtgtgagtgagatggatagtggtaaaaggtgaccttggaaaaggaaattgggaggccagattgtgtagggtcttggtggccatggtaaggagtctgaattttgttctaagatggaaattcactgtagagtttggtgctgggaagtgacaagatcacatgtgtatttttaagagatcactttgggtgctgtgtagaaatcagactgtaggagtcaagtgtggagggagaccagcatccaattacagcctgccatgaacttgccaggttcctcttcccttccttcagcacacactactctttcccaccgcttagcctagttaacacttattctttcaaaattagcccggatgtcactttctctaagaacaaccgcgccccctgccgcctccccacctcacacacctcctctaacgcaaactcatagccctcacaacttctttgtcactttttctccccctttttttgagacaggatctcgctctattccccaggctggtctcgaactcctaggctcaaaagatcctcccgcctcagccacccgaatagctcctttgtcgctcttatcactgttgtgattaattgtacaaatggcttaatggcagttatagcgcccagctcatcaaaggcagtggcctgccaatcgtcagcgggcagggcagggaccagtccagtccatcctggctcccatgtgcagccccagtgcgcatcgcgacaccggcgctcgttgccgcgctccgtgaacgtttgtcacatgtccgaagaatgaatgaattatatacctttcttcccactccagccctcaaaaagcaagtggatacaaagacttgaagattttataatcgcttcattagtaaaatttgaccatccttaccattaaaaataatgataatgatgaaaaaggctaagtgcgaacgccgggaggggagagctaaaattcaaagggcgaaatatttataatgcctaccgtcggcgaagagaaacagcagccccaaccgaaggcaaaaggaaatcccaccgcagcctccaaaggcgcgtgggcgggactggagaatggggccctgcgcactaggcgcggaagtcaagaagcagccccaccacccgtgccgcgagaaaagcagccctggggaggcggggcggggcctcacttggaaaagagacggtcactcatccagaggcgggactcagagcccctccacaagtctcattggtccatttgaagacggacaactctccctgaccatccgtagcacagacggggcgcaagcgtattggaaagggagcgggtgccagacgcgagaactacgcatgcgtctcagcgctttcccgccagcacacccttagtgggtgggggggggcgattgaattcccacagtgagtccagcccaccgaagctgagaggattcctaaccttcctcttcagagagcctcaggttagggaacgtccagtgcccaaaagctgccctgtgggaatcccattgtccaccgcctcttacctaatgtttcgttctggccttgccccatctcttcctgaggctgggttgttacgatggtgaattattcaagatgtcttgcagcctgacgccatctctgggcagtgctcctgcatcctccctgtcttccttgggagggcaccacgttgctcttacaagcacagggtcctgaaactgtttacaaggccccactctgccacgttagtatcttaacgagtgtttgttgaggaagcactgtgtgttagacccagtgcaatgagcaagtccctgatcttgtgaccttacattctacaggacgacacaaacgtataaacaaaaaataattttagatagtgatacatgcttaaaacatggctatgtggccgggagcagtggctcacgcctgtaaatccaacattgtgggaggctgaggcaggtggatcacttgaggtcaaggagttcgagaccagcctggctaacatggcaaaaccccgtctctactgaaaatacaaaacttagtcaggcgtgatggcagacacctgtaatcccagctactcgggaagctgaggcaggagaatcgcttgaacgcaggagatggaagtttgcagtgagcccagatcacaccactgcactccagcctgggtgagagagccagactgtatctcaaaaaaaaataaaataaaataaaataaagctatgtgatagaatgactgcgatggggattaggtcctcactgaaatggtgagagtggagttaaaacctgaaattaggtgacagcaccagatatatctgcccgagggtttcgtgcttggaaaatagcaggtgcaaacgtccttgtgctgtgaggaaatttggctggaacagaaggtgggccagattgtagctgaccatagtctctgagagcttggagatgattctaaatacaatgggaagccattaaattgaggcagagccttgatgtgacgtgctttatcatcattttgctgagtggagaatggattgctgggaaaagtgaaagattgattcagaggttgtggagagagggtggctggaactaggtagctggggaggtggtgggacgtggatgaattcaagataggattggttgtgttggatatgggaaaagaagtcaccatggttcctgggcttttggaatgtgcaaatgggtaatggaggtgccattgagatgggaacagtggaaaaataaccggtgctggggtgggaatgaagagctcagttgtgtggccgggcgcagtgactcacgcctgtaattccagcactttgggaggccgaggcagggggatcacctgaggtcaggatttgcagaccagcctggtcaatatggcaacaccctgtctctactaaaaatacaaaaacattagccgggtagcggggcctataatcccatctactcgggaggctgaggcaggagaatcgcttgaaccctggaggcagaggttgcagtgagccaagatctcgccattgcactccagcctgggcaacaagagcaaaactctgcctaaaaaaaaaaaagagttcagttagttcagttgtggccatgttgaatttgaaatactcattagacatccaaccagatatgctgagttggatggcgctcaagagaggtcaaggctggacttatgcattaacacatagaaagatggtacttaaagccatggacgttagtagtagggccacctacagaaagagtggaagtagaaaagagggcttacggtgggcaatgtggttcacgcctctaatcccagcactttggaaggtcaaggcaggcacatcatttgaggtcaggagtttgagaccatcctggacaacatggtgaaaccccgtctctactaaaaatacaaaaactagccgggtgtggtggcatgcacctgtagtcccagctactcaggaggctgaggcaggagaatcgcttgaacccaagaggcggaggttgcaatgagccaagattgcactgttacactccaacctgggtgacagagcaagactccatttaaaaaaaaaaaaaattgatggccgggtgcagtggctcatgcctgtaatcccagcactttgggaggccgacgcaggcagatcacgaggtcagcagatcgagaccatcctggctaacaaggtgaaaacctgtctcaactaaaaatacagaaaattagccaggcatggtgacaggcacctgtagtcccagccactcaggaggctgaggcaggagaatcgcttgaacctgggaggcgggggttgcaatgagccgagatcgcaccatgcactccagcctggcaaaagagcaagactccatctcaaaaaaataaataaaataaaataaaaatgacggctgggagcagtggctcacgcctgtaatcccagcattttgggaggctgaggtgggcagatcacgaggtcaggagatcgagaccatcctggctaacatggtgataccctgtctctgttaaaaatacagaaaattagccaggcatggtggcaggcacctgtagtcccagctactcgggaggctgaggcaggagaatagcatgaacctgggaggcagagcttgcagtgagccgagatcgtgcaactgcactccagcccgggcaacagagcaagactccgtctcaaaaaaatatataaaaaataaaagaaaagaaaaaaaacaaaaacaaagaaggcttacgtgagacccttggggccctctactgttaaccagttcaggagaggtgtaaaagtttgtaaaggataaccagagcacaaagtagaagagcaatgtcctcaaagggaaaaattcaagaagatgctgattatggagattaattgctgcttcaaggtcaagtgaaatgcaggcagagaaatggtcactgggtctgacaccacttttggtcactcaaattttggtcagagcagtggctgaagaaacacaggggaaggagtctgatgggggtgggtgataagagaatggatgtttaagtgtggagggaagaaaaagaaaacctattgctatgaaaaggagcagagatagaattcgtggttggaaagtgtgtcttgaaagtttcttttttcttaaaagtttcttgtgcaccatatagcacaagatcagcaacccctggcagagcccttcaggtacccagtatcccttgggggtgaggaagggtgtgtacaagaggagaagcaggagataggcaggaatgtgttgcaactacgtatggataggcagctaaggtcctggttggtatacttttctctcagtatcaggaaccctgcctgccctttggaccagtcatggagaggtcacctcagtaccacacaagatcatcacccaccttcaaaaagaggtgggtgatttggatagagggggctgccagtgagagaagttcagtcaattccgtacaatacacatttattgagcactagatatatgccatgctagatgcaggtgacccagagcatcaaggagcaatagtctggtggcagagacacacacaatgtcactgtgatgtattaaagcagtcggcaagagatgcagctcagggcactgtggggatatccagaggcacggtaccttctgcctgtcagtcagggagggagaggagcacaggctgaaggagactggaagacagcagttggcctctgatagtgggactggagagagatttctaagggccacttcttgttttcagggactaggttgggctagatatggggctcaggatggacaaggcttagagccaggttggagaagatgaaagagcattactagaggagtggggaggcctaggctatgctctttactctgccattgactgcgtgatcttgggcaggccatgtaacctctcagggctgtgcactcccttatttgtaaaactagagggctgggccagcatgttttccaagggttcttctagcattgacggtcaggttccaagagggaacacagtgtcagaagtgggacactcttcctaatttctaatttcccaaaggttaaggacctggggaattaattgagaggcctggaaagaggatccagataaaagcctaagttcctggcaaggccagggccactgccctgattgcttaggtgtgaacagagctttttgtttccgaagtattctaaattatttcctaacacaggggcattcagagaaagagattcttacccccattccacaggggagaaactgaggcttagggagatttaaggatcatgctgaagaggttatctggggacaaagcttactcaggatgtggtgggggatgctgaggaacagggactggagcctgggaaggtagggcaggctgagacctgggggtatggatggaatgtgtatgtggtaatggtgtctgggcgatggaatgaagtgaaagaaatagccaagagctgggcactgagggaacaagctggggggccctgggcgtgggttccctggatccagggagtgtgaggatggctttccctggttcctgaggcatggaccgagtcctagcctgcatctgagctccgttgtgctagctttgtggtgtctgggtcgggaaagttactgttagaaagttgctgtcagcaggcattgttccagctttccatggaaattctgggagctgctcctagtttgcggcccaacctttcttccttcttctcaatgggcccaggaccttgacggccagcgggctccaaggcccaggctttttgccaacagcaacaggctactggctgggcccaggcaagggggccttggcaggaaaagttccttgctgtacctccactgcactcagaggccagtgaggggggtaccagacaggactccttcctccctggtgaagtgcccttgcagctccccagcgtccacgccatggatatttcctccacagaagtacaatgctgattatgatctgtcagctcagcaaggggcagacaccctggccttcatgtctctcctggaggagaagttgatcccggtgctggtgagtgtgcccagacctcccagcatccatggccagccggggaggggacgggaacacacagacccacacagagactcaggagagcatggaggtcagaagcccaccttgaatcagacaggtgcactggctcagacctgcctgtttcttcctgcccacccaatccaggtacatactttttggatagacaccaagaactacgtagaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggaggtagctctgagaccgggggctattgtatgagatgagccccaaggatgctggccaggaatgggagtgcttaggtgcggaggtggcactgttcccgcagctgcaagcctacctgtgtcgcccctacagctgtaccgagaggctcgggagtgtctgaccctgctctctcagcgcctgggctctcaaaagttcttctttggagatgcgtgagtctgactccaagagggtaatgggtggcttggaagaagatacaggttcagatggagcagctggagctggggctggggctggggctggctcaggctctggataggaggtccctgagacagatactggccctggtgacagtggggctgtgcgtggggccagagccttctcagaggtacaaaagggtagggtgggagggcagccaggcacaggaagggcctgaagagctgtggggcactgagtgtgccctttatgcagccctgggatagagccctattcagggccaggctggcgccacctggggatctctccccataccaggtctagaactgtgtgtcctgtccttccctggtggccgcctgctgcccagagcccacctcccaaggctgactcttcctccagctccatctttaccccttctaccccagtggttctcctccatcccacccttctctctctgctccagccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggaggtaaggggcagatgggaggggcagccctggggagagtgggcagggatccaagaactagttctcctaacacaccttccttccttgaccctcagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactgactgggctcaaacattttctcctttaagagctgccatttttcctggctggtgccataggaatcatctgggtgcctgggcacacccgctgctgctttaaggcttccgccctgatgctgacactgctgctccacgggcccagttctgcatctccaggaaagacaaacagtctccagttttgggcccagctttcctagtctcttcttttccttaccctcagccctgatcttgtgtttgtacggacagtgagctcaccctaggcctggacccaggcccagtttccaaagcaagcagcacacagcgcatgttcacataagcatgggggctggggggacactggggcttactgatctttttctaggggcctccagcccctggcaccacctagaggggaaagtgagtcacccaaaccattgcccctgggcttacgtcgctgtaagctcacactggccctgctgtgccctctttagtcacagacagcgtgtgagctgactctgtccctttaatgcccaggctgagcccagtgcctccttgagtatctgctccatcactggcgacgccacaggtaggtgtgaatggagtagccaggtgagattgtctccaggaagcccacagcaggatccttgatggtaagaggcacatccttagaggagctagggagcagggaggagaagctgagagtgtgatcctgccaaggcccccaacgctgtcttcagcccacttcccagacctcaccattgccctcaccggtttagcacgaccacaacagcagagccatcgggatgcatcagtgccactgcgtccaggtcgttcttctgactggcaaccagccccactctctgggagccctcaggaatgaacttgctgaatgtgggaacagatggtcagagtccctcggggtacctcccatgaaaccctcatctaagaagtcacccacccacggacccaccccataactcctgcagaggctctgccctggctctctaggcctggagccatgctgctgggcactgaccctgcttttctgcatcgcagtccagcctcaggcattggggttttctgttgctacctagtcacttcctgcctccatggtgcaaaaggggatgggtgtgcctcttccgaggttccaccctgaacaccttcctgctccctcgtggtgtagagtgatgtaagccatccgatgtaggagatgataggcctggtatggaatgggggtgcccgccctccactcacctgaagtggccaaggtggtagaacatgggctgtttgtaaaacgtgtccttggtgatgtctacaatgatgggactgtcgacaaagttacgcacccaattgggtcctccttcggggttcagggcaaggttccagtcggtccagccgaccacatggtacaggaggttctagggtaaggacaaaggcaaagagacaaaggcgcaacactgggggtccccagagagtgtaggtaagggtcacatgtgggagaggcagctgtgggtaggtcagccctgtgaggggcacattccttagtagctaaggagttgggggtgtgaagatccaggcatctcaaggggagctgagaagtctgaggcagctgcaagtgcctcagtagttgcaaaaggggcaatgaggtgtgcagacctgtgaaggaaagggaagatagggaatcatggttccccagagttgctcaaaagggcaggctagctggggaaagctggacaggaagggcttctgtcagtctttggtgaaactagtaagaggtctgaggtctgctttgcaggaagggagactggggtggcttaccgtgatgatgctgtggctgtactgcatccctcgatcccaggagcctagccgcacactctgctcccagaacttggagcccacacaggcctctgaggcaaagagcatggtgttggggaacaggcggtgtgtctcccctagggtggctttggctggagccagaaagtccaggtaccaatgtacagcaatgccatgaacatatttagctgcttctgggtctgtcagtacctgcaaaggaagagcaactgatcctggaccttgcacacaggcttctggaacttctagttcctgttgtaggaatcctggagttgggtgacgggaagaatgcaactagagaggtttggggagatttttttttgtttttgagacaggatgtcactctgtcactcgggctggagtacagtggcgcaatcacgactcactgcagccttgacttcctagggtcaactgatcctcccacattagcctcctgagtagctgggactacacgggtgccacacccagctaatttgtgtgtgtatgtgtgtgtatgtatgtgtgtgtgtgtatatatatatacatataaacacatatatatgtatatacacatacatacatgaaccaccacccccagcctagatagttttgttttgttttgtttcgagatggagtctcgctcagcctcccaggctggagtgcagtggcgcgatctcggctcaccgcaaccaccatctcccgggttcaactgattctcccttctcagcctcctgagtagctgggattacagacacccaccatcatgcccagataattttttttttttgtattttagtagacacagggtttcaacacgttggccagggtggtcttaaactcctgacctcaggtgatcacccgcctcggcttcccaaagtgctgggtttgcatgagtgagccacctcgcccagcccctagaaaggtttcaagcgacaactgtgggatccatggcaccctggaggtccaggggaatggtgctctaggaatccatagttgggtagagaaatcgctctaagtttgggagccagtcatttggatgctggatttgaaggtcactggagcaccatggaggtccaggccttaccacctttgcccagtggggcagcagcaagcgttggtcatccagcatgagtaggcggacattgtggtgagtactgttggcgagggtaggacctaggtcacgggcaatgaagtctcgctgatgttcaggggtgaagcccaggcactggaaggggtatccactcaacagcccagcagaaggctcattttcagctgtcactgcccagaactgtaacttgtgctcagcataggcatccaggaacctggcaagagaaaggtcatgaatgatccggccaagaaagtggaccagaccagctgggtgtggtggctcacacctgtaatcccagcactttgggaagccgaggcaggtggatcacttgagttcaggagttcgagaacagcctggcgaaaccccgtctctactaaaaatagaaaaatcagctgggcctggtggcaggcgcctataatcccagctacttggaaggctgaggcaggagaattgcttgaactcaggaggcagaggttacagtgagtgaagatggcgccacagcactccagcctgggtgacagagagagagactccttctcaaaaaaaaaaaaaagaagaaaaataaaaagaaagtgggccagaccgagagaacaggaagcctgatggagtgggcaagattgacaggcccaaggctgaaaggcccagaaggtagaaaggtgagctgaggacaggcagatctggaagtggaactaggttgagggttgggacacagatcagcatggctaaatgggaggccagtcctgatcccacatccttgctgatcccttacttcacaaagtatctggcccaggtctggtggtagatgtctccgggctgtcccttgagtgaccccttcccattcaccgctccattggtcttgagccaagtgggtgatgtccaggggctggcaaggagtgaaacgggacgctgggccaactgcagggctcggtgaatcaggggtatctagagacaaaggtagtgaagagagaagcacccagagttggaacacatactagcccaaccagtgcatccggttcagccattagcctccaccctcccacccccaggacaaaacagcaggggacaaaatgtctgtacaagcagacctaccctacagtttctcaacccccagacatcagggccctcagggcctgaaaaagctagaatgcctaccttgagcttggtatcttcctctgggaggctgaagttgtgcaactggaaatcatcaggggtgtctgcataggtgtaggtgcggatggagaagtcacagctggccatgggtacccggatgatgttatatccgattcctacagaaaaggatgatcaagatatggtagtccgagtcaataggagagtatgggactctgcttatcacttgccagtcctaatagtgtctgagtcagggccaaagggaacttgggctcctgggttggaacctgtggaggctggcacctgggtgaagcgcaggcctttctgagcctgagtccgtagcagttagcagatgataggcggtgaaatcttatttcacagggcattaaaacaggaaccaaatgtcagggatgggcagaagtcagggtccaaagaaagggcaaagaaaagtgtcagtggctcacgcatgtaatcccagcactttgggaggccgatgtgggcagatcacgaggtcaggagttcgcaatcatcctggccaacatagtgaaaccctgtctctactaaaaatacaaaaaattagccgggcgtggtggcaggcacctgtaatcccaggtactcgagaggctgagacaggagaatcacctgaacccgggaggtggaggttgcagtgagctgagattgtgccactgcactccagcctgggtgacagtgcgagactctgtctcaaaaaaaaaaaaagaaaaaagaaaagtgtctgctgggctcggtggctcacacttgtaattccagcacttcgggaggccaaggcaggtatatcatttgaggtcaggagtttaagactagcctggtcaacatgatgaaaccctgtctctactaaaaatacaaaaattagccaggtggtagtggcgcacgcctataattccagctactcaggaggctgaggcaggagaatcactatagcctgggaggcagaggttgctgtgaggggagatcacaccactgcactcctgtctcgccgacagaatgggcagagtgagattctgcctcaaaaaaattttaaaaaaagaaaagaaaaacgaaaagtttcaatggctctatgtcatcttgtccccttcctcctcaccttcttcagagaagtacgatttaagtagcaaattttgggcagggggtgacagggcaaggatgttgagagcagcagcatctgtcatggcccctccaaatcccttcactttctggaacttctgttctggctgcagggtcagtagcaggcctgaggacatccacagggaataagggtatcagtacccagcgggaaactccatggtgatcactgacaccatttacctctaggaggacccagcctggcccagggggtgaggggtgtaatggttacctgtgcccgtgtgattagcctggatgggccccatactcagctccatccgtcgcccactgcgtgtactctcatagcggctgaaggtaccaagggcaggaaaggtcggggggtcaaaggagtcacagtatgtggcattgcagacacacaccaccgagctgtagccgaagcttttagggatgcaggggcgggcacctgggagggagggagtacaagcagagtgaggtctgatgaagacatggagaatggacacatctgctaggagagactgaacacggtttcaaaattcctcaccccttggccgggcgcaggggctcacacctgtaatcctagcactttaggaggccgaggtgggcggatcacctgaggtgaggagtttgagacctgccttgccagcatggtgaaaccccgtctctactaaaaatacaaaaattagctgggcgtagtggtggccgcctgtaatcccagctacctgggaagctgaagcaagagaatcgcttgaatctgggaggcagaggttggaatgagccaaaattgcaccactgcactccagcccaggcaacagagtaagactctgtttcaaaagaaaaaaaacaaaatcctcaccccaaagttggtctcagtcactcaaaaggatttattgagcacctactaaaagtctaccaccagcttactggaaggctaccaaaggactatgaggcagaagggaggctctgtgctacctccccactgccttgactcactcacctgatgcccacgacactgcctgaagtagaagcaatcctgtgaggctgccagccatgatgcttaccctactcaaaggcttgggacattcctgaggacagaatgaggaatgactgaaaagcaagcccctctccacccctcaactactctcctgggcagggcttagctgcctttgggtgcccatggcccggtctcccacattcattaggacaaggcccacagaaacctgggtgcagctctccctgcaacccttctgatgacaactctctgcccaccccaaatcaggatgctccccaccactcttcccacccatttcaacttcgacccctccctccatctgtgccttgctcaaagagccatgatggccctggattcaaagagagtctgtcattcattaaattccagtgccaggattccagaagcactgtgacaatgctgattgggagctctctctcttacctctctggaaggacttgaaaactccatcccctcagggtcattagatgaagagaagaccacaggggttccagagtctctgaaggatagaggatccactaaacaaaaacaaggatgcaggtacctgccttagctataggcactaggttagccctgcaagtaattccggcttcccgatgtggatgggtcatgtgatgactaggagcgtcacatgacacaggaagtgaggcaatcacagccatatttctaaagggcaattggcttcctctcatctgttacagattatatgccctataaaactctggagggcatgtatgggtgacaactttaggaagagcctagaacacagatttgcatggagaatggggtagaggctcctaaatcccagaggatgggaaccacagcaggcacacttcttttttgatagaaatgtcaaaaaggtacaaataaagctgatataatttaaaaaaaaaaacttcactgtgcaaaatactgacactaccaagatgtttaagacagtctttgccctatagaggtgtgtgaggcatggaagtcagacacacagatatttacagataaagacagaaacggtaacaggtgtgcatggagagctctctgagatgaggagggaccattcgtgggtggggaattatccaggatggcttcacagaggaaaaagtgaggggggttattagccagtgaagtgcagggcacaagagggtgggacactggcagtgggatgacaggactggagggagggagtggtcagtgcggctcctctgcagcgtcccttgtttcatcatcagatgcagatggtaataactgttcttccttcctcacaagacagggaggtttgtaaagtcgttcaaaaaccaaagtgttgtacaaagccatatcctcagtggacacaaggaggaagctgtccatggtgtggcctcatgaaccacatcaaatgagatttagcgggagtggcacacacagtcatgacctgactaatcccagctctcagcccatttccttgcctggaaaatggaggcaatgccacaacctcaaagggtggttactgcagtcagtgaggtaagtgcagtgcctgaccacttggtaggcacctgggaactacttgtctcttgtttgtattttttgttgttgttgttttttgagacagagtctcactctgttgcccaggctggagtgcagtggcgtgatcttggctcactgcaacctccacctcctgggttcgagtgattctcctgcctcagcctcccaagtagctgggattacaggtgccctccaacatgctcagctaatttttttatttttagtagagatggggtttcactatgttggccaggctggtctgaaactctggacctcaggtgatctgctgccttggtatccgaaagtgctgggattacaggcatgagccactgcgctggaccccagccatcctttttgttctttaaatgatctcagtgaagtctttctagatacactccaagcaaaattgatcatttcttcttctaggttcctccagtaatttttttttttttggttttgagacagagtcttgccctgttgcccaggctggagtgcagtgtgatctcggctcaagcaattgccctgcctcagcctcctgagtagctgggattacaggagcccaccaccatgcccagctaatttttgtatttttagtagagatggggtttcaccatgttggccaggctggtctcgaacccctgacctcaggtgatccaccagcctcagcctcccaaggtgttgggattatagcaatgagccaccacacccggtccctccagtaattaagtacagtctcagtgagacagcaagtttggaatcctggctacaccatttactggctgtttgactttcaataaatcaatcactctaagcctctgtttcatctataaaaggggagtgataactcctacctcacagaattgttgtgaggtttgagtgtgataatgtgtctctagtacactgcttgacactaaacattgcaacatgtcaggcctctgttcctggagttccttgaaggaatgtcttatgcattctaagtatcctcgtagatagcctggcacaggggtagctgtcaagttgtagaattgaactagttgcttcactatgtcagtagccaccccttccagacttctcacttttcaaggaaacattgcacaggatttgttctgggtagggcaggtaatatctagtaccttacttccctcaagttcattcatctcacagatatttcctgagcacattctacatttgcctctcctgctctattgagtttagaagtccaaacatctccttccacttcccctctgcatagtgagcctcttcttttttggccaggtactgagcaattttttgtttgtttgtttgagacagggtctccgtatgttgccctggatggagtgtagtagcttgatttcggctcagtgcaacctctgcctccagaataagcaatcctcccacctcagcctccagaatagctgggactataggcgcacaccaccacacctggctaatttctgtattttttgtagagacggggtcttactgtgttgcgcaggttggtctcaaactcctaaactcaaaggatcctcccgccttggctttgcaaagtgctgggattacagggtgaggcactgcgcccagtccgcttgttttttgttttgtttttttttttgagacggagtatctctgtcacccaggctggagtgcagtggcacgatctcggttcactgcaacctccgcctcctaggttcaagcggagggtagggaccagtccatcctggcacccatctgcagctccagtgcgaatcccaaccccgacgctcgtcgccgggctccgtgaatgtttgtcacatgtctgaagaacgtatgaattacataaccttcttcccactccacccctcaaaaagcaagtggatataaagacttgaagattttataatctcttcttcattagtaaaatctgaccatccttaccgttaaaaataataatgatggttggccgggcgcggtggctcacgcctataatcacagctgtttggcaggccgaggcgggcggatcacgaggtcaggaattggagaccagcctgaccaacatggtgaaaccccgtctctactaaaagatacaaaaaattagccgtgcgtggtggcgggtgcctgtaatcccacgtacttgggaggctgaggtcggagaatcgcctgaacccgggaggcggaggttgcagtgagccaagaaggcgccattacactccagcctgggcgacagggcgagactccctcaaaaaataataataataacaataataataataatggtgaaaaaggttaagtgcgaacgcagggaggggacagctaagatccaaaggtcgaaatattcattacgcctaccgtcggcgaagagaaacagcagccccaaccggaggcaaaacgaaatcccaccgcagcctgcaaaggcgcctgggcgggactggagactggggccccgcgcagtaagactctgaaggcaggatgcagcccgaccacccgcagccgcgagaaaagcagccctggggagtcggggcgggacctggattggaaaagagacggtcactcatgcagaggcgggactcagagcccttcctcaagtctcattggtcaagttgaacgaacaagtgtcgctggcgagccggagagagagagagagcgagagcgagagagcgagcgagagagagcgagagagcgagagagcgagcgagagagagagagagagagagaggagccggcgcgagaactacgcatgcgtgtcggcgttttcccgccagcacactgttggtggatgggggcgattgaattcccacagtgagtccagcccaccgaagctcagaggattcctaaccttcctctttagagagcctcaggttagggaacgtccagtgcgcagaagctgccccgtgggaatcccattgtccatcgcctcctaatgtttcgtcctggccgtgccctatcccttcctgaggctgggttgttatgatgctgaattattcaagaagtcttgcagcctgacgccatctctgggcagtgctcctcccacctccctgtcttccttggagggcaccacgttgcccctacaagcacagggtcctgaagctgtttacagggccccaccctgccactttagtatcttaacgaatgtttgttgaggacctactgagtgttagacccactgcaatgagcaagtttctgatcttgggaccttaacattctatgggacgacacagatatataaacaaaaataataattttagatagtgatacatgctgaaaccatgggtatgtggccaggcgcggtgagtcacacctgtaatcccagcactttgggagaccgaggcaggcggattacttgaggtcaggagtttgagacccgcctggccaacatggtgaaaccctatctcttctaaaaatacaaaatttagctgggcgggcatggggacgggcgcctgtaatcccagctactcgggaggctgaggcaggagaattgcttgaacccaggaggtggaaggttgcagtgagcccaaatcacaccactgcactccagcctgggtaacaaagcaagaccctgtctcaaaaaaagacaaaatgaaacaaacaaacaaaaaaaaacatggctatgtgatagaatgactgcgatggggattgggtgctcactgaaatggtgagaatggagctaaaacctgatattaggtgatagcaccagatataggggccaagggtttcatgcttggaaaacagcaggtgcaaacgtccttgtgctgtgaggaaatttggctggaacagaaggtgggccagattgtagctgaccatagtctctgggagtttggagatgattctaaatacaatgggaagccattaaattgaggcagagccttgatgtgacgtgctttatcatcattttgctgagtggagaatggattgctgggaaaagtgaaagactgattcagaggttgtggagagaggatggctggagctaggtagctggggaggtggtgggatgtggatgaattcaggataggattggttgtgttggatatgggaaaagaagtcaccatggttcctgagcttttggaatgtgcaaatgggtaatggaggtgccattgagatgggaacagtggaaaaataaccggtgctggggtgggaatcaagagttcagttgtggccatgttgaatctgaaatgcccattagacatccaagcagacatgctgagttggatggcgctcatgggaggtcaaggctggagttatggattaacacatagaaagatggtatttaaagccatggactttagtagtagggccacctatagaaagagtggaggtaggaaagagggcttaggtgagggccctggggccctccaatgttaagcagttcagcaggacaaagtagaagagccaatatttcccttttcaaagggacaaattcaagaagatgctgattatgggtattaattgctgcctcgaggtcaagtgagatgcaggcagagaaatggtcactgggtctgacaccactgtggtcactggaaagtttggtcagagcagtggctgtggaaagataggggaaggagtctgatgggggtgggtgaggagagaatggatgtttaacagtggagggaagaaaaagaaaacctattgctgtgaaaaggaggagcagagttacaattagtggttggaaagagtgtcttgaaagtttcttttttcttttttttttttttttgagacatggtcttgctctgttgcccaggctgtagtgcagtggctcaatcacagcttactgcagcctggacttcccaagctcaagtgatcctctcaccttagccacctgagtagttgggactacaggcgtgtcccaccatgcctggctaattttttgttttttgtagagacagggtctcactatgttgcccaggctggtcttgaattcctaggctcaggcgatcctcttgcttcggcctcccaaagtgctaggattataggtgtgagccaccatacccagtcctgaaagagttttcttaaatatgagagacactagaacaaatttcactggtgacagagaatgatcaagaaaacaaggggaaaactgaaatttattgaaggcttacatactgttaagagctttacaaacattctaccttcacagtctttaatggagcaggcaattggggttacatagcttgcccaaggtcatgcagctagaggtggcagagctgagaggccacctagattttttggactcttcgtgcctgccttaccaccccattgcataggcacacgtcaccctgtacttaaacacctgggccatgcctttgccctgaccatagtgcccttgcaaatcagaaagagccactctcattctgagggggacaagaatttgttttcctcctccagtgctataagaaggggcatctcccccacagtctaaatacccatgcagcacaggacagaagctctcccagtccagagcagcagaggcaagcagcaagagaccccagaggtaggagggaaagggacactttggggggtatacagcaggtttctttttgtgccagccagtgcaagaggatgctgggggctgctggtcccaaccagctggtgcctgtggctggatgtgttcagtgtgacaagaagcctaggtcagagcccagtctcccggctgcccccgttgaggctgaggctgtgggggcgggtaccacgctccagcctgcggccagacaggagacgccgcagggaagagctagagctcagatctccgcagctgcgaaggtggaggctctctcggccaggccggccccacaggctccggggcacctggacagggacacaagaaagggcatcatcaataaggctcaatctgaagctccacgctttcccaaacatctttcctggctccccgaattcctacctgcttatgtccatgagctccagtcccactggggtctggggctttcctggatatctggaggaaacgagtgaccaggccccgacctggccagctgccctttaggtcccccagggagtgggcaggtgcagggcccgagggcaggggaactttttggaaggtgggcacagggcgccgtttctcggctgaccgggcacgtagcaacttgggggaagggcagcgggctaggcggaagaggcaggcttcagagcagagccctgcagagagacagagataagagaatggtattgtagggtggagagggggctgggcagccatgcccaatccccatccctggggcgcaaaccacatgcctgacctgtatctgcagaggaaacagaagcagcttcttcctcaagcactttggtataaaggtccctgaagtcagctggggagaagagagaaagggagacagggagtgagtggaagtgttctgtggacacgcccaccctcctgtgggaactcaagcccagaggagctttcacagctcccacgctccatccccaatcaaagggccagcatctctgtccatattagccagcaactagatggtacaatccaccacaacaaggactgcagtggtgttgttcagcacctggcgcacagtgctgagcgttccccagtactatctcctttcttatttttttgagatggagtctcactgtgttgcccaggccggagtgcagtggtacgatctcagctcactgcaacctccgcctcccaggttcaagcgattctcctgcctcagcctccctagtagctgggattacaggcgtccaccaccaggcccagctaatttttcaatttttagtagagatgggggtttcaccatgttggctaggctggtcttgaactcctgacctcaggtgatccacctgccttggcctcccaaagtgctgggattataggtgtgaacagccttgcccggccactgtctcctttctcagcatcttcgagtacaatgcctatggctgaagtactgttattatacatgttttttgtttgtttgtttgtgtttttgagatggagtgtgtctctgtcacccaggctggagtgcagtggcatgatcttggctcacggcaacccctgctttccaggttcaagcgattctcctgccttagcctctctgttagtagctggaattacaggcgcgctccaccacacctggctaatttttgtatttttagtagagatagggtttcaccatgttagccaggctggtctcgaactcccgacctcaggtgatccacccacctcagcttcccacagtgctgggattacaggtgcaagccaccgtgcccggcctgaagtactattattatacatgtttaacaagtgacagctgaagcttggggaggacagataagtggaccaagctgagagctgtggaactggtttcaaaaaataaatccttttgggaggccgaggcgggtggatcacttgaggtcaggagttcaagaccagcctggccaaaagggtgaaaccctgtctctactaaaaaatacaaaaattgcccgggcacggtgactcatgcctgtaatcccagcactttgggaggccgaggcgggcagatcacgaggtcaggagattgagaccatcctggataacacggtgaaaccccatctctactaaaaatacaaaaaaatagccgggcgtggtggcaggcatctgtagtcccagctactcactactcgggaggctgaggaaggagaatggcgtgaacccgggaggcggagcttgcagtgagcccagatcgcgcggctgcactccagcctgggtgacagagcgagacaccgtctcaaaaaaaaaaaaaaaaaaaaatattagccggtcatggtggcgcacacctgtagtcccagctactcggcaggctgaagcaggagagagtcacttgaacccgggaaacgggttgcagtgagccaagatcatgccactgcactccagcctgggcgacagagccagagactccgtctcaaaaaaaaaaaaaaattctccttttttagctgctaagctatggatgttctgtccctaggaggtgagtacctgagaagtgtctaccagaggagtgaactcaccctttcttcctcctcagggacctcaactgtgccccaatcctggtgggcatcactggccacctaactcccagtgcctaccctctcctgagcctgggcagtcggggagggggctcaccagtgtcactggaggtcgtgatgcctgggtcgctgtgggaccgtggcagcagcagcggtggtggggatgccggatgaggaggccggtgccccggtggggtgagggaacctgagctatcgctgaagcgacgagtcggggctcgggtgggcggggctgcggctgggcggccccctccccgggggacccgccgcctcagctcggggaagcagggtcccacccagggcggccagccctccaaccggtggcagctgcgggcagctgtgggggcacccagtgggggtggagcttcaggggcagagcaggaataggagcgggcagcccgtggggggcgccgtggcagggggctttcctcgaaggggccccgcaggccacagtccaggctgaggcagtagccggcacggctgcgctggatggagcgaaagagaacgtagtccacggagcgcacggagccctgcagctccagcaggcacgagtcctccgacgggctagagcccccagggaggtcaccaatggctgacagcaccagagacccgctgtccatggacactgtgggcggcagggggcgctgtgtagcaccagcctggcctggcctagccctgcccaggcagttcctcttctcccaagcccagcctctaggggccactgtgcctccagctttatctcagaggagaaaaataagtccagggttccaagttgccacagccctcctatgtccccaaaccaccaactccgccttgttttccccttctattgtctctacccaccccagctatccctggcagccccgcccttgtccacccctcattacgccctgctcaccgtctacaatggaggccactcgttcacagatgcacgagccatcgtgaagctgagggtcaaagagagtggcctgcagaagacacagggtcaagggttcagccctacacactgaacacccccatgtgctagacagagctctggagacttagattccagaccagccttgtccctttgtacaagtcacttaattgtgcagcctcagcttccacgtctgtatggcagaaatgatagcttccaacccactcacctcaccaggctctagggaagatcaaaggcaacagtgggcatgctggtgctgtaaagaccttgaccactgttactatctttatccagaggctacagcctgttcagctttccaggctacaacccggctccccagcccgccccaagccgtgctgtgctctcacctggctgtctcctcgtagtcccatgactgcctcataagaaggggggcaatcggtagggtacaagggcactgggctgtccatggagccattgtacgtgatgctggcagatgaggaagagggtcaatgtaggagaaataattccccctccacaaagatccctctctccagcaatccaggcccagccccagtccccttccttagctcccccagcaagaccccaccaggccttacctctgtgcatctgtttctgagctgcaggtatactctgggggatagtagggcggtgggggcacaggcgggacaaattcctccaggtccagcatggtgtgtaggagaggggctgggggcggggacgtgcagcccagaggtcccagtgggcctgagactgaccgctcaggggccagctgctggggaagcgagcaggtcagcaagtctggattctgggaatacagctcctcctgggcccccaaactcctctctcatctacattattttttctggccctatcccctgagagaagctcttgttctggcccctccctcacccaaaatcagctctccttaaccccacgctcaccctgtacctctagctctggccctgcccacccacaaattcctctttatggccccacctccatccagaagctccacacattctgtgtcttcacaggaatgtccaccctttagcctcacctccatctaggaccttctttttttttttgagacagagtctgactctgttgctggagtgcagtggcgcgatctcagctcactgcaacccccacctcccaagatcaagcaattcccatgcctcatcctcctgagtagctggaattataagggtgtgcaaccatgcccagctaattattattattattattatttcgagacgaagtttcactcttgtcgcccaggctggagtacaatggctacatctcagctcactgcaacctctgcctcccaggttcaagcgattctccagcctcagtcttccgagtagctgggattacaggcacccgccaccacacccggataatttttgtatttttagtagagatagggtttcgccatgttggccaggctggtgtcaaactcctgatatctggtgatcctcctgccttggcctcccaaagtgctgggattacaggcatgagccacggagcccagcctaatttttgtaattttgtgtgtatatatatatatatatatatatatatatatattttttttttttttttttttttttttgagacggagtcttgctcttgtcgcccaggctggaatgcagtggcaccatctcagctcactgcagcctctgtctccccggttcaagcaattttcctgcctcagactcccaagtagctgggattacaggcacccgccaccacacttggctaatttttgtatttcgtttgtttgttttttgagatggagtcttgctctgtcgcccaggctggagtgcagtggcactatctcagctcactgcaagctctgcctcccaggttcatgccattctcctgcctcagcctcccgagtagctgggaccacaggcgcccgccaccacgcctggctaattttttgtatgtttagtagagatggggtttcaccatgttagccaggatagtctcgatctcctgatctcaggtgatctgccctcctcagcctcccaaagtgctgggattataggcacgagccactgcgcccggcccgatttttgtatttttaatagagacagggtttcgccatgttggccaggtgggtcttgaactcctggcctcaggtgatccgcctgcctgggcctctcaaagtgctgggattacaggaatgagccaccgtgcccagcataggaccttcttgactctaccccaccatccagtcccattctctaaagcaccctctcctggtcccagaccagcatcacatacttaactcactccctgccatctccccttctcatcctccccactaaacatccattcctccaatagatgaggataatagataacccatagcccctggtgctcaaaagccagatctgtagccattgttccctcaggcaagtctcagcacacacacccctgcccccaccatacctgcgtgccctggcccctgctcccttctcaccgtatgcacgaggtccagggagaagatttggatgcagcagacaatagcagagagtgtacagattatagcggcacaaatggtgagcccacagacgctgaagagcaggttctggggaagggaaaggaggagaggagtcaggagacggctaagttccacacattatgggcctgtgagtaccccagcaggggaggcaagagtgagaaccaggaggatgtttgcagggtgcaagctcaccttgagggcccctcgggcttcatcacaggtggagttaggggcaactttcagttcctgccccgactctggacagggccggaggaggggaacagagggacagcacacacagacctttccttcctgagtggagcagggagggtgaggcagcctgagtcaggacaaactgaggtgtcctgcacacctcccccagccagttctttccagctctccctcctcaaatctcaccagagagcactgttggaagtctcgggccagttgagcattcttacaggagagaacagagccagccatgctaagcatgacacagagcaccgaaagcaaggagaagaaggagatctggggaaaacagggtgcagactcagggctgggaccctcatgagtactcctctgccacggacagagtccccctccttcacagacacttcgtgcccacccggctggcaccaactggggagccagttcccttcttgaggacataaatgggcttccccttgcgtgctgggcacctgcctcccagtgggcactggaccctggcacctaccactagagtgaatggccgcttccaggacacaatgccaaccaccccggagaacgccagctggggacagagtgggcacaggctcagcctggcaggggaggctcctgagtgagcccctcaccacaggatgcacccagccctgtaaggaggcagaggaccaggagagggaggagaggcaagcatgtggacttgcagctggtgtggagggtggggcccgaggagcctcccccacccaacaactgtgcacccaactcaccgagaacccagcccaagacgggcaggacctcttgatgctctcggt

SEQ ID NO: 1093 - DNA, 23002 bp, Homo sapiens
gcgaagacagttattttaaagtatttgtctagtgagtctgatgtgtgggcttccttagggatggtttctgtctgttaattttgttccttaaaatgcgccacactttgctgtttctctgtatgcctagtgatgtttttgttgttgaaaagcgagcatttgaatattctaaattatggtaactccagaaatcagattctccaccttcctgagagttttgtgatttttgtttctgtttttaattatggaaggcagtagccatctctttgtttagatagttttccaaaccgcttttttttttttttttgcaaagactgtattccggccgggcccggtggctcacgcctgtaatcccagcactttgggagtccgaggcaggtggatcacgaggtccggagatcgagaccatcctggctaaaacggcaaaacccccctctctactaaaaatacaaaaaattaggtgggcatggtggcgggcacctgtagtcccagctactcgggaggctgaggcaggagaatggcgtgaacccgggaggcggagcttgcagtgagctgagatcgtgccacggcactccagcctgggcgacagagcgagaccctgtctcaaaaaaaaaataaaataaataaaataaataaataaataaataaacctgttccccaaatatatatatgaaattaaaacatgcgtggtcatgatcaagttctaattacagacaaagacttccttgagattggggagaacctgccttggactacggggaccacttcaactctcttgggaatgatttttctttaggtgggtgctggataggggtgtttgtgattttattattaatacttttgtgtgtgcctgaaagatttcacaatgacaaataaaactgagaggaaaaggtttggcagttccccattaagttcaatacagggttactctgtgacccagtaattccactcctcagtagagagccaagtgaaatgaaaacaggtgttcaaacaaaaacgtgtacacccacttttacagcagcattcttcatcaaggcgaaactacagtacaaatattgtaagattccatttctgtgaaatgttccgaataggtaaatctataaaggcagaaattaggccaggtgcagaggctcatgcctgtaatcccagcactttgggaagccgaggtgacaggatcgctggaggttaggatttgaagaccagcctgggcaacatagcgagatcccatctttacaaatttttttaaaaattagcaaggcactggctgggtgaagtggctcacgcctgtaatcccagcactttgggaggccgaggcgggtggatcacctgaggtccggagttcgagatcagcctgggcaacacggtgaaacccccgtctctactaaaaattcaaaaattagctgggcatggtggtgcatgcctgtaatcccagctactcgggaggctaaggcaggagaatcgtttgaacccaggaggtggagactgcagtgagtcgagatggcgccattgcactccagcctgggcaacaagagtaaatctccatctcacaaaaaaaaaaaaaaaaaaaaagcaaggcacagtggcatcaggctggggtgggaagatcacttgagcccagccattcgagaccaacctgtgcaacacaggaaaaccccattctacaaaatagtaaaaaattatcagggcatggtggcacatgcctatagtcccagctactcgggagagtgatgggggaggatcacttgagcccaggaggtcgaggctgcggtgacctatgattgtgccactgcactccagcctgggctacacagccagaccctgtctaaaaagaaacaaaacaggcaggacgcggtggctcacacctgtaatcccagcactttgggaggccgaggtgggcggatcacctgacatcaggagttcgagaccagcctgtccaacatcgtgaaatccccctctctactaaaatacaaacattagccgggcatggtagtgggtgcctgtaatcctacctactcgggaggctgaggcaggaaaattgcttgaacctgggagatggaggttgcaatgagccgagatcgcgccactgcacgacagcctaggcgacagagcaagactccatctcaaaaaaaaaagaaaaagaaaaaaagaagaaactctcattgatggagtgttcattgatggagcactttttgggagtgggttgacatgctcacaggtgtttttaacctcacctcgtctctgaagaggtgcagataaaagtcacctggtgaggaaaatgcctttttaaaaacaatttttagagggccagcacggtgactcacgactgtaatctgagcaatttgggaggccgaggtgggcggatcacttgaggtcaggagttcaaaaccagtctggccaacatggtgaaatcctgtctctactaaaaatacaaaaattagttgggcatggtggcacatgcctgtaatcccagctactcgggaagctgaggcaggagaatcactttaacccaggaggtggaagttgcagtgagccaagatcgcgccagtgcactccagcctgggcaacagagcgagactctgtctcaaaagaaaaaaaaaagagatggggtcttggggtctcactgtgttgcccaggctggtctccaactcctggcctcaagcaatcctcctgctttggcctcccaaagtgctaggattacatgcctgagccactgtgttcagccagggtgtcccttttctgagactgcattctttccaccttgcccaagtattgcaggagaaccacaggccccatgctgtgctggcgaaaatctcatctcatgctggcctgttagggtggccatatcctctcatttcagaggctctgagggagatggaacaggctcagcggctggctgcttggggctctaaccccagccctgctgtcttctggctgtgtggccgtgacgagcccacctctctggcctcagtttgtcatctgtgaaatggacataatctatccaccacatcaggctgtataaagattaggccaggtgtggtgcctcacacctgtaatcccagcgctttgggaggctgaggcaggcagatcacctaaggtcaggagttcgagaccaacctggccaaaatggtgaaaccctgtctctaataaaaatacaaaaattagctgggcatggtggcatgtacctgtaatcccagctacccaggaggctgaggcaggagaatcgctggaacccgggaggcagaggctgcagtgagccaagattgcaccactgcactccagcctgagtgacagagcgaaactccgtctcagagaaaaaaaaaaaaaaaaaagatatgtccaagtcctaacgctcagtatctgtgaccttatttggaaagaaggtctttgcaaatgtaattaaactaaagatcttgtactgagatcattctgaattaagaatggacctgtggctgggcacagtggctcacacctgtaatcccagcactctgggaggctgaggtgggcagatcacctgagatcaggagttcaaaaccagcctggccaacatggcgaaaccccgtctctactaaaaatacaaaaaaaaattagctgggcgttgtggtgcacacctgtaattccagctactcgggaggctgaggcaggagaatcacttgaacctgggaggctgcagtgagccgagattgcgccactgcattccagcctaggcaacaagagtgaaactctgtctcgaaaataaaaacataaaaagagtggacccatggccaggcacagtggctcatgcctataatcccaacactttgggaggccaagatggaaggatcgtttgaactcagccgtttgagaccagcctgggcaacatagtgagacccctgtgtctaaatacaaacacaaacagaaaacaaaaagaacccgggctggctgcggaaccccctagatggcacaggcacatcctggctttcgaggacagtcacgagcatgagacagcatttcttcttgtcctcggggcctgcaggaagtttttaagtaatctgcttttgtgcctcttccaaatctcctcctatgaccctgtttaccttacatcacaagaaacaatcaataaaagtggtttgtgttcgtgagtgccgtgtgtttgacaaaggcgttgataactgagagctggtagtggaggggggagattttgggagattggggccctgccaggtggacggactggcctgacctccggcccctgtgctctgtttacttccatcccagctccacctctggggacccatggaagctgtcggtgaggaacacaggatccgacctgctgagctcatctctggccacctgcctgcatccgccccatctctcctctcagcttggccatgaggcgggctatgaggtcattggttaaagatttggggaagcagagccaggcgagtggccagatgtggtggctcatgccatcacaggatcccagcactgtgagaggacaaggaaggaggatgcttgagctcaggagttcgagaccagcctgtacaacatagcaagacccccgtctctacaaaatataaaattagccagttgtggtggcacgcgcctctagtcccagctactcgggaggttgaggtgacaggatcccttgagcccaggaggtcgaggctgcagtgagtgggtaacagagccaaaccctgtctctaaaacaaacaaaaacagaaacaaaaagtacactacttactgtcctgcttctcaccattccagcctggtagtccttttttttttttttgagacagggtcttgctcagttgctcaggctggagtgcagaagcgtaatcacagctcactgcagccttgatctccaaaaagactaccagcttggctgggtgtggggactcatgcctataaccccagcattttgggagccagaggcaagaggattccttgagccaaggagttcgagaccagcctgggcaacacagtgagaccctatctctaaaattttttttttttgagatggaatttagctctcgttgcccaggctagagtgcaatggtgcaatctcagctcaccacaatctccacctcccaggttcaagcaaaattctcctgcctcagcctcccgagtagctgggattacaggcatgcgccaccatgcccggctaattttgtatttttagaagagacggggtttctccatgttggtcaggctggtctcaaactcccaacctcaggtgatctgcctgccttggcctcccaaggtgctggaattacagacatgagccaccgtgcccagcctaaaaaaaatttttttaaaaaatagctgagtgtggtggcacatgcctatagtcccagctacccaggaggctgaggtgggaggattgcttgagcccagcagatcaaggctgtagtgagccaagattgtgccactgcactccagcctgggcaactgagcgagaccctgtctcaaaaaaaaaagaaaaaggaaaaagaaaaagaaaaaaaaaggactaccaggtgttttttttttttttttttttttgagacggagtctcgctctgtcgcccaggctggagtgcagtggcgcaatctcggctcactgcaagctccgcctcccgagttctcgcctttctcccacctcagcctcccgagtagctgagactacaggcacccaccaccatgcctggctaatttttttgtatttttagtagagagggggtttcaccgtgttagccaggatggtcttgatctcctgacctcgtgatccgcctgacctcggccttccaaagtgctgggattacaggcacgagccaccgcgcccagcctggtgtccttatttcttgggaaaggatacagagggtcagagaggcgccccagcttgtgcaggaatgcattcctgagatctggcctggccgtggtcactggagtgtttactctgcttacagggtctggtgtagtgggggatggctgggtaggaacgtgcgggctataaagccagaccccaggtgtcagtgcggttcagaaagcaactagcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacaggtgagctctgagacctccacccccaggacagcccccacgtctattttctttttctttaaagatgttcttatttgggggccaggcgtggtggctcatgcctgtaatcccagcactttgggaggccgaggcaggcggatcacctgagatcaggagttcgagaccagactggccaacatgacagggtgagaccccatctttacaacaaatacaaaaattacccaggcatggtggcacacgcctgtaatcccagctactagggaggatgaagcaggagaattgcttgaacccgggaggcggagattgtagtgagttgagatcgcacaactgcactccagcctgggcaacagagcgagactccaatccaaaaaaaagaaaaaaatcccctaggacagggctgtggctgagaccctgagggctggaggcttggctggccttgcacagcagcgggtgcatgctggggtggggagaggcctggagaccctgtgactccactgggggccttgctgtgtgaccccctagtgagtccttgtgtctcttacccacgcatgcctgtcacatgcagacacccacacacacccagtatctgccggacagggcagcccttcctctccgcagccaggaagctggacataggcacaagggctgacgcctggggccaggaatcctgcctgagcattaggagaaggtctggaaccccagggggaagggcactcctggggcatcccctgcccctctaccatctggtggctggactctacaccagcctgccctgctctaaaaccccagctcctcaattctgtgccacctcctctctgggcccagacaagagcagattcatccctgccccaaaggaaccaccagtcttgggtcagcagagctgggcacagacacttccagtgccgtggggctgtaactgtgataggtctgttgctccatgcacttggcaagtcaacagctgagaaaacaggttgcaacatggaaagagttttaatccgaccggcgtggtggctcatgcctgtaatcccagcactttgggaggctgaggcgggtggatcatctgaggccagcagttcaagatcagcctggccaaccaggtgaaacctcatctctactaaaaatacaaaaattagccaggcgtgatggtgcgcacctgtaatcccagctacttgggaggctgaggcaggagaatcaattgaacctgggaggcggaggttgcagtgagccaagatcataccactgcactccagcctgggcaacagagcgagagactgtctcggaagaaaaaaaaaaaaaaaaaggctgggggcagtggctcatgcctgtaatccccacactttagaggcagaggccgacggatgacttgaggtcaagagttcgagacctgcctggccaacatggtgaatcaccgtctctactaaaaacacaaaaattagccaggtgtggtggcgcatgactgtaatcccagctactcagtaggctgaggcaggaggcggaggttgcagtgagccgagattgtgccactgcactccaacctgggggacagagagaaactccgtctcaaaaaaaaaaaaaaaaagagatttaatcctagggccacccaatgaggagataggagggaacctcaaatccatttccaggaggaggagtttggggccatataaatgtatatatacaaatatatatatttttttaagatggagtcagccggccgtggtggctcacgcctctaatcccagtactttgggaggccgaggccagcggatcacaaggtcaggagattgagaccatcctagctaacacggtgaaaccccatctctactaaaaatacaaaaaaaaattagccaggcgtggtggggggtgctcatagtcccagctactcaggaggctgaggcaggagaatagcatgaacctgggagctggagcttgcaggttggagtgcaatggcatgatctcagctcactgcaacctccgcctcctgggttcaagcgattctcctgcctcaggctcccgagcagctgggattacaggcatgtgccaccacgaccggttaatttctgaaattttttagtagagacagggtttcatcatgttggtcaggctggtctcgaactcctgacctcaggtgatccgcccgccttggcctcccaaagtgctgggattacaggcgtgagccactgcacctggccaggggctagagttttaatttttaaggattttggagtgggctgaagtgtggaggtcattgcttggtgaaagagtgcaggaggtgaagtcacagacagtaagaaactgtattctcatgcagattccgttcctctgtggggtcttcacactggtgggtgtcattggttaaggatttcaaaaacatcttaagaaattcttctaaaaagtcttatgattctaaggtcggaaatcacatctatagcaaatggtcggtatcaggtgctacaagcaacttgcggtcacaaggaagtgggtcaaagtgcagcctgattagtgcttaattataactaagtttctgtccagaattctttttttttgagacagagttttgctcttgttgatcaggcggaagtgcaatggtgaaaacttggctcactgcaacctccgccctctgggttcaagcgattctcttgcttcagcctctcgagtagctgggattacaggcatgtaatcccaccaccaagcccagctaattttgtatatttagtagagacagggtttctccatgttggtcaggctagtctagaactcttgacgtcagatgatccacgtgcctcggcctcccaaagtgctgggattacaggcgagagccaccgtgcccggcgcagaattcttttttttagagatgaggtattgccatcttgcccagacttgtctcgaactcctgggctcaaacaatccacccacctcggcctcccaaagtgctgagattactgacataagccaccatgcctggcccccagaattatgaatcctgtgaggatggcttcaaggtgagcgctgagccagacaaaaggatggggtttgggagcaccctgcttagactggaaagataatgttggagaagacttcctggaagaggggctttttgcgtagagttttgaagaatgagtaggagttctccagaggaggatgagtaactgcaataacacccagtttatcaagtgcctcctatgtgtctggccctgtgctttacccctcatttgaccacctctccagtgagagtctcagtcctttttttcctggtgaggaaacaggcatggcagagaggcatgacacatcaaggttgcccttcctggctccatctagcccgttctcctctgcttcctttgtttttcaccatctttagcctttgaccccaaccaaaaagagaagagaggaaatcccatgggcatagacagccacctcttaaactcttgtctggaatttttcacatagtaacaatgtctttttttcctccaaaaagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaaggtaagtgaaatcttagagatcccctcccaccccccaagcagcccccatatctaatcagggattcctcatcttgaaaagcccagacctacctttgagcctcagttgccccatctgtgccctgggtaggaatatcctggatccccttgggtctgatggggtagccgatgcctgatttgcacccacaacgtgggaggttataacctgtccccaagttgcaaatggggaaactgaggtacagggatgccagggaccctcctgaatgtgcacagcacctgggaaacccggggacggggtcgggcgtgcggtgtgggcatggtccctgacctgggctggggccaggatccaagagaaacaatgggggtgtggtgcatggatagaagtttgtgatgggcagagccagctggagctggttctgaatctgatgaaatcgcttgtcaaggcactgctaaagtcacatgcaacgagcgacttgttaggggaggaggagagtattttccccatctctgtgccctccatggaggctccaggggtgcagggcactggatgaggtctgggctgtggtgggacccaggagggggcaggcagaggggcacactcttagcccgccctaaacccatctgtgccgtgtgactccggcaaacctctcacccttgctaagcctagcaactaggttaaggcaccctcaaaccccagtctccccagtctccctaacacttgtaccagcctgaggggctgtgattcctagaggctcagtagtctggaatgtgatgggtttggcactcttcatttctcgggattacacctgtaatcccagcactttaggaggccaaggtgggagcatcgctttaggccagaacattgcagcctgggcagtatagcgagaatccatctctaccaaaaatgtttaaaaaaaattagccagacatgatggtgtgtgcctgtagtctcagttattcaggaggctgaggcgggaggagcacttgaatccaggagattgaggctgcactgagccatgagtgccccactgcactccagcctgggtaacagcaagaccataataaataaataaataagtgaagcaagtaagtttttgactgccagaagaaaagcagagccatggttggaatctcaggctgcctgaatatcagatatacattaattccttcaagtatttactaagcacctattgtgtgccaggcacagtgtcaaccaagctaagattctaagtagggaatatgaatgatacacaaggaaataaaatagggtgcttcctattttaggcaggctggaaggaagaggaggagccagccatactgagattcaggagattcaaggggagaaatgcccttttttttttttttttttttttttttgagagggagtcttcctctgttgcccaggctggagtgcagtggcacgatcttggctcactgcaacctccaccgccccgattcaagccattcttctgcctcagcctcccgagtagctgggatcacaggcgccagccaccatgcccagctaatttttggtatttttagtagaagcgggcgtttcaccatattggccacatatcggccaggctggtcttgaactcctgacctcaagtgatccacctgcatcggcctcccaaagtgctgggattacaggcgtgagccaccgcgcccgcacggagaaatgctcttggtaggggaaataacttgtgcaaaggcgccgccgccgtggtgagatccagcttggcgtgttaggggaaatgggcaccctcgttcctggaaaacggtaggcctgtgggtgaccagcttccctatctgtcttcccacagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcggaggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttccctgtggtgtccaggataagggaaggtgaccttgagaagatcctcctctccctgacctcagtttctctaggagacctgggagggggtaagtggaaaggctcaaggaatgagtggcaaggtgttctcggagatgccaagccattggaaggtgcttacgacacctgtgggctctaagggcagccttggccattcctgactccctgactctctgtctctatttctctatctccttattgctgtttcttttttctttttattttttttagacggggtctcactctgttgcccaggccgaagtgcagtggcacaatcacagctcactgcagcctcaaccacccgggctcaatcgatcctcccacctcagccacctgagtagctgggactacaagtgcatgccatcatgcccaactaacttttgtattttttgtagaggctgagtttcgccatgttgcccaggctggtgtttctgttttggaaacagctgagaccccatacctttttaagtctcagcttccctccatctttcctcattcctcaaaacttctctctttggggtctgaggcagaggatctgtctctgtctttgtctctatcaccatcctgttgctctccccacttgggagtcacctttccaaacacaggcagctcagagccaagtctatctgcaaccaagtgccttgttttgtggtactgtccccaacctgaggggttagtcccatcacccctcctgtttgtggcacttccatgttagtgacacctcattctttcacatataaagagtagggagaaacaaataagttgtgaagaatattttcatgcacaccacatctcccaggttatatatacttcctgtttaggatgttggaattttgaggtgtgctgagtccagccccctctccacaccaaactgcctgcccatcctgaatctctgagaggaatggcgatgggtgtcttgagggacagagtacccacttccagcagtgaggtgtatctgctgggaatgccatcacccacaggccaacctgaatgactgcaggttccccttaacgtattcagtgagtgcccactttatgccaggccccggacacagctgtaaaaagacacacaaggaccaccccactttgcggagcctggttgagtgaaggggacaaatgagtaaatcctaagaaagtagttgattgcagtaagatttgtgctggggattcaacccatcagttcattagtgaacggaggcagaggtgatctagatagttggatggggaggcctccctggggagggaggtcacatttgagctgagacctggaggaagaaaaggagtcggggagggggtagttgagggtggacattgcaagtaaatgcaaacagcaagtgcaaaggccctgagatgggagcaggctcacttcagtcacagcaaagctgttgaaaatgggcacctaggaggcttcaaaattaaactcaataccaaaaggcagcagatggtgtcactgagtctttccccaaacaacagctgttgcctttgcaaggtatagggctgggcctgtgccttctctgtgcttctccaggctcttgcacaagttggtccacccagccagcatgccctttcctctccaattctcaaactcctatgcatccttcaaaacccactgcagattcccctcttacatgcagccttattcaaactcattcaattgtctccatgtggggactgtgctcccattcttccctttggcccaggcttgatctcccaggactgagggtacttgtctctagttctatctcccccaggttggaggattgggctgggaccagctgataggaaacccagttgaggcatgagcctgaaaaaactcttgaaatacagacatctgtgagtcattaactctgcctgagaagaaaccagggacagcttctcaaaggaggtggcattgcaccagggtcttgaaagattttctcagaatattagagctaaaggaatatatacatttttttattttggggttggtgtgggctgctctggaggccaagcctggagatcagggacctgggaaggggccctgagaggggcagaagggaggaatgtgcctgggcgcagtggccacgcctgtaatcccagcacttcaggaggccgaggcgggcagatcgcttgaggtcaggagttcgagaccagcctggccaacatggcgaaaccccatctctattataaatacaaaaattagctcggcatggtggcgggtgctgtaatcccagctactcaggaggctgaggcaggagaatcacttgaacccaggaggcggaggttgcagtgagctgagaccgcagcattgcactccagcctgggtgacagagtgacactcagtttcaaaaacaaacaaacaaacaacaacaacaaaaaaaaacagggatgggaggtggggagcaatttgggagtctcagatggagacttggtcttagaactcagaaatccccaccttgaggaacccacgcaccctgagccagcagcctcatcagcctcgaagcatttattgagcactgcctgtacatccacaggagggtgatgacaggattggcacagtgaccgtcctgtccccttgttgggggtctctcctcttccccctctaggagctgagggagctgaggagcggcatgagggacagggagggggcggcagagcttcctggggcctcaaggacaatcctttcctgtacccattcttcagatggggaaactgaggccatggaggcgttaggacgccctgagtcacccagcagggactgaaggggttctgggtggaggttaggacatcttaggctcagtgcccggggatcacgtactcctcttcatccattggggcctggcccagtgactgcaggttacagtagacaggctgggaagccaggtcgatgtccttgtagttgatgtaaaagtcattgtcctctgaagggtgagccctggggggacagacagaccaggggtaagtgtgggagggggaggactcaggggacaggcacatgagctttgagaaagtccagagtgggccaggtgctctgactcacgcctgtaatccagcactttgggaggctgaggtgggtggatcacctgagatcatgagttcaagaccagcctggacaacatgatgaaacctcgtctctactaaaaatacaaaaattatccaggcatggtggcacaggcctgtagtcccagctactcgggagtctgaggcaggagaatcacttgaacccaggaggtagaggttgtagtgagccgagatcgtgccattgcacttcagcctgggagacagagcaagactctatctcagaaggaaaaaaaaaaagaaagcttcagagtggctcagtccaccccgaatatttacatatggggaaactggcacgggctagcgttctgactcctagccaaccccacctctctctgaggaggctgcgggagggcagtgatttagggaaggttctgtgggtgtaacgctgcggtctgaggaccctgaaccctttttccttccttaaaaatgagatagcggccaggcgcggtgactcatgcctgtaatcccagcactttgggaggccaaggcagaaggtctgcttgaggccaggagtttgagaccatcctgagcaacagggtgagaccccatctctacaaaaaattaaaaaattattcaggcgtggtgacgtgtgcctggagtcccatctcctcgggaggctgaggtgggaggaccgcttgagcccaggaggtcgagcctacagtgagccgttatcacaccactgcactgcagcctggatgacagagggagaccccgtctcaaaaaaaacagaaattgaggtagctgttcattattacattaaaatctaaatttttgtttcctcttgaaaaatcggaagctctggccacgtcagtcacatgcacacaagtggctgcacccacactctgtgctccttccgatgggaaatgttttcaccactgaagcaactgactttgtggccctcatatataaaagcaagtctctgagcctcagtttctgcatctatagaattggtcaaggagcaggtagctacttaggaatatttgttatggtcagcaagacctccagagaattttcctgcctcctgaacattctaattccaacccagctcctcttgtaaaaagggccactgggccaggtgcggtggctcacgcctataatcccagcactttgagaggccaaggtgggcagatcacctgaggtcaggagttcaagaccagcctggccaacatggcaaaaccccgtctctactaaaattagccgggtgtgatggtgggcgcctgtaatcccagctactcgggaggctgaggcaggaggcaggagaatcacttgaacccgggaggtgaaggttgcagtgagccgagatcatgccattgcactctagcctgggcgacagagcgggaaaaaaaaaaaggcaaaagggctactttgtgttaacagcatctatcagtcaattatactctagtacgaattgcccaccaacccctaagtggttgtagggggacgaacaggtctgggacgcagggtttgtgtcctgccttttttgactggctatgtgaccttggacaagtcatttccctgcctcccagagcctccatgtctgtaactgtaagatgcagggtggaaatgacacagtcaattctaaacacagtgtttctggaggccagtacataaaggaggctgatccggaagcctcggggacagggaggccaagatgaacatcagagcacaagctgcttttgcgagtccagtgtcttcaacaccctgcctcagaccatttctgcttttgagccatgttgacatctgctttgcatattttctcctttctcaccaacagccttccgatagcctccccacctcctggcacggactctgctgcccaaacacagccatggccgcggccccttcctgcttggccctccctgttcccctcaggcctcagctttcaagtcatcccttctcaaaaaccattcacagcaaattctctgttctttcccacctctgggtctctgcccctgagggtcccaccccttgaaattccctccattcccttttccaacctagaaaagcttttcttttctttttttctttctttctttctttttttttttttttgagacggagtctcgctctgtcgcccaggctggggtgcagtggtgcgatctgggctcactgcaacctccacctcctgggttcaagtgattcttcttgcctcagcctcccaagtagctgggattacaggcacccacgaccatgcccggctaatttttgtatttttagtagagacagggtttcaccatattggccaggctggtctcgaactcctgacctcgtgatcctcctgccttggcctcccaaagtgttgggattacaggcatgagccaccgtgcccggcctaatttttgtattttttagtagaaacagggttccaccatgttggtcaggctggtcttgaggtcctgaccacaggtgatctgacctcgccttggcctcgaaaagtgctgggattataggcatgagccaccgcaccccacaccaacctagaaaagttcaactcatttgtctaagcccagcaaaatcatccagaagccggtggcggtggctcacacccataatgccagcactttgggaggctaagacatgaggatcacttgaggccaagagtttgagaccagcctgagaaatatagcaagacccccgtctctatgaaaaatacaaaaattagttgggtgcggcggcatgtgcctgtggtcccaactactctggagactgaggcaggaggatcacttgaggccaggagcttgaggctgcagtgatctgtgatggtgccactgcactccagccagggcgacagaatgacactgtctcaaaaaaaaatgtcggctgggcgcggtggctcacacctgtaatcccagcacttaaggaggctgaggtgggcggatcacgaggtcaggagatcgagaccatcctggctaacacggtgaaaccccgtctctactaaaaatacaaaaaattagcctggcgtggtggcgggcgcctgtagtcccagctactcgggaggctgaggcaggagaatggcatgaacccgggaggcggagctggcagtgagccgagatcgtgtcactacactctagcctggatgacagggccagactccatctcaaaaaaaaaaaaaaaaaaatcatctagtggtgatgggactttgtagggcacctctttagtatctcatgtgtgtcatggggaaatggggggctgtccccactctatggagacagaaatggaggttcagagacagccttgggtcacatgggacctgggcctatgctgctgaccgccaccgcggagccccaactccgctcaagcagttgcctcctgtctccccatccttggccgccagaaactgggtttacaggtcataagggggggaagtttgtcccatatatgggaactcacttaattcttaccccaacacactatgatgggggctgtaattctccctcattttactttattttattgattttatttttgagatggagtctcactctgtcacccaggctggagtgcaatggcatgaacttggctcactgcaacctctgactcccaggttcaagagattctcttgcctcagcctcctcagtagctggaaccacaggcgcccgccaccacacctggctaatttttgtatttttagtacagactgggtttcaccgtgttggccaggctggtctcaaactcctgacttcaagtgatccgcctgccttggcctcccaaagtgctaggattacaggtgtgagccaccatgtccagtcctctccccattttataggtgaggagactgaggctcagagaagtaaagctactcacctaagatcccacagccttcaagcggcagagctgggatttgaacctcggccatctgggtgtggagccttattattcaccactttggcaggtgtctcagtggcttacttacccttgttcatcccactggtgctcggctgctggctggcccacaaacatgttctcatagtcgggagtggaggggcaggatggcacggccacttggggcttgggggcgctccggctgccgtaccgtggctgcaagcctaaaccgggcttgggcccatcctgagcagcccagggtttgttcagctcccggcttctggccactcggcatcgccagagtctccaggccagcacagggccagcgatggcaagtccaagaagcaggcacccgctgaccaccactgccccgatagttgcagaggccaggccaggggcgcagctgacctccaggaaggcagagaggttgtgctgggagctggttgtgtcccagcagagcagaggcttctggccagagcagttgtctcggcggatgtcgtgccaggactccagggcacagttgcagtcggcctgcaggtcaaggtcacagcgggcggccagcgccccatccacacgagacaaggggttgcgtagcacgttcaggacctcaagcttctgcaggtgggcaaagaaggtcactggaagctctcgcaggccgttcccagacaggtcaaggagaatcacgttgctggcccgcagagactggttgtgaggcaggctcaggctgaggccactgaaattcaggcacgtggcactgaactccgcgttccagtccacatccgcggaggacacggtgcacgacggttctaggctgtctgactcccgcagcagcagcggcaacagcagcgtccatgccagggtgccccccattcaagcaacctacgtagagacaccggaatcctagccctgacctcagccctgtggtcgccctcgcctccaccgccagtgtttattattatagctcagaccagctcaagccgcttctgaaatggtaaaacgcagccccagtctggtcgcctcctttggctggtgggctgcctcagtctccccttctggggaatgggtagataaccccagtgcttagcgggcttggaaggcgaggaggagatccgggccagttaaccccttcttctatgtcctgaacatttggggcgccctcgttggccaggacgggaccctatgcaaataagcggttgccttggaaacggccccgccccctgatcacgctcccggtatctcccagaacggcgggtcgctgggaagtcctgggatagggtggagtgggggctgctgaaagggtcctcccaggtctggtttgcagtccctgcacaggtgcaagttctagagcctcagtcctaccttttgggtcccactgccacgcttttgcctctgcgatgctggaaaagcgacggcgcccagaggctgcgtcctggcccacctggacacgggggccgcagcggccacggccagcaccgtccgcagcgctgctggggtcgctggcgttcctctggctctgcacccagcgactcagggggaagaggaactggtgtctgggtggagtgcagaggggaagaatgaagacagagatccgcccccttgcagggcctcaaggttctcaccagaggtggatggagggcaagagggaggggtggaccagagtcccgcttccctcttgctagaacccagtgacttcatgtcctctattagcaccccaaccgactgccacctcatcaactcgcttcttgatctcagcttggctggttcccagctcatgcagtcatttattcattcaacaagcatcacccacgctgggcccccaagaggcctcagccctgaccaggtcctcaaggagctatcttaagagaggacagagctggacatagacactcctagtcccatgcagttaaggaaggtccagagggaaagacagggtcctggaaggcttcctggaggaggaggcattacagttggggcttcaacgcatgagtaggagttcactaagattccccaaacctatcattggctctccaagctcctccaagcctctcccactgagttcttgcacagtggcacctctatgctggaggggacagtgaggagggctcccagcagcttgggaaaatgtagctggctgggatagcatggttaggagtggagaggatagaaggaattggtggtgggggaagaggtccatgtggagccaaggcaggtgcgtgggcagaggggcactggctcaagaagtccctctggagtgagcctggtgtctggggtgggcaacttggggaggaggctgaggtcccagaagcagatgggggcctgaggcagactggaggggtagtagtgacaaaaatgatactgaggaggggtgggctgggagaaggcctcacctgaacctggtgtcaggtggaccaggtacaacctatgccagcccgactcactgtgccaccttaactgcgtgtgacaccatgtccacagctgtcaaatgcacagaggcttctccgggatctgggaggctgggagtccactcccccacgttttcccctcttttcggcctctgtccttcacatcgccaaactccaagaaatggtcaaaggctttgaacggagaccttgaagaaaaagcgggaaactgcttttcaacatgtccagagatgctcattcttgccaggtgcagtggcttacacctgtaatcccaacactttgggaggctgaagtgagcagatcgcttgagcccaggagttcgagaccagcctggccatcatggtgaaaccccgtctctactttaaaaaatacaaaaattagccaggtgtggtggtatgtgcctgtagtcccagctactcaggaggctgaggcaggagaattgtttgaacccaggaggtggaggctgcagtgagccaagatcactccactgcattccagcctgggcaacagagtgagacctgtctcaaaaaaaaaaaaaagttcacacttaataagaaaactgcaaatcacaaactgtttgtcttcaccaatcaaattggcaaaaatccaacaatgcaatgacattctgtgccagccaggctgtggggtgcgtccatggtgtag

SEQ ID NO: 1094 - DNA, 22750 bp, Homo sapiens
agggggagccagataattaataagaccaaaaaaaaaggacaaattctttaatttcagatagtgactaagtgctataaagaaaacagagggggctggaaaaattaggtgggcatagtggtgtgcacctgtggtcccagctacgtgggaggctgaggtaggaggctcccttgagcctgggaagcagaggttgcagtgagccaaggtcgcaccactgcactccagcctgggcgacacagcaaggccttggctcaaaaaaaaaaaagaaaggggacaggaacagagtgacagaagcaggggctctttcagacccagggtaatctggagaggcctctaaagagatgaggtttgagcagaggcctctgtgatgagaaggatccacccatgtgaggttctggaggaagagcattccaggcagaaggaatcagtaaaaagcccccaaggcccttattccagggtggcagggtgaaaatgtcgaatctggggttttgctaagcctagcgagaagctagtagagtcttaaacaagggagtggcatgaactgatttaatggactctaggggcacagggggaaggtgaaaagccagtaaagaggccataatacaggccagaataatagtggtttggggcagggtggtggcctcgcaggcatcacgcatgctcagaggtgcaagtcagctccagggggactcacatgcacataggcccacacacacacgtggacaggcaggcgggtgctctcacacccacagcagcacagaaacaaggcacactcaggcagacccacccgtccacaccctctgagtcactccaggactgggaggaagatgtgtgagttaaggcctgaacaaagcacatctttccaccacaaggccctggcaactagtgtggctgggggtggctgggcttccccaggcccagcacagggagcagggagttttctctagatattccctggatctagtgtcctcccaggagtcagatcataaggctccatgcaccccccacctgaactggtctcccctcttcaccacccagcagctgtgagaccttgagctggttatttctcctctctgagcctcagtttccctgctgtagaatgggactcataactgcaacttcacagtatagtagtgaggcatccacaaagtaaacgtttcaagaatctggtctagggcaggagtccagcggagaagggaagaggaggtggtggagagcacaggctctggtacccaacagcctggccttgaatccacctcttgttttaagtgagtgacttgacctctctaaatttcacagtaatgagtagccagcatttatggggcacttactatgtactacttgctttgcaatcgttcaatgatcagtttcatctgtaagtgaggagcactgtaataactaccttatggggtcattctaagagattaaatgaggttctgctcataaagtgtttaacttcatgcctgactctgagtaaacactcaataaatggtgattgttattatcagccaaagcatatttgcttccttccagcatactagctctgttgcctttggttaagttatataaccttgctgtgcctcagtttcctatctgcagcttgggaggaataacagttctgaactcagagggtcgttgtgagtattgaacaagtcagaactcagaacactgcctggtacatagtaaatgctcaataaagtcacctattcattcatacgatggtttttcctctaattctctcaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatacaggttggctctgtctctggttctcccacactcccacccactgacagaaccctgaaggtagggaaaggtaagccctcagaaagggaaagagttccatggctcggggtggagctagggtgggggctgtggctgtggctgcagctggggcttgagctggagctcggttaggctggggctgatgttgacagccgggagctgggtttgtaccagaggaggaggctggggtggaacctactgatacatatgttgggattctagctgtggccacaagagtgcgctgtgctccctctgcaacggtgcttccagccttcgtaattagacttcaccctgagtacacacacaatcactgccactctcactatagacaaaccacactccctcctctgtcacccagtcactgccatctcaacacacatccccaccctgtgtacacacaatctctgttattcatactctcactccttatgcgcactctcaacagggcatgtagtctgcactcaagcatgccatcccagcctcaccctgcattttattcggctcatcccattttccctgaacattttcgctgaactagggccctggcaggatgctgggactgtgcaaggaggtaggacctatgcccacggagctaagagacaggaacacaggctcatctcccgcactaaccaacccctgggatggctcacagccctgctcccagtgctgtgtcatgacctgaaatttaggggacaccaacacccaaggccagacccaaatggaaagcaaaagaggatgcaaggctatattaacccagtggaacacttagtgactatcacagccgaggccgggagtcagaaattcaggagccagtgagccaagcgccacagccagcaaagacaggtggggtcatcacggaaacagaacagccagtggttcacctgtgctctcacaagtagccatttgaaggtggataagccagccaagtttaaaggacccagggccggctgacactgtccctacacccccatgactgattcatagcttgaccattcctgagcacagcttccccgcactacatcttgggcaggcctttagaacctcagtcttgccatcggtacaatgggaattggatcaatcagggtcctagcagaaaacagatggcacattcaaaccaagtaactttaaagggagtttcctagagagactgttttcaaaggtatggctactgcagcaccctggggctagtaccagggtaacaatggacaggatgcatccaatgccagcaaccaagtaaatcccccaacttcactctcccatctgctcgcctgccagtggctcccactgacctaacccaaccggaagtcagagggcaagtcagcctcccagtgtacagggcagggtggagagtagacctgagggacacagggaatacggtcagcatgacacccagttgttcctacacagaggatttttgtagaggtagaaggagacactgcaggtaaaacattagcacagcactaatgtatctgataaattcccaggtatgactgtgctcaggagagtctctgcctgatgcactggaggtcagcctctgcttgggctggagggttgcaaaggtctcagggaggggtggtcgccacctacttgccaacatgcattccagcatcttcctgggtggttctggctgcctggccaagggtggcttggaggtcagagtaaccagagaacatcactggctattcctgcagagaattaacgctcagcaaggactgagcttctagtcctggccccttttctccaggctgtgggccaggaccatggaggaggggacattccagccctgcacagcctgcctttggcctggagctgttctgagcagtgcagttcactgatctcatccagtatgtattgggtgactactattcaccaccaagagccagggcacattaagtcaccacaaggtggccctcacgtccccttgacgttctcagggtacgttcctctacctccgccttccccacccatgaggattcactgcaaactccctccaatcatgcatatgagattaggatttcatatagtcttcaaatccacatctactgtgtaaggtcacagccaccctgcagcccaagataaacaggacattcctttgtattcattcaccctggtccaagtccccatatggactgaatgtttgtgtcttcccaaaattcatatgctgaagctctaccccccagtgtgatggtattaggaggtggggccttcagggatcattaagtcatgggatggagccctcctgaatgggattagtgcccttataagaagagataagaacgagatgatctctctctctctcctccatgtgaggatacaaagagaaaatggccctcaccaagaacttgaccatgctggcacctggatctcggacttctgtgctccccagctgtgagaaatgaatgtttgttgtttaaactactcagtcttacagcagcccaaactgacaaatctctccccgggatgactgcttccatcttctcgcttcctgcccctgactctgggaagtggactctgaggaagggctaagtgggtacattggggagtgactcctataagtgtaaaaggggaggaagcaggattgagcaacaagatgtgtcccagggagctcagaagcagagactgtccatgcgggcagctctgcaccggacagcaatggcgaggccttgaccaccccctggttcagtcatggcctgaggccaccccaagaagaacatggccacttagacagcagaagcacacctggaagtgctgataggtgaaggcagtcagctggccagtctccacaccgctacacagcaagtcctacattgaagggggatgtctgtctgtcacccacccctgtagtctattcccagcacagcagctggggtgatcctgtcaaaacctaagtcaggccatgtcactcctctgtcccaaacctccaaagacatcttacacaggccttcaagggcccgcaagatctgccccatccgcatctcgcctgttgcctttctaaactcacttcgctttcctcacctgctgcaaccacactgatctcctgctgtcccccaagccaggaaacaccaggcacactccttccccagggcctttgcatcctaggttccctctgtctgaaatgctgtgcccccagatagccacggggcttcctccctgccttcagggcttgcatcaaatgtcagctgcttagtgaggcgttctctcctctcctactagaaattgaggccggccacagtgactcacgcttataatcccagcactttgggaggccgaggcgggtggatcatgaggtcaagagatcgagaccatcctggccaacacagtgaaaccccgtctctactaaaaatacaaaaattagctgggcgtggtggcatgcgcctgtagtcccagctacttgagaggctgaggcaggagaatcgcttgaacctgggaggtggaggttgcagtgagttaagatcgcaccactgcactccagcctgggcaacagagcaagactccatctcaaaaaaaaaaaaaaacaaaagaaactgaaacttgccacccctgcactctcactcctccctacttcatttcccccagagcattcatcaccgtctaacatgttctacattttgctagaatgtaaaacctccgaggacagggatttttttgttgttgttccctggttatctccactgtctaggatggcatcacagcacataggaggtgcttagtaactattgcttttaatagcaaaaaccacaattacttttgcaccaaactaaatacttgttaaattaacaaatttatatacagatctggtgccctgctaggtggtggagatataaagacccagctgcctgccctcaaagggctcacagtctaatggaggaggggaataaagataagtagaccatgcaccaaggaatggggaaaggggagtggtttactagagacagagtttcagttttgcaagatggcaaagttctggagatctgttgcaaaacaacgtgaatatactcaacactactgaactgtacacttaaaatccttaagatgatacattttatggtagctgctttttaacataattaaaaatttttaaataacaaaaacaaagcaccatgggtagtagctgagctgctgaaagcacaaaggtacacctagcacagagggagccagcaaggggacttctgggagaaggcaacaactgagaaaagtcctgattcacagcgttcagcacgtgagggtgctccatgcagagggaacagcagggacaaaggcaagagcgcacagagaaccccatcagtgagacctggttgggtcacagcgagaagggtgaggggtaaggctggagaagtggccagggactggaggttggggagcctagggcttacccagaaggtgatagggagccatagatgacttttcagcagggcgatgttggtcagatttctagggaagtgtggaggctgagttggaagggtggggctagaggtcaagagaccagctgggaggccactgaggtggcagcagcctgaacaggaccagggcaaagggaatgcagggaagcatgtggttccagggacatttccaggtggaatgaccaggttgtggtaactgttgtcttagttgatcccagcttcttcatcctctggggaggaggccgagttattcaaacctccaaagcccttgaggaaggagtcagagcagggtgagggcagccttgacgtcactccccagccctccactggctcttccctctttcccagtatactgaatcagaaaggctttgggagagctgggcccagccccaagagaggaaaactcggtagtgagcagaggctgcagtgggggcgtggtgagaaccagcctccaggggcctcggttctcatgccctcaagggtcagaattaagtggggcagttgttagcttcagaaatccaggagactcagttcagcctggccctgagggagaggcctagaggggaagccagcccagccggatccctcagggcagctagccctgaagttctcaggtctgcgtgtccccaaagatgtcctcctgctggtcctgaagacagaaccctcagggacccggccctggggcccagggaatccaaggactaaatcttgctgtggaggaacagggacttctgtgccaccagccccaggcctcaacagccccctgccaccttccctttcctcagctgcgccagcccctaccaccctctaagaacaacccacagaccctttttgttacagtatcacaatgtttttagccaccactcacttgaaaaactttatgtaccactattacactatgtgctttgatcacactgtatgccatcaaccccacaaagtagatactatcactattctcattctgtagaggaagaaattgaggcacagggatttgagtaacttgcctaagggtacaggagtcaacagcaaagtctcagctcctgggctcagccaccaacaacgtctcagcactccgagggcagtggccacagtctcagaaccccacagctccaggccctcgagccacactcatgccgcccctctacctagaatgctcttcccttccacttggctaatggagggggaaaagcatttcctctcctccaggaaatgttcctaaccaagtcccctgggaatcacccagtacctctcaggagaactttccacatttattatcttaccgttatccaagggctgatatgctcaatccctgcaccagccagtgagggaggaggccagagaccaagtttggctggttcctcagggtatccccaggtccccaagcagcgtctgcagcacagcagatgctcactgatgctcatccacctgtgatgcctgaatgcatgaaggcaggctccgcatagccctttcattcctatggatgtcccccacaccacccagccaccatttagaggcataagaacggggtccaagctaaaggtcaggtggttcccccacccccagtctcaaggagtccatgggaattgcttaatggcctctgattgtgtagcctgcccagacatggggatgtttgagaattctggaagaacgtgggctgggcgtggatagagacgcctgctccaccatgtatgctggaggtgtggattacaacccctgtcccccattggagcttcccgcgccgtaattagccttgatcgcctcatcctggcacactagggccagccacctagcaaatgagtggtccccacactccatccccatccgcccacccctcacagccccgcaggccagttgcccagatccacagcccttactgcaaccccttcaaatccagccaccctgagagatcctggcctgggagaactctccttccctggccaaagaaacgacaggagagtttactgtctggaatacctggtggagagagaacagaggagaggaagggtaggtcagcccctcttgcccctccccaccgcaaatcacacaggcccacctccccggagtgggtttagggagtctgcacctcccagtccccgcccccgccctctctccagcgcccgccgccctccccgtcgcgtttcctgcccccaccccgcccctctgcgctatttaaggcgcccccgccgctcgtgcggtccagcagggctcccgcgggcgtcactccggccatcgtccccacctccacctgggccgcccggcaggcaggcggtgagtcgggggctaggaagggaccaggggcgccacctgctcgcgggaggccgggaggagtcttgggtcctccgatgccgggacgggggttgctgcggaacgcccgccgcgacagagccgcgctcacccaggtggccttggccaggctcccaccctctttccatggaatccttgtaacaacccgaggcgggaggaatactattgtttccactctatcgtggaggagactgaggggcccagaggttgttccttatccaaggggccgcagttactaaaaggcaagatttgaacccagggccgcttccagagcctggctctaaacagctttgcacttgggaagaggcacctcccccttgggaactttgtggcctgtgcctcaccctgcaatgacaattcctttcaagagtctagaatttgccagcatcagctttggaggtggaagggggtgggagtggaggtggaggaagaagacaggaccaaatgtccctcctcaagtggcaggtggtcattattgctgaccggtggagctaaaggatgatgctgccttcagctcctaaaaccccttccactacccagcccctgcaggctcaaagattagagtgaagccagctgggtaagatatgaggcggggagcagggacctgaggctttgagccccctaagaagcagaagataacacctctaccatcatcactagctcccactgtctgggggtagccagccttgggcaaaagggaggaagggcttagcccagctgcacaactttggataagttcctcaaattctgttcccataggcaaaggagcctcaactccacccagatttccttggcctgtgtccatcctggggcagtggctcggggacaagagggacatagatgtctgattaggcagggaccttagccaaagcagaatgagaccatacaaagaggtgggcagccatcatccaaaaatctgggttgggtcctgcctgcactgctgagtgggagcctccaggccagtccttccccttcctgagcctgggtttctttgtaggtagaacgggcgtggcagacctccctgcaggcttgttgctgggcgaacgagaaggatgccatgctgacacactgacgtgctctgtctccttgcagacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcaatcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcaggtgcttgctggccatggagcctcattgcaagttgttcttgaacacctgaggccttcctggtgcccaccaggcactacggcttcctctccagaatgtggctttgcctgagcacagacagagtcagcatggaatgctcttggccaagggtactgggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatcgcacagacagagcttgtgccggatttggccctgtcaaggggactggtgccttgttttcatcactccttcctagttctactgttcaagcttctgaaataaacaggacttgatcacaagtaggtgtgtattgatgctatcatgatgtgctgggggttgggggatagagttattttgcccaggcttcctttacttcttggtcctgtataatctctttggtctctataacccccgattccagccaacaccttgaaccctcaaactcataccttctgcctccaacagccctgatttctaaatgctctgccttttgaaatgcctcagacactatcttcttttcatccccactgctccagcgcattaatcagtggtcaaagcataaacgtccttgccctccctcccccatgcccatcgtcgccctggccacactgccccctgcaaagtgcttccttactggatggtttgctctccaagcgtgcctgccagccaagcccttcgcagtccagttcagatgggccctgcactcatcccacctcatcctcatccttggtatttgggaagggaggtttaggtcactagtccttcctaccttggccctttctagtctgcccaccaggagaagcaactgaaggatttgcttcatatctgctctccatgcacccagacctcagtgaggacaatggcaatgtacagaagtggaagagactgaatcttgccaatgagccacaaaggctgcagaaacaaaatgaacaattgaactgggtcttgactaggagttcactggggagggaaagagaacactgagcattcaagcggagaaaactgtttgtgcaaagtcagaggagggattgacaggctgagggggcatttaggtcctgatgagccacctagatacaggaggcgtggctgaggatgggcccactgctggcagaattgacctatgtggaggcgacccaggtaggggagagcactaggtagtgaccctcagaggcaagctggttgtcctcccttcccagggacatctggggctagggttgaagaaggaaagggggtctctctgatgtggccacatgcttctccttgagagccacaatgccttcacagcaggttggcaagttggcccctctcccatcaggatgggtgttgaaaacaccagctctgtacccctcatccagagctcattcgctcactcgctgcttacccagcgagtctgaatgctcagcctaataaattacgaccctcttccttttccagctgtggttcccattgttccctctgaatcgctgaaatcgatcaggccagcttcctcatggctcccagattcacccagtatgttcccaccctgcccctgtgtcagcatgcagcgtccctgccccccacacttcgaaactccacaaatcctttaaatactactggaccctggaaaagggcttggtgcggaagagtgagatgagcttatcaccagagggccctgaatttaaatgctgtggtctggagtcaatcatttcgcttctctgagtctcagttttctaacctctaaaatgcaaataacatcacctgcctcacaactgactggaaaccaaataagtgaaagtatgtgactgtgcctggctcagtagtcatgcagtaaaattaagctcacacctttcagccagactaacataggctcttcctccaggaagcgctctctgacttctccagctagtctccggcaatgacctctacctctcagggatctgaaccactgcttgattgagtgaggctgggctcaatcctgaaagcctcaaaaaggaggctgttcacatactggaagtccatgaccactggaagttgaggtccctgtctaagagattctcctccagccagggtgagaggccagaggctgcaggttagaagccagcgttagagccagcattacctgaggggcttcagagccctggtttggtgtttctgttatccccaacctttcctactttggaaaggtaggagaagaaaggtttcagtgagcagaaatggcatccttcccctccctcaaagctcacccactctgagcttggtgtcagagccggggtcaggctggggctcaggaacttggacctttggcaagacaagttgggtcctagactggcggccacacaaacacaagcacatatgggctgggggtttaagagtgaggacagtgtcatggggctgggatcacaccatttgggttgggggtatggtgaagactttatggagagaagagtggctgtaagccccatcccacctgtattcccttgccaaggctactgtaccaaagtaccacagactgcacggcttaagcaacagaaactgattctcagttctgaaggccagaagtctgagatcgagatatccgaagggctggttccttccgagggctgtgagggagactgttccaggcctctctcccagctctggtgttttgctggcaatctttggcactccttggcttttagacgcatcactcccatctctgccttcatcttcacctggtgttctccctttacctgtgtctctgtgtctaaatttcccctctttataaggacatcactcatattggattaggacccaccctaatgactttgatctaacttgattacctctgaaaagaccttatttccacataaggttacattctgaggcattaggggttaaaacttcaatatatctggcaggaggcaccattcaacccataccaccaccctcgtggccccacctcacctccaagcactggtcaggcacggggctctggagaatgctaggtttgttggacgcaggcatctccttggtgatgtcactaggatgaaacacggcaggttcacacctttcttttcctttgtttccttcttcctctcaccagcctatcccttgctgccaccaaccaaaatctaagttgacagctagtggctctcagttagagaaagagccatcgtttggagttaggagacttggctcctacctcacacctctcatacgcacttgactatggctctttcccttctctaggcctcaatttccccattgtgaaatgaaagggttggatgagaaacacgtatgtgacaattaggtatgaggagcgttgcgtgtggtaacctgtcactgatcattgatctgaaactcatgagtgatgtgctatttcgcatgaatcagaaaaaagtcaaggttgtttctacaataagattaattccagtcgcttaaattcacattgccttcctaagtaggaaagacagggatggggttatgtggagtgcactgggaattttgcataacccaaggtcatcttatctatgacggatgggagcatgagaacatcacgggctgcacataaacaaggctgtcaagctgggtgatgtcaaaacttcttcccagtctaacatgctggctcactggccactggcttgccagcctcatggttctatcacctccagttccttgactggggattcttcgttttcacaccaacctcagcatgactattgacgtttgcaggaagaggtatccatcacaggattgtcagaacatctctctccacctttaagaatctctctccagacttggctctgatcccagagccacaggacacccagttctgtccttcccaaacagtactgcagccacatacagacagccaccaggttcagcctgagcctgctctcctcctattcctccagataatcctgatttccagaagtctctggccaacctgcaatttgtttactttcctctttttttttttttttttttttttttgagacgaagtctccctctgttgcccaggctggagtgcagtggcaggatcttggctcactgtaatctctgcctcctgggttcaagcaattcttgtgcctcagcctccccagtagctaggattacaggtgtgaaccaccacgcctggctaatttttgtatttttagtagagatggggtttcaccatgttgactaggctggtctcaaactcctgacctcaggtgatccacctgcctcggcctcccaaagtgctgggattacaggcgtgagccaccatgcctggcctaatttcctcttaacatatgccaccctccctgtatgctggatacgacactccagttggtccgaatccagattattgcctctcttgccccaaaacttctacctctcttaatgcaacctaagattataattttttttattttctcctcctttacatatatataaattcttttgaattataaagataatgcatgatcattgtagacagtgaatgagatcctaccatccagaggcaacaactgttaatattcagaagtaattccctccagccttcttccatgcatattttaaaataaaatcttagtaaagatatacctacaattttatattatgcttttttcattttatgataaatcattagttttttcccatgtcgttaagaacatatttttggaaataccacttaaaggctttatcagtgcctacttaaaccatgaccctgatattggatttttaggatgtttgcaactaatcatcctctactataaatggtactgtgatgcagatgtctgtacctaaatgttttccaaatttctatttccttaaaagaaaaagatattccaagaagtaaaattactgggtcacaaagtaggaaatcttaaataaagaaaatttaggggcttttatctgattgtgaaagtgattcattgtgggtgactcagaaacacagaaaagcacaaattacaagaaatgaaagcacaaactgcctctgagtgggaattggggtggagctgaaaacaggagagttcattgaaagcacctcggcctggggattccatccctgcactgagcagctaggtgaccacatcttcccaactctgtgaagaggtggaggtttattctctggagaggataaaacagagaaatgcagccaggtgcagtggctcacgcctgtaatcccaggcgggaggcggaggcgggcggatgtcttgaggtcaggagttcgagaccagcctggccaacatggcgaaaccccatctccactaaaaatagaaaaactagccaggtgtggtggtgtgcacctgtattcccagctactcgcactccagcctgggtaacagagcgagaccctgtctcaaaaaaaaaaaaaaaaaaaaatcgagaaatgccaggcataattgagggtaggagcaccataaataaaacagaggaattaagtggaagtttacatactgaacagtgggtccttctgccttctccccaaaattggcttccaaaacactggctgatggatcaggctttgaaaaaaaaaaagagagagagaatctgatctagcctgaggtcatagaagcctgcctgcaggaggtgggcttcagaaagcctaaaacgtgagaaggaatgagctaggaagagatggggaagagcattccaggtagacggaatagcactttcaaggctctgaagaaggaggaaggggcttgatatatttgttgttcagggttgtttttgatacagactgccaagctgctttccagaaaaaaaaattacttattcgttcaatagcattgtatgaaagtgctcatttcaaggtatgcatacaagcattattgtaatttttaaattgctttgcctattattaattattaaacagggaaaaaatggtatcacgtttcatgagggaggcctgattactagtgagtgtagacttctatgtgtgtgtgtgtgtgtggcaggtcttactctgtttcccagactggagtgccgtggtacaatctcaactcactacaacctccatctcccaggcttaagcaattcttgtgcctcagcatccctagtagctgggattacaggtgcgtgccaccatgccgggctaatttttgcattttcttgtagagatggggtttcaccatgtagcctaggctggtctcaaactcctggactcaagcaatccacccgcctcggcctcccaaagtgctgggattacaggcataagccaccatgcctggctagtgagggtagattttttaacgtatacttcttcagcacttatgtttgttctatgaatgttttttgcccatttttctatcaggttttactattttctgatcaacttgtataaactctttataggtagaggatatcaacccttcatctggcatatgttataaaaatttttctgtattattttgttcctttgtctgcagatatttttaatttctatgtagtcaaatttatggacttttttcctttccagtaactttaggcttacactgttatccccttttcaatattatttttaattttatactttaacctggcttgaacataataggagaaaaataattattgaacaaaagacaaagcatgaacaaacaacctaattttagcatataaggtgaagtgctaacttttccccccaaataatcaatggttttggcagcacttattggataatccttcctatactaatttgtgataacagcttcactatactatatgtaacagactacattttatagactacctataattctgttccattaatctgtcaatttatgtgatactaccactcttttcattagtgtagctttctaacacaatcttttcggggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttggtttcgagataggatctagctctgttgcccaggctggagtgcagtggtgcgatcttggctcactgcagtctccacctcctgtactcaagccatcctcccacctcaacctccccagtagctggaaccacaggcacacaccactatgcatggctaatttttgtatttttgtgtggagacgggggtctcactatgctgcccaggctggtctcgaacaactgagctcaagcaatcacccatctcggcctcccaaagtgctgggattacaggcatgagccaccacaccctgcatgtaatacagttttagtatctggtagaatccatttcccttttgttacttatacttttcttgagaatcctggaagccaggtatgtattttctatgcaagtgtttggaagagtgttgccagtggatctgacagatccaaaggaaaaaacctaaagatatgggcaccaggggctgtccaaggaaatagacagctagatggccacacaatgaaaatcacagtaaggaagtcctaatcatgcatacagatcgtccaaacagctttttttttctccattaagttgggtttttatttgcctactgcaatggttagagtgtccaaaacaaatgttttgtttgtatttgttgaacagagtttatcttctaaatattcaaaaatactcttctagaatatttttaggttcacagcaaaactgagcagaagataaagagattttccttatatcctctgcccacttcccacatgcacagcctcctcactgtcaacatcccccaccagagaggtacatttgttacacttgatgaacctacattgatacatcattatcacccaaagtccacagtttacagtagggttctcttttggtcagacagcgttttagtgaccctcttttaaatatgagcacatgggtgaggatcccaggcatttgagaaaaccatcttatatgaaagagtctaaaataatcagaataaagctttccagagaaaagagagattatgcatggagaataaaatatttttaaaactaatattactttattcagaaagattttatcacatctttctgatatgataaagagggtattgcagccatgaaataagacaatactctaagaaacagctacatagagaacaacaatgacaaaaccaaggtattggaaagtaaaagtatgacagcagaattgaaaacttcaatagaaaggctggaagatagttaagcaattccccagaaactagaataaaatacaaagatacaaacagtagaaaatataaaaaatgatttgaggacaagtccagaaggtctaacggaagcttcggaaaagaggagtagaaaaaataggaatgtaaataatcaaaggaaattcaataatctctagattgagagagccactgagtgcccagcccaatggatgagtataggtccactctactgaaaactttcagaacgccagagacaaagagatgagcctacaagtttccagagaagaacatagtttcacacataggctcaagaatcggagtgacctcagactttgcagtaacaatactggaagctacaagacagtggaacaatgccttcaaaatcctgaggaaaacaattttcaatgtggaatcctatactcaggcctgcaatcattttaatagcataattccttgaaagtttggatacgttacttgcctgtaaagccaactggattcagtgtctttcttatatgtcattcttcaaaaactttttcactgtcttcagcaactagttatctattcaaattctctttgtcataaatctctcttagtaatttagacttcttcacaaaaaaaaatgcttatttgaattaagtattcaggcatccttatctcatcacaccacatattctcattttaattaaatttttaccaaaagctctaagtaaaattgttccttgacatctgtgtatgccatgtgaagatgttttataactaaggttatgctagttttatagtaaattggaaatatttccaactaaaatccctgagccttttataagtgggatgccactaagctattactaaatatgagtttatgtaattgggaatttgggcaatgaaagtgacaaatatgacatctgtaccaattaaatgccatcatatccacttcagctcattgatccaactaacaagaactatcctcttaaacctggattttgtcaaccagaatatcggccactctggttttgataaatcaggcttatccttcatctgataaatctaagaagcttaatgcaattaagtggcattccctggtggagattatgcttattcctgggtttgaggtctttgttaagtgaacaatactgtttctaaaagactatatcccttgctccacccaaccccacagaatgggaaatagaaaagcaaagcatcacagaaggctgaggttaggaggcctgattatctaggccatttgctgatttcaaggaacctccatcagttcagctcagtgatgacccagaggaatctctaaaaccaaaaataggaacacttatgtaaagagagggtgaattcccatgaaaggcagacaaaggaagtcaagtccagcacagggtccataatgctttccaagaggtgatgtccaggcattaggttaggataacaggtggaaaagccgagctttagcaataggaagaaccaggcttatcctatggtcgtcagtcctgccaaggacagaaccaaggacagggagcccagatggtttgccttctctagagaggcctccagaaggactgagcagatgacagcagggtgtgtcagagccagacatacctagaatagaaataacaagggacagaccaagaccaagaattttaccaacccaacagcaacatcaatgggatttttgacattatttacaaataaggttatacatacaattgtgttttagcatgtctgtttaaaaagcacctaacattcacatatttgaaacattccacgatgtttgtaactctgtctatacaattctttaatatttactatggtggccgggcacggtggttcacacctgtaatcccagcattttgggaggccgaggcgagtgcatcacttgaggttaggagttcaagaccagcctggccaacatggtgaaaccccgcctctactaaaaatacaaaaattagttgggcgtggcggctcacgcctgtaatcccagcgacccaagaggctgaggcaggagaatcacttgaacccaggaggcagaggttgcagtgaactgagatcacaccactgcactccagcctaggcaacagagagagactctgtcttaaaaat

SEQ ID NO: 1095 - DNA, 185363 bp, Homo sapiens
cttctgggccgggtgaccttaaagggtttctccagctctaacgtataatggtttgaatggtgtacatttggactcagcctaggaactggggtagatgtttacagtcacagactcatagaggtgatggatccttctttgcaggaatgactttggggaccctccgcagccactgtgacacctgatgcatacgtgccagggacaaaggcttcctctccttggcttcagcccgagcctgagtggagagggagagagacaggaggaagaagaaaaagcatttccttcacagatgttgaactagccacactctaaatgccggggattgttgagatgcaaagcatgcttgctgtgcgagctgctcactacccacttagcccctgagcacgtctccctgatgccatcccctgcaggcagcctggtctgcggctgtgagacaggaagtggggctgtgcttggagagacaaagcctacagctggacccggctctttcctctctgagtcagggatgggtgggggacgaggctgtggggtgggctccagcggggaagtgtggccagattcagtcctcagggtgggttcatggggatggagggtgagagctgggtagggaaggaaggctggatccaggagtaggggttggggagccagacaggaggaacgagtggttttgaggtctgtgggtggactgggcaaaaagctgatgcttagaaaagtcctttttggtgtgtgtgacagggtctcactctgtcacccaggctggagtgcggtggcgtgatcatggcccactgcagccttgacctcctgggctcaagcgatcctcctagcctgtagctggaaccacaggcacgtgccaccatgcccagctaattttttaatttttaattttgtagagacaacgtctcacttacgttgcccaggctggttttgaactcctaggctcaagtgattcacctgccttgacttcccaaagtgctggtactacaggtgcgcgccacaatgcctgaccaaaaaaatcctttatagttgtacttttgtttattgatactcagttaatagaggtataaatgaatgagcgagtaagtgaaaagagggggtggagagagttgggcataaaggtaggaaggttggaaatagtagcttccgaatttgcctggctgcaggacgtcatggaggaggtgcaaggtggcattgggtgctgtagaagagaaaggcacctggaaggtagaggggagggtgtgctcacagtaggggaaatctggggcctcccagtgtaacagcaggaggggagagaagcctggagttggtgttgagcagccaccctcaaaaaagggctgcccagagccatggtgccctctcttactgggccaggcactgcccctcactgaactccccgctactgggaagaggttgggagcggagagcacaggaggggctaggggtgtgtgagagtgtgtgtgtgagtgtgtatgtgcgtgagaatgtgtgtatgtgtgagagtgtgcatgagtgtatgtgcgagtataggtgtgtatgaatgtggatgtgtgtgtgagggagtgtgagtgtgtgtgtgtatttgtgtgtgtagggggatcagtgagggccaggagaggtagactgagacgtttgagatgaaagcacaaagggcgcactcaccatgcaaatggccttgcagcggaagcctgttatcaggagcatctgatggggtttttcagggtggaagccagcaccccgggcagcacaaggctttcccggttcccaggcagctgcctgtagttggcatggccctggcgtaatgcactactcctggaccctccagctaagagtccagacacactggcattacctggtgccctagaaaccacctgccttgtcctgtgccacccacccaccacatcctggggatagcctctgctgaaagcatcagaccctctcaagcagaaactaggatgggagtaggtggaagaacagggcttggggtcctcttaggtgatgagaaaagctctccaccaacctggtcttccccaaacagcctggagtgctccctgagagcttcctcttgcctcctcctcacccccaggcctcctacaggcaggatgggactggtcaagatcaagttctcacctgcatggtaccaggagttctgatctgggtccctaagcagctactggtgtttcctcaaggaggcaggccagtgcaaagctttctcttccttccccttcttggggccttgagagagtctggaggactcctgagtccaaccaacttccttccagactgtgagcttcttgagggcaggaccgtgtcccagcacagtacctggcacatggtagatgctcactaatgacaaatacttatctggagcttactgtgtgctcactgctctcagagcatagagaggtaaagcaccttgcctaaggtagcacaactaggaagaggtggaggtgggatttgaacccaggcagtctggctccagccatcccctctcatgagttaaggtgtatttgtttgatggaatgagctcagttggtgaggggacaaccctgaggtcacctcggagtgagtcagacctaggaccagactacctaggccagaacagccttggggcatgagatccttgggccccactctccaggcagggggtgggtgattactgaagggtgaggtccctggggtcctgctgacggtggacagagcagtctcctgggaggcttttgccaaaacctgggagagccatcttctgcttccttcaaggtcaccccagcggggcagctttagccacaattgtgggtggggtgtgtgttggagagtgtgaaaggaggtggggaaggaggttccaggaggatcagaagagatctgagggtgagagtgtgtgagatgaagccctgaggggcacccttgacttctcccactctagagaaagacaggctggtctgtcaagtggttgggggtgtcctggggtccaagccagaggtcatcgcatgtgtggaggtgggggctctggttttatgatgaacctgaccaccaaggaccatggggtgaaggtgcagagaacagaagggcacagactgggggcagcaaggggaggaggcggccgctgttcacctggggtcattgctttcttaatgggaaaagagaggctggaagttagcctggggagcctgagacagacaggaatagtggaggtagctgggccaaagcaggtgcagcctgatagagtggtggccccaggaggctcaggagcacctgagtcaggcagtagcccccagcccagaagagcaattagcaagttggcaaacaacccttcctctgccctttagttcagaaccctggttacttgtttaactgatctgatagcatctcattggccataaggcagcatcttcattaagacccccatatttggctgggcgtggtggctcatgcctgtaatcccagcactttgggaggccaaggtgggcggatcacatgaggtcaggagttcaagaccagcctagccaacatggcgaaaccccatctctactaaaaatacacaaaaaaaatagctgggcgtggtggcacgtgcccataatcccagctactcgggaggctgaggtaggagaattgcttgaacccgggaggcagaggttgcagtgagccgaaatctcagcactgcactccagcctgggtgatggagtgagactcgattaaaaaacaaaacaaaacaaaacaaaacaaaaacaccaaaataaacacatttttctgggttcataagactaaggaagcccacttgaatttctccagttgtccatcttacccccttggcactcagctaactgtgggtaattgagatttcacagagggacccagtgagtggtgtctgcagggctgggatgccaaacagtatgacttcttccaggggatgacgttgttcctgctgacctctgagcaggctgaagcctgccacacccagaattattctggggtctaggaagataccttcccagcagaagccatgggctgagcatgtgtcggataattcactgttgaggaaaatagatggtcattttctaaatatgatgtcatggtactatttcttcaaaggaaatacgatcccaaactgcaacacagaaaataaacagagggaaactgggtctttgaggcctcccaggctgtcttcatgggccctgtggggttcccgaggcagtgccagggagccttctttgagagcagccctgggcagaccagggcccggtgtggcctgaggcctctgtgcggttggctacctttcctggtcattaatcgctactaagtgtcattaccactaataaaattaaccgacttgatactggactctctgagccatcaatctcagggtccattagatgaaatttaaaaaacagatgcctctggggtggggcctgaggatttgcattccacagagctccaaggcaacactggccatgcagagctgggcaccgtttgagacccattgctccctccagggtctcttcccctgggcatcgcggacattgtggttggagtggagccgttctgggcactgcagagtgctgggcagcgtccctggtctccacccactccatgccagaagcaccaaaaacgaaaacaaaaatgaacaaaccaacaaaaaccagatgcctgttgaatgagtggaggggtttgctgggtctggctcccaagtgcagcctagggaattctggcactcttcacatgtcagaggtcataatcaaggatgatgcatttagttagacaaaccaactttgagccttcgctccacactacatgggagtcccagacaagaacacagcttgggcagggtgcagtggctcacgtctgtaattccagcactctgggaggctgaggcgggcaggtcacttgaagtcaggagttcgaaaccagcctggctaacatggtgaaaccccgtctctactaaaaatatgaaaattagccagggatggtggcgcacacctgtagtcccagctactcgggaggctgaggcaggagaattgcttgaacccgggaagtggaggttacagtgagctgagatcacaccactgcactctagcctggaccacatagcaagactgtctcaaaaaaaaaaatgttatatatcatgtcatatcatatgacatatactgtagctataatgatataataatcatagctattattcttaaaatggcatttgaggcaggtcttgaaggatatgcagcttcattggccaaaatttccatcactccctgcttgctctcccctctgtcaatcagttgctatcagggaggtccagtttctgaaacacaggaattgtgtgagcagaagtcgccactcacaccagccctcggtgtgagaaggaggacatttgagggcaaggtagctgcagcccccaagctgccctccacactggaagccagtcaaggcgtggcctcctcagctggagttgacatccagttcttctctggacctgccaagggtcaaactctgaggatttcctgccaggctgcagggaggggtttgggtgtagacctggtggactggaaaattacccatttgcccccagattaatgattaacgggtccctgccctcaccctgtctgggagaggagcccagggccaggctaggccaacgggagcccgatagcatctgtctctgctcggaggtttcggagatatgctccatgatgggttgactgcacctgatgggtgtggaatctacaggtgatttctgagggcacctggggcctggccaggccgcataccctctggtgaggcttccaacttctggggcatacagagagggcatggcctccagccagatgtcctggctaaggcaggtgactccaaagaggagagctgtgcccttggctcagaggaacatgggcttctctgaccactcctggcttgaccacaggacttaccttggccagtggcacatgagcaacagtggcaagtgccacatccaagcaggagctctaagagacattgcctgcttccacctttgcttttttttttttttttttttttttgagatagggtcttgctctgtttcccaggctggagtgcagtgatgcgatctcagctcactgcagcctccacctcccgagctcaagctatccttccacctcagcctcccaagtagctgggactacaggtgtgtgccaccatgcccacataatttttctatttttagtagagacagggttttgctgtcacacaggctgctctcaaactcctggactcaagcgatccacctgctcagcctcccaaagtgtggaattacaggtgtgagccactgtgcccagcccacctttgatcttttaccctggctatgaggccaggatatcccagaacagggttacttctcttgggctgggtcctggaatgatgtatattccacccacactgggggcaccaggatataggacagcaaacattttgaaccagcagagccatctcacagagagcttctgggaagagggaagacgaactctaattccaattcccaccctgctgctgatctgttgtatgaccagtccagtcactgccccctcgtaaatcctttgtttcctcatctggacaaaggggagactctgcttagctggagagtaaagcatcttgcaaaatgagggaagtttgggaagctccagctagcaggaaggtaggcctgcttgtcccaggcactgtggttagtccatttcatataatcctcccaccaaccctaggaggtagagaagatcactctgcccagtttccagaagggaaaaaaccaaggtgtcaagattgcatagctagaacatcagccttagaatttggtagcttggctccagaatcgatgaactttcaatctaggagaacaagaagtctgggattgatggcctgatgggaattcagctccttcaccttcatctaaccatccatcagtccttccttccttcccttctctttccttccatccccttctctccccaggcatctgtttgtaccaggcaccaggtggtcagatggttgaaggtctatctgggaattatggaaacatgttagattggtacaggattacttgggcagcagcataatgtaagggagagagggatgtcaggggaccttggctgggtgtccgctcaatgtccacatcccctctgcctgccccctctcaggaatgtggctctcttggccaggcagccaccaatactctgtgcattatttcccaaacttcccggatcacaaaagctgcctagggactgtggtaaatgtacagattcccaggcccaattccaaaccaatagacccagaattgcccagcatggatcctgggaaagcgtatttttaataagcaccccagatgatttttctaactgggccaatagggaaataggaaaatagggtggataagaagagcagagaccggaatctggaaaacaggtttaaggtcctgcagcaacctttgttacatgaaccttggtttcctaatctgtaaaatggggacgggacctccagcgggtcagcctgctgcccagaagggcagtaaatgaagcccctgaggaggccccttcccttcatttgcccctcaccaccatccccaaggctcacctgtctccctcctctcgctctctctagcctgaccgggcgggaagtcctgacgcccttcccaggattgggcactgcggcagccccggcacagggcggggcccacctgaagcagtgtgacctgctgaagctgtcccggcggcagaagcagctctgccggagggagcccggcctggctgagaccctgagggatgctgcgcacctcggcctgcttgagtgccagtttcagttccggcatgagcgctggaactgtagcctggagggcaggatgggcctgctcaagagaggtggggaggagggctaggggacggggagggctgggggaagaagccttcagggaggaggaggctgggagaggctgccctttcctttttcctggctcccgtgcccaggccacactgcccttcctgccctagcacggtcccaaatgagaagagtcacaagagttaatgaggggcagttgaaggccagctgtggcccagcctcaggtttgggggagcagaggagcaaggaagatccaagagaggaggagacacaagcctattcctggaggagctcacagataagatggggtcccccagttgtctccctctgcctcttcacacacacacacacacacacacacacacacacacacacacacacacgaaacaaggcacatgaagacgtgaggatgggcggcagctgattccaggcccgatgacacgagccaggcgatgcatttgttcactcctttatctgtccctttgtttgtcacatccatcgatccatcagtccctccttcccttccactcccattctacctccctccccactccacccacccactaagcatccatggaggcccatagtgagccaggcactgtgccagatcctggaggttcagagctgaaccagacccagctaccctcgggaagcatgcagtctggaagggagaacacaggtcaccatgtgactcccttgccaaggggaaagggcttttgacagggaaggatgagggaatgtggcttgaggacacagctccgggtgggtctccctgtcaattgccccttaaactctgactcaagttgccatttaaatggaacttctagcctgggcgcagtggcttgtgcctctaatcctagcactttgggaggccgaagcgggtggatcactttaggtcaggagttcaagaccagtctggccaatatgatgaaaccccgtctctactaaaaatacaaaaatttaaacactgcagttggccggttgccatggctcacacctgtaatcccagcactttgagaggccgaggtcaggagtttgtaaccagcgtggtcaaaatggtgaaaccccatctctactaaaaatacaaaaattagctggcatggtggcaggagcctgtaatcccagctacttgggaggctgaggcaggagaattgcttgaacccgggaggtggaggttgcagtgagccaagattgtgtcactgcactccagcctgggagacagaatgagactctgtctcaaaaaaaaaaaaaaaaaaatgcagtgatgctgtacagggcagccaggcccctcctaggccagctgctctccacggtctgcagccaagctaatggcctctctctgtgtctctctcgggacatcaccagcacccagatgcactggagggcaggcaggaagtagtgagctggtgggaggccaggtttgggccacacccagcagagaggagtgtcggtggttctggagtgggtgggatggtcagtctgaggcaagtcagccaggagactcaaggtcactgtatcattgggtctattccacagtgggtagcagagaatgacatttgagaaccatcatgtgtcataggaagcccatggggcttatctcaggggcctcagaaatgggcccatccaaatggtcatacaccgacctggagtcaaaatggcaggtttagccccaactgtgcctacgccaggtgtctgagtagcttctctttgcatctcagtgttcttctctgagaggtgaaggccgtagcccctggcctgctgccctctgggaatctgggaacatactccatagtgaatttgtaaattccatttatttatttatttataaattaaaaaaatttttttgagacaaggtctccctctgtcacccaggctggagtgcaatggcgcaatctcagctcactgcaacctccaccttccgggttcaagtgattctcctgcctcagcctcctgagtagctgggaatattggcatgtaccaccatgcccggctaatttttgtatttttagtagagacggggtttcaccatattggccagactggtcttgaactcctgacctcaaatgatccgcccgccttggcctcctaaagtgctgggattaggggcacgagccactgtgcccagcctggaagttccatttaaatggcaacttgcagtcagaatttaaggggcagttgacagggagacccacccggagctgtgtcctcaagccacattctcttgtcctgcccatcacagcgctgccaccaccgcctctggccctcagagggcggcaggcaacctctaagcttcctcctttcctctcttccccctttcctccctccctatgcccctgggtgcccgatccaggcttcaaagagacagctttcctgtacgcggtgtcctctgccgccctcacccacaccctggcccgggcctgcagcgctgggcgcatggagcgctgcacctgtgatgactctccggggctggagagccggcaggcctggcagtggggcgtgtgcggtgacaacctcaagtacagcaccaagtttctgagcaacttcctggggtccaagagaggaaacaaggacctgcgggcacgggcagacgcccacaatacccacgtgggcatcaaggtgagcatgtccctggctgcccgcagtgccttcccaccagggtacacagctggggagcatggcttgaaggaggccagcaccccactccccaaaatacatgaagagccgtgaacttcataaaggcaggatgaacttcacgtcttcaaccagcattcccttggcatctactctgggctgtgactgggtgccaggaacacagcggaagcatggaagggtcatgagtgtcattggtggaagcagtggtcaccagtgggagccaggcttaggactaggtctggtgaagcagggacatgtttggagaggggtctccattccaaggaccaggccttcctggaggtcctggaagcccaacattgtttgaaaacctccatctagagcaactgcccacttctccattttatgggtgggaagatggaagtggcccagagaagggaaggggctgaggttacacagtagtgggaggtctggagggtgaaaagtatcttggtctattgaggggaggaggctgggagacaccagtgctctagctgtttatgagattaagttctgagttgtcatcactgagttgtgaaccggggctgctgtgttcaatcattgagttggtgtgaaccggggctgctgtgttcagtcactgagttggtgtgaaccggggctgctgtgttcagtcactcagttggtgtgaactgggactgctgtgttcagtcgcgtaagttgtctattccacaagaactccaggccaaggggaggagctggggctgagaccctgggtctctttcccattctcctgcctctgccctgctggggttggtgctctgggggcaggctctggctgctgggcccaggcctctgaccacgcctctgttctgcctcccccacaggctgtgaagagtggcctcaggaccacgtgtaagtgccatggcgtatcaggctcctgtgccgtgcgcacctgctggaagcagctctccccgttccgtgagacgggccaggtgctgaaactgcgctatgactcggctgtcaaggtgtccagtgccaccaatgaggccttgggccgcctagagctgtgggcccctgccaggcagggcagcctcaccaaaggcctggccccaaggtctggggacctggtgtacatggaggactcacccagcttctgccggcccagcaagtactcacctggcacagcaggtagggtgtgctcccgggaggccagctgcagcagcctgtgctgcgggcggggctatgacacccagagccgcctggtggccttctcctgccactgccaggtgcagtggtgctgctacgtggagtgccagcaatgtgtgcaggaggagcttgtgtacacctgcaagcactaggcctactgcccagcaagccagtctggcactgccaggacctcctgtggcacccttcaagctgcccagccggccctctgggcagactgtcatcacatgcatgcataaaccggcatgtgtgccaatgcacacgagtgtgccactcaccaccattccttggccagccttttgcctccctcgatactcaacaaagagaagcaaagcctcctcccttaacccaagcatccccaaccttgttgaggacttggagaggagggcagagtgagaaagacatggagggaaataagggagaccaagagcacagcaggactgaaattttggacgggagagaggggctattccatcttgcttcctgggatgaatggcttggagccagcatgttcttgggaggtgaactgctgggctaggaatgccaaggcaggcagtgccagctggaagtgaaggcgggagcctggctgagatgggtcaatcgggtcctgtggccctgctcaggtgcagtgggctccaggtgtcacacacctccaccactcccctggttttgctgtgccagagatggggagaaagcacaggtggtagaagccatccgttcagagaaaggagagctttctgtgcttgagtggacccgagtgagatctgtgccctggagccctgtgtccttgatttggcttttcaaatatgcctccgctgaggcctcattcttgtctcgagagctgggttatgcacactcacccagccgtgctcaaaactaccaccagtgcaggtaagacaggtgggagaactagccaccaaggcgggactcagtgcacctgaggttgaacagggagacaacggcccctccctgtgttccctgctggccaaaggaatcttcactcccagcgcagaggaggagggcaacagcttcctggtgcctggcagtgacgtggcgagctcagtttctcagctggctcttgagtgagctttggtgacttcctgtggctggggcctgcctggtctgtgacacccccataccagctgagttcacaatactgaagaacagctggctcacgagctatgacttgaagttacatttctattcttgtggctgctcatctagttaaggcttttgccctggctggggttataggtgcttgagtccttgctaagcctggctcctgggtagcctccttcagttcctaatggcctctcacttggccctcactttggctcttacttgaggaggagacgtgactttgataatttcctcagatcctgtggacattttcagcagcacctgccaaggccctctgtgaaaggaggagagactggtacctccacacaggcacacatggatgcacagcccctggaccaggctgggggttcctgttgcacatgcctctcttgttcaggatgaagaccttgcaggggtccccttgctggaggcattgtacttccccagagtggggcccgatgccacccaggaggaagtgacttctttcgggaagcccttggccactttgctggccctgccacgcccatctgtcagcttcctttctccctaaacctagagttgctgacccttcaccaacacaggaaatttcagaatcagctgaatgctcagaaacctcgcctgtgccagctccaggacaaaggcccgctgactgtgccctggccaactccctgagacctccaagggcgaggaggagctgcccagtctccagtggatcagggcagtctgctggatgctggaaggatttttgactgcagaggcccggctgagaagccaaactgacctgagcccctctcgttaaaatgacattgctgacccaagcacctggcccacaccttggcagcaggagaaaaatggggagagggctggttttctcctttcttccacttccccacagcatggagattttctctgccttcccaatccatcttgctcctccgagaccccaactctgcctccacccaggctcagtgctgggcgtaaggcagcagggacctcactggcagagcagggggcctgggagcaacgtggaggccagagcaccctgatccaccaacatgccacctgcattctgacttcatggctggcagtgccagggtcgtgggagggcaaagggcaggctctaaggcatctaggcagtggctggctgctaacatggacaccccaagtcaatggcacagtgcaggttctgagggctccttggcttgtggggtcttctctgtctgtctctctccctctcttcttccttgctctcatccctttcttttccagttacccctgaagacccacctcggccctcttggggcccctggggactagagtgaccactgacccctcattctacagctttaagggaaatgctcacagggtatttttgtctacctcaaatatatagtttttagagcaaaggagaataatttatatagctaagatatatgagaaagtatttatattatttatatagttgctatatttcacagacagcacaggtggggtttgtgtattttcccggaaaccctctgtctggggagatacagcctgacctgaccgggtcccccactgagcaggaggccgggtcgctgggaaggaggacaaacctgtattccatgactgggtctgtctcggagctggtaagcacatgtccgctctgtgatgagccctggtgggctccatccagaccctccttgtgatgtttttgtagattttctgcccttctgggtccaggcccccttcttctgctctggcaaaagtgtcttactcataatgataatgacaacgagaattcccacacctggcatttgtaaagcactttgctatttagaaacaaaaacttttacccctttcatctcacttgatttctccgttatctctgtgaggtaggtggggccacattactgtggccattttatagatgaggtccagagatggagagctgtgctcaaagtcacacctaagagacttgttcaatgaatatttactgaacatctccatagaccaggcactacgggctgacctgctctgagcccaggagccccaaagcctggataccactgtgagcccaagaactcagggaagcagttccttcccaggctgtgatcccagccttttggatctggatggcatgttggcacttcccccaagtggagtcccatgtctcaggggctttggctgcctgagaaggctggagagaccaggaacccatggaggccactccaaggggtccttctgcccacactgcccaagaagcttgggctacaccactgggcccctcccaacctacagatgaattttgattgctctcatttgtgttttgcttgtaaaaatgaattgttttccactggatttctggctgcttttgcaaaagtcagctgcgctggcagactgggcctgcatgtcctcctgcaggcagctagagtgagggagtctaatggacaggatgccccaagtgcccccgttgctcatggatgcccctgcctgcctctcatgagcacatagtcctgtcccctggtctagataagcccagctttcctggtacccttcatcacctggcagacagacagccccatgccaaccctggacattacttgcttttgaacctttcctttctcaacaaccatgaacttcaaatgctttctgtctcaggacactttagaataacaatggaagccatcacttattgagcaccccttatgtccatttattcaaccaatgattatttagggatctcttattgagcaccaggcagcatcctgggtgcttggtgcagcaaggaacaggaccaagtctctgcctcatggggctgacatcctagtgggtgagaaagacaataaaccaataaatgacatgccagttatttgcatttactttgtctcaatttattgcaataactttgcacattggacatggtccccgtaatggataaggaaatggaggttgtgagatgagaagcctcctcattgcaactggcaggcagtggggccaggattggaacacagatctcctggcctccaaagtatgggatttttttcctctgtacactggtataggtcgggcagggatggatcgccccattttattgattctgggtaaactaaggcctagaggaaggaaataatccatcctggattacacaccaattcagacaggccagagcctgcatccttcctggagttgataagcatttctggagccctcatgctatggcaagcagcatggctcagggtggggcgggatgaagccaaccaggggccttcagggacctacagtctaataggagaaatgagaagcacagccatgcagtggtttgggtcatttacacacgaatcctgtgtcccttttctggccacagttccttcccaacatgctttgggaggcctcgcccaccaggatcctcctgggggtctgatgggagaggaggcctctttctgagccaagcacagcagagagtgcctgtctcctggctcaggcctgccctgccccagttcttcagccctgctggggtccacattgccttaactgggctccccagggcgggaggcagaggtgggcccacagtccagccctgcaggggcctacatttccaccagcatccccgtcctaacatgctccttctacccagtgttcctgggcctggagaccagctggctctgagtaatgacagacacgtccacatgcagcagcaggctccagtttatcaagggatttctcatctattttctctcttgaacctcacaaggtggacacccttcttctttttttacagataggggaattgagacacaaaatggttaagtgacttaccaaaggctatatcgctagcaagcggatccaggccttttgcctccaaaccccatattctctctaccatacaccatcctcacctcctcctgccctcatctgagccttactttgttcctgctcataatctagttcccaaacaggcccgcagacccctccacctccagctgctcaatgccaccatcttccaggaggaccggggcttgttgagacagtcactaggtgggtaccctacccgcaatatccctcctcctttaaaaacagccacatgtgctttctgtctttgcatttgcaatatctatcttgttgaatcacttgtgagacctttgcagacaccaagacacttacatactttatcatgtatctcctaaggacaagaacattctccaacagaaccacaaggccatcaccacatctaagagatgtaacattgacaaaaattatctactacatagtccatattcagacttccccaattgtccctcaaaatgtcctttataacattattttctggccaggcacaggttcacacccataatcccagcgattggagaggccgaggcaggaagatcgcttgagcccaggagttcgaggatatagtgagctgtgattgcaccactgccttccagcctgagcgacagagtgagaccctgtctctaaaaaattaaaattaaaaaatttttaaaacatgttttcctggcccaggatccactcaagaattaggcattgcacgttgttttcatgtctctccagctccctgtaatctagaacagtccccctctttctttgctttcataacagtgatagtttgaagagtccaggctgcatgtctcgtggaatacctctcaactgagatttgcctgatcgtttccttgtacttggattcaggttaaacattttggcaataagctgcttgggtgatgtgtatcctattctgtgcatgctgtaaggagccacaggatgttttgctcttgttgcccaggctggagtgcagtggtgcgatctcggctcacagcaacctccacctcctaggttcaagcgattctcctgcctcagcctctagagtagctgggattacaggctcacccatgatggggatggggacattctggagggagaggcactggcgggaagcatcctatgcctgcccccacccttcccatttctttccgattcttgacttcgctccatctctcacctggagttccttcttgcaaccgatcatgcagcaaacacggattggtggcctatggtgcacgaggcacgtgacagggtcctagatgccatggtaatgagactaggtccagccttcagggaggtcccagacaaggggagagacaagcaaagagatggctggcatgcacggtgtccagcactccaataggtggctctgtgcaggctccaccccacacaggcattcctgtgcaggccatttcctcatactcccctctgggcaaccccaggggtccatacaaccatgatccccatttttttttttgagacagagtctccctctgtctcccaggctggagtgcagtggcatgatctctgctcactgcaagctccgcctcccaggttcatgccattctcctgcctcagcctcccgagtagctgggactccaggtgcccgccaccacgcccggctaattttgtttttgtatttttagtagagacggggtttcaccacgttagccaggatggtcttgatctcctgacctcgtgatccgcccacctcagcctcccaaagtgctgggattacaggcgtgagctactgcgcccggcctttttttttttttcctttgtgagatggagtctcgcttttgtcacccaggctggagtgcaatggcgcaatcttggctcactacaacctccgcctcccgggttcaagtgagtctcctgcctcagcctatagagtagctgggattacaggcgcctaccccacgcccggccttatttttgtatttttagtagagacggggtttcaccatgttggccaggctggtcttgaactcctgacctcaggtgatccacccatcttggccttccaaagtgctgggattacaggcgtgagccactgtgcctggcctatgatccccattttatagatgaggaaactaaagctcagagaggttcccttgctacacaataagtagcagggctggaaatgaaacagcttcttcactgcctcttcccggggagtgctgggcacggcctggggacagagagacggggtatgagggagttgcaaggattcagggcgactggtggcatcttccagtcctgccacttggtcctccttgtcttctcctctctctctttctccccaccctgcataccgcaaagaggaggttaatgcctctcacgcgtcttatccccccactcccatccctcctcaagtccccaggggctgtggggcccatattcctccctggctctcttgggcccattagtgtgtttacgctggagccgtctcaggggagctgagcccctacccctgccccaccgtcctcccgccatggagagtgggcagtggagtggtggaggccgggcagaggcacgggagaacctgacccagcgtccgaattcctgcccccacgtctcaacaagtccagggtggccagaagcctggagagcaacggtagccccccgggacccccacctcttcccacacagccccaccagagcctgacaggctctaatctcagctgtcttcatgcagccagccctccgagcccggggtcacctgacgctgacacattttaattcagaagctgatttctgcttgttggcaacatgtcatttctgaaattgctttctctgcccagaggcgggagatgtcagagctgcgcaggtgttgcagtggtgccgcccccgccccacacccagccccctctccaagttcaggaaggattaaggggcgtgagggggcacacaggagatcctcaagctctgcttctcatgtttccccaagtgctgggggccagggatgggggactcctggaatggcctctgctttcctttccagcctgatgacagaggcccagggtttggtaaatgaagttgctgctctgccagtgctgacaacagccacagtagttgttttgcgcaggcttcatacaggtaccaagtgctctgcagagtgcctctcgtgtgcattgttgtatttgaatcttatgacaacgctccaagttggtgtcatccctcctttgcagctgagaaaaccggggctcagaggggttagaccacttgcctgaggtcacacagcaagtatgaggcggggccagctttcagacccagtgaaggcgacagctggactgggattgggaggtctgggaagggagaggccgtggagctggggaggactatggcctggcttctcctatatttgcttcctgacttggttcaaatatctccagtgaaatttgtgaactcccccaacttccccactcctgcaacccatcaaatagttatttgctccctcttttatatttccttagcttttttttttagacgaagtcttgttcttgttgcgcaggttggagtgcagtggcaagatctcagctcatcacaacctccacctcccggattcaagcgattctcccgtctcagctgcctgagtaactgggattacaggcatgcaccaccacgcctgactaattttgtatttttggctaattttgtatttttagtagagatgaggtttctccatgttggtcaggctggtctcgaactcccgacctcaggtgatccacccgcctcggcctcccaaagtgctgggattaccggtgtgagccactgcgcctggccagcatttttttttttgagacagagtctcgctctgtcacccaggctggagtgcactggcatgatctctgctcactgcaacctccacctcccaggttcaagtgactctcttggctcagcctcccaagtagctgggactacaggcgtgcaccaccacgctcagctaatttttgtattttcagtagagatggacttttatcatgttggccaggctggtctcgaactcctggtctcaagtgatctgccagcctcagtctcccagggtgctgggattacaggtatgagccactgtgcccggccgccttagcattttgtgtatgttttgagtgacagccatctgtcaatattggcatcttttgttttattggatgaatgaatgaacaaatgaatttataaatcttgttctccatactgtttacccatcctcatttccctcacttggcagtgtcttgccatagcaggcttcctggtgtagctggcaccacatccctccctgacacacggcctccttattgcccctgctacttgcctttttctctcctccctttccttcccttcattccccctggcttccccttcccaactctcagaatccctggctgcctcaaccacaagaacaaagctgtgcagaagcctgaacctggagcttctgcaagatgaggtggggaatgagctaacccagctggaaagcagcctgctgatccctgggagagacggcgcttgggccaacccaccctccccaaggtggtcccctgcctcagctccacccgcttccccagatgaacttctttctctccctccagcgcttcagaggatgcacagctgtgtgtacttgaccctgagcctgggctagtgctggggacatagccagtctggctgatacccatatcagtacagaaagctgtcctcacccacttcatgcactagttgcattggtatgaagcattagctttataactatcccatttactgcaggcataaacctatatcaattggtggggatggaggttaaatgagagaagacatcaaagatgcatagaactattgggcccctttcaattaataaataaaatttgtaggaggccattagtttgtactgtgctcctgtaatggacccaacagaccaaacaaatatggagtcactcatgctaaatgcaattaacttgggagtatactcctaagttgcaaaaagtggtaacaaatagctgagttttggggcagttacagcagctgagcatctgtcaatgtaggtggccaggtgattcaattaaggatgctgtaaccaattaagctgtatctacacctcacttctgttttctatctacaaatactgcgtgatcatgttgctggttggagttctttgaataagctgtggttcggagggatgcccaattctagaatcatgaataaaagcctattaagatctttaaacaaaatttattgtcattttgtcttttgacattttacagatgggcaaagtgaggccaggtgagcaacagcatctgttttttttgtttgtttgtttgttttttgagactgagtctcactctgtcacccaggctggagtgcagtggtgcgatatcagctcactgcaaactccacctcctaggttcaagcaattctcctgcctcagcctcccgagtagctgggattacaggcgtgcaccactatacctggctaatttttgtgtttttagtagagacggggtttcaccatgttgcccaagctggtctcgaactcctgggctcaagcaatccacctgccttggcctcccaaagtgctgggattacaggcatgagccactgtgcccggccagcaagaacatccttaacacaaagttggagtcatggtaaaatgaggtcaggattgggcaggcactaacaggactttggaagtatagcattgctctatctcctgataattaatgagggatactgtttatgttcccatttaaaaattaagcctaaaaaattgaaattgggatccatttcacagaggatggtcaaatgtccaagaagaagggacaggtggtcattaaaattcagataaacagagttcccagtgagcactgtcttgggagtagaactaagcaagcaaagtcacctttcttctctgagcctcattcattaaaaaaaaaaaatctctatatagatatctttctatagcaatctctcagagagggccaggcgtggtggctcaagcctgtaatcccagcattttggaaggctgaggtgggtggatcatctgaggtcaggagtttgagaccagcttggccaacatggtgaaaccccatctctactaaatacaagaaattagccgggcatggtggcatatgcctgtaacaccagacacttgggaggctgaggcaggagaatcgcttgaacccaggaggtgaaggtttcagtgagccaagatcactccactgcactccagcctgggcgacatagcgagactccctgtccaaaagaaagaaagaaagaaagaaagaaatctctgagagagatagataacacatgtagcactcctactatgtgccaaacactgtgctgggccccagggatgaagcaattagtgagacaggcggagtccctgctcttaaaacacagaagacagataaacaagtcatcactattcaatgtgatgaaactgacaaccctactcaccctgggcagccaaactcagtggctgggagctagagatagggagagcagggagactttttactccatttcttgttgcttttgaattctgaaccatgtgaatgtattcctgatccaaaataaataaaaataaaatgtgatgagttttcacaagcgggagtgtgcttatgggaacatcagcagggagaagggataccgacctggcctagaggatgtcagagaaagcttcccagagaagtgagagcccagctacagcctgaagcttagggaggtgtgggtcaggtggggagttggagggagagggatgcaggtgtcaatggaagtttatggtgctgggtgataaacaccaacgttgcagggtcactgggaggattaaaagtgtccccagaaagtgcctggcacacaggatgtgcttactgtatggtagctattattattcctcaattatggttgctgtcattggcagaggctagggagaggggaccctaaggctgccactgactctactgatatattcctgggcctctgaaaggccttggtgacaggaactcataacactgctgcggcattttacagtttacactaatccaatcctgggtacaggagggcagaaagaagtttgaagctcagggtggcccactaaggggggttcttggctcttctagaatcagctgtctgtcaagcacaggaccaaaacaaccccacactgtctggttgctcatcttatgtcacagaccaagaaatttccccatgctaggaagggacagaactctctccctgccccagacccaaggcagcagcataccgttcatagcagtgaaaaccagtgtttctgagcaccaccaatgcacctggtgctgtgcaaaatgcttcacttggatttgattaaatccttgacctcacaaccaccctaccaggagcaagctactgtaatcactacccccattttacagatgaagaaactgaggcatgcaaaggttaagtaacctgcatgagttcacattgtcaagctttgactccaggtgcctcttagccccttactgaccctaaagcagagctctcatgtctaaaatttcctctgcttgcctgctcagctcttccctgcagcaggaagagaaccatttcttctgactctgcagagcctactaagtgcaactcaacctttattcgtatcctagacttagaacccatggaggcatgaataagattttgaaaatctgatttccaggggggccagatggtcaggagttgactatatctagatgcaggatggggaggcaatgaaccactcactcagagatgtccccttcagaatcaggacctctgggtatgactgccttagccaggcaggaagtgcctccctgggcgtggcgggggtggctcagcatgtctgacccccagagagctgtggggccagctagccacagggaagcagagctggagaccaagtcccctctgtcctttcttggaaggacatggaagtcacgtcttaacccatagcttcatcatggccttagtggagaccagccaactgtcaggggtcatggccatcagcccccagttggctaaatggacctctgagtcctaaaaggctaattaagacctctgacttctgtgttcttggtcccctgtcatccatacctgtgctgtgattattagagcatgccttttcttccctcccaaccctggatggagggggtccacatagccctccctcaccctccttgccacagacaccaagcccttgtttattctgaaagtgtcagttgcatttcatgaactcctaagcgggaccttggacttctgactcctagaaaacagaaggcagcttctactagcaaccagaccccagctttgcactcagggctgacattctttatcgatggacctctctgtgactttatttctacatcatctgtaaaatgaggatcgagatactaacacacctacatcgcaaggatcatgttcgttaaaacaaatgcttagaataatgcctggcatattgtcagctctaaacaagcattctctgcaattactattattaccgcaagtatcatcctgagcagcccctcccatgccaccatttcagcccggcctgcatctccacccctgaggccctgcctcattcttgggtctgctctatgtcttttgtccctcatccctcctcctcctcgctcctcttccctccctgtcagtcccccgctgctcctgcagtcttgtgccgactaatcatgctgctgtcagttcagattagagcccattacgttccttcatctcagcttaaaatttttgtggtttcccaactctgcctaaagtgctccacgagggacaagggccatccagctggagggtgcttcaggaggaagaattcgggtctgtgagtcccctggtgggctttcctccttcctgccaattcgataagaggctggatggtggggagtgggcaaaggagagcagtccctcctggactgccatcaggagctcaggccccgagaccagggagcgggaggtcttggcatcccaggaccctcgaggtagactcatactggtgtcgtgtgacagcactgctctgggaccacatttggtcactccatttgagaattcccagggctgtgaaattttgcaactgagagactcctggcaaaaccactgtgctcagcccctgaaccggggtctatctccttcagccacaggcatggcctgtctttgtgatggcgttgtccatagtaacccttggaccttgtcacaagcctgccttccaacagcccaagctccaaggatctcaccagccatggggtccctcaggagccctgggcaaagctctcaggaagagacaaaagcagaagcaagaggcacgggcgggggttggatgcaaggaaggaaggaagccaagaaccacccgttttaatgctcttgttcagtgggcctggtattgagccaggactttgcccgcctcatcctatttaatttccattaacagcccctgaggtaggtgcacctatcaccacttgacagttgaggaaactgaggcacagcgaaatgaaaagcccttgcctgaggctggaaaggggaagagcaggattttgaatttacgttgcaaagcacctgatggggagagacaggagggcgacccctggcagcctcagggctgtctggctagtctcagcctctagaaaagttgggtccagaccctgaaattctgtgtctgggtcttccttgtcctgtgacttgggtattacgtgttaataatcatatttaacctttgtgtagcgcattcctgtttacaaagtgtcttccgtggcctttctttttgagcctcgccatagcccacagggcaggcaggggtgccttatcatccctcttttgcagataaggaaactgaggctcagagagatgaagcctcttgccaaggtcacagatggaagatgacccaaccagaacccaaagcaaggtcgccagggcccagctgtgcagtgaggacaccacactctgacctctttgatggatggtctgcattcaccccaccatctgcaacgtcctcagttgggccaagatctgagaggcttccaaggggtacgcagccaggggctctcatctgggcccctcaaaccttctccctcccaaagctatcagttcagttgggaggatgtcagtttgtctgtacggaacaccagggagaaaattatcaccgccatgaaatgcttcccgttccacatgacctgacagccttccagccagaaatgtccttgcatgtggcccagtctcatcctctcactaggcctggtccttctttatcccctgaccagaggactcccctctgcaggggcttcaggaaccccagagctttcttggctccaaactaaatggtctctgtttctagtgaaggttaatggcagtccttagagtttccaagttcctccttttactctttttttcttttcttttcttttcttttctttttttttttttttttttgagatggagtcttgccctgtcacccagcctggagtgcagtggtgtgatctcagctcagtgcaacctccacctcatgggttcaagtgattctcctgcctcagctctggagtagctgggattacaggtgtccaccaccatgtccagctaatttttgtatttttagtagagatggggtttcaccacgttggccagactggtctcgaactcctgatctcaagtgatccacttgcctcggcctcccaaagtgctgggattacaggtgtgagccactgcacaggcctcctccctttatgcttggtggctggaaatgtcacacccctgcctaaaaaccccaggtaagtccctcagctcttccccaccatccagcttaccttcccagacccatacctccaatgcccctcaaggtacaccacagccccatcccctgagccaaatcacctgtctctgaatgctgaccacgtgttcccagctctgtgcctttgtatgtgccagtcctactgacaatgactttcctgcctttgtccatccaactcactcctgctcagccttaaagactcagccgtagaaagcacttcctcttctgagcttccaccatcggactgattttccctttatgcctgcactagcattgtaggtgtctgtccatctgtccatctctctccccacactggactgtgagcttctatgagcaagaactggctctcaagccacctcgattcctgaaaaaattcttccccttctttctttcctccctcctctcctctctccttcaataaatatttaaacagtcctgtgatgtgccaggccaggtactgggggctcaaggatggacaaaaaaaggcatggtcctagttttcatggttgttcaatctagtggctgatgtagatcatcaaatatacataaaattaatcaaaagattcatcaccactgtgtaagtgtctgttgaagaactgcagagtgctggcttatgcagtccaggactacctgacctttctttttcttttctttttttttttgagatggagtcttgctctgttgcccaggctggagtgcatggtgcgatcttggcacactgcaacctctgcctcctggttcaagaattcttatggctcagcctcctgggtagccgggattacagaagcataccaccatgcctggctaatttttgtattgttagtagagttgggttttcaccatgttggcgggactggtctcaaacttctgacatcaagtgatccacctgcctcggcctcccaaagtgctaggattacaggcatgagccaccgcgcttggctacctgaactttcttaagaagtacctggtgctgaggagtaggttcctgtattcaaatatttcatagcaatccagcaacatgttggctgccttcttggacagtggccactgtagtttcagcttggggtcctttatggacttctgatcctttttatctatctttgctcaaactcatttatcctcatgtggccagtgtagttacagcttggggtcctttatggacctcagaccctttttatctgtctttgcccagactctttcattctccccaccaggcatttatgggtctctcctagggtagtctagcccatatcatcttgggtggagggtgtctgcctgtgggacagtgtatatgagcagagtaggggagggcaggacccccttgacttgggtagctacatgtcacctgtagaatctcctcactatggggagatgtaagaacagccattgagttccaagctgaggttggaatcctgaaaaaaacaaactggaaggctctggcttctagaggagtctagaaagattgctgtaactgtcggcaaaagaaagaagcaaagagcccaattcattctcctgagctagggcagagcctggaaaaagccaaggtggccaggggctgagggtccctggtggggccagagcatggatgtcatgcttcaagtgggcgtggaggtgccttggtggacattttcatcaagacacaaacagtgatgctgagcacggcagggttagcacagctggctcacccatggcttggtttgtaactccagaccaggatactcatcctttatttacagccagtgaattcgcccccaagatttggagaatgcttactgtgaccacttaggtgccgccctgattgcagccaacaaacacctgtgaaacacctcgaacatacaaaacactgttgggttgcgatggtataacaaattcaccctggctttgttctgagctagtcgccctgttcctttaatgtcaataccttaggtacaaagtgctgaagatgcagccacgtcctcaatggactcgcaacctcatgggactaacttcacagcgggcaatgtgattgactgagtccctttccttctctgggccttgggctcttgctctgtaataacaaggggggtcagcctacccgaccttgggttttgccaggcctcataagattccaatgtaggtttacacagaaggtcactggctgatgtgcaggggtcattaagtccccctaagacaggtgccaggaaacctaccaattggataattaggcttgccccgaccctacagcccttgagggagcagacctggacttcagctgccctccccatggggcggaagtgccggcactgcgggggtcccctggtggaatgtggctgtggtgggtgctgggacagagggcttggctgacagatctaaggctgccgcctgccaccaggtctccgtggggccgccagccggcccccctcctgtggaatgacgagctcactccccccacctggcgtttaatctttaatgcagtcccagctgccctcgggcaggacccatcaacccacccgctctgataaaagcgataattagctctttttcaacttttcacttctcccccctccactctgatgtgtgagcattgggaggattccagctaatgggcctgcccacagccaattcccgggccatgcaagccggaatgcacggggtcattagcggggcctcccgggcaggggcctgtgctcgggacgggacgtgctcgcctgtccgctctggggcatcccagccactggagagccggccggatctcggcagagcagacctgcccagacaggctggatcccaccttccttggtggtggcccctgcctgcaccacagcagagaccacaggaaggtggccttaggccctcccagcgcccggctgagaggacacggggccatcagtccccaggcatcgccctgctcccagggcagacagcccagcctgggttcagccaccggtcagtgcggaggctgctagctgggatcccccaccctagccccacaagtgacttataataactaacttgtacatggagccttatgaagtgcttccagttctgaggtagccgcagcccaaggcttaaccatgcaggctcaggagctgggctgtacgagtcaaatcctaacttccccatttgtgttatgaggacggaacctctctgtgccacagctctcacccgtgaggtggggtcagtggccgtggtgcctaccatggaggctgatgtgaagattgagatgatgcagtgaagtgcttgacatggtgcctggcctgtctgagcattctgtccccgccattgtcactatttggttctctcaataggcctctagataattgctgttaccctgccatgcagaggttcagaaaggttgtgcctgggaatttcccaagttttattttcttaatgataattgatttaaccagtcctcacagcaacgttgcatggcaggtcctgttactcccattttgcagagaagcagcttccccacggctctgtgctggtacatggtgggtgcagaaatattttctgctactccaagaatcttgccttgtttggaaccatctgctgctgggcaagcccctggtcctactgcaggtgtctgaggatccaggagacaagtgggagcagggcctgatctgagcttgaggggtgggagcctggtgctgggcagggtcttgaaggggaagctggtgggggcagagggggttccatctggggattaagaaagaccaaggccaggctgggcgcagtggctcatgcctgtaatcccagcactttgggaggccaaggcgggcagatcatgaggtcaggagatcgagaccatcctggctaacatggtgaaaccccgtctctactaaaaaaaccaaaaagaaaaaacaaaaaaaattagctgggcctggtggcagatgcctgtaatcccagctactcgggaggctgaggcagcagaatcacttgaacccgggagacggaggttgcggtgaaccaagatcacaccattgcactgcagcctgggcaacagagtgagactctctctcaaaaaaagaaaaagaaagaaagaaagaaagagagaaagagagagagagaaagaaagaaagaaaaagaaagaaagagagagagagaagaaagaaagaaagagaaagaaagaaagaaagaaagaaagaaagaaagaaagaaagaaagaaagaaagaaagaaaaagaaagaaagaaagaaagaaagacagaccaaggccaggtactgtgtcagctcatgcctgtaatcccagaactttgggaggctgagacaggatgattgcttgagcccaggagtttgagatcagcctaggtgacagagtgagaccctgtttcaaacaaacacattaaaaaaagaccaaggttagcgcacaggtcatgaactggtcaagctccatcatggtcactctcaaggcaaagcgacagcttggccctgcctatttccctccatctgcagactatgtgctgctttctatgatgtccgtcccaccacaaggcagtccttgccactcactgtcccctattcctcctggattccagcgcccaagcaggaggggagtgtgtggggagaaagtcacacagcatgggcctgggaccctgagggcatctagggctggacaccccccaccagagtccaggccaaaagaagtccccaaatcaacactattgggtcttactagggctttccagcttcaagtcaaatgctacagactgtgactctcccacgttcctgaggggactacagaagacccacaagctaatgggtgtgcccctggaggaggtcgctagataaacagaaagagaggaacttcagaagagaaagaatctgctgcgaccgctcgagtaccaagaacgcttgagcagcagctcagcagcaccaggcagactctggcttggctcctcttcctttgtttctgaccagctgcggccaatgcctacaggcttgagacctagttccagaaggcggccagcacctggaactgtggagcctccatcagtaatgcccaggatcaccagcacccagatttcccagggctaccaaagtctagggccactgtctccaatagtcattagcaggaccactgatgcctagaatccgaggctaccattagccaaggtcaccttcccctggggttgttgacatctggaaccacttggaccacaggacataggacctagaaccctggaggagtccacccagagctgccataaactagaactctaggttaccatgagccagtattgggggccatagagtcactgatgtggagtccatccttggactcacactggattgagaagcttcctggggtgatggtgcttggtgaatggcttttcttgtgcaggctctgggtgtacctttttttattttattttttgttttttattttttatttttgtagagatggggtctcaccgtcatgttgcctaggctggtctcgaattccagggctcaagcaatcctcctaccccagcttccccaagtgctgggattgcaggtgtgagccaccacgctggctacctttctttattgactctgctccatagcaaaatatcatggagactcctgaaccccttgcttctctcctacctgggtcctgggttctggctgtgaactttccaaagaggaaacaagaggtgtcatgtgggtgggtcctgcacacccaggacccaggtgaggactgctcaaggagggagggggtacatggcctctaatgtggtctcctctttttccagaaaatacactgggaagtaggccaaagggtgtcctggaggaggttgtatgaatgttccggagacagagcagagcattactggggatggatcacggggcctggcccatcctaattgcatcccctccatcccattcacccaaaggccaacctttctccacatttttcagcgttaggcactaccgtgaccttgctgagataccccaaggaaaatgtgggaaagaacttttctctttccacctcccaccctcccccagccaacaaatagatggcctcagagcctcaaaaacatgcacagaaaaagttccaaactgttaacaactgaaatcttagcagtatcaacaaataaatgttgtacatgtaaaataattcccatgggatgccttggcctgctaccccaagggtttccattgccaagttcaaggttgtcccaggaagagggctgctcagctgttctctgcccaccctggccatggcctcttcttatgagacctggcctcatctctggactgacactgtatgtgaggagggcacaagtaagacctggagaaggaaactcaacttgggaatggaggagcattagagactagggccaggaggaaagataggaagcagaggatgaggaacgacacctgaacagaaaatggtgattcttgccttgggaatcctcgagtttccagtggaatccttgcctaatgtagccagattcaacagagagtcagacaattgcatatttcaacagtaataataaccagtcataataacagcacctagcctccctcatacattgaaacattcgtccattgctggtaggaatgtaaattggtgtaacttctctggaaaacggtctggcagttcctcaaaatgttaaacatagcgttaccatatgacccagcaattgcattcctaggtatttacccaagggaattcaaacaaatgtccatgcaaggacttccatgtgaatgttcatagcagcattattcataataaggaaaaggtggaaacaacccaaatgtccatccactggtgaatggataaacaaattgtggtatatccatacaatggaatattatttgaccataaaaaggaatgaagtactgacacacggctgggtgcagtggctcacactcataatcgcagcactatgggaggctgaggctggcggatcacttgagcttaggagttggagaccagcctggccagtgtggcgaaaaccctgcctctactaaaaatacaaaataataataataataatagccaggtatggtgtcatgtgcctgtggtcccagatacttaggaggctgaggtgggaggatggcttgagcccagcggggcagaggttgcagtgagccaatatgatgccactgcactccagccggggtgacagagcgagaccctgtctcaaaacaaacaaacaaacaaaccaacaaacaaaaacaaagtactgacattgacacacagacaacgtaaatgagcctcgagaacataatgctaagtgaaagaagccagacacaaaacactacatattgtatgattccatttatatgaaatgtccagaatagaaaaatccatagacacagaaaacagattagtggttgcctaggactaaggggaggagggaatgggagtgattgctagtaggtatgggttttgggaggaggtaatgaaaaatgctctggaattactggtgatggttgcacaactctgtgaatatacactgagtatatacaacccactgaattgtatattttaatagggtgaactttatgtgaattgtatccccatagaactgttatttagaatatgctaggagattgtgttaagcaggttgattgctgttgtatttcattcttacagtgaccccacctggaattaaggagatatatagtgggggtagttaagggcacagactcttcagtcaaactataggggtacaacctcagctcattcccctctagttcagggaccttggacaagtcactcaacccccgtgagtctcagagtcctcatctgtagaatgggcacaaggatctgtatcttatccacacagcacagtgcctggggtacagggagtgcacaggcatcggtactgttagatgtagtaggaattcaacaggagtacaatttcaccacctcctcccatccttttctatatatatacatatacatatatatatatatatatatatatatatatatatacacacacacacacacacatatatatatatatacacacatatatatatgtatatatatatttttttgagatggaatctcgctctgttgcccaggctggagtggagtcgcatgatcttggctcactgcagcctctgcctcccgggttcaagagattctcctgtctcagcctccctagtagctgggactagaggtgtgtgtcaccacacccagctaattttgtatttttagtagagatgaggtttcaccatgttggccaggctggtttccaactcttgacctcaggtgatgcacccgccttggcctcccaaagtgctgggattgcaggcgtaagccacggtgcctggccctttctatttcttgagccccctggaagtacaatcacccttaaaggatgaggatggtgaagagtttggagaaggagcagcatttaggaaagagtgtatacccgcttctcgcattcaactcactgcactgtgttcagcagtacagtacaaggtagggtggggagactataatactagctaatctttattaggcactttggcagcagttgtatgtgttttttttctttccatgtcatcccagaaaggtggtttggcctggagataccattaacttattcattactgaacaccatctacaagccaagctctgtgctctgggccataaaacaaagtggggatcaagacagccaggatctggtgctcagaggcttacattctagtggggaggggaggtggataagaaataaataaacgaaaagcaatgtctttcccaatcagctgtaatgcaatggaaattaatcagataaagggggaaggactgccctacataggcattaaaagaagatttatctgaaaaactggtttctgagctaagataggaggaagatgtttgaggtagagggaactgaagtgaaaataagcccagcacatttatttatttatttatttttattttattattattatttttttagatggagtctcactctgtcgcccaggctgaagtgcagtggtgcgatctcagctcactgcaacctctgcctcctgggttcaagtgattctcctgtctcagcctcccaagtagctgggattacagacttgcaccatcatgcccggctaatttttctatttttaatagagacggtgtttcaccatgttggccaggccggtctttaactcccgacctcaggtgatccgcctgcctcagcctcccaaagtgctgggattacggcatgagccaccacgcccagcccagcacgtttaaagaacagcaagagagccaatgcagctggagctggggcagccagggagagtgacacaagctaagacacatgagggagccagggccctgttacatagagcaagcaggtctgcgtgagggacttgatttttgtattcagtgtagtaggtggcataggaaagttctccagccttctaatgggaaagaagctgaagagaacatcagaatcccaagcaataggtctagtctgatatctcttcatgcttaaggcaattgagtcacctgcaacaaatcctttggtttcccccacaatgtcagctgccttgtactgtctctgggctaaatggagcaagaatttttttttttttttttttttgagacagagtctcactctgtcacccaggctggagcgcaatggcgcaatctcggctcactgcaacctccatctcccaggtttcagtgattctccctgcctcagcctaccgagtagttgggattacaggcgcccgccactgtgcccagctaatttttgtatttttagtagagacagggttttgccatgttggccaggctggtcttaaactcctgacctcaggtgatccacccaccttggcctcccaaagtgctgggattacaggtatgagccacggcactgggccgcaagatctttaccactgggattccttctggtgcctggtgttgacccaatgaggtgagcagcctccttcctcctccctagatgctgccctcctgaagcatcttccttctgggaagtccgggtggtgcacatgagtttaggtgttatttttcccgtgctttagatcaagcccagtcttcagctgtaaattgattgtgaagaaatggaggctcatagatccctacttgtgctaaccttgtcagaaatagatgaggaatgtctgtgatgcggagggtgcaatgtgctgaaacttactttccccataagatgagatattcagagtaattcatttgaaatctcgataagggaacagtgcgtgtgtgtgtgtgtgtgtgtgtgtgtgtaagatagagacagagagagagacaaaatgctatggcaggaagttttcactcggccaagttttaacaacaaacaaggagcagtttgtggccaagcagtcagtccagggggaaaaacaaacaggcagagtgggggcttgggtgggggttgctgagaaagccaggaatgagtttatcatgctgcttctggggtgaggaagaaacacaaaacatttagatctttcacctggttgcccacagataccgtgagtagccaaccctgtggtcagtttccccttcttcctgatagagagagccctggttttgatcagatacccgttctcccctggggaagggatcgccatcttcagctaagggataaatcatgactcacctaagccaggtgtggttattcctttttccttttcagagactaatttgcacatagatgcagtgctagccaatgacagttgaagggaagttctgcctgggactgcagaaaggtctcctttctcgaaaaaggattcaagaaggggccaggtgtggtggctcatgcctgtaaccccagcactttgggaggccaaggcaggcggatcacttgaggccaggagttcaagaccagactggccaccatggtgaaaccccatctctactaaaaatacaaaattatccaggtatggtggtgcatgcctgtaatcccagctacttgggaggctaaggcaggggaatcgcttgaacccgggaggtggaggttgcagtgagccaagattgcactattgcactccagcgtgggcaacaagagtgtgactctgtctcaaaaaaaaaaaaaatgcaagaagaaactgttcctcttatacttcagttattacaggaattgtctgcagtccccagatgtgtggtagccccttggcaccatgagctgaactggcaggcacttggagggagggtcaagcagaaaaacagaaaaaatctgaattttcaatgatgcctttgggcccctgaattgaccaatccagaggttccctacctctggccttcttatgtgaaataaattttccttcttatttcaggtagggcttccaggtacttgtatcctgattgatgctgtcactctcactggaaaacaattggaaggtaagaaccatggcttccacctctctggattccagtaccctacaccaaatctggcttattataggtgctcaacaggtgggcggatgtatgggtgggtggcttaatggatgtatgggtggcttggggagtagatggatggatgaatgggtgggtgagtggatggatgggtggggtggttggatgggtgggtggatggatggatgggtggggtggatagatgggtgggtgggtagatgagtggatgatggataggtgggtggatgtagggatgagtgggtgggtagatggatgaatgggtggctgtatgaatgtatgaatgggtggtcgggtagataggtgggtagatggatgaaagggttggatgtgtgtgtgggtggatggtggctggctggctaggtggatgagtggctggataaatgtatgggtgggtggatgggggttagatagatgagttggtggatgggtgagtgactgggtagatgaatgtatgggtggctagatggctggatggatggctgggtaggtggatgtgtagggtggctgggtggctgggcagatgaattagtgggtagatgggtggatgggtggctggttagctggatatatgggtgggtgggaaggtgggtagatggatgtatgggtgactggatgggtaggtgggtggatggatgggtggatgaatgggtgggtgggtaaatgagtgagtggatggataggtagatgggtggatggatggggtggatgggtggatggatgtggttggtgaatgggtgggtggctgactggctggctggataaatggatggatgggttggtgggtgcgtgggtggctgggtggctggctgactggatggatggatggatggatggatggatggatggatggatggatgggtggatgggtggctggacggatgatggatggatggatggatggatggatggatgaacgggtagctggctggctggttggatggataggtgatgggaagatgtgcaggtgagtgggtgggtagatggatgaatgaatgtgtggatggagctcaccatctctcatggcaaccttatcacagcatctgctcttctagttctcattgtattctcaattcaggttagagtggactgaagaggcataaagtttcaaactcaggagacttgcatgaagccttcacatgaacacaggcctgttctccacttggagatgacaggaaactttcccaacaaaggcctcagaaacagtgtccttgcctggggtttcctgcagaactctgcttctcccttgaagatggggcactcccatctctttggggcccctcccgggtctctgcctcccaacacacaaagcaggagttgtccacccccaccgtaaagaaaccagctgtgggatctttcagcaggtctccgcttgttccaaagcctcagtttctacattggataaaggggaatggcagcggccctagagaaaagacctttttttttcttttttttttgagatggggtttcgctctgttgcccaggctggagtgcaatggctccatctcggctcactgcaacctctgcctcccgggttcaagcgattctccctgcctcagcctctcaagtagctgggattaaaggtgcctaccaccacacctggctaatttttgtattttttaaagtagagacagggtttcatcatgttggccaggctggtctcgaactcctgacctcaggtaatccacctgcctcggcctcccaaagtgctgggattacagatgtgagccaccgtatccagctgggatgaccttcttagacagcctgtgtcacagaatttgtagttccctttaaagatgatgcttggaataacccacttccagcaagagtggacagcagcaagaagactttgtttcatccttcagctgagtcgtaagttgtttccttttgtacatgtcacacatgaagaagagagcaagccctggtgcaggatggcacctgtggctatgaaacagaagaaaatctatggccctactagggattgacccatgaccttgaccttttgggcaaggagcaccgacagctaagccatcatccccaacagcccagtgtgcatcagatggtatggacgtgcagcctggaacagccccctggaagacaaacagccaagtcattaatcagttgctttacccctgtactctgtgtgtttgtgtgtgtgtgtgtgtgtgtgtgtgtgtgtgtgcgtttgttgggggatggggtaagggtattgtgtgcctgtgagtatgtgcccagccctccagaccagggtcctcaaagggacctgccccagtgtgaaggaaagaccccgcccagcaatgagggagtggccaggacatctttccacagcatctgggaggaacgggcagggccggatatgggctgccgaccttctcccttcctcctgaagaggaagctcctcctgcgccacctttgtgctgaccgctgggtggttacgaatgtgttccctgcctgtcgttctcttcctgagcagtgaggagcagctcactcagcccagcccagcccccactcctgagatccagcccatgaaggagctctgtgtcctggcttctgaccaggctgatgggtggggtgggaggcaaggaccagaggctgagtcaaggccttcacccagcctcttctggagcatggctccctcacctctcccataaaaaatagacataaggtcggaaaggacttccctgaactaacaggacagggcctgcagaaggcctgaaccctggccagcagacaggtgatgagcatgtctacaccaggaaggtggggaataaattttattttaaaaattaaattaaatttatttaagagacatgatcttgctctatcacccaggctggactgcagtggtgagatcatagctcactgcagccttcaacacctggagtcaagccatcatcctcatgcctcagcctcctgagtagctgagactacaggtgcatgccaccatgcccagctaatttaattttatttaatataacactccaataccatgtatcatgtgccctttataattatgaactgatattatataagcctcataacaaccctatgagaaaggtgctctgattatgcccacttcatataggaagaggctgaggcacagagaggttaagcaacttacccaagatcacccatctagtaagcagcagagcccagatctgaattcaggctgcagagttgaagcttttacctaatatgcaatgccacctcccagaggcacaaaaataaaagcattgcttgaacaccagatgtgtgccaggcactgtcacagagtcctacctggagctcactaaccaggtactctcaaatacatgatttcatttagtcgtcacaaaaaactcataaggaaactgaaggtcagactagtataagttgtaaagagtaagttgtataaagatgcacagccagtcactggcccaacacaggtctctctgatggcaagacaagatggctttcctctccaccgggagtacgtatcctagaagcagttgccaatgaagggaagaggggcttagatcattcaagtagcctgccgaggtcaacagacagcagagggctgagccaggattcaaacacaggcctttctgatgcctctatgagccactgccaaggcttggggctcttccgggcccagctcttcccaggactgcaattccccaggcggggcttcctttggaggaagaagaagcggaaatgtcatgctctggacccacctggtaaagagaggttgaccgtggcagtgagtactcggggcacctggggccagctgacccttgtgcttcagacacaggtgttgggctcggtgggaaggtctgttggtcctctgctcttacctgagcatctcctctttctctccagccccagctcttggcataaacaacactttggagaccctcagtgcaatttagctcccttaactttttttttttttaaagggctcacacctgtagctccagcagattgggaggctgaggcaggaggatcggttgaattcaggagttcaataccagcctgggcaacatagtgaaacctccatctctacaaaaaaaaaaaaaacaaaaaacccaaaattaagtaggcatggtggtgtgtgcctgtggtcccagctactcagcggggggggtgaggcagaaggatcgcttgagcccaggagtttgaggttgcagtgagccatgatcgtgacactgtactccagcttgggagacagagtgagaccctgtcttaaaaaaaaaaagtgtgtgcgctattttctgaaaaacaggagcagacaaaaaggccccatcaatttctattttgccctgggccccttaaccacaactccatttgggaatggccggtagaagagttcagtctcggcactgtgggagagcaggctggggggcagctcagcctgggttaccgaccctctaatcccccaatggtggaatgtgcttgattccaggaggctaaggtttggagggtgggtgagctgcagaggctgctatggccctgctgtttgacgcttcatgatagatgagcccccagtcctcctgtctctgtgtcccccctcctcccccaccgcccccctcactctgtgaggtctggcttgtgcaaggaagcctgtcagtgtcaggacacgttggcctcatggcccgcagcgggaagggggcctctgagggatgcctgctgtctggccctctcctcaagaggggtcctctcaccctatgcctcagggtcctgggcgcttccctttcaaagctgcaaaatgatcgccattaatgcagcttgtctcctggaggcgctgaaaatagggtaagggaggaagggcccctgactgcctggcctccgagaaccggcatcggtctggcttagttgaggctggatgtggaagagagaagggcacaggctagcttggtggatgttgagtggggattttgcccgagggggtgggagccattaggaccaccctggggactgctgtgagttcagctgtggacttctgcagagatgtggccgccatctggctgccaatgaaagaaccatattgaagcctgccatgctgggagcaggggaagacaggccacatccccagggtcagcacctgcaccttccggagactcagtgcctcccaggggcctccgtgcctcactctggccctaacctgaaagtcccattcacctccaacagaaagctcacctgggactgccctcataccccactctgagatccactctttcgatctgagggacctcagaggagcccaaatggaggagctattcagtctggaaaactggggacccactttgtacatctgcatgaggaggccctgggctgtcaggctgggagaggtgggtctggtggaagaagtaccatccaaggcagctctgccttccaggagcctgcagtctcatcagaggccaaaggttacaatccagaccagccctgagccatagaaatgtagcatgagtctcactctgtcacccaggctggagtgcagtggcacatacatggctcactgcagcctccaactcccgggctcccaagtaactgggaccacaggtatgcaccaccacccctggctaatttttaaaattttttttgtagagatgaggtttcgctatgttgcccaggctggtcttgaactcctgggctcaagcaatcctcctgcattcgcttcccaaagtgccgggattgcaggagtgagccgctgtgcctgggaagatgcatgtatttaatatgagccatgtatttaattgtaaatttctagatggcacatttaaaatggaaaaaggagcagaggaaattaatacattttatttaatccaatacagatgaaaaatatcgtttcaacataaaacataaatgtaagcatattaatattttacctttttacctttttctgtactgtcttcgaaagccagtgtatgctttacagtgacatcacatctcgatttgctctagccacgtttcaagtactcaggagctgcatgtggctaacagctagcgtattggatggcacagctctagacgctgtggcttgggccatggcaacagcacctttattttttgtttaacttttcttttaagttcaggggtacatgtgcaggtttgttatatacgtaaacttgtgtcagatattaagcctagtatttattagttatttttcctgatcctctccctcctcctcccacccagcaccttcctttcaacagaagaaaattccagatggaatgcacaaggtacagtgggtttggaggcatggagaagccggtagaacttcctccttggaggctttcagtctggactgggctgctcctcctcctggcaggctgaaggcaatctagctgagagtatggctcctgagcactggtcccaggcctgggttctagaatgtctctgtctgcagggctcacttgctgctgtgtgtgtcacccgagaggcagcatagagtaggaaggggggcactggatggggggtcaggacattcaggttccagctgggctctgaattctgcacaatcgggcagatcacatccctttctgggcctcagtttccctgtgggcaaatgagcaggaaggcaattactcaatacccccatctcccactctccccttgaaaccccaaggactcattgagtggcatgggtcgggatgatacaggatctcctgcatgctcagggcaagtcctgtggcgctctcctgggttggcactctttgccacctgccaaaaacaacctccgcttccacactggcctgacacagctggagtcaattcactgatatttactcagccctccagtgtgccagatcctccgagtgccgctgctctagtgactctcacggtggggtaaggcatcctcaccccacatggaaatggagtaattcctgaagatgtcctcttagccatcacctgtctagcttggagtagttgagcagattcatggaaagacatatgcacctctttgtcctcaagaagcatatgatccaacctggagactgattatgtgtggaaagtcaatactccagcaaggtgaatgccaagaacaatcaaggcaagggagtggaaaggctgccacaggctgagtggtcgggaaggctgctggaggaggagctgggatctgagccagcttggaagcggggacaaatcacttcagggagccagcaaaggcacacaggtgtgaaaacacacagtgtattagagcacccagcataggatccatgacttgagcccacggtcagctcatgcagtgcagggaagcagaggctccaactttgggaggtagaggtgggttggtctggggaaggcacgattccaagctaaggaagcaggagcagggagccactgatggttcctgagcaggagcatgacatgcatatggcggtgccaaggcaggtgaatgtgaaggcaggatgcttggagaggaaggtgggtgcagagggaaatggccaggagcacctgtgacaatcactgtgacaataacactcaaaatggaaagccctttcatgccccttctcatttaattctctttcaactcagtgaagtacatagaatgggtagtattgcttccttattaaagataaagaaaatgagtttcagaggaattaattgatgtgtccaaagggaccagcttggagaatcagactcaggctttgtgtctaaaaatactgaactctttctactatcccacatcttaatggtccaggaaaatggggtcccaaaaggagacagagataaccaaagaaggctccccagaggggtgaagtacattgagaggagagtagaactcagatgatccaagcatccctcagaactcttcacacttcaatactgacctggtgtatctgatccaactggtgcttacatgcccaaggtaggagtcagtgaggcctaaatttaggtctcagctggccatcagcctgctgcatagctttggatgttttacgtaacccggctgagtctcagtgttgtttctcatctgcaaattaagatagctgggcactgtggctcacgcctgtaatctcagcactttgggaggccaaggtgggtggatcacctgaggtcaggggttcaagaccagtctggccaacatggtaaaaccccgtctcaacttaaaaatataaaaattagccgggcatggtggcacacgcctgtagtcccagctactcaggaggctgaggcaggagaatcgcttgaactggtaggcagaggttgcagtaagccgagatcacgccactgcactctagcctgggtgacagaatgagactccgtctcaaaataaataaaataaataaatataaattaagatacctggatatgaggagctcgtaaggaatgaatgagatcattattagtgagagcccagagtgaccaatctctcagccagcccctcaagtctacactaggccaacccccatcgcttgatgtgacacacaagtctgttccacacccacgattgaccagaagaccaccatcctccccctgcagcttcccctagcctcatgccacctctgccttcctcacacctcctctcctgctgtcccaaggatgtgcacacctactccctgctccgtatggccccaaagagcagcgggtgcagaaggcatttctctagtctgggagggcttcctagaaatgctgctgagccctgcgaatgcctaatgaccatgggaatcatttagcaagagaaaaagccagacctttgccctggcccagctcacaggtgatggggttaatcgggaattctttccctcctcagggctgctggtaggggtccagctccccgatgacctggggacatattagtcagtgataagtggggctttccagccccttttatcctgtttacaatacactggttttccttagacaaaaccctccttccctgccttgctcctggctgttatggctacatgagacaatttgctgatggactctctagggaggacaacttccttggagtccccttcccacctcctgcagcacccggggcaacatcccctctacttggtgggtcctggagggggccacagatgcttgtttttctcagctcattgcagcctctgaattcagaagtgccaccctgtctgctcagctttaacccaagggggtgaggagaaatccagaggtgacaagatgatgtttccctggctttggggtgggagtgactggggtcattgttgctgtccagagtggaagccatcagaggtgtcctgtttatctgtgtgactcggccctctttgggtcacaaaggccagatgatccagcagctacctggagggtggtttatgacagcagcctggtcctagttcccttctgccaccaacaagcttggccagcttaggcaggtgagttaatttctctgaagtttagtgtccttgtctagaaaactggcatggtgatgcctgtcctgcctcccatgaggcggatgggagcacagaacgagccacggctgtcccagtgcctaaaggggaggcactgtatttggcactttgcactgattccaggtgacggctcttccagcaagaatggctccaccgctaagggcagtttttaatcgcctaaaagccgacttccaaataattctagatttctgaaatgccaagcaggtaggatacttaggcgaataagttaatgaaacggagtccatttccaggcaacagaagtttcacaagcacctacctcacaccgggcactgagctggataccaggaaatgcagggatgtaagacacatcttccaccctcgggctagtgaatggacaactgggacccctgtgacgagtgctgagagggagcaccagtgctaaggaagcatggggaaggggttctagcccagcctagaggttggggccatgccccaaggaaggtgaattcagaatgggacttgaagaatgaacagtaatagcttaggcctgagacagagggaagggtgtttgaagcacagggaacagtgcatacaaaggccagaagacacaaagaccttgtgaggagagctgcaattattctagttaggatggcggaaatgaccaggatgaggccagtaccgagggctctgtctgccacgatgaggatattactgtgttctctagacaccagggtgccatcaaaaggcttagcatggcaaggcaccaactgtgtttcattttttacttttttatttttatttattttgacagagtctcactctgtcgcccatgctggagtgcagtggcacgatctcggctcactgcagcctctgcctcttgggttcaagtgattctcctgcctcagcctcccgagtagttgggactacagacatgtgccaccatgcccggctaatttttgtatttttagtagagatgggtttcaccatgttggctagactggtcgcaaactcctgactttgggtgatccgcttgcctcggcctcccaaagtgctgggattacaggtgtgagccaccgcacccagcctactctgtgttttagaaagatcttttggggaactttgaaaaggatgattgaaagtgcagggggtggctgaagaatgatgtgggcatctcgatgcactctcatattttagtaagggaagtgggacatagtcacagctggccccaacggtgcaaggtggcatgtgagcattggcacaggtgggacacaatagcggggcggccaggaggaaaaataatccgaaagtgcgctgggaaggggagtgaccaggccaggagagtaggggggccactaatagtttaagagaagggataatagaattatcctatttcggctgggcgcagtggctcacgcctgtaatcccggcactttgggaggccgaggcaagtggatcacctgaggtcaggagttcgagaccagcctgaccaacatggtgcaaccctgtctctactaaaaatacaaaaaaattagccaggcgtagtggtgcatgcctgtagtcccagctactcgggaggctgaggcaggaaaatctcttgaacccggaaggcggaggttgcagtgagcttagatcatgccactgtactccagcctgtggggcagagcgagactccacctcaaaaaaaaaaaaaaaaaaaaaaaggaaaagaaaaaggaaagaaaagaaactctttgccttagccaagagaaaccacacagattgcctcctgggtctacctatacccattccaactttatctcactgcctgccaggaatgccctgtgcctgcctttccatacatccttgtagttcaaggtccagctgaaatcacatctactctagaaagtcttcctttgtcataataattcaaagggatctttctttcctgcattctgatagaacttaattgtccttactactcattacacactcgtacactgtcttgcactgttatattttcataagccctgtaccctctcatcccaactacatgagaaactctttgaggttggttatctattgctgcataacaaactagcccaaaagtcagtggcttaaaattcatccattttactatatctcttgattttgtgggacaggaattcaaccagaggctcagctgggcaattctatttcagatggagtctacagaggtcacacagtaggattcagctgacagatagacacagagggtacgatatggctttgcccacatgtatgatgccttggtgggaatggctggaagactggactcagctgggaatggtaacgggagcccctacacgtggcctttccagcatggtggcctcaggttgctgggcttcttccatgatggctggggctcccagagtaagtgctgcaagaagctgagtggaagctgcagggcttcttataacctggccttgaaaatcccagaatttcacttctttcatattctgttggtccaggaagtcattaagaccagcgcaggtttagagggaataaaactagactccacctctcaatggtagcagtagcaaagaatatgagatcatctctattttattacacaatttgccctaagacctaggcaagcagggtccctagctcaggccccaggccagattctcaggggaccccacacttttgagtgctcttcttgaaatattctaagttctcttcagtggctgggatcatcccagttggtttctcttcagagtactctgtgacccacctcttgatctgtgtggttggccaaatgccctgaggcggttcagggctcatgcctatggggttgtccagggcaacctgacaagtagattgcttctgctgaccagcacagtatttattttatggcattgaacaatactgggccactagaatggtactgattggctaatttggggtgattcacattggatatatgagttcagaactctgggctactaacagttcaccaccaacccttgaggttgagccacctgtgtgggtcaatgccctggctctcaccacatttatgaccacagtgccacctctgacatgacacaataatgagagtggatgcatcctttaacctgactgctggggtaccccacctccagctggtacaaggtgttcacccctctccaaggctttgcaacacatgtcaggcaatcctccagaagtggccacgcctatcttctccattcaagaccattatgctgtaaggccaaccagcttttacaatcaatgtcctctcttgcctctgatcaatatagtgatctcatgagatactgggttggttttaagctgttccaggtgagggccagatgttccttacatgaatggaacttctcttcttgctccacccatgggccctgagcctatccactccctcccctgacaactgatttcagtgtgtggaaggcaggggtgcagtcaacactgaaagaaatcaccttctaggaattcagtgattaaggcctaaagaactcaagagaagatgtggttggatgatatattgttgtaaacatacatataaaactctgatcggcgaaattttattcacatttttctgcatactctaagcaaaacttgccattggtgtcatcactaaagaagcacaggaacaaactttgagttatgaagccagtatttgtacgtagagtgaagaattgtgcagcatcatgagtaatgatgtaaccagcattaaataaatggcattatcaacacaaccagctgtcttagtctattttctgctgccataatagaataccacacactgggtaatgtttaaagaaaagacgtttattcagctcacagttctggaggttggtaagtccaagagcatggcaccgtcatctggtgaagttcatcccatgatggaaaagtgaaaggcagaagttagtacatgaaacagacagacaatggcagccaaacttatccttttatcaggagtccactcctgtagtaacaacatcaatccattcatgaaggctctgtccttgtgacccaattgcctcccaaaggccccacctttcagtactgccacaatggcagccaagtttccaacatatgaatttgggggggacacattcaaagcataaaattctccccctgccccccagccaaatttatgtccttctcacttgcaaaatgtattcattccatcccaatagtcccaaaagtcttaactcaatccagcatcaactcaaaagcctgaagtccaaagtctcatctaaatcagatataggtgagactcaaggcatgattcatcccaaggcaaattcctccagctgtgagcctgtgaaatcaaaacaagttatctttttccaaactacaatggtggtacaggcataggatagacattcccattccaaaagtgagaactaggcaagaaaagaagggtaactggtcccaagtaagtccaaaacccaacagggaaaacaacattaagtcttaaagctagagaataatctctgattcatgtcccactcctggacatgctgggaggctggttccccaaagctttgggcagtcccacctctacagcctttctaggctcggtccatgcagcagctctgatggattgagtctcctgcctacagttcccaggctggagttgcatactggtaggactacagttttgtggtcttggagatggctccattcccgctgcttcactaggcactgccctactgcagactatgtggtggctccaatcccacatttccgcttggcgttgccctagtggggactctctgcagtaccagctttaaataaatagcattaggaactggaggggcaaagaaagctacataggccaatacaaacaggttctgaagagtcatggtatttgaataacaatgttgttccccttttctcatgtagccagaaactagtgagaaatagcacatttgacaataacataaagagatagttcctggacccagacagaaagcgatggtgcctgaacactgtaaagaatattcacatgcacttattagacaataaacaaatatctaagtacttttctctactaattattctaaatctttgttgttaaatcactattcttcacgagtccatgaattttataacacagttttgtttgtttgtttgttttttgatacggaatctcgctctgtcgcccaggctagagtgcagcggcgcgatctcagctcaccgcaacctccgcctcccgggttcaagcaattctcctgcctcagcctcccgagtagctgggactacaggcacgtgccaccatgcccagctagtttttgtatttttagtagagaagaggtttcaccatgttggccaggaaggtcttgatctcttgacctcgtgatccgcccaccttggcctcactaagtgctgggattacaggcgtgaaccgccgcccccggcctataacacagtttttaatcaaattgcatatacagactgggcccacaaaaacatttgcttggggctccacaaaacctagatacagtcctgtcaacgtgatagataaataggtaggtatgtaggtattaggttggtgcaaaagtaattatggtttgccattaaaagtaattgcaaaaccacaattatttttgcaccaacctgatagagatatagcaggcagacacacacacacacacacacacacacacacacacacacacacatacaatttcccagagcactactcaccaatgaagtactaatgaaatagctccccctgaaccacaagggtcattggactgcagctccctccctcctacagaatgaagtccaagctccttagactgacttggccacaagctacctttctggccttgtcctttgtctttttgtgcattatgttctagtaacttcaaactgcttgtagtttcccctgcacatcatatatctttgcttttgtgtacgctgtttcctcttcctgggatgttttccccactggccttatcttccaagattcagtttaggtatcatctcctctttgaatctctcttgagtcaccaaactgggctaagtgttccctccttgtcatcccacagttcccaattactgtaccccacactcaccacataggattctaattatctgtatagatgtttacctcccagtatattaaagagcttctatggtaaggtggtgtcttactcatctttgtatatcagcccttgcattgtgcttgacacacagttatcagctcaatgaatctataatgtaggatgatttatggaaggagaccaatggactaagtcaagtggactctggtgagcctagaaaacgttctagtaaaatgaaggagaggctggagggtaagtcatgccaagagaatatcagcagtatatatcaattatccaagtggtttagccatacaagaaaaagaaaaaatgggatataagttaaaaatgcagtaagctggagagtggcattttcttctatttagaggaaggcctaaatacgtataaagacttaagagactgagaggcagaagggagatcttctggacttcaatttccttatctgccttatccacctcccagggatgccatgagacccaaaggaaaacaagacataggcatgaaaattatttgagaaattttttacattactatcctctgatagatttttctgatagcttccaactacccgcagaataaaaatctataaagaaaaacccaatctgacatttaagatttcctggccaggcgcagtggctcacgcctgtaaccccagcactttggaggccaaagcgggtggatcatctgaggtcgggagttcgagaccagcctgaccaacatggtgaaaccctgtctctactaaaaatacaaaaattagctgggcgtggtggtgggtgcctgtaatcctagctactcgggaggctgaggcaggagaattgcttgaacccaggaggcggaggttgcagtgaaccaagattgcaccattgcattccagcctgagcaacagagcgagactccatctcaaaaaaaagaaagaaagaaagaaaaaaaaattcctatgatctcgttctaacctttcttcgactactattattgccccaaacaccctgaatccagccagaggagattcatgttctttccttctgtttgcctttgctcaagctattccctcagcctcaaatgccctcctcttcatctctaccaggcagacacaataaacattttcagagtggttagtatatacaagacactgttaaaattctattgattcttgaaggtcttattcatatgctattttgtccatgaaccgttcttgcccttcccacggaaatggtactttgtatcaattgtagcatgtattctacttaataatgtagcttgagggtatgattagttctcccaacagaccatgagagatatgggaggttttagggctgtgtcttgcttgtgttcctatctccagtatctgtgcatggtacattgtagatgctcaattatagaaaaagtgaaaaaaataattttaggaaaagaatgtacatgggtggacagtctcttgggacacaaaactgggtgggatccaggatccaggaaaagagaagtatcaacttgtccaagaaaagaatgtctcctgccttgggaggaatagtagataagcttggaggatggaaacgggatagcctatgtggagacagagaagtgtccaaacccagtcccagctcaaatgccaccccttcattaagtctctcctaaatctcctcctagagacgacccccagctcagctcaatctctttggattttctaccttctagaatgtttgtcttgataaataaaattcatagaaagccattggtttggactgagctcctgcactaggcgcaacaggccaaaccaaaatagagtcactcatgctaaagttccaagccacaaagccaaaattaagctgctcatctgaccttaggagaaatcagaagagagggaaaatagccatatccccatgataaaggaagtcccttctgccttaaccaatacaagtaaaataactttgaaacttgttctttgtttctgcttttttttttcagcccttttctgtctataaagataatctcctctgctcagctcatcagaatactcattctattttatagaataaggtgttgcctggtgctagaatcgcaaatagccagttaagatctgtaactgtgttgtattaaaggagagaaggttagcactccctttgacaaggatggaagaggcccttgggcctgacaacacgcatacggttaaggcattaccacctacttcgtgggatctaaccatcgtttttgaaatggtgctgggaaaactagctagccatatgtagaaagctgaaactggatcccttccttacaccttatacaaaaatcaattcaagatggattaaagacttacatgttagacctaaaaccataaaaaccctagaagaaaacctaggcaataccattcaggacataggcatgggcaaggacttcatgtctaaaacaccaaaagcaatgacaacgaaagccaaaattgacaaatgggatctaattaaactaaagagcttctgcacagcaaaagaaactaccatcagagtgaacaggcaacctacagaatgggagaaaatttttgcaatctactcatctgacaaagagctaatatccagaatctacaatgaactcaaacaaatttacaagaaaaaaacaaacaaccccatcaacaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgaccattaaaaagtcaggaaacaacagctgctggagaggatgtggagaaataagaacacttttacactgttggtgggactgttaactggttcaaccattgtggaagacagtgtggagatttctcagggatctagaactagaaataccatttgacccagccatcccattactgggtatatacccaaaggattataaatcatgctgctataaagacacatttacatgtatgtttattgcagcactattcacaatagcaaagacctggaaccaacccaaatgtccaacaatgacagactggattaagaaaatgtggcatatatacaccatggaatactatgcagccataaaaaatgatgagttcatgtcctttgtagggacacggatgaagctggaaaccaacattctcagcaaactatcgcaaggacaaaaaaacaaacattacatgttctcactcataggtgggaactgaacgatgagaacacttggacacaggaagggggacatcacacttcggggcctgttgtggggtggggagagggggaagggatagcattaggagatatacctaatgtaaatgacgagttaatgggtgcagcacaccaacatggcacatgtatacatatgtaacaaccctgcacgttgtgcacatgtaccctagaacttaaagtataataataaaaaataataaaataaagaaaaaaaatctataactacatttcttgtaattttgtcttttgagagtatacatatcttatttcctttcccagaccagaacctctttgagggcaggaggaacccggttttccctactttacacatgacacataataaccactcattcaatgtaggtttactggatggataaataggaatggggggtagataggcgggagagtgagtagacaaatgcgaaacaggaaaagcttgcgccaggaaaaacagtgaagagcgaaatctccagacccccgattaaatggtttaaagtgaagccaagcaagaacctccagtcctctctgcggcagagaacagcagatgatagcggctcgccttcaactttgctctgaggacctctcgttagtatcccgcgattgtccttcctaacgcctgactgaatcctgaggctagccttcagcgaacatgtacaccgccttgcccttcacgtgaagccgagcctgtgactacacttatccttccgtcgccggcctcatttctccttccccttctccgatctcgcaaccactgctagtaaggcgcgcgtgcgggcagccctggccggcaggggagggagggtcctgcgaccggaagccggaaaccggaaggggggctgtgaggacgtgttccgaggaagccagagccggagccgtggcctgcggggccggcgacatggatcccctgttccagcaaacgcacaagtgagggccggtcggggagcgggcaggggctagacgaggcgaggccaggtgagcctggcttctggggctgaggcctcggacgtcagccagggtagaggccgagtttttccgccagggcactgctggggatgcctccgaagtgcttaatccttggcgggactcccaggtcagccacagacagtgggttcaggctggggcctggagacgtggggcagatgactcctggggtctgcaagttcgtgactacctgctgggtagactgggtgacgggaaactggcacctgcaggttataaaactttgtccagcacttgtcaactcggtgctcctggttggtagacctcgagaggagacacggagtaggagacacggcccctggccgtaggagtgtactgtttaattggagagtcagggcacgtacgggaaagtatttgtattcttattcgatttatactaaagaccacatttttatggtacaaagaaattgctgtccacgtagcattcactattattacttgttaatcgtatctggttacaggttatcgctaagaaaatcaaattgtaatttagtttctcataacttaaattccttggtagtgtcctttattcgcatcgtcctgcactttcggaattgctgagatacgtagttgagtattaatggggccatacttaccctatttttgggggcggggggcagaattatgatttttaccctgttttggagggacggaattttatgatttttattttttattgtaaaatatacacaacataagatttactgttttaacaatttttaagtgtacaattcagtgacattgagtacattcacaacttacatcactacgatccatttccagaactttttcatcatcccagtgtgcctgttaatcagtagcacttcatttcttccttccagaacacctagtaacctctgttttacttctctctatgagtttacctattctagatacttaatataagtggagtcatacagaatttgtccttttgtatctggcttatttcacttaatgttttcagggttcatctatattgtagcctgttaccagaatttcattctgttttatgacggaataatattccgttttatgtgtctaccacattttgttatccattcatctgttgatggacacttgagttgtttccaccattgggctgttgagaataatactgctatgaactctggtgtagaagtatctgttttagtttctcttctcaattttttgaggtatatacctatcctattgagaactttcaaacttatgctgtagttttgttgattaaaacacttaaaatcacactcccaaggcctggaaatgaaatgccctgaagcatgaggaataagagggtgatgatcctctttctctttcattttctaagtttatgggtttcttttattttggcgatgaggtgtttcatttggacaggcgaaaatacagaacctactttgtaatgacagaattttcttttacactggggagccctattctcacataaacgttataggaagggacttaaaactagtctgtgagtaatttagagaaagaatgaaacgaaattatgttcatgttactaagaaagggcctatctttcacaatagcagggcacaatgggcatagtagtgccttgaagttaatctgttatgtatggtcttatctagttaatttagttaaaggatgttgccaagaaggccatgacccattttatattcaagaataactttatttagagagtcttagactacctgttttcagtgcagctaatcacagagaaaactgcatggctcagaagaggaattctaaatggtaccccaaacaaggtgtgtggagtgtagatgctctgtaggcctccaacaatgcacccttggactctagcagcttgccagttttttctattaagggccagatagtaaatattttaggctctgtgggctatacggtctctgtagttactactctgctgttatattgggaaaacagccatagacaatatgtaaactaattgatgtacctgtgttccagtacaattttatttatcaaaacaagcagtgggccagctttgccccacaactattaggccctctgctaccccgacactcattaattcattgaatatttattgagcacctactatgtgctgtgcaccattctcagtgctggcagcacagccctgccctcgaggagtttaccttcttttatgctgcagtatcttgtctatctttcctctccagtgctgaaccaggagtgggagttctggttctagacctccttactttatttttcctcatctgtagaatgatattataatttgggctggttaaactgtaaggctcctttcagttccatgataacagaactgatgactgaatgactttcacaagaaacacgtggagtccagtgagcaccagcaatgaactttcgcaactgcagaaattagtgattgtagctgagttgacacaacagtagctgaacttattaattttactggaactttgaacccagtttgtgattatctcttgccgtgtcactgaatacattgagtacattggaattagattgacatattaaagttacttgaaaactcctgaacctacctgaacaatgaatgaatgaaaataatgaatgaatgaaaacaataaacattttacacttaaatgtttaatttagatgaactttatagaggagctaatagccaggcttctatttttgagatcccaatggttgtaaaggtgaccacatttgtcccctatgtagtccaagatcagtctcctgtcctggaccttatcgtatgtccaggacacaagaagcactacatttaacaagctccctaggtggttttgatgagcaggtaggcttaagaactgttaccttatctcaagaccattttttttcctgaacagcggagcttaagaactattaccttatctcaagaccatgtttttcctttatagattttgccctttaatgagcgaaatgtaaaggcaaagtgagtgaaatgaaaatgaccagattgttgccactacttttaagtaaagttaacaacaaacttacatgatgctgtgtaggttacacagcgttttcatgttcatcatggtcagaggcagcctggatgcaaagtggatgttatggggtggtggggggcggtgagtagtttcatgaacttttaaaaagcacttccattaaaaaattcttcctagatcttctgtaaaccttttttaaagacggctacaatgaccctggcttatttgctactatttctctgctttgttatattatcacccaagcccaccatggaccccatgctagagagggctaagacttctttttcctcatgtccacgctcccaagtcatgcttgtgtatcacctgtttcttatggacttccagtgtgttatgttgtgttagaattcccagttcagtttgagacagattttgcacttggcatattagtagttcccaccttgccattcatacttgctttgttgtttcatatttatgttttcttagcatgaaatgtagccgctggaattgtattattggccacattgtctctgattggttcaaagcaaatagagatttgatgggaaaagtcagtggattatgggcctgtacaaaagtgctttgatgaacgtcctgccatgtacatctcctcagggtatgccagaacctctctaggacacattcctcaaactgctgggtcatagcatggacacatgctttattctactagttattgtcagaaagcatttaaagtgttttaccaatttataatcctaccagctgggtatgagagttctagtttccctgtttccttattaatgcatatgtccccaaactttaaaatatttgtcagtttgatgggctgaagaaatgtgatctcattgcttttcatttgtgttttcctagttgagtgtcattttgtatattgattgaccatttgggttttcttttctgtcatttgcccttttttcatttaaaaaaaatgccttgtttgactttttgtattgatttgtaacaattctttatatattttctgcacgtcaatcctttgttatctgctgcagataccctccagtctgtgccattcatttgtttattttgtggctttggtgtacagaagttttttgttttcatgttgtcagatgtatccatctttttctttgtggtttgtgggttttgtgggggtgggtagtttttggattttgtcttatttaagaaatcttctgtaacccgaggtcatttatgcacacctgtattttcttcagaaagtttgaaagctgctctgctttttccatttgggttttaagtgagcttgagtttatttttatgtgttacctgaggtggcctttttctgtacgggtaacaaaccggagctgttggcatttattgtagtcccttctttcaaaagctcccaaataacgtggggctgtgtctaggctgtttctttcctcttgggccagctgtagggtttgcctttccttgtctgtctgcacctgcactgccgccatattgtttccattgttactgctttgtaagtcataatggcaggtgggacaagtcattcctccccctccttcttcagagtggtcttggctattctttacctcccccctttttattatgtcactgttcgtgttgatcatattaccaactttcagatttttctgttaaatcagcattgaaaatttacctcacagcctgcgtcaggacttccttagagtcctaattctcctttctgtccccgttaccctccggtcccctgtacctgttcccttggttgccctgcttcaggtgtcggctacctcaggctgcattcctacatcagcccccatacctccacacccccgcatcatcccacaatatcccagacttactttccggaagcaacggcctggtctcggactctagcagtgatttctagttgcttctcagggccacaggtcttgcctaggagcaccctggggagtcatttgacagctcacccagcttcttttggtgcccgagggcatatctggaggccatagggaagccctggaaaagactgggcacaagctgaagccaaagttgggtgcctggctggcattggtagatttggggtcctggtttgcattgctcacgatgcagaatggttgctgacctttcctccagcgttggggatgatgtgagagtccagcaggcccccttcatgtgggccctaacttggggaaatctccaccgtgagcaccgggaagtggatggtggggccagcataagcagtatcccgaggactgatcatggaggaccattaggaagggggtcttaaggatgaccttggccagaccgtgggaagcctccagagagtgttacccagatccagggtacagtgttgcatttccaaatgagatggcagttccttcgttccttgatattgtcggagaaggatgtttaccaaacagaaggtccctgtctcagggtcttcctctgaatggtttcctccagtgagtcacttcagcatcctctcccccaacccgattccctttcaagcagcccaccctacttgtaatccacatgtcttgaatgaatttttgcatatcattttcttctatcttccttcaccaaatgatgtctcccttcttcacagcgatgctcagaactctttccatccacataacttacctggtttctctttctcagccccacccctctgtctgcttgcctgtgacaccactgtgcagagctgcccctctttctgtttgtttatacttatgtgtattgcttttctcgtgaatcttcccagggcttgttcatgtctgtttagcctgtcattcctcattatgttgtttctcaaggacaaggattatatctccctcgccctttgactcttcctggtacaggccagtgcttagcacattaggtcgtagaacagaaagtaggattggccgggttcagtttgaggtttatcacttgctgtgtgatcttgaacaagttacataacctttctgggcttcagtttttataaaatgaggatgataatggtactttcctcatagggttattgatttggcagagtatcttggatatggtaagcacccataatctgcctatcagtgttattgttagtagttaagatattagaaaccatgccaaaacgtgggacctaaagtgccacatacaaattttacagttcagtgatgctgtcgatttaaatcagttacatgttggcatcagaaaaattgtctttcctgactgaagcgctgttgattactcctgtctcactcatttcctccctcttcctttgataggcaggtccacgagatccagtcttgcatgggacgcctggagacggcagacaagcagtctgtgcacagtgagtaattaactgtggagaccagagtcctttctctgatgacagggtgctaatgggctgggcttcctgactgcactctgccttgggggcttaatgattcagcgtggaatgagttttgttgttagggtggacagaaaaaccctatggcaaagtcactgatttccctgagtgtgccctttggaatcccacaagtcttatcccccattacccctccactcaacctgacatggccctatgggaatggaagcgcttgcctccatctatcttaatctaattacctagtccttagaggaatgtactccataaaaattcagagatgtttaactggaattggccatttcttctgagctgagaactgtggctttttaggaggattattcagaaacgaacagcaatattaattagtttagttcccacagcatggtttcttttgagaagcatgctggttttttgttttttttcattttttttttttttttctattctgaggaaaggtcctttttctgagttggtcatatggacaccacctgcgggggctgcctacccaccccactgctgggctccctcaggacccattcctcctgttctctcatgtctcctttcgcagcttcaaaagcagctctgttcttggttctgtgccccaccttgttctaatctcaactgtctttgttcactgtgggcacaaagggctaggaaggggcagtgtcactgctgtcacttctttatggggcaagaagcagtctggatgctttcttttgtgcacagtttagcttctttgttcatcggactttgtttgccttctcagcaatctcattgttacatgattagaaatggaaagaggtcattttgactgtcttatcgaaagggatagggaaaatgaccgtatttatcgtatctctttacctctgtggattctttcctgggcctttcctattgatatttggtttattttggggacgtcaacattgctcagcccacccattcttacagaaagctttaagggaagaaagccttaagggaactcttctctgtatgtttcacatactaatcttccccttcctttatgcttttttttttttaaataaaaaaaaaaaaactcattactatagggaattcaattggcagcctttttctaggtatttataatccacgtctgagaatcccaaaggaaaagagacctatatcagaaaatttagcttaaagtatttatttggacaacctttgcatgtttattttctaaaggtaggaaatttatttctacagatttaccttcagcttttttaaaaaattggcattgttatgtcattaacagctatatacatgtacttttttcaaaacaacatttacggcctaacttgaattttttctgttattcattagtgtatacatttttctccttttgaaatatgtagttctagtttattggatattgaaaaaaaaatctgtgatttatcattgtaatttaagttcactatctcttttccagcaattattcttttttcttttttgtacagtagtagaaaacgaaatccaagcaagcatagaccagatattcagccgtctagaacgtctggagattttgtccagcaaggagccccctaacaaaaggcaaaatgccagactgtaagtgctgacctctgacatggctctgatactccaggcccatcaagacaggcttttctccctgggggaggtgatagaatattctgaaaaccaacgtacatgttgaaaaactatgactatgcaaagaaaaagccccctcaaagggcacaattctatctgagtgatgccgctcaaaataaatagcctgtgaggtttgtgactcagaaaccttgtgaccccttacctctttggtgtcattttgaaattttgcctccagttctgttttttgactagatccatagccacctgaagcctaatgttgccatggagttttgttctgctctttggttcctgctgggttcttcttgggttgaaatgaaaaatcacttcaatcagtccacccataatgaaatgctgatctaatgtttgatactccagcatgaaattaaaatgaaaccacccttgccacctccacccccagcgcctgtttccaaaagttttatgaaactttgtggatgctttacctcaaagatgcccttgggcttcttccaggagagccatataatccatagaaggtcaagaagaggtcagtgagcctgcttcctgtcccctgttctctgtcatgcatccagaatcagagcaacagattctgaagtcaagctgctggaatcttgtgtgctaccatctcactttaaccacaagtttcttcttgactttcaacatcgttgatcaaaattagatcttgtggtgagggggtatagtgtggggtggtgtagggagaagtaaggaaacgccgtctttcctcagtacaaagcctggccccctcagattctgctgccctgagttcctggaatttaatctctctctccatcaattccagtcgggttgaccagttaaagtatgatgtccagcacctgcagactgcgctcagaaacttccagcatcggcgccatgcaagggagcagcaggagagacagcgagaagagcttctgtctcgaaccttcaccactaacgtaagccaggcccgtggtgagggtcggcctgcacttgacagatcgtgggggctggagttcagatctctgagcgccatctgttttgggggtgtctgaagaagactgatgatgaggaaaccaactggaaatgacaggaactttgtgcattgccacagagactagacctagacagagaatccctttttctaagacaaaaacctgaagaggaagcagttaaattgaaggggaataggcagaggtgaaaattacctggttgggctggtctgagacagaaaggtggaagttcacatggtggaaacgtttttctgatcagatagagacagatgattagaacttaggccatttgtagagaaggcagcatttcaaagctgcctgcgggcagttgccattgtgccgagtatgtgtgtggctccagtgtcaggtgcattaagatgtttttgcccctagtctgagcagcaatttggaggaatttgttaacagatgtttagggttagatggactgcttgcctgagtctgtctgaaagtgtgttggtttgcatgtttgatttttcagaacccattgtccctgccctttagtcttaaccagatcatttcctgcacatggctgtagaacatactggccttttctgtgtcctgcataatatattccactaaatgaagtgtgctttggctttttgtattttgtttttttacagaggattattttctaaagagatgttagctttctaagccagttgttaaaattcacatcatttcctgctttgtagatgtttaaccctcaatgctgcatccttgctttgcaataaattttcccaagtgtttcaggctgtgccaacatagtttttgcttccccagactaagcagtcaagttacagtgtttaacagttcaaaaatttaatgaactataagacacactaaaagatgtttggattttagatcgttataatgtagtattcaggccttttttaggccaaggatgatcgcttgggattattttgttttttgccagcctggcgtgatgctgtgcacaccgtcagttcttaataaacattgacttgccagatgaaacttcttcctggtcattctaccatatggagctataatacatttttctgagagataatggcccatcagccatactgttttagatgggagggtaagaaagatttgtatgtgaatggcatttcataagtgctagtcaaattactgaagagaagtctctgagtctttcaaacgccagcatcttctgacacactgggcattagctgcatgcagaaaactagttaattcaggcactaggagtaaagcacatgatgaaattaaaagacctgacgcctatctgtgaggagctcccctgttagcaggggcagttgaaaacacgtatgtgcaaaatgattccaaatctgagcagcaaagaaacagtggcataaccttttttttttttttggacaattgaaactggaatttaggtggtaaaaacagcactagtggagcagggcacaatgacacacgcctgtgatcccagcactttgggagaccaaggcagtggattgttcaggagttcaccatcctgggtgacatggtgagacattgtctctacaaaaaaatataaaaattagccgggcgtggtggcgtgagcctgtggtcccaactactctctggagcctgaggtgagaagatcacttaagcctggtaggtcaaggctgctctctatcctgggtgacagagtgagagcctgtctcaaaaaaaaaaaaaacacgaaacaaaccccagcactacttggcaggagagcttgtgattggcagaaaagagaagggaacgctctcacagctggcgaggacttggctcctgcctatagtccactttcagagcaaaagtagagccaccaggatgggcgttggtgtttccctctacagtgtgggtaacagggcaggccctgcgctcagtacccacattcccagctccactggacttccagctctgtgatcactggacacacttccagctgtgtgatcttggacaagttattctacctctctgggcattttttcatctataaaatggggaggcctgtggacagattccttgagcacaggagttggagaccagcctgagcaacatggtgaaaccctgtctctaccaaaaatacaaaaaagagaaagaaagaaagaaaaaagctgggcatggtagcatgcacctatggtcccagctactcagaaggctgaggtgggagaattgtttgagtccaggaggctaaggttgcagtgagctgagatcgcgccactgcactccaccctgggtgacagagggaaaccctgtctcaaaaaaaaagaaaatgcagaagcacagcctcctctatccttagttaactctcagtctacttggagaggtaaactatagataaaatagctaaaggacacgagcaaacatttaacactgcattaaggggaagccatggaaaggaacatttggaaccagctaggttagtgagtagtcagagaaagcctttaggagacacccaatgaggtcttgaaggaatagcttttcctaagaggagatcatgatacagagacaagtatcgttggaatgaacgatacttgtggagtggaactcatttggagagtgacagatctgaggaagttcctcttctgtgtggacagaggccaccccaggcctttgctttgctttttcttatccattagggtccgctgattctttcaccagcccctccggctgttctggcttggccttggccaaaagacagagcagtgagaccccaggaactgactgataagcaaagttaatcaagtgcctgtgtttctttcacaggactctgacaccaccataccaatggacgaatcactgcagtttaactcctccctccagaaagttcacaacggcatggatgacctcattttagatgggcacaatattttagatggactgaggacccagagactgaccttgaaggtggggtccctgctgggggacagagagaaggcctcttgttttagcctcatccaacagtttagtaactgtgtttatattttgattacgtgtcctcaaattgtgatattttgatgacaagacagagcccttgagtttgggatcctttctgttggagttgagttattgtgagcctgaaagtacccagttcctttgccagtgcttgaaacaaaccatgaagtggcctctcttaggatccaggtcttttcccatttactgaacttatcatgaaagtgagtgctactacgaggggtccaatcacaggctgagaaattgtgttacagaatctactcttggaagaatgaagacgtggctgtcctttggtacctcgctttaaggtggctttcccttaggacccctactgtggactgccttataactaaaaccttttgtattttagtaactgaatccccactgtgcagtgttagggctgcctggttgtttgcagtagattagagctttagaagcttctagagcttctaaagcccgtgctggtgatcccagcgactcttcactccctagccttaggtattcctagaagccctgaccagttggcactgctgagactccagcccctgggagtggtttacagaaacattacacagactctgatgtcagtcatgatgtttcagcctctgcccttttcctgtatcaaccctgatggataatagggcgtgggttctgtctgttatcagggtgtggtcccctgtgaatgaagcactcccagccactgagctgtgagaaacagtcactcggaagtgtgagctttatcttagtttttgttggatcatgttgagtctgtcagctccacaggacttcagtacgtttctgaacagtccctgccatctctacgggggagagggtcaggcaagctgcaagtgacactcacctcctgctgacagttgcagtgtctcagatggcctggaagggtggtctccagcagcctgctgggcgctcccctttcatgagagccacctgcagtgacctgaactgatacatgttgattagtctgccctttctttagaaaactgctactctccttttcatatctcagaaaaacagtagaggccttttaggaccaaactccatgtcacactgatgaagagccagtgggggttagagcgtcctgttaaggcacatgctaacttcccactcaagtctggcagcgctggggcatcagcacacctcttgccacccacactgataccagaggggaaggctgtgaggtggctgggggttgagacttgaggtttctaactttcctctgcacacctgtggctacctggtgtttgtctcttgattccctccacctgcctcacaccctgcctccgtcgggattttccacctacaccattcaaaaggaacataggagagggcatgaaggggctaggctgaagcactctgatgactggggccaatttgtggctgaaaatgaatacattttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggcaatgaagtttgacttgtaatttctctggctgaggcttcttaattgctttctgggcagaatgtagattttggattcctgtccatgatgcctaatgttgatctcactttccttgtttctctcagttgctcattaatgtgtatttattaaaaaaaaaaaaaaaggatatggggcatgaggttagatgccatgcatataagttgcagtgggtgatatgtgctgagtgacttggggtctgccccggcattcacttatacttgtttcttactaagaaattgaatgtgctttaagctgaaaattagaaagcagtagggaaggacaggctggatggtttgggttgttggtttaggaataaaatgcccttttgttttggtggtgggtgatgccatctatagaagggttttaggtcattgtgttggtgtctttccgtctttcccacttgagaccctcttgtaaatatggacttgacccacccattgtactcagaagaaacctcaaagattgtactctacaaagtaaataggttggtatcaatgattattggaactagagagccgaggacaagttttttgatgttgccttctttttatagtataaaatattctaattttaagtatttttgttgagatataatttacagacagtaaggtatacagatcatatttttacaattcagtgaatttgggcaattgtatcagcctttgtaactcacactcccatcaaggcccggaccatttcacctctgaaagatccctcgtaccccttcccagtcagttgacccctctgccccaggcagccactgttgtgatttatttcaccatagatgaggttttcttgttattgaacttcatataaaggtattcatgctactcttttctatgtggcttcttcctcccagtatgtttccaaggttcattcatattgttacctatttaattccatgttggtagtcaggtactttttattgcaaagcagtattccattggtacaggtttaccatagtttgttcattcatcttgtgattagtgacaccattgttttcagtatgtatttatttatgtattttttgagacagggcctccttctgccacccaggctggagtgcagtggtgtgatcttggcttactgcagcctcgaactcctgggctcaagtggttctgtcaccttagcctcgcaagtagctagaaccacaggtgcacaccaccacacctggctaatttttttttgtagagaaggggtcttcactacgtgcccaggctgatctcgaaatcctggcctcaagtaatcctcccacccacccctcccagagtgctgggattacagggatgagtccctgcgcctggcctgtttgcagtttttagatattctcctgtgtttttttctagaagctttaattgtggctttagcttttatgtttaattctatgaaccatctcaaattaatttttatgtataatgtgaattgaggttcaatttttacacacatatctgtaagagagatacatatatataaaatacatacctgtgatattatatagtcagtcgttccagcaccatttgtggaaaagacttttctttccacttagcgttgctctggtaccttgatcaaaaatcagtcgacgacatgagagtggctctatttctggctgatattgctttctgtgtattctgggcatgaccaagagaatgtctgttggcaaagctccatctcctgatgccattcacccactcttggtaaagcgacttgatgtttgtttttttttctgttctcttctgccccaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacatagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcctacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctggctgcttcagaagcagtggggaagctttttaaaattacatattcctggggcctaccccagatctgaattagaaccttttttaaatctctaaggtgattttattttattttttatttttgagacagtctcgctctgtcacccaggctggagtgcagtggcgcaatcttggctcactgcatcctctgcctcctgggttcaggtgatcctcatacctcagcctcctgagtagctggaactacaagtgtgtgccaccatgtctggctaattttttttttttttttgtattttttagtagagacagggttttactatgttgaccagattggtcttaaactcctggcctcaagtgatctgcctgcttcggcctcccaaagttctagggttacaggtgttagccactgtacctggcctctaaggtgattctgatgtgtgtattttggaaccactgtctcctagacagaaagcttctgtctcaaagatgatcacattggtgtaaagagcaaaacttgttaagtccaaaataaattcttactgtttatatcctaccttagtccaaaaaagatttgaggagactttgaggaaataactgaaacagatacaaagaagtgaggcacaagaacaaatcaagtcagtgtagaatgtcgacatcaggacaaggaactcaaacgttgtaacaccctaagaaatgtttggggaaccctaatttgactttcagctccagtagccaaagcaaagaaagaaacgtcatctgttactgtctcaaccggggggtgacattttctcaagggaaagcctaggcccttcataaacagcttgcctgtaggcctcacggaggtcagacagggattttcctggctccatccctgccaatctgaaaccctctcacttatgttctccatcatttatcctcattatgcagacaaggggctgagctgtggtgactgtgaaggcctcacaggagtccgagaggagctggcccctcatccagcttggaaccatgggcccacttaatctcccacacttctcgtggggtgctctgctggggtctggggggattgagaggtgtgcaggggactgagatggtgcagcctgctggcatggactatagagctataaggtgtttgctgcagacccttcagatagtatagggcaagttccctgttgggaaataatttcctaactggaaggggagggaatctgaagtgaaagctgtcctcaggccttgcccctagggggcggcatagccctatctgtggctagtgggccctgaacacactgccttaggcctgctgtacttagaagctgagaaaggaaagtgtcattccttccccattttctgtgtccttttcatttcatatggaaggcacatgggagaggagtgttcaggggtgctgggcccccaagtgctgttggtaagttccccaccatggagcctctgtgagccatccctccccgcctcatccccatgtccctctagtacagggttcccaaccttggctctgcattggaattccctcgggagctttaaaaacccatgtgtgggtcttccattcaccctcttattaattggcctggagtgcagccggggcattgggagttgcccaaggcgattgtaatgcccaggggtagggagccgatggctctaatacaagaacatcaacccaaggctagcccgtcccccatgcacttcccctggccgcaccgtgggaaccacttgcagagaccaactaggggcagggatggaagcctgattctccctctggatcagaaggagccagatcccttgtggccattgggtgcccctcattaactgacacctctctgctgagtaaagcaccttgatgtgacaggccagctcttcgctgcccctgcagtgcagcccccagccctccccaccacccctgcctggtgttccgtcctccctggactgcttggtcttctcagaacatgccacacactcagtacagctgcacctttgcacaagatgtttcctctcagatgtgccacaaacacccccacaatcccatgaaacctccaagaagcctgcccctcccctccaaacaacctcatactgcacgcttcctgcggaatgggagttgctcctcaccgcaggggcctttgtgcatcccgggcacgtagtaggcgcaggcgccatcgggtaagcggctgcaggagagcacttgagcccatcccccatgcagggccagcaaagctgttgcagccaggccaggaggaagccagaaggttcaaggccactgatgctacgagccatgtgctcacagggcctcaacaacagcaatgactgcagtaaaagaggagaggcatggggccccgtgagggaaactgtcactcaggactggggagagagaagtagagtgaccaacttgtctgggttttaaagctgaaagtcctgaatcctggcgatccctcggtctgatggtcaccctagataagctaaaggctaggacaggcgtgactaatgcagggtatctaggaagagggggctctcggaggctgactcctggcttagcaattccattagtgtggttccactggcccttccttccaggcatctgtgacatggtggctcctggagagctggcagaggctgggccaggcccaggagggaagtattccaacctcctcagaagacagtggctgacagtacaagaggggacattcatctttattccgtcttccagagccctggcatgtgtccagtgccagtgttagctgtttcagggcagagggaaggagttggagacaagcagccctccgcagtttgcactggttacagcggccggaggctgtggtaagagcgctgagcccaggatgcagagcctggcttcaagtcccagccctgctggcagcaaccacgggccacacacctctcagcctcagctttctaagaatgggggtaacacctgtcccacgtccctttctggggtggacatgaggcccgagtcacgtagtgcttttggcagattccagaggtctgaggcagtgaccctcagcctgggctgcttcctggagtcccccagagagtttggaagtcccgattctgggcctcgctccccagagatgccgagctacctggtctacagtggggcctgggcttcagaatttttaattttcttttttttttttttcctctcattctgttgcccaggctggggtgcaatggtgcaatctcggctcactgcagcctctgcctcctgggttcaagcgattctcctgtttcagcctccggagtggctaggattacaggcacccactaccacgcccggctaatttttgtatttttagtagaaacggggtttctccatgttgggcaggctggtctcgaactcctgacttcaggtgatccacccacctcggcctcccaaagtgctgggattactggcataagccaccgcagccggccttaatttttaactttctaaggagtctcctgtgaggtcgagattgagaaccacggctgtcagtgcatcccaggtgcaatggagtatcattcctgttcagctggaaagacaggatctactcgtgaaacaaccgaggttgagaggtgatagtttagtgcggccattgtggtgggggcattaaccaggaagagctttctgtgagagggcgaggtgatgggtgtgtgaaggacaggagatgatgtgggagcagtcgaggggcaggagtggcctgggggagggaggaagctctaaccagccctggctgctgtgggctctgaggcctgatgtgctgtcttctgcacgacatcctccacgcactgtcctccgtgttccagctgggaaacttgctgctcagaggcctgagttcatgctgctgagatgctactgagagctggagaagctgtcaggctggtgtgggtgtggacaagccctactgtcctaggaagacctgcccatgatcttttgaggtgcaacgtagtgtgatgggggtggtgggatagtgtttgagatggggttggcagacatggcgtagaatcctgactttgctgtttattagcagcctaaccttgggcttaatcactccagcctcagtttcctgtctgtattcagctcaaaacagaattgcatctttgctgggtggtaactcatcagagaggaacaggcgtgggctatgcagaagggaagcagttctcccttctttccagcccgagcaacaggatccacattctttcaaccaagaccacttggccctgctcacctcctggcaacttctggcctcctctaagagtttcttgtgccccaggcatgtgcagggactgaggcagaagctcagggagtggggacctctataggaggggagaataatcactgctgcccccaggacctcaccaggtggttgtgaatgtcaaaaggtaaaaccctggagataaacccctgatcgctgccgggtgctgtccaaattattgttgctatgtgcatggagtgggtataaattccgtgtccatggtgatttcttccaggaaaccatttcttttttccccctgtggcaaagggcagcctctcttacctcaatccaggggccctgggagacccttggaaggcggggcctccagggctgaattccagaacagcagctgtggccacctccttaggccacctgggaatcaattctctgtcgtcactcacttggaggaaaccacatttaaattaaaaatgtaggctgggcgcggtgtctcatgcctgtaatcccagcactttgggaggccgaggtgggcagatctcctgaggtcaggagttcgagaccagcctgaccaacatggagaaaccctgtctctactaaaaataccaaaaaaaaaaaaaaaaaaaagaaaagaaaaatgccaggagtggtggcgcatgcctgtaatcccagctgctcgggaggctgaggcaggagaattgcttgaacctgggaggcggaggttgcagtgagccgagatcacgccattgcactccagcctaggcaagaagagcaaaactccgtctcaaaaaaaaaaaaaaaaaagtaggtggcctgggatattccctttgtggaaaaaaaaaaaagaaatagctcaagctcagtattgcagcccttaaacagaaaagtaattaataattatgagaggccaggcatggtggctcccacctttaatcccagcactttgggaggccaaagcaggtggattatctgaggccaggagttcgagaccagcctggccaacatggtgaaaccccgtctctactaaatatacaaaaactagccaggcaagttggtgtgcgcctgtagtcccagctacttgggaggctgagacatgagaattgtttgaacccaggaggcagaggttgcagtgagccgacattgtgccactgcactctagcctgggtgacgaaatgagactctgtttcaattttaaaaaaacaaaaattatgagatgtcgcggggcagcagtcaagtgccaagcaagtggggtagatatcagagggtggagagcccacccagcagtgagaggaggctgcaactgactgctgcccctggggaaggtgggacgggggccagattcacaggggagccatgtgagcttggttctcagcaggctgggtttggagtggattgtggaaagagtagggacgtattagggtgaagctggaggtgggtgtggaggaaggccaggggaccctgacatgaatgtggatgcaggaaccctcagctgtctctgaaaccaggagggctggggaaggaccctgtgcatgtcctagattctgtggccccaggagttactgctcaggaagcagggcagcctcctctttggtgtatgtgtgcaagagagaggtcgtggtgggctgtgggttgttagtctctctcccaggagcacctggcaacctgaactacccctgctccctccccaccctgccccagatctggtgaaaccaccaaccaggcggaggcagggcagaggctgtcactgccacacaccttcagagctccctacaacttacgttcatgctgctgagatactgatgagagctggagaagctgtcaggctggtgtgggtgtggacaagccccactgtcctaggaagacctggacatgatctttttaggtgcagtgtaatgtgatgggggtggtgggatgatgtttgagatggggatggcagacatggcttagaatcctgactttgctgtttattagcagcctgaccttgggctaatcacccaaacctcagcgtcctgtctgtatagtgagaataataataactacctcaagtggtagcaaaagtgcctgtatttgagagcttgtccgtcactagaaatagtttttttttctttttgagatggagtttcactcttgttgcccaggctggagtgcaatggcacaatctcggctcaccgtaacctccgcctcccgggttcaagcgactctcctgcctcagcctcctgagtagctgggattacaggcatgtgccaccacgcctggctaatttttcgtgtttttactagagacagagtttcaccatgttggccaggctggtctcgatctcctgacctcaggtgatccacctgccttggccttcccaaagtgctgggattacagacgtgagccaccgcgcccagcctagaagtgatttttgtcaggagacagaagacctttagtgattggagtcaagcaggtggagtgtgaagatcagctctgccctttagctgtggaaccttgagcaagccacctcacctctccacgcctctgttctgtcaccttttggagatgaataatgcccatctcacagggcagctgtggccagtgcatactgccatgcctgtaaagtgcctactgcacagcccaggacatagaaagatggtaactgaggttttgttgtggttgttcactagcattgcataggacccaggtctgatcccttcattcagctggtgtgattgtgagtcaaggatctgatatccccaaagaaaggactgcaagtatttgccagtcagactttatttgttacaagatacgatattgcacatgtattcctgtgttcttcatcagaagacctgaattcaaatctccagttcattacctattaggacttgctcactccctctttctctcccagcctcagtgtcctcgtaggggaaatgggaatgctaataatggcctacttcacagaactgtggtgaagacaaagccaatcaagcatgtggatcagtgagtatgcgcagggctgcaagggccagaaatcccaggatcttactgctggggttagatactgatctaaggagcttaagtagtaagaactgtggatgtggggcagcctgcagagctggttgatttagggctcggtgacatcatcaaggctgggcttgggactgcctgggttccctgagaggcgtggaaccatggtgggaagatgtaggaaagatgaggatgatgattgacagatcagtctggaattgttgcctgctaaagttcattcatccattctttcgatagctacgaactgagcacccaccaggtgccagtcacgggactgggccttggagaacagacgtgacccacctgcattgtgatccactgctgtgtaacaaatcaccacaaaacataggggctgacggcaatagctctcagttgctacacctcacagcctctgagcataagaactggggaccaggcgtggctgggatagctgtctctgctcagcgatgtctggggcctcagatggaagatttgaaggctgggaggagaatcatctgaaggttcactgatgtggctggcacacagtgtcgctgggcacacaatgtcgctgagccctggactggggctatcctctggaacacctgcacacggcttctccatgggaccagggcttcctcagggcatgatgactgagttccaagagtgagtatcccaagggagagagcaggtgggatctgtgtactttctatgaccaagcctcggaagtcatagggcctctgttctgccatactcctttggccgtggtgatcacaagccatatggtcacaagcccccagctgcctctcagtgggaagaatgtgggtcacattctaagaagagcaggtgggatggaattgacacggtgggtggccatctttggagagtacaatctgccacactccccttgaatgatgctcacgtctagctgggaagacatacatgagcatgcagcaataaagtgcacaaaccgtcacacaggtacaaggtgcttagggccatggcagaagtagtatctacttaccctggaaccctggaggaggcttttgagctgaatctcagatgagtcagactggagcaggtggagcctgggcggacggtctcagcagagggagtcatctagcaaaggggtgtgctctgggaagggcaggaggattctgtggctggagctcaggcttcaggttcagtgtggaggagggaagaaaggctgcagaggtaagttgaggccagacgcggggtgcctaagagcagactcattagtccctgccctcctccagtccctggtcctctgcacacagtaggcacttcataaatattgattgaaattggagtgagcagtgtgtgttgaagaggaaaccaaatcccaaagagaggccgtggggcctcctggagggagcatgggataaagacagggagaacccactttcatatcataggaacttgagattctctttctcagttgttgcctttccagtatttttcaatgtctctgcaagagttcacgggggctgagagcagcccctgagtcacttctcgttcctatccctcacccccagctggattcttgggtcttcttccctccatactggtccccagagagtgtggactctctgcctcttgtaggtgaggaggaggcggctggctgaggaggtggcagaggcaagtgaaagggccaggagggtgaggatggagagaaggggagggaaaagaaggagatggagggggagaagatgaagttgctaagtgtatgatcagtgccagagccaaaagcccatactacaaattgctttttccttcacacttgtcccagggaaaggcccaattaaaatagcacctattggaaatggaagggtaattggaccaggcagcttattaggcccatctccaagagcattcaggggcagccatgagcttcaggaatttccaccatgtgaacttagcgggggagatgaccccgagcagcaagggctgacaggatggggctgccccaccatcctgcctgcccggggccctgctcagtggcttgagagggcagggactggtctgtgtgggggcactcttctgtggtggggtagttcagtgggctgagacatggggctgatgagatcaaaactgtccagttccaaatcccagaacagaggaaaagcggggccagaagtggtcttggggaccaccaagccagactttctgggggagaatgacttgccaagggtgacccagtcggtgatgagagatctggagtcagagggggaagtcaccgactcccaatccagtgctgctgcccagggacagtctcaccatgccacgctgtcctaaactagcctgtggccctcgccccaactacacgcccatggcctgtcactgtaccatgttcatgccaggcacagctaagtcagggtggcaggagccacgccaaaggcttctccagcttgagggcatcatctctccacacccctcagttattgacagaaactggcacacgcactgccagaccacgctgtccctaggaggaggcagacagaggtggacgcagcccacaggcttggctggaacggcgggttccagaggtgcccgctggccgcccacagtgaagtctggtaggggtggcactctccccacaggttacccattggaccagagctcatccacccagagcccatttccatgacaacagcaagctccttacccatcaatttcatccttaaagattcccaccccagctttctgagcctgggctcctcgcccagctgccgcgccagcccacgtctccagatcacaggtttagcagtgacttgtcaagctgccagagagagcctcctgggaggtgccttttaactggcgtagcccttgaaaacgaccatataatcacctgctaattggattaggaacttgttcccagggactttcttttgcccccatgttgaggccaccctactccattcttccggaacttagcattggagagcttccccgttcccctctgcacaacctcccaggccagggtaatgctgacagggttgccccaaagtcagatagtgacacaagaggaaaaggaaacctctaattttctggggcccaggtacactcagagaggaaaaatggcccagggtgggagaacacacagggccctctcttcccccactctgcccgcctttcagccttgcaagaaaatctggcttttccctcggggtgtttgcctcgctgcttctcccccccagacatcacctccctcacagcccagctccatgttcacccccaccaggaagtcttcctttctaaaccgtttttctctgcatcctctcagagtggctatatttggttcctgcaatataacttcgtatatattgcatcagggagagggggagattcctgaagctgggttgttattttttgtgaagctatttttttggtgcattttctttctattccagaaaattcttatagtgggtggatgtcatttatctacccagcatctcgtctttggactacaaatccttatccccttctgctggtgccattgtctctccttcctgtggaaaacctgtgccacgggactcagcgagggctgcctcctccagcagggtcagcgcctgaagcaggcctggtccatgcaggactgggtcagcagcccaaagcagtcggtttggggtgaccacatgactgcgcggtgggccgatcagaatcttccctggaattcccatagacactgctggtttcctgaccaacatccattcctcccctattctcactagctacacgccacttttgttgatctagcaagaagtccagttgaagatatttgtgcctctagactttcttgcaggtaggggtcaggtcacccaattctggtcaataagatatgggcagaagttgctgggagagacttctgggaaagggtttcaaaaggaacatggctcctttagtccactcttaactgatggctgagatggagacatcttaacctgaaggcttttattccagctatgtgagaggccacctgagaataaagtgatccgagaagaaagcaaaacagagagagagacagagaaagagatggcaatatcagttaagtccctggattgagccatgcctgaagcctcagaacttcccaatttggagagccaatcaataaatccttttcctacttaagctggtttgcactggatctccatctctttcagtgaaagacccctcagtgcaaacctccacaaaaccaaacccatgtctttccctgcctctgttctctcctcccaagataccccacataagatgctcgatgcaaagctggcacacaatattcattcaaatgactctgagccccccaaattctttttgtttttaaattttattattattttttatttttttattttattattattttacgtaagttttagggtacatgtacacaatgtgcaggtttgttacatatgtatacatgtgccatgttggtgtgctgcacccattaactcgtcatttagcattaggtatatctcctaatgctatccctccccactccccccaccccacaacagtctccggtgtgtgatgttccccttcctgtgtccatgtgttctcattgttcaattcccacctatgagtgagaacatgcagtgtttggttttttgtccttgcaatagtttgctgagaatgatggtttccagcttcatccatgtccctacaaagaatatgagctcatcattttttatggctgcatagtattccgtggtgtatatgtgccacattttcctaatccagtctatcattgttggacatttgggttggttccaggtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccgccaacagtgtaaaagtgttcctatttctctccagcagctgttgtttcctgactttttaatgatcgccattctaactggtgtgagatggtatctcattgtggttttgatttgcatttctctgatggccagtgatgatgagcattttttcatgtgtttcttggctgcataaatgtcttcttttgagaagtgtatgttcatatccttcgcccacttgttgatggggttgtttttttcttgtaaatttgtttgagttcattgtagattcttgatattagccctttgtcagatgagtagattgcaaaaattttctcccattctgtaggttgcctgttcacgctgatggtagtttcttttgctgtgcggaagctctttagtttgattagatcccatttgtcaattttggcttttgttgccatcgcttttggtgttttagacatgaagtccttgcccatgcctatgtcctgaatggtattgcctaggttttcttctagggtttttatggttttaggtctaacatgtaagtctttaatccatcttgaattaacttttgtataaggtgtaaggaagggatccagtttcagctttctacatatggctagccagttttctcagcaccatttattaaatagggaatccttttcccatttcttgtttttgtcaggtttgtcaaagatcagatagtagtagataagcggcattatttctgagggctctgttctgttccattggtctatatctctgtgttggtaccagtaccatgctgttttagttactgtagcgttgtagtatagtttgaaatcaggcagtgtgatgcctccagctttgttcttttggccttggcaatgcaggctcttttttggttccatatgaactttaaagtagttttttccaattctgtgaagaaagtcattggtagcttgatggggatgacattgaatctataaattaccttggtcagtatggccagtttcatgatattgattcttcctacccatgagcatggaatgttcttccatttgtttgtgtcctgttttatttcattgagcagtggtttgtagttctccttgaagacatccttcacatcccttgtaaattggattcctaggtattttattctctttgaagcaattgtgaatgggagttcactcatgatttggctgtctgttattggtgtataagaatgcttgtgatttttgcacattgattttgtatcctgagactttgctgaagttgcttatcagcttaaagagattttgggctgagacagtggggttttctagatatacaatcatgtcatctgcaaacagggacaatttgacttcctcttttcctaattgaataccctttatttccttctgcctgattgccctggccagaacttccaacactatgttgaataggagtggtgagagcgggcatccctgtcttgtgccagttttcaaagggaatgcttccagtttttgtccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacgtttattgattttcgtatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgccagagccccccaaattcttatctcaacaagagtcaaataaagacttgaaaagacttgacatctaaactacacttattaaggaaaaactcattaattccctatggagatctgaggccaagcacacctctgaagcagtgcatggcttggaatcctgtctgctcttcaccgaaccattccttctgcactcacctcctccagaaagccttccaaaccaggtcttaactccatcatcctaactaccttgtcagcactcacttttgttaacactttgattcagcagtacttgggttccatgagtatttgagcatagttgtgtgtgtgtctcatctctctcaccccaaacccactccaccccaccctaccctaccaactgactctcctgaactctctagagcaagagctgtgtctccatcagactagcaacttcctgagggcgaagactctaattccttatcccattgggatccagatgctgtctctcctcacatcagactgggaatggaaaatctttccatgccccatggagcctccttggcaagacaggaagatacggagtctgaaccccatagagatggagagtgggaggaagaaggtagccgggagcagttagcaggagggtccatcttaaccttcagggaaaaaccgattcacagcacataaagctagttctggatcagaatctgttattcaacaacacttgcaagggtttaactcagatcctgtcccctctggggtagaaatctctacccgcctaaggccaggattctgccttgccagtccttttttttttttttttttttttttttttttgagacagagtttcgcttttgttgcccaggctggagtgcaatgctgccatcttagctcactgcaacctccacctcccgggttcaagcgattctcctgcctcagcctcccgagtagctgggattacaggcatgcaccaccatgcctggctaaatttttttgtattttcttagtagaggcagggtttctgtctctactggttggccaggctagtctcaaactcctgacctcaggtgatccacccaccttggcctaccaaagtgctgggattacaggcgtgagccaccgcacccagcccttgccagtgtttcttatttctcttgtcccttgatgattgtgtaatgatgaatcccttcgttaggaagcttgtcaaatgcaagtagacgctgagggggcggccatgtgtctactgtctcgtggctcctgttggatgggagtagcctgcgtggctgccagtgctggctggagaggataccaccatctgctctcgtcagcatgctgccctgcctttgagtcccctcactcccgccccaagactaaatccttgaaagagcagctccacagcgagcatgtggcaagaaaggatgctaatggagggaagaaagtgatgaatccccaaaagagtcagggaaagccacacaagaaggaaaaatagctgcataaaggttgcgggggtgagctgggcgaggctgcccgctgacaggtgaatcaagactccagagagctgggtacggtggctcacacttgtagtcccagcactttgggaggcccaggcgggtggatcgtgtgaacccaggagttcaaaaccatcctgggtgacatggtgaaaccccgtctctacaaaaaatacaaaaattaggcacagtggcatgtgcctgtagtctcagctactttggaggctgaggtgggaggactgcttgagcccaggaggtggaggttgcagtgagctgagtttacatcactgtacaccagcctgggcaacagagtgagaccctgcctcaaaaagaaaacaaaaaaagaaacccaggctaagcgctgtggctcacgcctgtattcccagcaatttgggaggctgaggcaggtggatcacttgaggtcaggagtctgagaccagcctggccaacatggtgaaaccccatctctactaaaaatacaaaaactagccaggtgtggtggtgggtgcctgtagtcccagctacacaggaggctgaggcaggagaattgcttgaacctgggaggcagaggttgcagtgagctgagatcatgccactgcactccagcctaggtgacagagtgagacttggtctcaaaacaaacaaacaaacaaacaaacaaaacccagacagcaggaagcccaggtgaggagaaggggagaggcaaacaggacatgaaggaagatttgtttggtagagagaagggaattgatggcagccccaggatgcagtttgaacctgtatttggtagaagcagcgatggggaaatgggccagatatcggacaggagagagacatgatacaatcagtgctaatgatccagacatctccatggaggaggatgagcactcaggggaaacggaggcaaggcactcacccaggacgctgcagcagggatcagtgtgcctagcatggcaatggaagtgagagggagtcggagatctgactgagcgactcctaactttgagagttggtggctcattcccaccaaggggcttatggctgctgctttgggagtctttgctgccaaatgtcactggccgggggtcacctcacccgtaacccatggagagtgggtctcctctccccatttgtgcaggactttctttccattggcagcaactggccagggggcctcagaggagctgggaatggggagcaggctgccaagaaggtttggtcaggccaaccaacttggagggcagggaaagaagtggagccgtcaaccttcacattttacaggcatacaaatcacacaccaaataaggagaaatatgggacacatttgcacaataattcaagacaggatctccatggcaacaattacccaaaaatccactcctgacagttgcaacagcgggagctagcaaagaagactgggggtgggaaacgtgtgtgggggctcagagaatggcttccttttattctcgaactgaaggaagtgctgacggcaggaagcaaggtgtctcacagcctgactaagccaagagccactggaagtaggatctggaagaagccttagagacgtctgtgtgagctccttttgagctgcttagaggcctgggtgtgggataccacagtgagatgtgccagtgggatgtgccagctcaggggagggggccatcagggcatcgccctcccaccactccctctgatggacaagagttctccctagcctccagaggtcctcacaggggcacagtgagagatggagccaacttccggcgaagtcaaaggttctgggacatttaagtctgcctgaaaactgagtccagtccatagaaagctgacacatgacataggttaggagaacggagctctagcctgctctgctcccctcccagacttgctgtgtggcccctcagtttcctctacagtgaaatgtacaacctacctccaagaactattacaaggctgagtgaatagcatgagatgggaaatgcttttaccaaaatcactgccaatgcaaaaataagaggtttctgtgcagccatgaagagtggcctgagaaagatagctgcatgcaaggctgtccttaacaggcagaggagtttcctaggtcaggtgagagtcagtacaaagactgtggtgggaatctagaatgtggctaggcagcgatactgatgagatggtgggaagtaggaggttgggcgtagtggcagaagtgtcacctgtgtcctaccaccagacagatggacagactgactgtgagctcagagcaggcagtagagtgtgtaacctccaatttacaaacatttttaatcacacaccaaaaaggaaaagcattctgctttctttttggagtaacataaatccaaccccgttccccacccacatccttttaagtgtatttctttttgtctggtagtcctcaaaagccattggctatttttcagatcctagagctcagattgccttaaatcgcttgagaaaggagagttttttcatctttctttttggaactaagactttagagcaaaggaaaaggttcttctgggtttcatttgcatttggaagcccaggtttttgggaaaaaaacactctcaagagcttattactattataaatgtttagccatgtgatttttcctcaagagggcacccaaaacttttcataccaactcccatggatagcagtccccttatgctgaattatggtgggaaaggattaaggtaggacatttcttgagcatttttttcctattctgggctctctcctttgccatcccactctccactacaaaacttttcccttcccttttgtctcactaaccatggaaagtcctccaatccttggaggtcctcagaagccattcttcccaccactggagctgactttcttccctctcctggactgagcaggaagaccgattcatgagagagctcctctaaaggaattcaggctgggccctgagacaggacatcatggagtggactttggagtggccacaatagtccagatctggtcctcagcagtagagtccagaaacttggttgggccaggacatccaaaagttgtcagcctctcaggactgattcaggctaaccaaattcattgatgggcaaccagaatgccatttcctgaataatatatctaccaaaagactggtatccaaaatatggaaagagctctcaaagctcaacaataagaaaacaagcaacccaacttttaaaaagcaaaagacactttactaaagaagatatacagatggcacttaagaacatgaaaagatgctcaacatcatcattcaatagaagacaaattagacacacaatgaggtgtcactacacacttggcatacatacaaacaaacacaacacaaaatctgacaatatcaagtgctgacgaggacatagagcacctagaatgctcacacattgctggtggaaatgcaaaatggaacagccactatgaaaaacagtttggcagtgtcttacagagctaagcgtgtgcttcctatatgacccagcaatctcatttctaggtatttacccaagtgaaaggaaaacttttgttcacacatacataaaaaaactctacatgaggatttatttgcaatcaccaaaacaggatacaacccaaatatccttcaactgaagacagataaaaatttaaatttaaaaacctgtgatacatccatccaatggaatattactactaagcaagaaaaaggaacgaactactgaagtgtgaaacgatatggatgcattaagataagtgtgagaagccagatggaaaaggcagcttattgggtgattccatttatttgaaattcaggaaaagaaaaaccacagggacaaagaacagatcagtagttgtctgcattaagggaagaagagtttgtggatttggctacaaagtggcagcatgaaggagtatctcgattgtgttcatgatgacacaactctaagtatttgtcaaaatatatagtgctctacgtcaaaaaagtaaattttaccctaaatttgaaataaaaataaaaggcatttataatgactactttggggagagtttaaaaaaaacaaggtgggaataaaatactagacaaaaataacttggtagatgagagagataattagaatgtaaacatttaaagtcctgattttgccgaggataaaggtaaagatattgattaatttcagacttttggaacaaggatgcttttaaaaatggaagggtaaccactaaaaaaacagaaataatatgtataattttcaaactagtagagactatgaaagaagtaagagaagaaacaaatatctgtaattttagcactttgggaggctgaggcaggaggatctcttgaggcctagagttcgggactagccttggcaacatagtgagaccccatctctacaaaaaacaaaataactggaacatggtggtgtgcatctatcgtcccagctatttggaaggctgaggtgagaggattgcttaagctcaggagttcgaggctgcagtgagctatgatcacgccattgcactccagcctgggtgacaaattaagactctgcctctgttaaaaaaagaagcaaatgaaaagtgtagcaacagcaaatcagtaggtaagatgatagaaataatccaaatatattagtgatcacaataaatgaaaagatgaaatacgtctgtaaaaagattatattttttaaaaaaggtccagctgtatgatgtgtacctaaaatataacgacatagaaaatttgcaagcaatgagttgaagaagagatacacaaagaaactaaccaaaaataaagctagtatagaaatattaatatccaacaaaatgtacaccctttatctaatgcctactgtatgcagagccctgtctgaagcctgtgagatgacacaggagaaacagaaacatgactgctaccctaggggattatagttaggggctgaccaatgattccaaatcattttatttaatcaacaaatacttgttcaaaaactgtgcaaatccaaaaacatgatatttctaaaatgaggataagggagtggggcatagttggaattccaaaaataaaaataggggccaggcacagtggctcatgcctgtaatctcagcattttggccgaggcgggcagatcatgaagtcagaagctcgagaccagtctggccaacatggtgaaaccctgtctctactaaaaatacataaaaaattagccgggcgtgatggcatgcgcctgtaatcctagctactcaggaggctgaggcaggagaataatttgaacccgggaggtggaggttgcagtgagccgagattgcgccactgcactccaacctgggcaatagagtgagactccatctcaaaaaaaaaaaaaagtattgatcagtgtagtagttgattttcaaagatacccccaatgaaccatgcctcccagtgttcatgcccttgtttagtctcctcacacatcaaatctggactggccctgtgactcattttaataaacaggatgtggcagaagagaaagtatgctgattctgggccaattattgaggtctggaaactgcttttgcacttttgggaagaaagctgccatacatcaagtatagctatgctgctgtctagactgtgtggagaagccacatggaggaaatgccatgagttgataaggagaggaaagaggtccagccatctcagcagagcccagccttccagctgtccctgccaaggtgccagacactctagccagccaagtccttgaaggttgcagttcctgtcagtatcacgtgcagcaggactgagcagttgagcccagttaacctgcaggatcatgaaagataatgaagtggctaccataaaaccagaaatttctgggagtagttatgcagttatagataaccaaaagaatctctttcagtgtgtgctagaccctctgctaactcatcattttcatcaatgatgtgatttaatcctttcaaacatacttagaggtatgtataactaactcccattttataaatgaagaaactgaggcttggaaagaatgccacatggctaataaagaatagaagcagggcttgaatcaaggaagtcttgataagggacttcacactctcaaccactgcattatgtggccaagtgggagagctgagggatgaaaaacacaagacatttcacaataaatcatgatgtctatatgagcaccctttaagctttctattccttgtctttcttcatcctgtgctactgaccaggaaagtggattctataaagatgatcagttaagtaggcagatgacagccaggtgcagtggctcacgcctataatcccagcactttgggaggccaaggcgggtggatcacttgaggtcaagagtttgagaccagcctgaacaacatggtaaaatcccatctctactaaaaataaaaaaattagctgggtgtggtggtgggtgtctgtaatcccagctacttgggaggctgagttacaagaattgcttgaacctgggaggtggaggttacagtgagccaagatcacaccacgcactccagcctgggcgacagagtgaggctcggtctcaaaaaaaaaaaaaaaaataggcagatgatatagttggagattttattatagtttggacacacttcataacaagcactaatcatcctcagtgttcagttgtcacttgagaaaatgtaaatgctacatctgctcactgcctgtcttttcttccagacaaagaacatatgttcttgacaagggagtgtgccttgttccccacccacagtcaccactggagaagcttgagttttggagaggtggggactggctgaattctctttttttctctttttctcctttttgtttttaaagagaatagcatcttgctctgttgcccaggctggagtgcaatagcacaataagagctcactgcagtctcgaactcctggtctcaagtgatcctcctgcctcagcctcccaagtagctgagactacaggagcgtgccatcacacctgtgtaattgacttattttttgtagagggtctcactttgttgcccaggctgatctcaaactcctgacctcaagtgattctcccacctcagcctcccaaagtgccgggatgacaagtgtggctgagttggtatgggctctcctttccccatatccaaggcaagcttccaggattcttctgggacatcaggtgttagggaccatcttagtccctacctcagtttcacacatgagaaaattgaagtccacagaggaggtgtggcttcatcaaaaacccactgagaacgagtgttagaatcaggctaggacacattggactcctcctccagggctctctgacatccaaggccctttgaaatctctctccagctgcaaacagatttctagacttctgatggaggtgatctgagatgagcagcctctaaaagcagcctctgcgagcctctaagagcagccgggacctgctggagaacagaacatggcctaggagcgcaacagccaagtgttcagcaccacggacagcttcgctggcctattgctggggaggccagaggtggggaggctggttgtccagcaagacagagtgccatgggagagagaaaaaaacatgggaaagatctcagagaccatctagtccagcctcctcgatttggatgggaggagacccaggacaagagagaagtgacttgtccaaggtcacacaacaagtcagtagagagccagagatgggagctgacagcctacttcctcacacctcttcaaggccctcagatacctggtgtccatgacttattagtggcacagccagaccttgattaagggctccaaaattaaaattacctgtccttggaaatgacaagaaaagaaaaaaggagaaatcaaagaaatggaaagagcacccggccctgatgggaaggtctgtgatttggcctctaactgcaaggctttgacaggagcttcctactttccaaggtgatgtggcctttcagaaacaatttagttaccatggcaacctcattccaggtttcatctccatggcaattcactggagtttttcaccctccggtaagtacatgtgtgatggcccagacatgtatcccagaaacattaatataaaatcacatttttagaagtggagtatctcattatcctagtctgcagccagaggaataacaaggcatgttctcgggtgggcagggcccagggcatagtggaaggatgtctctgggggcagctctgccttctcactgcaattgcaaacctgtcccagtctttacagctagtgcatctcaacctcccatgggtacaaatgatttctccttttctgcatcctccctggtgccctgctcatgacaaagcctgagtgttgcctgtgctgacaagaagtgctgggacaaggagagagaaagctggtccttctgactatgacttctgtggcaccccagggctcctgcttccctgtccactgtgccccagattggggcaccctggagcagttcccagcttttgtgttggaccttgcttgtctgatctgtggactgtgggcttccccctcaacgtgacctaatctgccatccaatttccaggaaatcctcgtggtttctgctccacccagggcaccccttctgttttccagcaatgctatgccttctctttcttttttttctgagacacagttcactttgtcacctaggctggagtgcactggtgtgatcacggcacgctgcagcctcgacctcctgggctcaattgatcctcccaccttagcctcctgagtaaatgggactaccggcacacagcaccatgcccagctaatttttgtattttttttttttttgtagaggcggggtctcattatgttgcccaggttggtcttgaactcctggtctcaagtgatcctcttgccttggcctcccaaagtgctgggattacagacgtgagccactgtgcctggctgctatgacttttctttaatatgtcctgctgtttataatgatgcagggctggagtatttagcccaccatcttgacctaaccttctctttctttctccacttttaatgtctataaataaccatctactaatctacttataatatgtctaacgatggatcatttctctcctcctcatcttcttcatcatcgtcaccagtagcagtagtactatttcgtgattgagggatcaccacagagtaagaagtgctcacaaaaatgttccatcaacatctcaaataatgagacagaaaaatcaaggcatggcttcatttaaaaaatgtaattgagagtatgaaatgtactagctatgtaccttctcagaccactttttttgagacagggtcttgctgtgttgcccagggtgcagtgcagtggcacgatcatggcccattgtgtgacctcctcacacctcttcaaggccctcagatacctggtccttgtgacttatttagtggcacagccttgacctgctgggcttaagcaatcctcccatctcagcctccagggtagttggaactacaggtgcaccccaccacacccgattaattttttgtattttttgcagagacaaggtctcaccatgttgcccagaatggacccgaactcctgagctcaagagatcctcctgcatcagcctcccgaagtgctgggattataggtatgagccaccaccctgacctccaaataccttttgaactcaggcttggatttgaactctggttctatcaactattagctgtgatttcagatcagtgacttgagcaatttgtgccttgtttcattaagtggagatgacaatagcacctgccttgcaagaattatttgatgtggccgatgagaaaaatcagaattatgaaaagtgcttcacaccattcctggcatgtgaagagccctctctaaatggccattatgctaattagcaccttaaagggaaatcattttcatgaaattttatttgaatctggctagagaaaatgctcaccttcttccttgtgttttgcttatttgattaaatgtctttgatttctgtgatgtgtgaagtcccttgaaagcagggctgtgtgtccaacaaaggtttgtggccttcccgcagtgaattgtgtgggaaatacaaacacagggaagacagttctggtcctcaggggaagtgtagtggggaagacggacatgagaacctaaccataacaggatgcagagcgaggcatgtgccatgcactgtggccgtgttacctcctggtttggagtgtgagctcagacaccagtctgcctgggtttggatcccagctctgccacttattggctgcacaacctcaaacaagtctcttacccttgctgggcttcagtttcctcaaatgtaaagtaaaaatggtaacaggagagttaatacatgaacagaggctaacacatagaagggctcaatcaacattagctgtcattaccaagatatacgaagatagtatggaggggatatgtgagaagtgattataattctgtttcatgggtgaggttgtacttgagcttggtcttggagggtaagtagttctcaaagggcgaagagaaggagagaggcattttgggggaagcagagcagcaggaacagaggcatggagtgtgaactctgcagtgttctctgggtacagcatgggggctggatcacaggtgcatggagagaaatactgggaaatgggccggtgcagagggtttaggacagcccctaggaggtcttgaaaactggctcaagcattcagacagttctgtagacaacagagactgactacaggctactggagagaagcaacatggtgccacctgtgttctgggcaaatcaccttggtggcagtgaaggaaagataaagaggggggtagggggcccagagaccatttgggggctatagcacagcccaggcaaaaatgtcaagagcttaagcagggaggtggccaagagggagagccactgtgaacacagaatccgacaggcttggtgaaggagtgggcagagtcagacagggtttcctgctaggtggctgggaagatgacagtggtgatgctcttacagaatcaggaccctgggaagaggaccagcctgggatgggggccttcttcagcttggggcatatggcatggcccagtgcagacccttgtatgtccctcactgctgttccttctcttcagctccaacaagccccatagagcaccctgcaccagtcaggcactcagtgaatacctctgagtaaggaaccacagggaaggaggcgtccagagacctccctgctccaacttcctccattccagacccagcctcttcctctccctccgcactgtggacacccctgaacatctcctcctgtttctgaatctttagggaaaaaatgtcccaactctgtctctcagcactgcctcctttctctgccccaacccactgaatgtgtgactcattcccacgcttacatcctaaagccctgcctggggtgtccctccatgcggggaccgctggagcagagaccatcaccatcataacaccctccaccagccacccagcccctgccatgggaagagcaccatgccaagctcatcaatcaccatcagatcctctcgacaaacacagaggatgggctttctgattcccattttagtgtgtgactcagagaacttagttggcttgctcttgcgcacacagctggttctgtgtaatcatacagcttgaacaggtcccctgccctctgcctgccttccccaccagcacctctacaatggccatgcagatcttcaggacacaaacagaaagcaggggctacctgagactggaacatcagggcatctcttgggatcagcaccacctgcagtcattgaatgcagaagggccttctaatcctgggacctgtccagacccccaaggattctgatgtaattggtctggggtgcaaccccaaaagcaggacttttaaaagctcctccaggtaattctcatgaggttgaaaaatgattgttctaatgggtcctaccctgaaagcatccctgccgacacctgccccccaccacagtcaccgtggacctgctctgctgcctccgtactgagcttctcatgctggatgcagccgggccatggcacaggtcctcacagccaccggcctcccaggagaagcggaagccgatctcgctctggctcccctccactctggctcccttttctgactccagatacttctctccatccaccttcccaggtttccagagccttcttatggtccaaagctccccctctccacaaggggaacactctagctgcccttctggagaggactgaagaccccaagttgactccctggtccttgtgccccctggggggccactgagagccgggcagggaggctggctggtgtcagcaggaaggagggtggtgggccaggtggcagagtggccagaaaggaggcagccttcaaatgctggttccgccacctcctcccactgggctgtttcccctatgtcacagtgagagagctgcacaggaccccagccccaccctgcagaggggccagagttgctttcttatgcctggagaccctaaacaaccgtggaacgatcaggcttccctgctccaggctgggaccagcctctgtcctgatggccagaagctctgatgagcaggtatagacagcagacagtttccttattcagcaataaggacagtgtgcttggtggataaatgccttaaacacggaagagttcacgggaatcaaaacaatgaaagaggcttggcaaataacttcaaaccagtgagatgggtccccctctgtggggactcccaggcctggcctgaagatttgagtgtataggaaggcatgaggtcccccaactctcccattgcaagagaggtgcttgttacctttcgcgatccccttgccccctctctggtgcccactttctcactctgcatccctcaactcccacctctgccccagctgccctggtgatgtgcggggtgggggaacaaaaaacacaggctgtgcaagcagacaccgggggtcaaatctcctggctctagctgactacagctaacctctctgagcttccagtttctcatctgtaaaatgacgatcatccccagcatagagtggtgctggaggattaagtaatgagataatatctgtaaagcactgtgcttagtgatggagatcagtaaatgtggttccatcccacggctgtcctgcctcatctcccccatcatctcaaaacaggtacagcttccatcctaaagcattaagatgcttcctgcaaaaagatctcaagaaagaccagccgcggtggctcacgcctgtaatcccagcactttgggaggccgaggtgggtggatcacctgaggtcaggagttcaagaccagcctggccacaatggtgaaaccctgtctctactaaaaatgcaaaaattagctgggagtggtggtggacacctgttatcccagctacttgtgagctgaagtaggagaattgcttgaacctgggaggcacaggttgcagcaagccgagatcaagccacagcactctagcccaggcgacacagactccatctcaaaaaaaaaaaaaaaaaaaaaaaaactcaagacagcagaggagagacgctgcaacatgaggactccagccacaatcagtcgtcagctgagcttttgcatcaaagcctgtctgcgaggcaggggtgtgcactggagccgctccactcacgtggacgggggctcagagacccggaaacagcattatgccccataataggggatcagtgatgtttgcataaaagagaaccaggtacaagcctgagaaggatggcttatgtggatattagttactgacatgaacctttgtcatcatacactgataagtgaaaaacagtatcacggtatacgttcaaagtggtgcatatgctagaataacattttctggagaaaatctcaaacctaattctatcgatccctcaaaatatgaaaggctgcatgccaaaggattaatagtgattccttctaggttgcaggaatgtggctactgtttgccaacatttttcttttttttgttgctataaatgttaattacttgtatcatcgctttaaaacataggccggtgcggtggctcatgcctgtaatcccagcacttacagtggatcatttgaggtcaggagtttgagaccagcgtggccgacatggtgaaaacccatctctactaacatataaaaatgagccaggcatggtggtgggtgcctgtaatctcagctacttgggaggctgagggaggagaatcacttgaacttgggaggcagaggttgcagtgagctgagatcgcactactgcactccagcctgggcaacagagcgagactccttctcaaaattaattaattaattaattaaaaaggaaaaatataataaggacacactccatggcttctgcagtctcttctgagctgatagtcaaggtcctggcatggcttggctctcctccagtgctgggttaggggctctgtgacccagtgccccaccctagcctggcctaactatatcctttgctgaccttgaaccccacacagatcctggcaaagctgcatggctccatgaatacatgtatgtacatgtaggagcttttcatgcactttctcacttaaactttccaaccacctagagagctcagctagagtacctcactttacagatgaagaaacaggccttggaaggtgaagcgactttctctgatgactggaaagtgtggagggaagtcctgcaccccgacctgcctgtatcaaagacttgtctctcacgcctcaagctctgtggttctgtgcacacctcaccaggcccccactcacccatctaacatgtgtttgttctgtgtgcatgtttttcttctgtgttctgggccacacctgttgggcacctctccctccccggcaagggggaagctttaggaagtagagagaaaggcagggcacagggcctggctctgaggaagggtcacacttacagccaggcctggggctggtggggtaggcagagggcacagggcacgtgggggagaggggggaccttcccaagacagggaactgtctcaaccataatcaccctcagtgttgctgcttccccgctttatgttctatagagacacccggaggggacagcctgctgtggtgggcactgtgctgggcccaggctgtgtgctgacagaaccctggggctgggctggggcaggaggcgagaccctggcttcctgctttgcttctcccgccacccgcttcttcctcctctcttcccttctccttccatcccatcttctccctgctgtcctttcatatgcttcctcttcccccttctttctcctcctcctcctctcccttcttcatttctagtccagctatagtgggaagaagtccctgcaaggagctctggctcttggccaagagggaaggagaacctgggacaggaaaggattcccagcaaagggttgcacactgggcaccccgagcccttgctgaacctcagctttggagcacaaggtggaattcaggtttgtcagcctccccagctcagcagggaaccagcagtctgcacaatgtgaccgttggtgacggatgttggcctctgcccatctggctgcattgctgtcaacatacaggttccatgtcccgggctttctgcccaggcactcccctgcaaagtgagccccaggagaaacccgggtttacagctgctctgtagccccaaaccctgtaccccactggctgacgctggctacccaaaaagaaattattgaggcacagaggatggcagcactcaatctcccgtgtggacgagcgtctctgcagtcatattattagcatctcgagggcagagcctgagttgccttcacctctgcaacttccttagcacccagcattaggagagcgacataagacacacctaaaaaatactggcactgacatgcaaacctaggtcttgtacgtcaagtttattaggagtgtaaaacttcttgtagtattccctctaacttagccaggtgggaaagtgtcaaataaaaaggacttcagtgggatttctgagtagcatccttggaatctgcactcaagggatgctactcggaaatcccactgaagtccttttaattaaatgtgtgtgcatgtgtgcaacccacatgtgtacacgtataccttgcccccaaaactggaatgccggatgagggccatttctgctgtacccactgcctctgccactcattagctgagtgtgaccttgagcccattatctaaccacacaaccagatgacaatctcatatgacagctggcttgctcactctcactctgctgctgcttttttctttttcttttcttttttcttttttgccatatagatgggggtcccactgtgttgcccaggctggtctcgaactcgtgggctcaagtgattcgcccaccttagcctcccaaattactgggattacagggatgagccaccacacctagcctctgttgcttcgttgttgaaaattgttgagatctagcgttccccatgggttaaactctccttatccatggactggagtgcacttatcatgggatctcaagtctaagtaatagaactatgactgcaagggtgagcaggcgctgcctcagaacaccccgcaatgctgtcatctcagaggctgggacacctgccccgtctgccgagctggggtttgctgtcctggacaccccgtgtatctgctgtgatctttattgacaagaaagaatcttgctttcttgacaagaatctgcactcaagagatactactcggaaatcccacttaagtcctttttattaaatgtgtgtgcatgcgtgcgacacatgtgtacacgtatacctttcccccaaactggaatgctggatgggggccatttctgctgtacccgccacctcgcatgctccattctttgcctctgaagccacccccaaagctcaaggcttctttccatctactactgagttggggtctggggagggcgacccccagcagccacagccgtgcacccctctatgtgaacttggcttagacaagtaagtaagaaagtaagtggatgtggtgatgtaagccctccctacttcccccgttctaggggacatcttgctggtgaaggcacagctgaccccagaagtactatccccgactcagaggacaggatgtgggggatttgacctaggccctgagacgcatggaaccagctacctggggagcaaagcaagtgccagggtttctggggcgctggccagggccagacgctaggtctgccatccgttgctcacccagtgcctggcacagtgcctagcccacaggagatttacaatagacaccggtggaatgaatgagcttggacaagatcagtaaacagaatcttaatttcctctcctataaacaggaaattagaggagcatctgctcctcttaccaatgtgttgtggggagcaaaggaggtcatctccgccgggcgcggtggctcacgcctgtaatcccagcactttgggaggccgaggcgggtggatcacaaggtcaggagatcgagagcatcctggctaacacggtgaaaccccgtctctactaaaaatacaaaaaattagctgggcgtggtggcgggcgcctgtagtcccagctactcgggaggctgaggcaggaggatggcgtgaacccgggaggcagagcttgcagtgagcccagatcgcaccactgcactccagcctgggggacagagcaagactctctctcaaaaaaaaaaaaaaaaggtcatctcaagtgaaactgatttgaatcccagctctgcccctttctagctgcgctacctcaggcaacctcttggagcctcagtttcctcatctgtacaatgggaggagctacaaaaccttcttcgagggagtggaagctcagtgtttggcatattaggcattcgctactattttcgtcatgcttatgaaagtactctgaaaactgcaaatgcttttcaaatatgaattactattttcttttttttttttttttttttttttttatgtccagggaatccatttcagagaaccaaatgtactttagggaaagagttcatacgataaacaaaactaacaataaccctcattgtccttattgagcgtctattaaatgccaggcattgtgccggcttcttcaaacacatcatgtcgtgaaagctatgggtcccctatcgctcctattttgtaggtgaggaaaccgaggcacagagaggttgagctacttctccaaagttacagaactaggaagcagggcagccaggattttgaagaccaggatcccaggccttctctcttgtgaacccaaggccctctgagatttatcggtgcatcctgggaagagctctcaatggacagcagttgtgggtgagtggggctttctagaaccatcctccactcggatggctcaggattctgctctgtctggctctgccctggagcactgttcctcattcactcttaccttatgtaactcagtgttcccgccccctgccccaaggattatataaggcagcccagtaaacaccctgcaggcctcaggactcctggggagaactaagacggtctacaaatgtgacctcttgccctcaccccttctcaggaccccactcttgctggctgtcttcctcctgaggcacaaggctgcctgtgcctgtgtgtgtgcctgcttgtgtgagcatacactcacaccatgtgcccacgtgtgcagacttgtacaccacaggggacccaaacacacgttagtacacacgcgtcttcactatttttttaaacagtgggagaatcctgcaaagtgtccccactaaggctttccttttcagcaaattcagaacagttaactttgctttgacaaggaactatgaaagaaagaaagaagaaagataaaggaaggaaggaaagaaaatgataaaagttgttgttgttgttgttgttttggagacggagtctagcactgtcgcccaggctggagtgcagtagcgtaatctcggctcactgcaagctccgcctcccgggttcacgccattctcctgcctcagcctcccaagtagctgcgactacaggtgctcatcaccacgcccggctaattttttgtatttttagtagagaccgggtttcactgtgttagccaggatggtctcgatctcctgatctcgtgatctgcccgcctcggcctcccaaagtgctgggattacaggcgtgagccaccacgcctggcgataaaagtttttaaaaaagaaatttggctgggcgcagtggctgacacatgtaatcccagcactttgggaggccgaggcgggtggatcacctgaggtcaggagttcgacaccagcctggccaacatggtgaaacccggtctctactaaaaataataaataaataaataaataattagccaggcatggtggcgcgcgcccataatcccagctattccggaggctgaggcaggagaatcgcttgaacctgggaggcaggggtttcagcgagccaagattgcgccactgcactccagcctgggcgacagagtgagattccatctcaaacaaacaaacaaaaaaccaaaaaaacaaatttaactcttgactcgttctcttctcgccccagtcacatttagtagcagacctattttattagaggagagttctcgcagtgttcgccctaacttggcccggtggaaaagcgtgtaagcctgtgttctttctgaaaccattttctggtcatttgggattttacgcaaatgcctgtagctgtctgagctgcattccccaaaccactgagggcagcccagactccagataactgcaccacctacatgacgaagccacttatccaggttgcctgagtcactgaaggctgctgtccccagatcaggctggacttcctgcaagtcacaccaaaccatcaacagaacattctccacattcggggtttttcccccagagacactttacaaggagtgtcagttcctcccctcactggcctggcctgaattctcccaggtctgagattgggacgaccagggttgggggatggggcacatcctgatcatgataattctgaccacacaggagcacttgggagccaggacgactctggatccttcatagccagggaccatctgtgccttcgagaaactcccccaccccacctgtgccaagcctctccctaatgaaactagtgccaaatacacgggatcgcattcccttcgcttctcttagctaaaagcagctaagacttcagtcaccttcctcgttattcttcactcccacccacagcaaaagagagaagaaagggagaaatccagtctctccccgaccaagtcttccaagaaccgcttgagcggggttggcactaggactaagtgtagtgggggatacataggccagaaagcccagccttctctcctccagtgtccccaggtccccctgtccccaacttccagaaagcagagctgtcctctcgctgtccgctagggagtagccagttcttgctgctccacactgctgcaagggaagttagcacctgcaggaggcgtgggtttctgggcagctggggcatcctgtaatgggaggctccaagtcccctgcaggcaactgcgtttggaggccattttctccattgtataataaacatcctgggacttcctcaccacaaagccgccaacccccacccctatgggatgcaacaagggggtttcttccgtctactcatctgtccgctataagggtagggacaaagcaagcccttagaaggggctttggccttataattaaacttttaactagatctagttttcccctctgccaaattgaattttccttgttcacattttcttcgttttggacacagctgactgattttgtttcatctcatattagactcatatatccagtgatttaattaatctcaccagctgtctggctgtcccacaggacctgccttctccgctgttggcgttagaaaacgattccctttgcctttcctcgctctggcctccgcgtggagccccaggatccttgacctgacctgtgggctccccagccaggcgtccacgcaggggctagatgtctcccacggggctcaaagtgtccgccaggagggtacatgccctccgccccgcaacacacacacacacctcacaggcgcgggtgggaagctgcctgaagccctacggctgcagttttattacaagatttctttccaaacgcaagatcaggccaacaagctcagcgactctgacgcttcacatcttcacccactcgcaccgtgttccgaacccacccgcaccaacgtacacacaaaactcccacgcgagcgaccgcagtcccaaattgcatctccatacccactcccaccctgccccgaacgtcttaaaaaacaaacaaacaaaaaaaactggtaagaaccctcaccccacattctcccaccccgcaacgctgcagcgcacacaggacagagccgggcgtccaagtcccttcccgcgcccccgccgacagtctcgccgcgtccccgcccgggcgccccaggcacgtagctgcccgcccggaggcggcggcagagcgcagagagcggggcgagggtccgggtctccggggtccttcttgcagcagcgctggcgagggcggacccagatggcgctcagtacagccccaggatggctgcgcccacgtccttggagggccggcgctcctgcaccagaaagttgatcatgctctcggacttgatgagcaggttgcagcccaggaagaagacgccgaagaccacggtaagcgacagcacgcagagcacggcgatctgcgccacccgcgacacccacaggctgcgctcgtcgggcgccagccccgcggggaccccgtcgctggcggccagcggtgcgccccctggacagcagcccagccacgtgcccagcccgtgggtgcggtttcccagggcggccccggcgccgccgcccacgccgtccacctcctccaagccgctgtggttcaggaaggtcgcgttcatcgccgcgcggcgccgggggtctcggcgcgcagtcccgggtgcactgggctgctcgccggggtccgcgctctcagggacgctccggacccctcggaccggctcctgcggtacggggaggggacgaaggcgggaggctggctgcctgcgcgctctcgggccgcctacccctgggcaccgggcgggaagcgaccgcccggaggagcgagcaacaggcggcgcaggagctggagccggagaacctagtgtgcttagcggtcgcccgctgggttcctcgcgcgcctggccgcccctcccctagcaacggcccggccccgccccgccggtccccgcggcatctccgaggggcgggaatcccgccgcgggcgcagcctccccggagtcccggtgctggagggggtcgggagatccggcagcctctgtccgcgggccggcgaaactccaccccctcctggcacccgctgtccgttcttggctagaaaacctctccaaggtgcccattccaggatttgatacccttagcagtgaagttattccggaatctgccctgactctcttcgcttattatttaagccctcgtaagccttgctagacatcagatgagtcgccgggacccctggcgctgcccactccactggccccgggtctcctgggcggtcctgcctcacagctttcccggggtgaaagctgtcgcggcgaggcgggctctctgcctccttccctacaccctcctctcaacttggtcccatttaactttttttttaaattaaaaaataaattactgtttttttctttcttttttacacaaacatagtcattgtagactagtttagaaaacatgaattaccgaaattactctaaaactttataatctgcctcctagagagtgtcgatgttatcacctgggtataaactcctcccagactttttctatttgtgcctttctctagataacagatatggggatgcaccgttcctgcttactgcctcccaacctttcctcacttaacagcgtaactttccctagcgatggtcctctacagctatggctctgaattgccttggagggtttattaaaacccagattgcttccacctcccgcccccaacctccccaccccaaccaaccccaagagtttctgaatcagatgtgggatggggccccagaatgtgcatttctaacagttcccacgtgatgcacaaactactgagctacaacatcatttttagtgaaggaatggcattttaaggtatggactactacagtttatttaaccaagcttcctgctggatgtctgagtttttctttccttcttcttccttctccctttccttctctccttccttccttcttctttctttctcttcttctttctcttctttctttctcttctttcttctttctttctttctgtcttcttttttctttcatcagaaacaatattaccataaggagccttgtaacaaagtatttgtgccaaaactgatttttctttagattgtattttgaaaaatggacctgtagaatcaaaaagtaggccgggcgcggtggctcacgcctgtaatcccagcactttgagaggccgaggcgggtggatcacgaggtcaggagatcgagaccatcctggctaacaccgtgaaaccctgtctctactaaaaatacaaaaaaaaaaaaaaaaattagccgggcgtggtggcgggcgcctgtagtcccagctactcaggaggctgaggcaggagaatggcgtgaacccgggaggtgaagcttgcagtgagccgagatcacgccactgcactccagcctgggtgacagagcgagactccgtctcaaaaaaaataaaataaaataaaataaaaaaagaaaaaaagaatcaaaaagtacttcctactaaattgctttccagaaatataccagtgtacaatcatgccctgtggggaaagggggctccccacccccaacattgttatcattattttaaaagtctttgcctgagtagcgaaggggggtgggggcaggggtggtttctcacccgtatgttaatttgcatgctttgattgttgcaggagagtaaagaaagcactttgttattgcaataatgcaggcaaaagatgctgcctggagacttgaattccagtggtgacagtgaagtgggagacaaggggatggaaagggcatggcaaattggagtgaagggattcgggatgccccaacacacaggcatcacagagcctctgctccctgttatggtttgaatatgtctccccaagttcatctgttgaaaacttgacccccaatgtggaggtgttgggaggtggggtgagatgctgccattgtttgggtcaggggcaccaccctcatgaatagattagtgccattgtctcaggagtgggttctttataaaaggatgagttccacccctctttctctttctctctcttctctttctggcatgtgatgtcttctgccatgttttaatgcagaaagaaggcactcaccagatagatgctggccactcgatcttggacttcccagctcctagactgtgagaaattaatttctatttataaattgccctctttataacaagcatcctgttatagcagcataaagcagactaagacacccatacccatcctgatactcattattagaacattaagcatgtgtgtatatcctggtaagttattaaaattattattttatttatttatttttattttgagacaggatctcgctctgttgcccaggctggagtgcagtggtgcaatcacaactcactacagccctgatcacctggctcaagtgatccccttacctcaactttctgagtagctgagcccacaggcatgtgccaccataattttttattttattttttgttcagacagggtctcactatgttgcccaggatggtctcgaactcctgggctcagatgatctaccacctcagtctcccaaagtgttgggattacaggtgtgagccactgtgcctggcaaaattatcactttaaagatgaagaaactgaggcacacataggcaccccagattgggaaacaacctggctcaagctcctcagtcctgggaaagctggcctggcgcaaaggcatgcagttttcagggcaagagtctcccctgccctgatcaccccttggagccaggatagaacagggagtccagcaggtgtctggcccgaacattctgtcctctgctttggcccaattggatttctgtagagaaatgctcagttatatcctttgtctgaaaccaacccctggcttttgctataccctggacttggagtccgtaccttgattgcatccagctgaagtcagactgcctgatgtaaaggaaaggggtggggtgagtgaggatgcagaatggggccctgcccactccagcgagttgtgaggaggctgacatgatggctgacctttcctttattaagcatctattacatgcccagtgcattaaatacattacctccctgaattctctcacaccagcctttgggttctgctggactgtccccttgacatgaggaaacagcggcactgactgtttaattgacttacttaagatcacgcagctagttaagcatcagagccagaatttcagcccagatctgtcctgttccaaagccacgctcttcattatccccgtccccctctctcccatcatccctgggggaggtgctggggagggaaaaagacatctttgacctgggagcaggaagggggagagagaccttgggcttgtggatgtaaacaaagaccactcaaatgagagcaagcaaaggctgtttattcagagcttgttacagtaagggaggcagccactgtcacttgcttttcatggagactcaaaggcaggccgaggggaaggctttatagcggaaaaaggagaaggcttcaggtacgtcctgttggtggtgcaggaaagctacagttgggctcattagaagaggggcatcctaagtaattggttaggggagcatatttggctttctccggtttgtcctgcattgaaagtgggaacaaaattagggaagctgtcagttaccatcaagtcctggccatttggggctgattgctgcaggggttgttcgttggcttcctgggctggtgctgtaggtttgggggcagagttctattttaatatgtggtctggccattgtctatttgcatatttggtctcccagaaccatccacgtcaggagcaggaccccatctggcctggacctagctaaccactcctccttctgtggtttctgtctgccctttcttctttttttttttttttttttttttttgagacggagtctcgctatgtcacccaggctggagtgcggtggcatgatctctgctcacttcagcctccagctctcaggttcaagtgaggcctgcctcagcctcccgagtagctgggattacaggtgtccgccaccatgcctggctaatttttgtatttttagtagacacagggtttcaccatgttggccagctggtctcgaactcctgacctcagatgatccacctgcctcggcctcccaaagtattgggattacaggcatgagccactgcacccggccctgtctgccctttcttgagcctctggtcccagcaagtttggttgtagtttgatgtgtattaactcttaattctcataataaccctgaaaggtaagtgtgtttgttatttattgctacatcacaaatatctcaaattgagcaaacatttatgatctcatgtgatttctgagggccaggaacctataagcagcttaggtgggtggctctggctcaaggtctctcatgaggttgccgtcaggatgttggccaggactgcagtcatgtaaaagcctgaccagggaggggccattggcttccaaggtgaccccttacacggctgttggcaggaggcctgttcctcattggctgtcggcagggggatcctctgttcctcgccatcggacctctccatggtgctgcttgagtgtcctcatgacatggcggctggcttgcctcagagtaactcttgaagaatgtgctagaaggtgagcacctggctggaagggagagggacagaagagtgaggatacagagtgaaacacatcagttcttattgttatttaatcttcacagcaagacttgtagaaagaaacaagttgacagatgagaaaatagaggcctggaaaggaaaaggatcttgtcccaggtcacagagctggtaatagcacagccaggatttaaatccttagttaccctacaactaagctcaaagtctttccagcacttggcatatgtgtatgtgttgggggtggggttgggggtgggagtgcttcgttgttggggaaagactcccccgagccgggcttagaggggctcaggagcctaagggtgagtctgtcaactggctgcctccccctgctctagagaaaaggaagccagtgcctctgggccaagccaccacccacatgggactatttttaccctccacctcagggacaagtctgcatttcccagctctggaagggccatctgggcagtccggctgccccaggaagagctgccacccggagctttatgccctgctgtctctgcagctgtttctagatgaacctttagccctctggcatgcctgagccatccagagtcagtaagaagtccccctcctccagatctcaaggttaataaaagctcctaattagtatcacttgctggatggacccgccagaaggaaaatgcttaaatctgcagagattttaaattgttcacgtttgtcaataagtgttctttgtatgagccattttaatgaagagataagaatgattttatttgcatattcaactgtaaaccacccagacaccttcagaaacaagtaaatagatgaccactatatgagagtgtacttcagggaggcccaagagcctttggacatcatttattttctgaagtggttttaaacaacccccctaggacccggtttacactcttcatttgtttggcacgcttttcctggaatgggcaaaggtagcctgctgcctgtttgcccagttcctgtccaaatgatctcacgtttcaaattggcagagggaaagttaatgacattttactgcatctggtacggaattgaaataaacatggattgccctgttcagcctttgacccctaagagacttcgaggttggcccctgctcagtttacctacagaggttgaaggcagagggaagtacccaggcagttcaggccaaccatgcctgtaatcccagcactttgggaggctgaggcaggtggatcatgaggtcactagttcgagaccagcctgaccaacatggtgaaaccctgtctctactaaaatatacaaaaattagctgggcgtggtggtgcacgcctgtaatcccagctactcaggaggctgaggcaagagaattgcttgaacctgggaggcggaggttgcagtgagccaagatcgcaccattgcactccagcctgggagacaaagtgagattccatctcaaaaaaaaaaaaaaaagaaaatttaaagaaatgccttgcaggttgggtgtctatgcagtagcagacagggagcagtgcctggctaagttctacacagtggagaatgagacaggcatcccaggtgacatggagctcacaacccaacagaatacctggattttggacatctgtgatctacttctgcctctgcccctaattgactgtgtgacattggacaagtgaaccatcctctctgggcttccattggctcattcattaactatgggagcttaatcagaataccttcaataaagctttatttacaagaacaggtagtgggccagatgggccctcctctgtcttcttctgctctatgcttcttgtgggcttgaagacagtgaggagccaaaggtctgtacctcgtctaccccaaaagtactgcctgggcctctggtaccctaatctgtaaaatgagaaagttggttaatacctacgttctccaaactgtgctctttggataaatagttctgcgaggtctgcaacagagtagacattgacctaaacagatttcattgctataggacttctcaggacctttagtatgtggatgtacattgtgaatttccctgggggtggggcaagggggggatgcgggattcagcatttatcaatggaatccttttttgccaacaccgactaatattttgtgccactatgtaccatttagcacagtttaggaagtgccccgaagcctccccaagcctaagtttccttccctatagaccagggatgatgatgatggtaactgcctcctagaattgttgggaaggttaaatgaggtaatgcctggaaacgggcctggcgcagtgcctggcacagagtaagtgctcaataaatgctagtaactattatttataataaggtccttcctttacagctctgacattctgcgcttccaactgtagggtgtaattaagctctaaagcatctggcttcccgagtagaaaaaacaagcctggaggaaggaaaaaggaagagaaagctccttatgggttgcccatttgttcacaagcttcactgccagccgtcacaacaagggaatgtagcaagatgccaactcctaatgacggagcttgggtgggttggtggttccctatttagcttagacactgtggggactatctgagaccgcggagaagtgagaggtaaaaccagtgctgcttatggtcaatcagtgaaacctaactgcatcctatgtgcgtcttccttttccttctgtcctggacacagtgatcctggccactttcaggtatgtgtgacctgctggggggaacagtcacaaggagagctgagtcagagaaggtaagtgggacagatcagactggaagggcaggaagggcagtcccacagaggaatagcatgtgcagtggctcagaggctggcggagtgcataactatagttgcaggccagggggggtggctcacacctgtaatcccagcactttgggaggccgaggtgggcggatcatttgaggtcaggggttcaagaccagcctggctgacacggtggcccgtctctactaaaaatacaaaaattagccaagcgtggtggtgcatgcctataatcccagctactcaggaggctgaggaaggaaaatcgcttgaactcgggaggcggaggttgcagtgagccaatatggtgccactgcactccagcctgggcaacagagtgagactccatctcaaaaataacaataataataataataactgtagctgcaggggaacaggcatggggaggcggtgaggaagaacatcagaagagatggctaaagaggcatgtgggcgccaggacgctcaggacttcatccaaaacacaggggagacacacgatcagcctggcatttacatttccccagattaaaaataaaacaactcttttttcgcattaaaaaatttgacaatagagtttacaataagaaaaaaattatattttttgaaaaagaaaggaaaatggtgaagactcttgcaaccatatggaggacagagtgcactggctctaggaggccggtttgggggctactgcaatagacaaggcaaaaggccccgatgagtgaccccactctaagtatatacccaaagaactgaaaactggcactccagcaaatatacacacatgcatgtttatagcagcactattcacaacagccaaaaggtagaaacagcccagctatttatcactagatgaagggataagcaaaatgtggtttatccatacaatggaatattattcataggaaggagtgaagtatgtgtgcatgctataaaccttatagcatatacttacacatactttaataatgtggatgaacttcagaaacattacgttaagtccgggtgctgtggctcatgcctgtaatcccagcactttgggaggctgaggcaggcagatcacctgaggtcaggagtttgggaccagcctggccaacacagggaaaccgtgtctctactaaaaatacaaaaattagccaggcatggtggcacacgcctatagtcccagctactcgggaggctgaggtaggacaatcgcttgaacttgggaggtggatgttgcagtgagccgagattgcatcactgcactccagcctgggcaactagagcaagactgtctcaaaaaacaaacaaacaaacaaacaaatgcattatgttaagtgcaagaagccagactcaaaaaataacatatactgtatgattccatttgtatgaaatacccagaaaaggtaaatccaaagagagaaccaagattggtggttgctggggctggggagagaggtgagttggggagcaactgcttgatgggtacaaggtttccttttggagtgctgaaatgttttggaagtggtgatggacattgtgaatgcacaaattgccaaaattgccaagacattgttcactttcaaactgttaattttatgttatgtgtatttcatgtcatttttttaaaaaggcaatgatgcaggtgaacaaaggcagggaaagaggagatggaaagtgggaggggattctggagcctgtgaatctgaggaatggttcccagatttctggccttcactgggagtgaacaagtgggcggagtggtcaggccaaggtggagttgaggggctcagggttgaacatgatgagtctgaggtgaccgtgggatgtgcacgtgacagtgtcaggcagacagttggaggcatggccggggaacttaggcaccctggggctggagataaaggtttagaagtcatcagcttgttcacccattcactgaacacgtactgagcatcttctgtgtccagctaagtgctagggaatcacagtgaaagccagtccctgccttcaaggagctcagtctggagaggaagacaagtaaagaaactagataatgataaacggtgagaaggtgcgaatagaggaagacataacatgtggggggcacccagaggggacactgtggacgcaggtcaacagaacacaggaaatgagtgtttcactctgtccctcagcagtttagcaatgccaacccctgctcgagcataggaaatcattttcagactctgctagcatagccaaggactccatgcagattctgcaaggtggaggacttttgagtaggcatgctagtcagatgcctttccggtgaaggacagaacgtgttgtagggactcctgtcacctgcttcagggtctgtgaaggcaggaaatagaaacatattcaggtcaggacaactgctggggactacccccttcgaacagatcccacggcgggacacaagcacaaggcaggttggctctggctaagttgtgctcagaattgtaaagacatcttgccccttgttttgtctgctctaaacatcatctgctttcttttgaggaatcgctcttccccatcccaaccagttaaggtgggacctgccaattaggcttcccctgccccccagatataaggggatgcatgattgaggctgagccaatcttagtactcttctgcctgaccttgatgattagctcagggacagggatgtgacccacgacaggctggttggtggccaccagggtccctgaccccaggtatcatacccttgtatcgtcactcccacagtgatgctgggcttggctatgtgattggctttggccagtgggacaactgaaagcgtaatgtaagcagaggcttggtgagcgcttgcacaatggggctggtcctcttcaaacactcacttttgggacccagctgccatgccaagaagcccaagctggctatttagagacagcgtgtgaacagggcaagtttctagctttcagccatcctcgccacggtgcctgacatttagggaaactattttgggcactcctgtcccatgaatgacagagcgagaccagcagagctctgcagctgagcccaaaaccccacagaatcatgagaaataattaaatggttattgttaagccattccgttttggggttgttacaccataaggaataattaaaagataagccaaagtgggccaatctgaaatcttccctgagaatttctacacggaggtggtggaaaagagctctgttctgtccagtgacaaggctatagggacgcaggcctattatattcctctccacagtggaaagatagagaaaacctatctgcggcagaaagggtgaagtcccagacacagaagagtcaaaacaatagtgaaagaaagccccaacttttagaaccctggacgctcctgtagtctggtgacataaggtattaaattaaatccccctttatggcttcagctacctcaagataactttttatcagttacacaaagggtcctatgtaattcacctgataacatatcataaagatctttgccaatgtccttaagtcaagaataaagtgatcacactattgatgttgttgaaagctttgttgagcatgtacaatgtgagaatcttgaaggatcttcccccagtcgttgtaaggggtaagacaagggaaggacatggttcacaccacaccaggaaccagtgtccagggcattcacctgtcaaggccagctggatgcaggaaggtgttcacactcatttgagtattagaaacacgtttatttctctctttctgtaggacaatttgacaacacacacaaaatgctttttttttttcttaagatagagtcttgttatgtcgcccaggctagagtgcagtggcacgatctcggctcactgcaacctccacctcctggattcaagcaattctcatgcctcagcctcccaagaagctgagattacaggcatgcaccaccacacccagctaattttcatatatttggtagagacagggtttcaccatgttgtccaggctgatcttgaactcttggcctcaagcaatcctcccgccttggcctcccaaagtattgggattacaggtgtgagccaccacacctggccacagactgcttttaaaaggttcaggccctttgctccagcaattccacttccaggaatttatcccattgcaatggttttcaaattatgttcctggtggaaccgtggggttctacagaggtgctttgctagttctgcaaaactttgatttgaatgtcactggtactgaggctgatttaaaactatagtcatcatcttctgagatgtcatcttgagatgatgtctaactggtctagaagacccctaactggtcttctaaatactgcatatttgaatttataaaatatgccaacagaatgacttcttatctgttgcttacatgagccttattaagtttcatttaaagaagggtcctacttctaaaaagaaacagtataggccaggcacggtggttcacgcctgtaatcccaggactttgggaggccgaggtgggtggatcacctgaggtcaagagttcgagaccagcctggccaacatggtgaaaccccatctctatcaaaaatacaaaaaattagccgggtgtggtggtgcacccctgtaatcccagctactcaggacgctgaggcaggagaattgcttgaacccagtgggctgagattgcaccattgcactccagcttgggcaacaagagcaaaactccatctcaaaaaaataaaataaaataaaataaaataaaataaataaacagtataaaaccactgtcacaagaaaatgatcatttcatcctagaaggtttagcttcatgaagatgtactacacaatgtttatacagagttggttcagtgaaccgtggctcacaggctggatctggccaccacctgtttttctaaataaagtctgattgaaacacagctatgtgcattcatgtacacatgatctgtggctgcttttttgccataatggcagaattcagcagttgtaacagagaacttgtgacctgcaaaggccaaaacaaataccacctagctctttacagaaaaaagtttgctacttcctggtttataatgatataaaaattggaaccaagctaaatgtccaagaaagtggattgatcaaattacaacacataccttgcaaatggaatgcaaggcccttgttgaaaaataatgctggctgggcatggtggctcatgcctgtaatcccagcactttgggaggctgaggcgagtggatcacctgaagtcaggggtttgagaccagcctggccaacatggcaaaaaccccatctctactaaataaataaataaataaattagccaggtgtagtggtacacacctgtaatcccagctatgtgggaagccgaggcaggagaatcacttgaacccgggaagtggaggttgcagtgagccgagactgtgccactgcactccagcctgggcaacagagcaagactccgtctcgggaaaaaaaaatgttttagttcagcagctgttaggtttggctgcgtactgaaactatctggggggtttttaaaaattccaaagctcaggccactccagatgaattaaatttgactctaggggtggaacccaggcattgatatttttaaagcttccccaggggttctaatgcagtgccactgttgtagaagaatatttaatgaggccaggtgcggtggctcatgcctattatcctagcactttgggaggccgagctgggaggatcacctgaggtcaggagtttgagaccagcctggccaacatggtaaaaccccgtttatactaaaaatacaaaaattagccaggcattgtggtgggcacctgtaatctcagctacttaggaggctgaggcaggagaatcgtttgaacctgggagatagagtttgcagtgagctgaaattgtgccattgcactccagcctgggagacaagagtgaaactccatctcaaaaaaaaaaaaaaaaaaaaaaaagaatatgtagtgacacagaaagatggccactatatattattaactgaagacaaagaagattttctaacaatgtgtagcatgtgactcctttctggtaagtttctatacacacatgcaaacagactcacatgtatgaaaatatatgcccaaactgacagtggccatctctgtaggctgggactaggagagattttgattttttttttttttttgcttatctgtattttttagatgttctacaatgaacatggtatcttataataaatgcaaaaaataaagttgtcaatagcttaaaaagccatgtactttttgttttaggcaaaactacaaagaggagcatctaatcaaacaacacatccccaggtcactcatgtgtgcagcatgccttcaggcatgcatcccaacagaggcagatcccaggctcatgggacaacaggttttccttggtgaggaagtcaggcactgcagcctccaagcctcaggctcctcaactgttaaaaagggatcagtctgcctacccccaggatttaaggcaggcatgcatagtgtctggcacataggaggtgctcaacaaaagttgcttatttctccataagcagcttttagcgtcacagcctgcagccaatcagcttcttgctgttcttgccaaaggaggattggctttgccaaagctgggcctgcccaagttcatccgcagccactggtctctgatgctgtccaccttggcttggaatctctgttgctcttggaatttttctgtgttccctagaaggactgtgacctctcatcaacacaacctgtatcccctactcccagaatgggttccatctgcgtagagaaagtgagggcttcaagtcttcgtggggctgctcactcttaataaaaacaacagtggctgccatgtatcagaattgccctacatgtgcccgggctgacatcctctatctctcagccccaactctgcaggaatgtgagagtgttcccatttcccagatgaggctcagagagttgaaggaactccttgaaggtcacacagctggtccatggcaggtgccacactgccttcttagctatgttggttccatcttctacttcaaaagacagacattccccagtggattctaatgtgcagccaggtttgagaagcattgttatgaaagtagtggttctcaacattgactataccgtggaatcacctgcactgatttacaaaaatgctggtgggggctgggcgtggtggctcatgcccataatcccgggactttgggaggccgaggtaggtggatcacctgaggtcaggagtttgagaccagcctggccaacatagtgaaaccccgtctctactaaaaatacaataattagccaggtgtggtggggggcgcctgtaatcccagctactcaggaggctgaggcagaagaatcacttgagccccggaggcgaacgttgtagtgagctgagatcatgccattacactccagcctgggcaactacagtgaaactccatctcaaaaaaaaagaaaaatgctggtgggggttgggagttgaagagtggggagggtgggaagaggacaggaagaaaggaatgggggaggcttctgaagttctggataatgttctagttcttgatctgggtgctagctacttgggtgtgtttattttgtgaaaatcattgagctgtacatttatgatttatgtacttttctatatgaatgctagtctacagtaaaattttaaagaaaaaaagaagctgtcatcagccacatcactgcctcctgggaaaaggcagtccgtggccttgacccatattttgaggatgcttttctcagcatcaagcagttgtcggcctctgagtctgtgcctgtccctgccaatgagcagactaaccctactttcttgccattggggcttcttcctgggttaatgctgggttagctacaaaacaaaacaaaaaaaacacaaaagtccaggtacagtggctcattcctgtaatcccagcactttgggaggccaaagtgggtggattgcttgagtccaagagtttgagacccgcctgggcaacatggtgaaacctcgtctctactaaaaatacaaaaaattagccaggcatggtggtgtgcacctgtagtcccagctactggggaggctgaggtgggaaaattgcttgagcctgggaggtagaggttgcagtgagcagagatcaagccactgccctccagtctgggtgacagagtgagactgtccccccactcccccaaacaatacccactgttgctatggttgcaggtactcagacagccaggctaagctggttaagctccacggtccctccctcccacagtgggagtcatatgaccctatgctgtctaagccccaggacctagggcagcaggggtataaatggctacagccgagccccctgggcctgaactgtgagttccctggttgacctctgccttgtgtcataatttgagtcactagaggtatgttctcttgttcttcagctacaggttctgatttttagctaggcttatgaatatgttaaaggaaaacaacatttccaaccctcttttgcagctaggcatggccatgtaactcagttctggccaaaaaagtgtaaataaaacagtctgtgcaattctggggaaaaaaaggagagtactcttctccttcccatactccttcctgatgcctggaatatagcgtggaaaggctgagctccagcagccatattgtaccatggggtagaagtcatgtttgtggttagcagagcaataagacaggagcctagatcccttctccctttgcatcatggagcaccctgttggctctggaatgattccctcaggacagctaaacatgagagagaaactgagcttcaaacttgtttgagccagtgatatttgagggttttcattcttctcaacccaactgaatcctatctgatacagtaggatttgctccttggtcctgagttcccgccttggtcacctgcccagtgtaaggaggaggggcctggcctgctccatcctgcaactggagttctgtcctcggcccacctcagtggctggtccctgctacctgctggaaccccatccatgctgcctccccactcagcaggattctgttccttggctggccccttgccaggatggatggcaggcctcccactctgcttgctttcctggagtgaggtctgctgcttgcctcccactccctgcttcccacttacccctgtgcccttggcttctgccctgggcctgccagagtggctgctctctggatatcccaatgccaccagtatcttccccaggagcagcccattcctgacatacaggaacaacggctccttcattcattgactcatttaagcagatatttaccaagcatctgttatcagcattgagaacaccacaggaaataagatcaggtcgaatggtgggcctagtgcaagcacttacaagtacaggctttagagtgagaacatcaggcccaaccagccaagacactgaaacccatctcaaggaattttcaggagtttcctttaaggatatgcccatgacctgggttatgtgtccaagtctggatgagtcactacacctcccagtcctcagctgtcccatctgcacatggtgaggctgaactgcatgctcttgatgactctgtgcaggtctgacttcctgtgaaggtaggaaagggcccaggggcccctaggcctggttttgccacccatgggctgctgctggatttagggccttaaaacaaccactttattattaatttctttagagacagggtctcactctgttgcccaggctggagtgtagtggtgtgaccataggtcactgcagcctcaaactcctggcctcaagcaagcctcccgctcaggcctcccaaagcgctgggatgacaggcatgagccaccacatccagccctcactttctaattatttattatgattttgtcggttgactggggccagccaattcttctgctggtgacagttccttcagcccctctgacctctggcctaacatggaagtggggataatccatgtacccagaattctcccagaattgatgagataagactccaggtcatggaatagttaacgaggaggagtttctctttagaagtaatccagctaataaatgaagacaggatgatagaattagaatattaccatttctgggccaggcacagtggctcacgtcagtaatcctagcactttgggaggcggaggcagtctgattgcttgagctcaggagttcgagaccagcctgggtaacatggtgaaaccccatctgtactaaaaatacaaaaaattagccaagtgtggtggcacatgtctgtagtctcagctactcaggtggctgaggcacgagaatcgcttgaacccaggaggcggaggttgcagtgagtcaagatcctgccacttcactccagcctaagtgatagagtgagactctgtctccccacctcaccaaaaaaaaagaatatcaccatttctaacccccagtgaagtaactggtctagatatggaatgtcaatagctattaatgtcacaaaaaggaagtcactagacattctgtgccttctgtggaaaaacctaatacctactaagaacaagtcttgccaaaaactcaaaatcttaatctgatcaggcctctagatccaactatccacttataggaaatatagaagacagagaaatgtgtataaatgacatcatggatttgcaataatcaaaatccagaccgtgggtaatatctgcaggatgcatggtagggctggttcaagaataaaggaaggctaggtgtggtggctcacgcctataatcccagcactttggaagacctaggcaggtagatcatttgaggttagaagtttgagaccagcctggcccagatggtgaaaccccatctctatgaaaaatacaaaaatttgccgggcatggtggcaggtgcctgtaatcccagctactcgggaggctgaggcaggagaattgtttgaacccaggaggcagaggttgcagtgagctgagatcgcaccactgcactccagcctgggcaacaagagtgaaactccatctgaaaaaaaaaaaaaaaaagaataaacggaaaaagagaaagatggaagaggaatccatggattaaaagatttaagagacatcaactaatcatattgtgtgcatcttatttggatcttgatttaatcaaaatgttagaaaatgctttctgacataaaacagttggaaatttgaacacttactgaatatataacgatattaaagaataattgttttaagaaacacagagagaaataatgagtgaccaacacttgataaagaagaacccagcagcctatctcttattagagaaggctacggggtatgctgggagtcctaatcccggctcggccgtgagtgtgctgtgtatgtagccttggctgagcccctttccctgcctagaccttggttttcccatttatgaagtgaaggaggggacccaaggggcgtgtttaactctggcctgcttttgctttgtcttgtcacgtgcagccatggatcctttaactcggggcctgtatcaacaccaccatgcgtccacaagagtataaaatgggcagaagagtgcttgatgggcacaagcccagagctgtcggcttctgcagaacccagaacaggaagggtcacctccctgaggcacctgacctggagaaccaactgcataatcccaggtaggccaggtcaaagccaaggggaaggagaaactgctggaggacttccccccacaaaacatgggcacgtgttatctgctcaccaggatgcttcgaccttgttctgatgcctggggacttctggtgagttccctggccatccatcctggtctgttcaccttctcaggactccagttgagttgggctgcgtgtgacagacccctgtgagtgcaaatgaacaatgtcactgaattgctgcctcactggcccctcaattccttgttgctggcctctgcccacctgcacttcagatactgtcatcatggaagaatcatccttagcacagaaactcacacactgtaaatgctccatgtgaagaggtgaagaggtggagagggaacctccctcccagaccatcatggatgcttaacattctcttgaagcctgacgagttttctccagaaagctgaactacaatactcaccatctgctaccaacaccaacgagttcaacacatgaactaagtaatcgagaaggacacttccgtttaattaggtactatagagcagtagcaaggcccacacgttagtgtcaaatctggatgcaaatccttgcactgcctcctaccagctctgtgactttgggcgtttcttaacctctctgcagcttatttattaagaatgctgtgaagatgagatgacgcccttcatacagtgtttggcatcgtgcctgacccaccagaagggctcaatgtgtgtccacagttgctttttttctttgagactgggtgtccctctcatacccaggatgtagtgcaatcatagcttactgcagccttgaactcccaggctcaagggatcctcctgcctaaacctcccgagtagctgggactacaggcacacgccaccatgcctggctaatttttgtaattttttgtagagacggggtcttgccatattgcccaggctggccttgaactcctgggctcaagtgatccgcccaccttggcctcccaaagtgttgggattacaggcgtgagccaccatgccaggcctgttaggcgtttcttaacctctctgcatttagtttcttaaccactcttatttagtaagagtgctgtcagcctggaactatagctcacgcctataatcccagcactttgggaggctgaggcaggcagattacttgaggtcaggagtttgaaaccagcctggccaacatagtggaaccccttctctactaaaaatataaaaattagccgggtgtggtggcgtgtgtctgtaatcccagctactcaggaggctgaggcaggagaatcgcttgaacctgggaggtggaggttgcagtgggctgagatcacgccactgcactccagcctgggcaacagaggaagactccatctcaaaataaaataaaataaaataaaataaaataaaataaaataaaataaaataaaataaaataaaattaaaataaaataaaaaataaaataaaataaaataaaataaaataaaataaaataaaataaaataaaataaaatagtgctgtgaagatgagctggctccctgcacagagtgttcggcatcatgcctcacacactgtggtggctcaatgtatgttgacaattgcttgttttttgcttttttttttttttttgagacagagtcctgctctgccacccaggctggagtgcagtggttcgatcttggctcgctgcagcctccacctcccgggtttcagcgattctcctgcctcagcctcccaagtagctggggttacaggtgtgcgccaccatgcctggctaatttttgtatttttagtagggatggggttctgccatgttggtcaggctggtctcgaactcctgagctcaagtgatctgcccaccttggcctcccaaagtgctggattacaagcctgagccaccgtgcccggcccacgattacttttttgggggaagcttccattgcagcaccccatgggcactccaccatcatgtctctctactcctcaattgaaccttctctcctttccctctctcctataaaaatgacccttcagtaggtcattttctcactgacatgctaacttatgacttgcagcatctgatgatacaactttgacctgctttataatcgtgggtttcaggcaaggtgggaggccttccaaagtcaccttgagaaccacaactctttggtgccatctgcaatcctccatatcagccctgcagataacagggaactatggctgctgcctccctggagtaggacattcttttaaaaagatctgggagcactttaggaggttgaggcgggtggatcatgaggtcaggagtttgagaccagccagaccaatgtggtaaaaccccgtctctactaaaaatacaaaaattagccgggcggggtggtgggcacctgtcatcccagttacttgggagactgaggcagaagaaccgcttgaacctaggaggtggaggttgcagtgagccgagatggtgccacagaactccagtctgggcgaccttcctgcactcccggtgttcggggaccaacaaggcgtaataaggagccagagaccaaggcccaagtctcagctctaactgagtattatgggggtattaatgtccacctcccaggatagggagcacagagcaaggaatactaagtattgaagccctgaaacgcccacttcctgtacctgagtcgctgctgtcctctagtggccactggataaattgcacagcacgccggcctgaaaaagcggaagtgagagatgcttttccccacttctgaatctaccagatgctggggggttctcaaccatgctccactcatgacttcctttttataaaatgtattttgtgtaattacagtaatttttgaacattttaggcagatttattgaggtattgacatataataaactgcctagagattacaatttgataatatctgagccttagtatacagctgaaatcattatcacaatcaagatagtgaagaaagccatcctcccaaaaaatttccttgttgccccttggtgatcctgcttcctgccctttctacttccctctcacccccaagcaactactgatctgctttctttctcttctcttttttcctttttttttttttttttttttttgagatggagtttcactctgtcaccaggccggagtgcagtggtgagatctcggctcactgcaacctccgcctcccaggttcaacagattctcctgcctcagcctcccgagtagctgggactacaggcacctgccaccacgcccagctaatttgtgtatttttagtacaaatgttgtatttgtatttgtatttagtacaaatgttggccaggctggtcttgaactcctcgcctcaagtgatccgcccacctcggccccccaaagtgctgggattacgggtgtgagccaccacgcctggtcctgatctgctttctgtcatcataggttagtttatattttctagtgctttctagacacggaatcatacagtgtgtatttttttggtcaggtttctttcactcaccataattattttgagatgtatccatgttgctttgtgtgccaatagttcattactttttaaatgtttaattgtagtttttgtgggtacatagtaagggtatgtatttctggaatacctgagatgttttgatacaggaatgcaatgcataataatcacatcatggaaagtggggtatccagcccctcaagcatttatcctttgtgttacaaacaatccaattatacactcttaattatttttatttttattttttttttttagtttttgagacagcgtttcactcttcttgcccaggctggagtgcaatggcgctatcttggctcactgcaacctccgcctcctgggttcaagcatttctcctgcctcagcctcccaagtagttgagattacaggcacgtgccactaggcccagctaattttgtatttttagtagagacagggtttcaccagattggtcaggctggtctcaaactcctgacctcaggtgatccacctgcctcggcctcccaaagtgctgggattacaggcatgagccaccacgcctggccattagttatttttaaatatacaattaaattattattgattattgccagcctattgtgctctctaacactaggtcttattcattcttttttttttgtacccattaaccatccccacctccccacattactttttattgctgagttctgttccattgtatgaatgtaccacaatttgttattcattcagaatgatagtaattttaaaaatcaatataatgccctaactagaacatacaacagaaactaactcaaagacgagttctgtataaaagctcaaggaagctgggtgtgatggttcacaactgtaatcctagcaccaaggcaagtggatcacttgaggccaggagctcgagaccagcctgggcaacagagccccccgacccccccaacttctacaaatatttttaaaaattagccaggcttggtggtccaggtctgtagtcccagctactcaggaggctgaggcaggtagatcacttaaggccggaaggaaatttgaggcttcagtgagtcgtgatggtgccactgcactccagcctggacaatagagactcaaaaaaaaaaaaaaaaaaaaaagctcagccatgaccaccctgaccctgaccactctggaacatacaatgatacagtcgggcacttatatactatacatgtactagctgcgagtacagccaggcagaggtggggcagatgagcacatcaactactagcaccactgtcctggacatcacacaacaggggggcagggctgggctttgagcccaggtttgtttggctctgaagcccagtggctggccactccatgcaggagggtacagtgctctgtcgcccaatgcatggggactggtgttgagcagagaagatggacatgggcagattttagctggatggaaggatgcgtttctcacagggctgaccattggggtagcatgttctttttttaattacgtggatggcgtgtttgggctggctcaccctgggatttctcccatccagccatgacccagactcattcactaaggtctatatttgccttttttttttattatactttaagttctagggtacacgtgcacaatgtgcaggtttgttacatatgtatatatgtgccatgttggtgtgctgcacctattaacttgtcatttacattaggtatactgcctaatgctttcccttcccccttcctccaccccacaacaggccccggtgtgtgatattccccttcctgtgtccatgtgttctcgttgttcaattcccacctatgagtgagaacatgcagtgtttggttttttgttcttacgatagtttgctgagaatgatggtttccagcttcatccatgtccctacaaaggacatgaacttatccttttttatggctgcatagtattccatggcgtatatgtgccacattttcttaatccagtctatcattgataggcatttgggttggttccaagtctttgctattgtgaatagtgccacaataaacatacatgtgcatgcgcctttatagcagcatgatttataatcctttgggtatatacccagtaatgggatggctgtgtcaaatggtatttctagttctagatccttaaggaatcgccacagtgtcttccacaatggttgaactagtttacctttttaaaggtatgtttgtatttcactcactttgcatttcacggtaacccaatccaggggcttttccctggcacttcccacagcacagacatatgctccttccttgcctgctgccctcaggggccagcagcaggggtggcactgcacagtcccactgggggcctccctcagggcagaatataattttatggaagaaagtgtctagcaatgctttcttgagacagggtcttgctctgtcacccaggctggggagtgcagtggtgcaatcataggtcactgcagccttgacctcctgtgctcaagtgatcctcccacctcagccttccaggtagctggaactataggcacacaccactatgccccgctaatttactttattttttgtagagacagcgtctcactatgttgcccaggctggtcttgaactcttgtgctcaaggaatcctctcgcctcaacctcccaaagtgttgggattataggcgtgagccactgcacctggcccatagcaatgcttttgagacaacaagattttaaaacctgctactgtaagacaatcagtcatatttaccttctggggtaatttacctactgtgttattactgaaggagtctcttggttggtggtaaccccttagcttcagagtggcctgtccttgcaaggaaactttgaagaatttagtccaatattagtgttacagagaaggacccaaggtccataggaagtggaatgtaatacacaagttctccagtcacttcctaactctgtttttaacatctcaccccaacagtttcccctggatccaagtaaatgtgtaagtcacgcttttattcttaagctttgcttcttcctgttttccttggaaatgttttcctctgctccttataactttttgtgttgaatgctcagttcatttattttgttttatttattggatttttggttttggtttttagtcccctttcccctcctctgttgctcacagtgcagacaactttgtgcagtggaaacagtgcagtctttgaggcccgaaagtcttttgttttgattcttggttcagcttcccgtgagcaactgttaagtctgttttttcgtatgtaaaaggaaggcagtgatagccctctgcagtgttttttgagggttaaatgggatcgtggtatgtaaggaacattgcgcagtgcctgatacatggcagatgctcatcggattcctgtctcctgattgtttcccaccctccacatttacaatgcccacctagttaataaaacaagcaaaacctcatggtttcttttttcttttgtgtcatttatattagtacttcttgctgtaatgtcacagtgcacgagctgagaggtaagttgccaggaataagacggggacatagcatagaatagctattaaaatgggggattctggagtctggctgcttctttctgtcccaggcttctccacagaccagctggattaagaaaatagcatcaaagcctcaggatcctgctattttgttttattggaacaaaagcagttaagacaatgaatttacttctaagtatagctttggttaaattgtagacactgatatgtaatgctgtctttctcattgttttagaaacctgctatttaaaaatctttttaatttattttgtgagacaagatcttgctctgttgcaaaccctgtctctactaaaaatacaaaaattagccaggtgggtggcaggcgcctgtaatcccagctacttgggagcctgaggcaggagaattgcttgaacccgagagaaggaggttgtggtgggccaagattgcaccattgcactccagctctgcaacagagcgagactccatctcggaaaaaaaatttttttttccctctgttttctacagcagtttatttacagaagcatattttcccagtcctgtccttcgagctggcaagaggagcccctgactgggccctgaaatttagagaactctacatacaaaaaataaaataaattaattaattaaggactgcagggccgggtgcagtggctcatgtctgtaaatcctagcactttgggaggcagatcacctgaagtcaggagttcgagaccagcctcgccaacatgacaaaaccccgtctccactaaaaatacaaaaattagccaggtgtggtggtgcatgcctgtcatcccagctactcgggaggctgaggcatgagaattgtttgaatccgggaggcagaggttgcagtgagcagagatcgcaccactgcactccagcctgggtgacagagcaagactctgtctcaaataaataaataaaggccaacaggatgcctctgctagtctggatctggtgcctggcattggcgcagcaccacctaaccctatgcatcctctcttgactgacaatgttcaggccccagagacgtgcttcttcacaccttatcttcggtctatgggaaaaataactacatctaaatgttgaatggggcctctgccaggcactattttgaaagtacacagaagctgtgggcagaaaaggacttagataaaagacaagttaatgtatctaccagatctttcctctcagatagtgtgaatacaatcgattcaaacattatgaagtaccatttccgaatagtgctgagaatacaatttcttcttgtttttgtgctcctattcatggttccagaggttctcaagagttagcacagtatttgcctcagttgcatagaagctgaggaaaagtttgcagtattaacccttttcccatttaggaaaaaaagggcagctcactgccagtgctcatttaattttacagaaacctgctctttgaggctgaagcaaatctgattttctttcttttttttctttctcttttcttttccttcgacagagtcttgctctgttgccgaggctggagtgcggtgttgtgatcttggctcactgcaacctccgcctcctgggttcaagcaattctcctgcctcagcctcccaagtagctgggattacaggtgcctgccagcacagccagctaatttttgtattttttagtagagatgaggtttcaccatgttggccaggctggtctggaactctgacctcaggtgatccacctgcctctgcctcccaaagtgctgggattgcaggcgtgagccactgcgcctggccgcaaatatgaatggttttcagtttgaaaataaaatataaaaactgctattggaattatttctaaacagaactaacatcagaatcatctgaatcatcagaatagtctattctggaaaatcagatacatcaaatgaatctttggccaataactgttcgagaatgatgttagtatcacgtgtaggaatgctacattttctaggatttgatattttcagcttgaacaattaatgtattttgtaaatggaaatcccgccactaaaaacacaatgctataaatagaataatattttttgtttccaaagtggatatactagagtgatgcaaaaataataataaagcgagatattttgtggcaaagttaccttggggaaaacgccgcagctgcaggtgccaccagtgagtcttctctgggcaaatgagaaaaggattaaataaatcacattacacattactcttaaatttgtatctatgtctagccctcagacaaacagtgatgcttattctttgcattggcaatgaggtggtcattgaatgctagaattatgaattttaatttcataaaatttaattaagttttcaaaaatcaaaataaaatggatttatttcaatcattttgatgtacaaatttaattaatttttttttttttttttgagacagagtctcactctgttgcccaggctggagtgcaatggcgcaatctcggctcactgcaagctctgtctcctgggttcatgccattctcctgccttagcctcccgagtagctgggactacaggcacccaccaccatgcccggctaactttttgtattttttagtagagacggggtttcaccgtgttagccaggatggtcttgatctcctaacctcgtgatccgcccggcttggcctcccaaagtgctgggattacaggtgtgagccaccacgcctggcccaaatttgattaattccaatttgtatgttgcatattggtttaatagatacttatttttttttttttgagatggagtcttgctctgtcgctcaggctggagtgcagtagcacaatcttggctcactacagcctccacctcccgggttcaagcaattcttctgcctcagcttcccaagtagctgggactacaggcataccaccatgcctggctagtttttttttttgttttgttttgttttttgtatttttagtagagatggggtttcacaatattggccaggctggtctcaaactcctgatctcataatctgcctgccttggcctcccaaagtgctgggattataggcgtgagccactgtgcccagcaatagatacttttcaatatttgaaaagaatattgtttgagattctgacaaaattaaattttttacataaaaatatttttgattaaaatattaagatatttgtactttgaatatgactgttttaatccttacatgtattttaaatcttgacaataataacataattgattttgctgaaaggaagataagaaaaataaatttcatggaatactttcagtaatttataaattacacatttctttattttattactcgcttcaatatgaggaattgcttgaacctgggaggcagaggctgcagtgaactgagatcacatcactgcactccaactggggcaacagagtgatattccatctcaaaaaaaaaaaagcaaagaaattgtatgatctttgacattttgctaactttctgttatctacaaatcatagcttcatacacatctaaaaaattttatccttttaaaggaatatttgtcaggggctgaggctagaatatactttatttaacaccctgttagtttaatttataacttgcaaatatttagacagacggcctgtggcatccatctgtcctcttgccctgagccgcacatccagacttgactcatgggccccagcttggcttttccagttctttgaatggataggaatctacccagagctcatgtttgtcatagctggggagctgggggtggagggtccctctggtccccctttgaatgctgcagacaccatcttctctcagattttaagctgcagagaccaaatttccagcatgtggtcctgagctatggaaacttctcctcctgcccaggactctcactctacagagacgcattcattcaggtccctgaagcccctgtagagttttggccataaatggttcctcataaagtggtgcccccaggagctcagcctccgcccccacgccccggcaggcctcctgtcccagggcgccatgtgctgctgccctgctgggatgagaagtctggagggcacggggcagcattgcccacttagaagtcccttgtactttctttctgccagatgctgccgcgctgtttcggagggaagagtgggccagcagtaacaaaatgtttcctcccttgcacctttttcgctacagttggtagaaacttctcccagacttccttggtgactaatggtgttgggatgttgtggccttcgccgggaggggacaagttgtcagctcacagtttcacagatggttgaccgatgctgactgtagctggcaggtctcttttggctgcaagtgacagaaacccaactcaaacttgttcgcaagtagggacatttattgtttctcagaattgaaggaaggggaagggtgagtctgggtcccagaaggggtggaccgtgggattggaatcccatccagactccactccctcttcacagaagcttagcgcctcagatgggctgtgtcctctggccccgcacacatgggcttcctgttgggagctgagcagctccaccagcttccacttgcaaatgtagcgactggtgcacaagtgttcctatgcatatggggggtgacaggaggcagggccctgggactggcagcccctgcctaaaaccccatgagagaaggagttcccccaaaggtggtgctgttcccagaaaggaagggaacagcccgtgctctccaccctgtcctgcttggccattttcttcacagatgtcacctgtccttccaggcacagctgctatttctgcctgatgcttggccagtttgcatggttaaaaccagcatatttccaggagatggataatgtcacagaactggggttccagaaggctggggtggtccagcactcccaccttctttagaacatggagagctgttagttgggcagggctgaagcttaggtggcgaggaacaggaggctcctactgcagacagccttgttcttcggatcctcccagaaatccctaggccacctggaacccggggtcagagagggatgggagagaagtaggctatgaaagggggtgggaacacaccttctggaaccactgtcttccttgagaaaaccccgagagggggcgtaatgggcagggatggaccttcctccttcccgaggctcagtgacacttatctctgagggaccctcctgaggcagtgtggggtggattgttgtttgtccgaaattctgggatcttgtaaattttatttgctaaattttatcagctctaggggtaggaggatgagaggagcaaaagaatggtcccaagctcaggctggtgtggagtgagtcttagacagaaaaagagaccagagaggaaacaagcccacaagggtagccatcctgtccaaccggaagccgcctgacacttgaaggcgatggatggaagaactcagccctctgcctccttagcaacatacacctactttaaggggaaagacacaccttccctcagtgacagaaacagccccagattttcagatttatcaaaagtatattttttccaggatgggtgtagtggcttacacctgtaatcccagcactttgggaggcaaggtgggtagatcacttgagatcaggagtttgagaccagtctggccaacatggtgaaaccccatctctactaaaaatacaaaaattagccaggtgtggtggtgggtgcctgcaatctcagctacttgggaagctgtggcagcagaatcgcttgagcctgggaggtggtggagggtgaagtgagctgagattctaccactgtactccagcctgggtgacaaagctagactctgtttcaaaaaaaaaaaaaaagttgtttttttttttttaatgtggagatgaggtcttggtatgtttccaaggttggtctgaaactcctggccttaagcgatcctcccacctcaggctcccaaagtgctgggattacagacatgagccaccacgccaggccagcctttcagttttcatggcattggccattttgagcaatacagaccagtaattttaaagattttcagtgagttcaactctgatgtttcctcaggattagacacaggctatgcatccctggatagaatactacataaatgatgtgtcctccctgggaatcacatcttgggggcacacactctctctctgtccctcactggagatgttaattttgattgcaagatcaaaaaatgtctggttatccattgtatagttactgatttttttctatgcaatgaataaacaatctctggggagaccctataagatcgtggacatatccagttcttcagcaggcttcccaccacctcagatttagcatccgatgatgattcttgctgaaatcaatctatgatggttgaaaaatgattattattttccaacttcatgacttcttccacatttatcagtcaaccttttattgtcaggaagaggtttccaattcagctccacactatgtatctttttgtcaatttattattattatgggctcatgaattcctattccattcaatgtataatctgttactatcatctattttgatggtctaatagtcccagattaccttggaaaccattatgcaatgatttcttagatatgacaccaaaagcacatgcaacaaaaggaaaaatagataaattgcatatcatcaaaattaaaaactttggggcttcaaagaacaccaccaagaaagtgaaaggcaacccacagaatgggaaaaaatatctgccatatatctgctgctggtctagtatccagaatatataaagaacacttccaactcagtaataaaaagaaaactcaattttaaactgggcaaaagtttgggaaaatagctattttcccaaagatatacaatggccaataagcacatgaaagtaaaatcaacattcataaccatccaggaaatgcaaatcaaaaccacaaaatgataccagttcacacccactaggagaacttttgtcaagaagacagacaataacaaatattggtgaagatgtagagaagttagaaccttcatatactgttgatgggaatgcaaaatgatgcagtcactttggaaatctggtaggcctcaaaagcttaaacctagggttaccccatgacccagcaactctactccaaagaaatgaaaacatatatccacacaaaaacttatacgtgaatgtccatggcagcattattcacgatagccaaaaatagaaataacccagatgtccatcaactgatgaatggatagacaaaatatggtctattcatacaatggaatattattcaaccatagaaaggaataaagtatcattatgcgctccagcctgaatgaaccttgaaaacattaagtgaaagaagccagatacaaaatgccatgttttatgtaactccatgtatatgaaatgtccagagtaggcaaatccatagagacagaaagtagactagtggttgccaggcattgggaggagcggggtgggcagtaactgctaaatggggttttgttttagattggtgaaaatattctaaaactgagtgaggtggtagttgcataactctgcaaatatactaaaaaccattgaattgtacacgttaatggaattaattctatgatacatgaattatatctcaataaagctgttaccaaaaaatattgtccaagatctggccagtcagtgcctctttgagctagctcttgtgtccatttgacatgccccaatccatactttgagcatttttaaaatttctggtacaacaagaatccagactgatctcataaccctttcctgctacagcctgggaatcagccacattccctagagtcgtggttccctgttgtgtggaatgtgaaccaagatctggccattatttcatttaatcatcacatcttattttctgcttttagaaaccaaaagaatgtctcattgtggggtgcgaccagtatatgcaggaagttttagaatgaaaaagattctgaattgatccttgctaactttatttcagaaagtggtaaaatagctgtggagtatgacccagtgaagagattgtaaatatcagatgggaaaaagaactacacagtttaattcaagtatgtggagataaaaactcaagagtaacagggctgggcgcggtggctcacacctgtaatgccagtgctttgggaggccaaggcaggcagatcacctgaggtcgggagttcaagaccagcctgaccaacatggagaaatggtggcacatgcatcccagctactcaggaggctgaggcaggagaatcgcttgaacccgggaggcggaggttgcagtgagcccagatcatgccattgcactccagcctgggcaacaagagtgagactccatctcaaaaaacaaacaaacaggccaggtgcagtggctcatgcctgtaatcccagcactttgggaggccaaggtgggcggatcatgaggtcaggagttcaagaccagcctggccaacatggtgaaaccccgtctctactaaaaatacaaaaattagctgggtgtggtggcgggcacctgtaatcccagctacttgggaagctgaggcatgaaaatcgcttgaacccaggaggtggaggttgcagtgagccaagatcatgccactgcactccagcctggatgacagagcaagactccatctcgagaaaaaaaaaaaaaaaagaaaaaagaaaaacaactcaagggtcggataacatagccagtgtaaccataattcaaaacaagcagcagaatttggaggataatttgtttcattctcaggaaaatgtgaaactctgaaactgctttctgagtgcagggtatttctggggcttttcctaaagtcttgacccttggctctgaccccttatttgaagtttggagagcagaactgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcaaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttccgtaagcgtataatggagctatccctatataggtataccatttttatctttttttttttttttttttgagatggagtctcactccgttgtccaggctggagtgcagtggtacgatctcagctcattgcaacctccacctcccgggttcaagtgattctcctacctcagcctcctgagtagctgggattatagacacgcgtcaccacactcagctaatttttgtatttttagtagagatggggtttcaccacgttggccaggctggtcttgaactcctgagctcaagtgatccacccaccttggcgtcccaaagtgctgggattacaggcatgagccactgcgcccaggccccatttttgtcttttacacagtattttaactatatattttccatgtttacatacacaaatacctgccattgtgtgacagttgcctttagtattcagtacagtaacataaagtacaggtttgtagcctaggagtcctaagccataccgtgtaccctaggtatggtggctacaccacctaggtttgtgtaagtatatgctatgatgttagcacaatggtgaaatcacctagtgacgcatttctcaagctcctcacgtggcaagcaatgcatgactgcatatgaaagctcttaaatagggattgtttctaaattaatctcaaaacagtcattatttactatttatggaaacttttttaaaaaaaggagcaaaagtatcatttcagtgggaacttaacttggggctacagtgttttatttaacttttaccccaaagttgcaaagtgttttgaaatttttccctgtaaaataataattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttatttattttattttatttttttgagatggagtttctctcttgttgcccaggctgaagtgcaatgttgcgatctcggctcactgcaacctctgcctcccaggttcaagcgattctcctgctttggcctcctgagtagctgggattgcaggtatgcaccaccacacatggctaatttttgtatttttagtagagatggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgcctatgccaggcactggaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataaatgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccatcccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtggcataaatacaggtgtcataaagacagggcgggactcacgcttacaaggggcacgagtgtctcggagctgccagaatgacttccgctcagtgcccggcactagcgtgtgtcatgtcccggctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcacccaagaagctgaagaaagatccagctcagcgttggagccttgctgagattattggaattatacgccaattatccacacctcatagtcagaaacagaatttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccaacaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaaacccagcaggagaccccaattcagtttccagaggaggtggaaccttctgcaacccaacaggaggccccaattgagcctccagttcctcctatggagcatgaactttccatcagtgagcagcagcagccagttcagccttctgagtcttctggggaggtcgaatcttctctgacccagcaggagaccccaggtcagcctctagaacatcatgaagtcacagtttcacctccaggtcaccatcaaactcatcatttagattcacccagtgtctctgtgaagcctccagacgtgcagctcaccatagcagcagagcctagtgcagaggtgggaaattctttagtccaccagcaggctacagctcagctctcagggtcaggtaatgatgtagaacctcccaccatccagcacgggggcccacatctgcttccagagtcatcggaagaagctggacctttagcagttcaacaggagacttcatttcagtctccggaacctattaataatgagaacccctctccaacccagcaggaggctgcagctgagcatccacagaccgctgaggagggtgaatcttccctaacccatcaggaggccccagctcagactccagagtttcctaatgtagttgtagctcaacctccagagcattcacccctgactcaagccgcagttcaacctttggatctggggtttaccatcactccagaatccatgacagaggttgaactttctccaaccatgaaggagaccccaactcagcctcctaagaaagttgtaccccaacttcgaatatatcaaggggtaacaaatccaacaccaggtcaggatcaagctcagcatccagtgtcacccagcgttacagttcaacttttggacctgggacttaccatcactccagaacccactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaatacctactacagaggttaaaccatctccaaccacggaggagacctcaactcagcctccagacctagggcttgccataactccagagcccactacagagattggacattctacagccctggagaagactacagctcctcatccagatcagcttcagactctgcatcgaaaactgactgaagtcacaggtccacctactgtgctagaacctagtcaggattcattggtgcagtctgaaagttacatccaagataaggctttaactgcaccagaggaacagaaggcctccacaagcaccaacatatgtgagctctgtacctgcggagatgagatgttgtcatgtattgatctcaacccagagcagaggctccgcaagtgcctgtgccagagcccaacacccacaatggcaccttcaccatcttgtaagaatcacctttcctcaattgccctctgtgtcctgcctgacatggcagccttttcctggaggccttcctgggccttctttatctccccaagccatatggacaactgactttctgctttcacctttgcttgtcaactctcccttctcctcattctcctttaatgttaggccccttctccagtcttttccttttactctggtcttttactcgttttcgtatccatttttatttagccccatcacatcattgcttaaccgctgctctcctcccatttttgcttcaccctctttacagcagcctgtccctctcccgatctcagtgatgatgctctaagtggttaagagttgattccagagccaggctgcctgggtttgaacccagatctatttattagcttggtgacccagagcaagttattctgcctgtgactcaatttcctcacctttaaactggggatcatgctagtttgcatttcataggattgttgtgaaatttaggtgagtgaatatatgaaacacttcatcagtgcttagcatatgtaggagagttggctgttcacatgattattcagtcctttagttttgtccagaactcatctttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggtgggcggatcacgaggtcaggagatcaagaccatcctggctaacatggtgaaaccccatctctactaaaaatacagaaaaaaattagccaggcatggtggtgggtgcctggagtcccagctactcgggaggctgaggcaggagaatggcgtgaacctgggaggcagagcttgcagtgagccaagattgcaccactgcactccagcctgggtgacagagcaagactccatctcaaaaaaaaaaaaaaaaaaaaaaaaataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaaaaaaaatgggagtacagtctaggcaaacgcttggctacaggtatggttggaatttagtagaccaacgtggttacaaagaattaggtgagggagcaatgaagatatgattctgtaaaaccttgattatcagctacaggagtttgaaagttacacaatgaggtatggaaagccattgaaagtttccaagcaagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagtgtacagttggaccgagaaactgtgagtatattctctccaaatatgacaaaaagctaactgcattgtaagatctttcttggtccagcattttgaggtcggtacctctgaggaaagatatttctcctccatgccccaaatcaaccactgttgactgcaatcgtatggttattttaaaattaaatttggtaggctctctttaaaataagaggcaatttaaatttattttttatcatacaaataatacatggttatattcctttttgttctctttttttttttttttttccagagacaggttcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtatgttttgtagagacagggtcttcctatgctgcttaggctggtcttgaactcctgggctcaagtgatcctcccaccttggcctcttaaagtgttcatattacaggcatgagccaccacccgcagcccatgattccatttttaatgtataaaaatgcaataacagatataacaaaaactctccttgtgccctactccctcatccctgaagtaatgctactctgcatttagtatacatgcttccagacttttccccatttacctacatacatatttacataaagcaaaatagatttgttttgtggtttttaaaattttttcttcacataaagggtaacatcttacaacgtgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctagaaatggaattgttggggtgaagactatgtagatataaaattttaattgccttcaaaaattttgtgccaacttactctattgtcagcagaatatgacagcattcatttcccgacaccttttcactgctgggtattctccaactttttgctgaagttatggatgaataaaagggattccatctaaatgtgaatttttctgattactcatgaatttaattaaatatctttatacgtttgttgaacatttgtgcttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccatgatgagttctaaattaaaaataaacatatgctaggcacggtggctcacgcctttaatcccagcaccttgggaggtaggcggatcacctgaggtcaggagtttgagaccagcctggccgatagggcgaaaccccatctctactaaaaatacaaaaagtagccaggtgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcccgcgtagctggaattacaggtgccctccatcacacccagctaatttatgtatttttagtagagacagggtttcaccatgttggccaggctggtctcaaactcatgaccgtgggtgattcacacaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggaaagctagaaatgatcttttgtaacgatgtttacatgggtatctgctttataattattaaactgaatatttggccaggtgaggtggctcatgtctgcagtcacagcactttgggaagcagagataggaggatcactcgagccaggagtttgagaccagtctgggaacagagtgagaccctgtctcaaaaattaaattaaatataaacaacatttatgttatgtgcactttatgcacattatagttctccaatttttttgatggaggggaaaaggttgaatggcttcacttgcagccctgacatggttccatgtggggctttcataataaggtttgggaaaagagaggaggaaatggaggttctgctgatcttggtgccacccagagttgattctaaaagggattttgtgatctagacaggaggcatgaaataatacaatttggtgggaagagtgggtaggggtgtgcttgagtgtgtgtgtgtgtgtttgtggtggtggtggagagagatggacacaaaaaggaaaatgtaagaaaaggtttgaatgaaagcagagcagatcccaccatcttgaagtgaccatgacccagctttcctccacatgcaggagacagtcctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtacaatgaataaggggttcaaattagataatctctcagatttctttgagcaataaaattctgcaattctgtaagtttgtatagggtctcagcccatctctagcactagctacctcctgtgcattttcagtttttaagttatatagacaaaatacagacaaaaacatttcacatggtaagaaaatctgagcagtgactgacacccatatgaaccttgttttataagggttcacatatcattctttttctatgcggtctacaaccaatagatccaatctaatctatggtctatttttaaatagcccattaagttaagaatggtttttgcatttttaaaggactgtgaaagaaaaagaaaagaaacaaagagaaatatgtgagagagatcatatgtggcccacaaagcctaaaatatttactgtctgaccttcacaaaaaaaatttcaaaaagttggtttagtaggatgaaaggaactaaagttaacttcagattgttgcctaaaggagaagaaaatggagaccacctgcattcatttgaacatcattattccagaatttttggtaatttaatcggaattaaattaacatttaaatattaaaaatcagctgaattatatcaataatattatcgagaatattaagctaccaagagaatagactggtattaaggatttcatttcaggaattgttatattaatacagatgtttaaaatgatggttaagtggtagagctagaaatgtttaccctaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagagagacatcttggggaaaatactctaaacttgcaaaaggaaaatgggagggcaaaacacaggaaagtattcaaggaatgccatgagtacccgtagagtacaagaagggagagtaggaaaatggagccagatcttctagggctttgaatgccaagctgaggagccaacatggggaaccatgttaccacagcagtgctgtaaggtagatctgcatcacagtcgttgagagggcacgttagaactcagttctggactccaccctcgtagttactgattcagttggtctagagtgggaccaagaatttgcatcttcagtaacttcccaggagatgctggtctttgcaagccacttctggagagtttatatgatgactgtgtgcaggatagtttaggaagggagagactagagatggagacatcagccagacaacgttacaccatccaggtaaagagggagggacaaactccatcactgtataactgaataaatttcttttatgaaatattaaagcaatataaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaactggcttaggaaaacagacctaaactaagaaggtgtagaaatgtgagactttgtttgtttgtttgtttgtttgtgatggagtctcgctctgtcgcccaggctggagtgcagtggtgcaatctcggctcactgcaagctccacctcctgggttcatgccattctcctgcctcagcctcctgagcggctaggactacaggcacgtgccaccaggcctggctaattttttctatttttttgtagagacggggtttcaccgtgttagccaggatggtctcaatatcctgacctcaggatctgccagcctcggcctccgaaagtgctggattacaggactgagccaccgcacccggcccgactattttttttaatattagaaattgtatatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggtagggttaggggctctggaaagttcaaatacaagtccaaacgtttagagttgagataaaaaatgtgtatccaatattattctaaactcttgctattattcataccaatcaacatttaataactaatcaaggcaatattttccttttccttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatataattaaaattttaccagtagaaagctactaaaattatacagcaaatcctttttgtctctagcaaggattattgtgagaattattacacagatcttagtgaatcatcagagagcagtggttctcagctggtgtgattttgtactcaggtggcatctggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacgtgtgcagtgttaaagtataaatcataagccagtatcttccacagtgagatttccttagtgcatagagaaaggattgaggttatgttccatcctgtataaattagaatcatggcaaatgataaatgttctgaaataattatttttttcctttggcttgtgtcttttttttttttagaaatcttagttgcaatgtaattacagaactcagctttggaacatttcaggcctggcacgaaatgcagtttttacataagttgtaagtgaaatagaagatgaatacatgtaaacaactatttatctacaaaaactcatacaattattgggtagctgggtataagcccattatcaactctgaaaagcgtgtcttaagatccattcatttttctcaaatggggaagctaaggtacaaagaggccaagagacttacatagcttatatatgacctcctctgcttgtcctagttctgacctatagcatgggcaagaaaaggcatcaaagaggtgaccctcaaattagccttattgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcgaaacctcatctctactaaaaatacaaaaattagcaggtcatggtggcgggcgcctgtgatcctagctatcaggaggctgaggcacgagaatggcttgaacccgggaggtggaagttgcagtgagccgagattgtgccactacactccaacctcccctccaggctggtctcgaactcctgtgacctcaggtgatccacccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctttgtataacatacccatcaaatcagagtgggtatattcagtggcctgaaggggactcaaggtgaagattctcctctacatctgactttagaaaagactttccacctgccttgtggttcagaaatctagtttcacacagttcacttcgagatagagggaagcattcaggatgtgtctggactagagcagcagtttctgcacatgctcccctctgtcctcattaatttgctgatgcataacttaggaaaagcacactaaaggtctgtttttctttttccctcacaccagagaacaggctcattaggtccctccacgaagaggtttaggtagcatcaatacaaatgttttaaactcaccatctttactaagcactttatacaactgggagtccctcataaaaatctggtggccgggagcggtggctcatgcctgtaattccagcactttgctcaggtgggtggatcacttgaggtcaggagttcaagaccagcctgaccaacatggtgaaacctgtctctactaaaaatacaaaaattagctgggcatggtggcaggcaactgtaatcctaagtactcaggaggctgaggcaggagaatcacttgaaaccaggaggcggaggttgcagtgagccgagatggcaccattgcactccagcttgagggacagagtgagactctgtctcaaataataataataataataataataatcatcatcatcatcatcatcatcatcatcatcatcatcatcatcatcatctagccagcttcactacaattatgtaggcaacaccaggaaaacactggaatcacagttgataaaaattaatgaattcactcaaaaacattcagagtgccatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctcctttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttgtaaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttacaagataaggctcaggccccacaaaatcctgaaatcatccctgggttccaatagttacaacccagtaaatctcttgaatgaagcctctatgttattgacaaatactgactggccaaattagcagggtgatagggtcagtctattttgaatctgaaatccatctcaaagacaggccaagagcttattcgtggacttaactggattctgctggcccaagcgcagtaaagtcaaacaaccatatcgaggttttgcattggggaaaggaggacatttatttgcagggcatccaagcaagaaggaccaggtggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcatatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagcttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgcagatgaggaagttgaaactcagagacgctaggtaatttgctaaggttcacacggctaataagtggcagaaccacttacaagctttgcaagtaattttcaatgcagctcttagttctcctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaatgctacccagaaaggctcatgttcattactcaagtcacttcaccagaaagtgacagagccagaattcaaacccaggtctgccagattccaggtcccttgcttcttctgttgttcctcattgcaagggagtcttcttcaaggttattctcaggactttgattaagatacaggctcacagctgggcatggtggctcatgctgtaatcccagcactttgggaggccaaggtgggtgcatcacttgagctcagaatttcgagaccagcctggccaacatggtgaaaccctgtctctactaaaaatacaaaaattaaccaggcatggggacgggtacctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaaaaaaaaagaaagaaagaaaagaaaaaaggctcaccgtttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgatctgcttatttctttgactaccttcttccatggaaccagttttccctgacagccttgggattctagcatagatcattttggagtttgtcatttaaatttattttcacggcctgctttggacattttttcagctagagctgttagaatttcagtacatttaagacagtgatgacatgctccagtcctttcatctctctctcctcagttaatagaaaggaaacatagcccatctatctggacctgtacagaagaatttggagggaaaaaaaagaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctggaaaaaagcttgccacattttactcccataaagataccaaaaaggcgatggactgggagtcagtgcaccttagtttaatgtataaaatgaaggacttgaaccagaaatggaaatgatcatctactgtgaatctaaaaacactcaaggctgggcacactggctcatgcctgtaatcccagcactttaggaggccaagacaggcagatcgcttgagcccctggagttcaagatcagcctgggctacaaagtgagaccccaatctctacaaaaagacttttaaaaagtggaaacataaatataaataaataaaaacattcatatcatttggtttgtggaaaagagttgctgtagagtcctcaaacttgagccattgagccagttcccactcagtctctccatggcccaggcacaaccttagtcaagaaaagaatgccttagaacaggaggaaaagaggataatatcgaatggccctacattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgctaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaagaggtagccgactttgtacagagcccaccagtggtcttacaacttttcatgccaaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttctttccatctgccagcatgtttggtcttctggcacctggtgttctatacagcacaacatgcttctttgtgttaaattgagacttgatccacataccatcaacgcagtattataaagtgtacaattcagtggtggttagtatattctcaaggttgtatagcaaacaatcaccattatctaaccccagaacattttcatcatcccccaaaaaaacatggtacccattagccatcactccccagtgctgtcttccctcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatttggttgtttctactttattttggcttttatgaataatgctgctatggacatgcatgtactactttttgtgtggacatgtttttaattctagggtgcatccctagcagaattgctagatcatatggcaactcttatgtttaactttttgaggacctgtcaggctgatttccacagtggctgctccattttacacttccatctgcagtgtttgagggtttcaatttccccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcaaatcctctgcctctgcccatttaaaaaattgatttgtctttttattgaattataggaattctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttactcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgagatttactcccatgtgtttgtctaagagtcttatcattttggctcttacatttaggtatttgacatattttgcatcaattcttataattgtgtgagatgtagggggtccaccttcattatgttgcacatagatgttcagttgttccagcaccatttaaaaaaaaaaacattatttccacgtagaattgttgtagcacccttgtcaaaaatcaattttccataaatgtgagggtttatttctgggttgtcaattctattctattgatttatttgtctgtccacattccagtatcacactgtgattgctgtagatttgatttgggttttgaaattgggacatttgagtcttcccactttgttattttacaagattattttcctatttagggtgccttaaattgcattataattttagaactagcttgtcactttctggaaagaagccagctgggattttgataagaattgtactgataatagcaaagatatgtaatcaacccaaatgcccaacctaactgctatgttattcctattccaatactttgcaatatatgtagctttttagaaagaggatatgttagcagggcgcagtggctcacacctgtaatcccagcactttgggaggctgaggcaggtggattgcctgaggtcaggagttagagaccagcctggacaacatggtgaaaccccgtgtctactaaaagtacaaaaattagcagggggtggtggcaggcacctgtaatcccagctactcaggaggctgaggtaggagaatcacttgaacccaggaggtggaggttgcagtaagccgaggtcacgccattgcactcaagcctgggcaacagagtgagactccaatggagacggggtttcagcacgtttatcaggctgctctcgaactcctaacctcagatgatccacctgcttcagcctcccaaagtgctgggattacaggcatgagttaccgtgcccggccaataaatgaaaactttttcactcaaaaaaacaacaattgtagtgaaaccatagatcaatttggagaatcgtgctattattatctgcttcatgtttacagaatactctgttgaatttggtttgccagattttgtcaagcatttttccatctacattcataagaaatactggtctgtaattttttgtgtgtgatgtctttagtttggataccaggttaatatcaccctcatagaataagttaggaaatgttctctcctcatctgtattttgaaagactttatgaaggattggtgttaattcttctgtaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatccttttcatcatattataatcctttatgtctctaagaacaatagtaatgtcccctctcatttctaattttaataatttggtcttctgtatttgtgcagtgcagtggctcacacctgtcatcctagcactttgggaggctgcggtgggaggattgcttgaccccaggagttcgaggccagccagggcaacatactgagaccttatctctacaaaaaaaaattaaaagttagctgaacatggtggcacacgcctgtagtcacagctactctggtggctaaggcaggaggatcacttgaggagatcagggctgcagtgagccatgattgtgccactgcactccagcctgggaaacagagtgaaaacctgtcttgaaaaatgaacagtaaaaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttatccgagtgtggtggtgcgcacctgtcgtctcagctacatcttaattttataacgttgtagttcagattaattccaactttgtttcaatggtatacaaaaacttcgcttctctaaagctccactctcaccccctcctttatactgttattgtcacacattacatctttatatactttatgttcatcaactagatttataattattgcattatgtaagtatctttttcttatttttttttgttttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccaaccagtgctttttatttctttgtgcagattcacattagtactccttatagggcaggtcttctagcaacaaagtctctcagtttttatttatctagaatatcttaatttctcttcaatttcaaaggtagttttgacaggtatagaattattggttgacagtttcttcagcactttgaatatgccatttcattgccttttgtcctccactgttgtgtgtggttgctttgtttttagacagggacttgctctgttacccaggctggagtgcagtggtgcaaccactcacatcgttgcagcctccacttcccaggcttaagcaatgctgtcacctcagcctcctgggtagctgagactgcaggcatgcaccaccatgcccagttatttttaaattttttgtagagacagggttttactctattgccagtgctggtatccaactcctggcttcaagcaattcttgagcctcaagcctcccaaggcactgggagtacaggtgtgagcaaccatgcccagcatctccattgtttttgaagagaaatcagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccattatttcttcaaatattctttctccttttttctgtttttcttctcctgggactctcattatgtgtatgttagtaagcttgatgatgtgttccacaaacaggtctctgagattccattcactttcattcatttttatttctgttcctcagggtcaacaatctcaattaaccttcaagttccccattctttcttcggcctgctgtaatgtgccattgagaacctctaataatttttccatttcagttaccatacttttcaactctagaatttctatttggctcctttttatggtttctatctctttattgatattctctatttgatgagacattgctttcatactttcctttagttctctagtctacagaactgaatcatttctcttatctctttgaatatattttaaatagctgaattaaatccttctctaggccaggcatggtggctcatgcctataatcccagcactttgggaggctgaggctgaggttgaggctgaggccaggagttcaagaccaccctgggtaacttcgcaagaccccaactataaaaaataaaaaaatctttgtctagtaagtctaatatctggtctttctcagggacaatttctgcttatttctccccccaccaagtgtttgggccatactttgtttccttgcatctttcataaatgtttgttaaaagttgaatattttaaataacataatgtagcaattctgaaaatcagatccatgctgccagggtttggtgttactgctgcttgtgttagtagttgctatttatttagtgacttttctgaacttcttctgtaaagtctcgcattatatgtcatgtgttgccactaaagtatctccttggttagcttaccgatcagctaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaagatcagccaggggtgagagtttatgaacttagtaggtctttcctgaccatgctggcagcctgccctatgcatgcgcatgacattgcaaattgccaggaatatgtcttatggacttctagtttcccaagcatatatcagagtgtttcaaaattcctgtggacatcttattactcagcttttcctattaagcttttcgattaggctttttttccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctgcttggggatgtgggctgtttttcaaggcaactactgagctagagagtgaggaatggtctaaggcaagttaacacaaatctcactgttcttacagaaatttttcttgaataaatgctcctcgggttgctgcaagactttggttacatttctagagttctgaaaaagtttattatggtcaatttttttttttgcccttttcttggtgtttgttgcttttatgaagggatgaatttttggatgtctctttttttttttttttttttttttgagacagagtctcactctgttgcccaggctggagtgtgcagtggcgcaatctcgtctcactgcaagctccacctcctgggttcacacaattctcctgcctcagcctcccgagtggctgggactacaggcgcctgccaccacgcccagctaatttttgtatatttagtacagacggggtttcgccttgttagccaggatggtctcgatcccctgacctcgtgatccacctgcctcagcctcccaaagtgctgggattacaggcgtgagccactgcgcccagcctcgatgtctttattccaccattttcactgatgtcacttacaacatggttttaaatctctgaaggctcactgggcacatgcctgtagtcccagatactcgggaggcaaaggaagaaggatccttcgagtccaggaattctgggctgtagcatgctatgctgattgggtgtccgcactaagttcagcatcagtatggtgacctcccgggaaaaggagaccaccaggttgcctaaaaaggggtgtcccagcccagttcaggaatagagcaggtcaaaactcccatgctgatcactagtgggatcatggctgtgaatagccactgctctccagcctgggcaacacagtgagtgagaatgtgtctcttaaaaaaagaagtctcatcgaccacagactaattaactatttaatcatgggaaatgattaggggaaagacataaaaagagaaactgtaatccacttttttttgctctatcgcccaggctggagtacagtggcttgatcttggctcactgcaacctccacctcccgggttcaagcaattctcctgcctcagcctctgaaacagctggaattacaggcaagcgctgccatgccctgctaatgagaaattgtaattctcatagaggtcctcccagaggagtagaagaaggttgaaaggcacttctgtatttagtcttctcaatattaaggctgggcccagtggctcacaccagcactttgggaggccaaggcaggtggatcacttgagatcaggagttcaagaccagcctggcaaacatggcgaaactcccatctctactaaaaacacaaaaaatagccaggcgtggtggtgcgtgcctatagtcccagcaatttgggagactgaggaaggagggttacctgagcttgggaagaggaggttgcagtgagccaagatcacgccactgcactccagcctggtcaatggagcaagaccctgtttgggtggggaggggaggggagtggacaggagaggagaaaggaaagaaaggaaaggaaagaaaatagaaagaaggaagggggagggaaggaaggaaggaaaaagagagagaaagaaaaagaatgaagaacgaaaataaaaattttttaaaaacctaaggttaaaataaaccctttttcttcatatataaacacatgagttcaaattacagctttgctgcttaatagcttggtgacccaggacaagttatataacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggtcaacctaaaggcagattttcttttatttcttcctgtttcttttatttttcttgttcaccttaaagaattaaaaagaaaatcgattccagcattttggaataaaaatttgcatcaaaatcaatttattcattttattgacatataaacaaaatgtcatttgtttattcaataaacatttgttaaatgcctaatacatttcagacatcatgccaggcacggggatgacagggcatggtggcgggcacctgtaatcccagctactcgggaggctaaggcaggagaattgcttgaacccgggaggcggagattgcagtgagccaagattgcgccactgcactccagcccgggcgacagagtgagactccatctcaggaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctattttttttaactgtgcaaattaagccatgaattttaaaaactttataaagataaaagacaagcatccagcccagtggctcaagctggtaatcctatcagtttgggaggctgaggcaggtagatcacctgaggtcaggagttcaaaaccagcctggccaacatggtaaaaccccgtctctactaaaaatacaaaaattagctgggcatggtggtgggtgcctgtaatcccagctactcggaaggctgaggcagaacaggagaatcacttgaacctgggaggctgaggttgcagtcagccaagatcaagccattgcactccagcctgggcaacaagagtgagactccatctcaaaaaaaaaaaaaaaaaaatagatgaacaacgaattatgatgagcaaattgaattatggaggatgctagaaatagtgtttcctccacagtcagggcttcctaccaacatagtcacttttagggtttttgacctgaaaagttctgtggcatattttttctttgctatccactttttttttccttgtagtctcaaaggtttgtcagtatactttaaaacaatcctggtaacagttctagattgaaggagactaaagaatcatgtactaagtgtaatgtctgatgtttgattggattctcaattttttaagccatgttatgattgggacaattgtgaaaatgtgtatatggaccacatagtagacaatgataatatgaagttccattgggtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaacttgggggcagaaaaagaataccaaaaattttgggctcaagcctgtaatcccagcactttgggaggccaaagagagagggtggcttgagcccaggagttcgagaccagcctggacaacatggtgaaaccccatttctacaaaatatataaaaattagccaggcgtggtggcacacacctgtagttctagctactcatgaggctgaggtgggaggatcacttgagcacaggaggcagaggctgcagtgagccaagattgcaccactgcactcagcctgtataacagagcgagacctggcctcaaaataaacaaaagaaacacctttgtggcagaggtaaggctgctatataacaaaatgctgggttacggttccgggtccattccatatgaagatcagaggcttccactggacccaaaggaataatactagtcacttgtgattgttcctctataggtttgaaagatgtgtcaggccaactcattggatgcagttttaatctaaaactctatacattgtactcccaattcatagacttcttgtatccatgaaaccctcttctgttttcacagtctcaatgtggccccaataaagccatccttttggaggactcagaaaaggccccccacaacctctgcaacataataattatagttaactcttattgagcactcactgtgcaccaggcatttttcaggtattgattcatttgatcctcaaaattcattagaggtaggtactattataatgacaaggccaaggaacagagatttaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggttacctcttttgcccaaatttacgtattgaaaaaaattcaaacaagccagaaagatgaaagaatagtacagaatctaatcaaagatcaggcactgcatgtcatgtcttcatttcctttaatctaaaacatgcttctactttctttgatctttcatgacattggcattttttaagagtcaaagatagttgtcttgtaaattgtcccacaacccggatttgtctgtttcctcatgacgaaattcaagttaagcatttttgggaaaaatactgcataggtgatgtatccttcctgcctcgtaactgcagatggcctgtaatactaagtttgatcacttgaccaaggtgaacttccagatctctccattgtaattattttgctgggtacagtggctcccacttgtaatcccagcactttggaaggctgaggtgggaggattgcttgagcccaggagttctacaccagcctgagcaacatggggaaaccctgtcactactgaaaatacaaaagtacaaaaaaaaaaaaaattagctgggcatggtggtgcaagcctatactcccagctactcgggggactgaatttggaggatcccttgagcccaggggggttgaggctgcaatgaggtataattttgccactgtatttcagcctgggtgacaaaataaaaataaaaaataataattttccgcttggtaattaataaataatctgtgggttgttactttgagttcagtgaagatcctgttctcaaatgtcttttcacccaaatgtgcatcagtgataatccttgtctgaatgaatttgtattacactgatggttgcaaagtgacaattttaaaaattctgtcattccttctacatttactagctggcattatttcattgaagaagaactccccctctttctttttctatatcactcttcgtggattcttctttatattaaatatgttgtaacttattgttgttattcttttgaatgctcaaattgtccagatttgaccaatgcaatctttgttattttttaactccacaatcgaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgagttgggaagagatacttctgaattaaactactaatcactgtcacccaattctaatcccaaccatctttattctaggcataccatactcactgccatgcttacccttcagttgggcacctttgccctccttcctattggccttctggttcctacccaactgtccagtccataggcttcaatgacacctttttcccacacctgtggcagcgttggctgcctcctttacctactcaagtaaccgctttaccgctaatttattgctctctgttttcatctataggatcttacctagccatatggcctgctgcctctgccaacttaaaaacagcattgaggctgtctgcaagacagtcaagctgcattgcaacagtgcatgtctgacaaacaccatacattgtcgtgagtccaaattgcgcggtgataaattgttacattaagtatttgtttttaaactttttatttttaatgatgataaaattttaagctaatgacataattgctttatttttatttactcattcagagttaaactccctcaatttctgaactactcccttgctgagagtcaggttctcagttactattacaaaatttaataatagaactgttccatatgcacaaaggaccaagacaaaggaatgggaaggctagagaataacattaacatccacacactgtgtactgtgctctctgcttgatgctttgcccacagtgataatttcttcatatagtgcaaagtagtttgtaaggtggttttaaattcatgaggtctcaagtactctctgccttataggacagatgtagatacggtttcggtttttctgtttttacagttttataagagtacaagtgatgctgttttatttgaagcctgagagcttctggttccataaccagaaattgctacctggctcttctaatagaatggagggcttttccattcttagaccatccaactctgaacttgctctgaatctcaaacctttctgttcacagaacaaatgctcaagggctttcaagagtgtttctgtagattaggtttattagcatcaacttcatgacttctaaaatgtgactactttcatgtccagatagcttgaatacaggtatctaccagtgatatggggtggagaattaataatgcttggttacataaagtcagtgttgcttatttttcaaaactttttttttttttttttaccaattatattattcccttctccccaagaagtgggcagaaaagctttgttaacctccttttacagatgaagaaaaacaagatcagaggtgctaagtgctgtagcctagtgccaggtcttctggccccaattctgggttctccccaagcccatgcttcttccactttctcacaatctttacttcttcctctgaccctcaccaccacccaaaatacttttaattctggaaaagaaacccagctgcacactggcacacttgaccttcatgcagtcagaagctttggctgattccccatccaaaatattagagatgaaatgaaagcaaagtaggcatctgacaaaagttgctttttcccttctgcattttaggacctcaagtaatgtttatccagaaactgttatcataccagagattcactgtgtatttaacaacataggcatgcaatctggcaaatttgaaaaactcttaacatacaccccaaatccctgcccaaatttaagaactagggtggacacagtgcttttttccatgtcgcatcttctgtgatggggctacgatatgtgggagcagagaatggggagggtggagcgcatgccagatgaggatctatcagcaatgggagggggcctccactttagcatctccaccctgctcctctcagaggaccgcctttcattgcattcagctgtgatggtagcaagaacacaggcgcaccgaggacgaggagagcgggagccttgtgctctctctgcatctgaggcaggacagcacagggtatggagcagtctgcagagaggccagctcatcagctcatcagggaagcacttgtcttccaccttgggctttgactgagcactgggcaattggaccctggggatcaatgaaataatcctaagcagagttactctatgtcacactatggaatgttccaagtagatggccgtgttttcaaaagatatattttctccttttgttgttgccatttcataggtttaggattgggtgtgtgtgtctcctctctgaatggcactcaaatgtttgctgactcctactctgtgtgactggggtgtacagctatggactgatgcatcccatcccatcatctttcatgagcaaagcagtctcttttttgacagctgaagaagaatctgtagggaatccagaaggagcattcatgaagacgttacaagcccggaagaattacacaagcactgagctgactgttgagccggaggagccctcagacagcagtggcatcaacttgtcaggctttgggagtgagcagctagacaccaatgacgagagtgaggttatcagtgcactaagttacatttgccatatttctcagcagtaaacctagatgtggaatcaatgttactaccgttcattaaactgccaaccacaggaaacagcctggcaaagattcaaactgtaggccaaaaccagcaaaaagtgaatagagtcctcatgggcccaaggagcatccagaaaaggcacttcaaagaggtgggaaggcagagcatcaggagggaacagggtgcccaggcatctgtggagaacgctgccgaagaaaaaaggctcgggagtccagccccaagggagctggaacagcctcacacacagcaggggcctgagaagttagcgggaaacgccatctacaccaagccttcgttcacccaagagcataaggcagcagtctctgtgctgacacccttctccaagggcgcgccttctacctccagccctgcaaaagccctaccacaggtgagagacagatggaaagacaacacacacactatttccattttagaaagtgcaaaggctagagttacaaatatgaaggcttctaaaccaatttcacattccagaaaaaaataccgctttcacaaaactcgctcccgcatgacccacagaacacccaaggtcaaaaagagtccaaagttcagaaagaaaagttatctgagtagactgatgctcgcaaacaggcctccgttctctgcagcgaagagcctcataaattccccttcacaaggggctttttcatccttaggagacctgagtcctcaagaaaacccttttctggaagtatctgctccttcagaacattttatagaaaccactaatataaaagacacaactgcaagaaatgccttggaagaaaatgtttttatggaaaacactaacatgccagaagtcaccatctctg

SEQ ID NO: 1096 - DNA, 22797 bp, Homo sapiens
atacttaagaattatctgaaaggatacaatcgataatttttttttgagacagtcttgctcttttgcccaggctggagtgcaatggcgtgatcttggctcactgcaagctctgcctcccaggttcacgccattctcctgcctcagcctcccgagtagctgggactacaggcacctgccaccgcacccggctaattttttttatttttagtagagacggggtttcaccgtgttagccaggatggtctccatctcctgacctcgtgatccacctgcctcagcctctcagagtgctgggattacaggcgtgagccaccgcaccccgcctattttgtttttttctttttgagatggagtctcactctgttgctaggctggagtgcagtggcacgatctcggctcactgcaacctccgcctcccaggttcaaatgattctcctgcctcagcctcctgagtagctgggactacaggcacccgccaccatgcccagctaatttttgtatttttagtagagatggggtttcaccatgttggctaggatagtctcgatctcttgacctcgtgatctgcctgcctcagcctcccaaagtgctgggattacaggcgtgagccatcatgcccggccacaatctatcattttttaaaaataagaatgaaaacttgccctatcaggcaaaatgtactgcaaatcctaagtaatactgtatttccagattaaaggcactactgcaaagaaaagtgtaaatttatttaataccaaatgtttcctaagtttactttttgcacaatgcacagacacttttgggacaatgtatggttaaaaactaatattctaccaacagctccatgctgctctagatcatcctgaaggaaaaagtaatgcaaaggatgctgggtctccaagtcccaggactggctgatagcctctcccagtggatagcaggtcctaattctcttcttcgagcagattctctgatttcagctgggccttcctgatgctctccaagttcagttgttgatattttcttttaaaaaagccacactgaaacaaaggaaggaaaagtccagttacaggccaaagatagccatctgtttcagaaaaccggcattctggctgttgcctaaatagcccctatattcctctgcttctcatacttactactcccttctcctaacttactctgaatctctcctggagagtccaatccttcaagacctctggtgctcatccctcaatcagaactgactccaccttcctctgaaccctgctctcccgagcagctgaacctttttaacttattttgcaaagcatgataatttcggctgtactggatctaatcttatttatgcaaaaatactcagtatagcctatgatgctgaagacagaaggagatcaagtacagcttcctacatcaagctcatcatctagtaggaaaaagagataattacaacacagtgtgatgactgccatttggaagggtttctagaagggagctcacagcaaacacacagaagccagcacagaggactcaggagtctctagaccgctttcagggaagacagtgagtgaagtgagcagtcatggagggcattcctgacaagaaaagcagcctacgcgtacgcagaggcacgaacctatttagggaatagtttgacttgttgggagaaaaaagcaaggtcaggtgcttatgcctgtaaccccaccacttcgggaggccaagatgagaagatggctcgagccccggagtttgagaccagcctgggcaatatagggagacctcatctccacaaaattaaaattaaaaaattagctgggtgtggtggcatgcacctgagtaacagtcccagttactcaggagactaagatgggaggatcacctgagcctaggagtacgaggctgcagtgagcccttaactgtgccactgagctccagcttgggggacaaagaccctggtgtttatttttaaaaaagaggctgggagtggtggttcatgactgtaatcccagaactttgggaggccgaggcgggaggatcacaaggtcaggagtttgagaccagcctggccaatatggtgaaaccccgtctctactaaaaatacaaaacaattagccaggcatggtggcacattcctgtaatcccagctactcaggaggctgaggcaggagaatctcttgaacccggggtcagggtggggggaagggaaggttgcagtgagccgagatcgcaccaccgcactcaagcctgggcgaaagagcggaactccgtctcaaaaaaaaaaaagaaaaaaaagcaacacttaagggcagagacgggtagcggacagagaggagaggatcttaaatagcagtagaagagtttgcacattaagacaggggaaggcaaggaaaagatttcaacaggggaacaacagtcacatctgttttaaggccttaccgttaaggcctcttccaagtaagttataaatgctggcctagggttgaccttccaggccctattgaactcacaggtaaccgaacataacagtattaagttctgggccttgagaatagggaggtaccaaagaaatatatataaaatcactctttataactcagagttttctcttttcagacagatactgttttactcatttgtctaaatgggggtgtgcagttgaaggaggagaaaaaagtggccacgaggccagggcagctgctctaagtcagaggttggctgtcctaaggagttctgtgcccaaaactagagcccagtcttccctcactgtgatgccatgagtagaactgaccttgaacaggatgaccagaatcacgatcaacaccagaagtccaccaacgctgcctttaatgatgataggcaaagaatggtacttctcatctttcaggaagacgacagtgatctagacaagacaaagagatcgcccaataaatcaggtgaagcaaacaaggaaaaaatcctacatgttattttaaggagcaaaatacgaggacttggcaacaacccgtgtattgatcaaagctgatgacagtaaagcaaaaagctagatattccctgatgcagcattttagatcatctaaaactatccaatcacccaaatacttcgtaagaaactattctggccccttatctagaagggctaggtctgtcaggagattatgaccttctgttaaagatgctctgacagcttgaaagagggtcccacggaatccggtctcaacacaggactgtgaggctgtcacgccgctacactgctctatgtccctgagccccgtgcctatgctctttaaaatgatgacttcctttaaatgatctccaagtcctttccaactccgttctgacggctctttttgatcttgcacagatccctaaaggctttggtaatacactttccccacataaaatatgacaaaagtactggtcttcccctcaccagactaaaaagtgtgtattacctaagggacataataaatgcaaattatatccatgtgtactacttgcagagctcagctattagaagtcatccgcaggttttgttttccaaaggctctcccaatttcgggagtctaatctctcttctggcagggctcagctagaaagttcaggagatgtccttcctgagacccaggtatggcccttccaagttgtggccagaggaagttcccaggacttaggtggggccagagagccaacaagacttctctgcctgcccagagcaacccttcacgtgtatgtttaagcaccaaggtcaggggtgctttggagaggtttctgtacggggtgaagggctggacaaacttacctttaaggcctcttccaattaagttataaatgctggttgacctaaagttgaccttccagtcctatttagctcataggtagctgaactaaataggagtgaagtcctaggctttgagaatagggaggtaccatagcaacaaagagggaggaagaacagaaagagggctggaatattctacaggagaaggagggggactcaagaccctgggtttgggaagtgaaaggaagtcccaaggtgactcgggaaacaggccagatgtgagtagaagaaatgtccctatttctcaaagccacctccctttatcttcttctaaacccacagattcccaaaagtgccccaaagatgcccaagtagaggttaagggagaagcaaggcaccgggtactactgtttgcagcaaacacggatgctggcctgcccaggggcccctctctccttttggattttattcaggaatcatcgttggtctcaggtgatcatgacacagctattctcctttgccagtgactgacatgagattcagatctcactaataagatgtaagaggatgtctcctgggagcttttggaaactgtttcatccctgaaaagggaaggcacatgaagaaaaatccaacatccttttgctactgacttcttgcttcctgttttgtatcctgccatgtgaaaatacagcatttggagatgtggcaactttgtgctggccatgaaggaatgcgtcccccacacggcagagtacaaggaccaaagaagccaggccatcgccccaggccggcctccctcactggataaacagcatatgcccttatgctgcatgagctggattttccctttcttgtggctgaaatgcatttggatacagtttgtttatactcatagagtcactgtaagtcaggggcttattgtcaggaactacttaacactttgcttaggatattggatttaaagaaaggaattttggggaatccatgctatagaaataaaagtatcagtaagtaagagggggaaacatacaaatttaaaatgtgcacataagaaacttaatagtaactcctccctgctgggggcatgggaagggagaaatgaaggaacaattatttttcatttggtaccattctctgtatggcttggattttcttgctattatttttatttgttaaaatctgggcagtgcaataatggggcacttctatttcttccgttttctgtattttccatttccctctattttctgtattagaaatacactacttagccggacatggtggctcatgcctgtaatcccagcactttgggaggtcaaggcgggcagatcacctgaggtcagaagttcgagaccagcctggccaacatggtgaaatcctgtctctatttaaaaaaaataaataaattagccaggcatggtggtgggcacctgtaatcccagctactcgggaggctgaggaagaagaatcacttgaactggggaggtggaggttgcagtgagccgagatggcaccaacggactccagcctgggcgacacagtgagattcttcctcaaaaaaaaaaaaaaaaaaaaagaaaagaaaagaaaaagaaatacactacttaaaaataaaaggaaatgttatattggcatgtctagagaattgctcctttctcctcctccagggaggaaaacagaggaccttatatttagcaatccagcatcactctcctgacattccctctagtagagaatcatgcctaactaaagagctcagagctcacagatagatcacctctgaagccatgtccaggcaagggtcaacaagaatgaaaacacagggtaacacacaaagcattcagtccacaaatcacaggcatcagtctgacttctagtcatacttttgcaaaaagaattccaagagttccagtatctagtctaaatcttataaaagatttatgcattcctgagtactgtttaatactataactaaacactgatacagcacactaagacagttactggatacaaaaaacaatttctcacttaggtaattcattttttatttatttatttattttttgagactgagtctcactctatcactgaggctggagtggagtggtgtgatctcggctcactgcaacctctgcctcccagattcaagcgattctcgtgcctcagcctcccaagtaggtgggattacaggcacccaccatcatgtccggctaatttttgtatttttggtagacagggtttctccatgttggccaggcttgtgttgaacttctgacctcaggtgatccacctgtctcggcctcccaaagtgctaggattacaggcgtgagccacctgcgcccagctgcgaaatttttttttttaatcaatccattttcaaatcaaagtatatactgcagattccagcctagttatttcaactcagaactcctcagcttaggcctcttaattgccttatttcataagaagctgactcactcaaaggtcacaaaggcagcgatggcagagccaagatcagaagtgttaaggctgaaaacaggaagagggcaacagaatgtctgtggaggtgctcaaaggttaggcacaattttccttgggcactactcagaagccagccaggaattaccttagttctgtggttctctgcattcagtccctcatatagagatttgttgaaagatatttcaccaaggatctgcagttcagttacatcttttagtaactagaagatggggaaaggaatgagggaaacaaaacatattttagacatgaactcactgtgtttgaacagccttcaccacctttccctttaaaggtattcctgggcttagttaatggccctaacgtacacaacactacataaagttacccaaacaagacatctgcagttattcttcaacttcctttttttttttttttgagatggagtttcgctctttcgcccaggctggagtgaagtggtgcgatctcggctcactgcaacctccaccccgtcaggttcaagcgattctcctgccttagcctcccgagtagctggaattatgggcatgtgccaccatgccaggctaatttttgtatttttagtagagatggggttttgccatgttggccaggcttgtctcgaactcctgacctcagatgatctacccacctcggcctcccaaagtgctgggattacaggcgtgagctgccgcgcctggccttttcttcaacttcttttcccttgtgccatccaaagtcagttcttgactgactgacttatttttgagacaggatctcgctctgtcacccatgctggagtgcaatggcatgatcatgggtcactatagcctcaaccttccaggctcaagtgatcctcccacctcagtctcctgagtagctgagaccacaggtgcaccccaccacactgggctaatttttgtattttttgtagagatggggttttaccatgttgcccaggctggtctcaaactcctgggctcaagcaatccacccaccttagcctcccacagtgctgagattacaggcatgagccaccacacccagcttattcattttatttaacgtaagagatttttcctttttttttttttttttttttttttttttgagacaaggtctcactctgttactcgggccggaatggagtggctcaatcatagctcactgaagcttcaaattcctgggctcaaacgatactcctgcctcagcctcccaagtagctgggactacaggcatgagccaccatgcgtggctaatttatgtatttatttatttttaagaaatggggtttcactatgctgcccaggctgatcttgaactcctggcctcaagcaatcctcccgcctcagcctcccaaagtgttgggatgacagatgtgagccaccacactcacaattctttttttttaaattatttcttgtatctgtccctttcttttccacccccattgctacttcttcagttgagacctcacaaatgtcacctggatcactgtaaaacattaaacttgatcacttgatcactagttcccactttagaataagtgatcagggaaggcctctctaagaaaataacacgtgtggccgggtgtggtggctcatgcctgtaatcccagcacttcgggaggctgaggtgggtagatcatctgaggtcaggagttcaagaccagcctgaccaacacgatgaaaccccatctctactaaaaatacaaaattagccgggcgtggtggctcacgcctgtaatcccagcactttgggaggccaaggagggcggatcacctgaggtcaggagttcaagaccagcctcaccaacatggagaaaccccatctctactaaaaatacaaaattagccgggtatggtggcgcatacctgtaatcccagctacttgggaggctgaggcaggagaatcgcttgaacccgggaggcggaggttgcagtgagccgagatcgtgccattgcacaacaagagcgaaactccgtcttgaaagaaagaaaagaaaagaaaagaacacctaggtcgggtgcggtggctcacgcctgtaatcccagcactttgggaggctgaggcgggcgatcacctgaggtcaggagttcgagaccagcctggccaacatggtgaaaccccctctctactaaaaatacaaaaattagctgggcgtggtcgccggcgcctgtaatcccagctactcgggaggctgaggcaggagaatcacttgaacccgggaggcggaggttgcagtgagtagagatcgtgccactgcactccagcccgggtgacagagcaagactccatctaaaaaaaaaaaaaaaaaaaagaaaagaacacctgagctaaatttaagaagaaaccacctacgtcaggacctagaggaagagcagtgtcaagcaaaggaacagcaagtacaaagtcttgtggccagaataatgctgtactggcgagctagaagaataggacagaataacccgattataaaaggggcagtgggagagaaaggcgagtactaggagatgaagttgaagaattaagcagagaccagatcaagtactgccttgctctggccatgaaaaaagtatggattttagtctaagtgtgctcaagcatcagttttgtttgtttgttatttttaataagcaggggaatggcacaatctaatgtctgctcttagaagacggatagctgttacgtgggaattatttgtaaagaatgtgggaaaagcagaggcaagaaaggcaggccgaaggttattgcaacagccctggcaagaaagggtagcttgaattacaacggcagtggaaatggagagaagtgaatgggtttaggatatattttggccctgaaatggcagggcttgctgctggaatagacgtggggatgtaggaaagaggagtcacaggtaatccctcgagttccttgtactgtaactggagtatatctccctcctgagggtagctaaggaacgggttgggacagagggttggttttttgcaccaaaagatctattttggacatggacatgttatgcaaagatgctattatctcttctaggggcgatgcccgtgagcaactggataatcaaatctggagcatttcagtctcaaacacctcctcagagtgatcccaggagatctctgcagccacggtgacattttctttatctgaagcgatgacacagctcactgaatgccattcttccacatgctggaaaagcgaggtctagtgaacacaattcctttccgtgcggaaagtctgaaatctttttaacacttcggacacagagcatcgtaaggtcccagaatagagggtgtgagcaatttcagcgctcacctcggcccaagcgaagctccagcgggagcaattgagacccagggacgaagctagggagggcctggcagcccccggcactggccggcaggggtaacccaggaaaaacagtctcctggcctctcgttacccgcttcaggccctccgccctcccctggcctctcgggacggccgcgcttacctgaaccgaactgtacgcacaagcgcgctcctgactccaggtgcacaccgtggaggcctgaaacgagagccatgaccgcgacgcgctgaacaaaccaagccgccagttttccgtcccgtcccggccccggccctggcgaggtgcgcatgcgcagggccgggagctaggaccccgcggcaggcgggcgcgtccgcgtcgcacggaagtctcgcgatgtttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggtgaggcggcggcggaggcgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcggcctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaatagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgtctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaacgctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccatccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcacagtggcgtgcgcctgtagtcccagctactcgggaggctgaggcaggaggatcgcttgagcccaagagttcatatctagcctggtcaacatagcaagacccctgtctctatttttttaaataaataaactacatgtgaaaacaaacgtttatatttataaaccctcttttttttttttttaattttattgagacagagtcttgctctgtcacccaggctagagtgcagtggtgcgatctcagctcactgcaacctccgcctcccgggttcaagcaattctcctacctcagcctcccgagtagctgggattgcaggcatacaccaccatgcccggctaattgtttgtatttttttagtagagatgggggtttcaccatgttggccaggctggtctcgaactcctcaccttgtgatccacccacctcggcatcccaaagtgctgggtgattacaggagtgagccatggcacctgacctataagccctctttctaattgtcagcagagtcctttctgtaaattcctttccgttttttgagccttaacacttatgtagtctgagcaaaaaaaaaatgcccaggcttcagcttcatactgagcagagcctgttgcttcaggtatcaaggctagctttgggaaccagactacagatgagacaactgaaagcaaagaggctgaggcaaagcagagaccaaaaaagagtctcaggggagaagaagggaagctagtaagcaacttatagggggcagtgtaagaaatgtcacatgttacatcgctcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctcagcctcccaagtagctgggactacaggcgcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggaggaaaactgacaggttgctttaagagctgagtgattgagagtccttctgaacaggacttcgggaatttactcctaatcttttcccatggttaacttgtcttcactctgtttctagaactctggtttttatacttgagactctgtagtcactgtggaaagaggtgtgactgataaagaactgcctttaaatacctgagtcctcgtcagcttcttcactgctacaacctggagacctcgtaatttggttgggacgcaaatttgcaactggtattctgctccaaagaggttctccccatgtacctgcaaattaaaatcagagtaggaaatcaaagctggtattgctttgccatctacagctttacaataataagtacttacatggaagaggaattctttgtggtgagaaagcccctggcctgtgttcacgtacattatggatggtctgcaattgacaggacatgcgtcagcccttgaggagtctttctcccttttttggagacagggtctcactctgttgcccaggctagagcacagtggaacaatcatggctcagtgtagcctcaacctcccaggctcaagtgatcctccacctcagcctgggaaagtgttgggatgacaggcatgagccactacactcatccctttttttttttttttttttttttgaggtggagtcttgctctgttgcccaggctggagtgcagtggtgcgatctcagctcactgcaacctctgcctcctgggtttaagtgattctcctgcctaagcccccaagtagctgagattacaggcgcctgccaccacacctggctaattttcatattttcagtagagacggggtttcgccatgttagccaggctggtcttgaactcctgacctcaggtgatccacccacctcagcctcccaaagtgctgggatgacaggcgtgagccaccgcacctggccttctctttttgaatgaactcgactgctttcaactgaatacattaggacagagggcaccagacctttaccaggaatgaggccgggtgcagtggttcatgcctatcatcccagcactttgggaggccgaggcaggcggatcacctgaggccaggagttcaagaccagcctggccaacatggtgaaatccccgtctctattaaaaattttttaaaaattagctgggcctggtggtgtccacctgtagtctcaactactcgggaggctgaggcaggagaatcgcttgaacctgggcggcagaggttgcagtgagccgagatggcaccactgcactccagcctgggcgacagagtgagacttcgtctcagtttaaaaaaaaaaaaaaaaggaataaaagctgaatgtcaaaatataaagtggtcgtagcgcagttggggtgaggtggaatatttgaattctgtatcgttgggctggttcattttctaattatccctcaaatggccttactcatcccctccttacttcccagtcccacagctgccttcttccctccacagcgtcatattaattcccttttgtagcacgactagttggcaatacacctcctttgatgaccacagtggggtttctgtgacccaaatgttagcaccctagagatcaatatcagagcctgggttctaagcaggctcctctcagaaggacagtgtccacattcatcctgaccaccagctccatctacgagagagagcccaaagctgccccctgggcgatggagtcacaccgctgctggcctcttgggagtactcacttggacagaactgcaacgaagccatgcctgaattgaagggtgtgggtctcgttggccaaagaccgtctttcattggaactaggaataagagtgttagttcatagcacacctgctttgtacatagcaagtgcttcttaaaaagggcttcgctctgttgcccaggcaggagtgcagtgttgccgtctcagctcactgcaacctccgccccccgggttcaagcaattctcatgcctcagcctcctgagtagctggaattacaggcgtgagccaccatacccagttaatttttgtatttttagtagagatggggtttcaccatgttggccaggctggtctcgaactcctgacctcaagtgatctgcctgccttggcctcccaaagtgctgggattacaggcgtgagccactgcgcctggctatttttttaagttccagggtacatgtgcagatgtgcaggtttgttacataggtgaacgtgtgccatggtgctttgctgcagctgtcaacccagcacctagttactaagcccaacacgcattagctattcttcctgaagctctccccaaccctgcccctcccacaggccccagtgtgtgctgttcccctccctgtgtccatgtgctctcactgcagaacaggtgcttctgcacctggctccccagggtcactgggagtcagataagaaaaggctctcagaggctgggcgcggtggctcatgcctgtaatcccagtgctttgggaggccaaggctggtggatcacgaggtcaggagttcaagaccagcttggccaagatggtgaaaccccatctctactaaaactacaaaaattagctgggcgtggtggcgggcgcctgtaatcccagctactcgggaggctgaggcagagaactgcttgaacctggaggcagaggttgcagtgagccgagatcacgccacagcactccagcctgggcgacagagcgagactctgtctcaaaaaataaataaataaataaaaggctttcagagataagcaattggagttcagaattgtctctagaagaccacacttagaagaatactgattttaaaagggcttctcagcctccacactattgacgttttgggccagttagttcttggttgtgggggctgtcctgtactgctctgcgtgatgtttggcagtattcctggcctctacccaccagatgtcctactgaacacccccctccccaagtcatggcaatcaaaacaggcacagcctctggtgggcagaatcacctccctttgagaactcttcccagcagcgttccccaccttaccccccaacacagaggtcttgcaggtaacatagctatcccaagctattccaaagctgagtgaacgagaaccagaactccagggctcattccaccaggctgtaccacagttttactttgtgtgtgaacaaaagaacattttcattatctctggtaacaagaagagaaagtcgagtccctgcagggaaacagatgccttctgtgggctcactggggtttcctttctccctgggctgtaagggggccgttcctctcacagcgtgcatgtggcagggagatgtcttccggggtcatagcctgactctgctgtgacccaggcagtacttacttggtgacagtcacagtgatgtctgctgtcctgtttggaaaggcattctcctctagctgccaaacgactgaaacatgagcctattttaaagggggaaaaatggtcagttgattctctctatgccactcacaattcagaccgctagctactcgtggaacagacctaggagacgattcctcagattttcacattcctcacatttttctaacacagcatgtttcctttcccttccttttttttttttttttttttttttgagagggagtctcgctctgtcacccaggatggagtgcaatggtgtgatctcagctcactgcaacctctgcctcccaggttcaagcaattctcctgcctcagcctcccaagtagctgggattacaggcacgcaccaccacgcccagctaatttttgtattcttagtagagacggggtttcaccatgttggccaggctggtctcgaactcctgacctcaaatgatccacccacctcggtctcccaaagtgctgggattacaggcatgagccaccgcgcctggccccgttatttcagttaagcctcaaatacaaatatggagtaagcaaggcaggcggcctcattccccttttacaggtgaagaagccacttcagagatttcccacagcacagagatgacaagggacagatcagggttaataacttttcgtcttggccgggcatggtggctcatgcctgtcatcccagcactttgggaggtcgaggcaggtggatcacttgaggacaggagtttgagaccagcctggccaacatggtgaaaccccatctctaccaaaaatattttaaaaattagccgggtgtagtgctgcacgcctgtaatcccagctactcaggaggctgaggaaggagaatcacttgaacccgggaggcggaggttgcagtgagctgagactgtgccactgcactccagcctgggtgacagaatgaaactccatctcaaaaacaaacaaacaaaaaaactttttgtctgacacgccctccatactacccacaacttcactctgcttcacggaggtgagcaggcagttcacctagggctgtgtactggaaagctctcgtccccatcaccccctactttcagagccagcttagccactgtaagcactgctggggacacactgcagtcaagcgaagcgcaaagctggaaccgagagattgagatgagaccaagatgcagaagacgccaactgcagggtggtgagaagagcgaatcagtccaaaccgactcacagatgacctcttgaggacggggtgaccaatcctgcagttcatgatcaggacagaagcaaccggctgagggtcatcacactgaatgtttggagagggaggctgttaaaagagcagatgacattctcttaaagagccaaacaaaacaaaacaaaaacgtggtttcctcacagcaattcagcaaacattcactaatttttctgcctgtcagacaccctgccaggagctaaagaaataaagtccacttggtccctgtcttcctcacaagccggacaggcagggtcagcagtagatccccgaggaatttaaatacaaggtcgaaggggtgcttctgtgagggagctgcagagaacagcagtggagaaatatgaattccaactcggaggaattcgtaaggtcttcctggggaaggaggcatttgagctgggccatggactgatgcaaatataacccacagcctggctggaaggccggcacacaccagcactgccacgtagccaccagggctccccacctggacccccgaggggcaggtgatgactgcagtgagttttcttaattctcccagggacggtccatccctagttcccctctagatgcctaggagattgttttttgcttttgttttcatttttttgagatggagtttcactctttcgcccaagctgcagtgaagtggcgcgatctcggctcactgcaacctccacctcccgggttcaagcaattctcctgcctcagtctcccaagtagctgggattataggtgcccaccaccacgcccggctaattttttgtatttttaatagaaacagggtttcaccatgttagccaggctggtctcgaactcctgacctcaagtgatccacccacttcagcctcccaaagtgatgggattacagccgtgagccacggtgcccggcctaggagattgcttcattcatataatggatactgtcctagcccaaatagcctaagatgaccggggacaaatctacagtccaacaaattcaaatttattgactcactgcaatgaggaaaactacactttggttttgtttgtttgtttgtttgtttttgagacagagtcctgctctgttgcccaggctggagtgcagtggcgcaatctcagctcactccaatctccacctccgggttcaagtgattctcgtgcctcagcctcccgagtagctgggattacaggtgtacatcaccacacctggctaatttttgtatttttagtagagacggggttttgccatgttggccaggctggtctcgaactcctgacctcaggtgatccgcccgcctcggcctcccaaagtgctgggattacaggcatgggccactgcacccatccaaaaactacactattgtgtgtatcactgaacaatggaaaaggcggttattaaaggactccagggaagggtggagttcagatgaaatgtaaataaagtcctgttttgatggtaaagcagggctgagtgtcaaggagtcagtcaccagcaggccagcctgtgaatcagacccagggcccgcttcctgggaaaccattaatatggagtagaaagttgacagacactgtatctgaagctctctacctcaggtggaaacagactcttctcttggtcaaaatgacttacactctccaggcaagagggataggggttcataattaccgacgtaactacttcaaacagcaaagttttctttcttgttttttcttttgagacagactcttgctctgtggcccaggctggagtgcagtggcgcaatctcggctcactgcaagctccgcctcccgggttcacgccattctcctgcctcagcctcccgagtagctgggactacaggcacccgccatcgcgcccagctaatttttttttgtatttttagtagagacggggtttcaccgtgttagccaggatggtctcgatctcctgacctcgtgatccgcccgtctcggcctcccaaagtgctgggattacaggtgtgagccaccgttcccggcccaaagttttctgatctgtgattttagagaataaaatttctcagtgcagtgatacttgtcagccacagggtgtcctcgggaaacagactgtttcctagtatctgtgtctgtatccagccttgggaatggcagggcagattttcactttcccagtctaagctaatttttactttctcagtgtcttagggcattagactcacttctctctcagaaccctggtgaagaaagggccgcacatagggagggtggcactgcagcagaatatggtgcctcgggaggcatggagccggactggcggggatttatctagttattaaccatctgttggttggaccaggaggaggctggaggcaggggtgccagtgagggggccaccacagaaaagcaggcatgcagcgagggaggggcgtgagggacctgtttccacagccaccgtcacagtcaccttttgcatcctcttcaactgcaggtttctggggtaattcaaggccatgcttgtcatgtaggaatcttccccggagttagttaggttaatgttcagggtcagctcctttgtgagacccaccaccaactcctgcctgcacagggtacagataaaaatgttacagtttatttcatctgtaaaaacctcaacgcaatacaataggacattcaccgaggctagagcgtggtgctgtggtgcaatgatcacggctcaccgcagcctccacttcctgggttcaagtgatcctcccacctcagcctcccgagtagctgggactacaggtgtttaccaccatgcccagctaatatttttcttatttttatttttttgagacggagtttcgttcttgttgcccaggctggagtgcaatggcacgatctcggctcactgcaacctccacctcccaggttcaagcaattctcccgtctcagcctcctgagtagctgggattacaggcacgcgccaccatgcctggctaattttgtatttttattagggacggggtttctccacgttggtcaggctggtctcgaactcctgacctcaggtgatccgcctgcctcggcctcccaaagtgctgggattacaggcgtgagccacccagcctggccaatgtgcagctaatttttgtattttttgtagagacagggtctcgccatgtggaggcgggtcttgaactcctgggctcaagtgatccacctgccttggcctcccacagtgctgggattacaggtgtaagccaccgcacacagcccagaatagcaccttcttaagtaacttcttagataagttgcctaaggaatacgtttagcttagacattcttcctctcaacataagcaaacagctggactgccacgcccatctcagttgttgcatgagatgacgataatagctgccctttatttagtgcttaccatgtgccaaggactgcgtctcacacgctcaaccctcatagtaaccctgtgaaatagtacagctactctccattttatagaagaggaaacagaagccaagacaggctaattacctgtcatcccaacactttgggaggccgaggcgggtagatcacctgaggtcaggagttcaagaccagcctggccaagatggtgaaaccccgtctctactaaaaatacaaaaagtagccgggtgtggtggcaggtgcctgtaatcccagctactcgggaggctgagacagagaattgcttgaacccggtagggggagtttgcagagggctgagatcacgccactatactccagcctgggtgacagcatgagactccatctcaaaaaaagaaaaaaaaaattagccaggtgtggtgcaggcacttgtaatcccagctattcaggaggctgaggcaggagaattgcttgagcccgggaggcagaggttgcagtgagccatgagcacactattgcactccagcctgggcaacaagagtgaaactctgtctcaaaataaataaataaataaataaaaggctaattaaatgcctggagtctagtagtccaaagaattgagagaattgtacccaaatcctctttctaccaccaattcactgtgaccctaggtgaggtactctatgacacaaattcatccatgccacaatatttatggggcactgctgtgcactggagaacagtgtgcataagacatactgtcctaccccgtttcttggcctcagcttcctacccacaaaatcattcagacccttcccattaaaaggctgtggtttaagacatgggtccacatgtcctggaaaagagggtcctggggatgtgtgaaagggtcctccagaatgctgaggtatcacagggacccagagtgcagaaccactctcagta

SEQ ID NO: 1097 - DNA, 123333 bp, Homo sapiens
gcacaccaccacgcccggctaattttttgtattttagtagagacggggtttcaccacgttggctaggatggtctcgatctcctgtcctcgtgatctgcccgcctcggcctcccaaagtgccgggattacaggcgtgagccaccgtgccctgccgagtgtttactgtttttcagtttatatgtgtatgctttgtgggatgaggattatagatctataaaatgacaattcacctgctcttttgaaaaatgtgtcacgccaggtgcagtggctcaggcctgtaatcccagcactttgtggggcagaggcagtctgatcacttgaggtcaggagtttgagaccagcgtcgccaacatcgtgaaaccctgttgcctactaaaaatatagaaattagcttggcgtggtggtgcgtgcctgtaatcccagctactccggaggctgaggcaggagaatcgcttgaacctgggaggcaaggttacagtgagccgagatctcacaactgcactccagcctggtgacagggcaagagtccttctcaataaatgaatgaatgaatgaataaataaataaatgaaatttgtcattaaaatgaatggttctttttttttgagacggacaaatattttacataaattcaatcacttaatatgtgtttttttgtgactggcttcttactgtaatgttttctgtttgtttgcttgtatttgagacagggtcttgctctgtggcccaggctggagtgccctggcaccatctcagctcactgcaacctctgcttaatggatttaagtgattctcctgcctcagcctctcaagtagctgggacaacaggggcgggcaacacgacgcctggctaatttttgtatttttcatagagacggggttttgccatgttggccaagccggtcttgaacttctgaactcaagtgatctgcccacctcagcctcccaaagtgctgggattacaggtgtgagccactgtgcccagcctatttttctaaaactgtccaaaatgaccagttatttggggctctgactctttaactgctcaaagaaaggtccttaagttgaacttgatggctcttttagaattatggccaggaaaaaaaaaaaaaagaactgcttgattgacaggagaaaaggcctccccaaggattaagagaactttagggaatagaaatatgcaataacccattgtttatccacctcttctaccacctcctcactccctaatctctcccacctctcctttctgcctaccctgcttcagggggccagtctctgtttctgcctttctcagattccagccaaacttactccctaaatttgaagtctggtaatggctgagttggggaaacagccagtattaagttaggaatgaaggaattgtagcatctaaaatttttcttggagtccaagaattaaatctataccagtcttgtgataggatgagaaaattgctcatatcagttgtcattattgttactactattttcttttggaagagtatgattgaagttagggagttgcctaattttaatttctaaattgatgttttatttcgttaaatttaataaattcaatgaaataaaacttaatttaaaattaattttgtagtgactgatatttacagaaatagatacttcaaatctaaaatcaggattactttgacaaatctaaatatctaatacaggggagattgaaatgataatacagctctgaagctgtagcaagacttctcttggaatattaatggtgatcaacttcagattctatttctctaagcaaaggtaaactggtttttgaacacattcttttcctttctccccatcaatcccatgccttgcttccctaccccttttctcttttaaaatttccaatgagtgtaggctctattcaacagattgttttcttttagtaactgaggtgtcctcatttctaagccagaaactgaatttcaaacaattaacgtctacttcattacataaaaataactgtgtgtgtatgtgtggtgtatagaaaaagaacgttttttatgagcttgctattcctgtcaactctgcagctgagatgcactcatttccaggtatagccactttctcagcagacgacactcaattttcatttaggcttgaattgctcagaacagtactgccttcccaagctcccacctggtagtgcttagacataaattaagttgatcctcaaaaaaattcaaatctggtacaatattttttacaaatatgatgggcgagggggaggtggaacgaaatctgggcactgtgcaagaaaaacaagagaaatgaatgaagttgaagaaatccaatacattttgtttcattttgaacacattgttttccttagatcttctaaaacaggatttaacctatttcgcttgtactatatctctctccctctactctccaggccctcaatattctactgttgttcaatatgtgttaattatagtacttgcagttgttctctgtaatggaaaattctatcattatctatgttatcttctctcccagatttcccctcagctgcaggacatgaagtaacaagagtgggagtggttggaaccagcttatatacactttcacgtgaactctaatacataacattattcctgataaactgatagtattcaagcttaaggagccaatatataaaaattcattgtaggggaaaaagataacttaaataacatggtttttagtatatggcaataaccaaattaatgctgcaacttttctttataagaatgtagccggattaaaatgttaaagaaagagtataaataagctagaagatgacggtgggatggggagcatttttggcaaaattgaaataccctgaggaagaaaagtacacagtatatttgatatgttgaaagaactccaatatggccaacacataaagagcaacataaaagtgatagtgattactgttgttgttttttttttttttttgaggagtcttgctctgtcacccaggctggagtccggtggcacaatcttggctcactgcaacctctgtctcttgggttcaagtgatcctcctgcctcagcctcccaagtagctgggactacaggcatgcaccaccatacctggctaattttgtatttttagtagagacggggtttctccatgttggtcaggctggtctcgaactcccgacctcaggtgatccgcccgtcttgacctcccaaaatgacgggattacaggcgtgagccactgtgcctggccacaaagttctatttttttaaacacaaatgcaacataattattattatttgagatggagtctcgctctgtcgcccaggctggagtgcagtggcgcgatctcggcttactgcaagctccgcctcccaggttcatgccattctcctgcctcagcctcctgagtagctgggactacaggcgcccaccaccacgcccggttaattttttttttttttgtacttttagcagagacggagtttcaccgtgttagccaggatggtctcaatctcctgacttcgtgatccgcccgcctcggcctcccaaagtgctgggattacaggagtgagccaccgcgcctggcccacactttatatatatatatatatatatatatatatatatatatatatatatatatatatacacacacacacacgctttgtatatacatatatatgtgtgtgtgtgtctatataaatatacatatatatacatatatacatatatttacatatacatacatatatatacatatacatatatatacatatatacatatatttacatatacatacatatatacatatacatatatatacacatatatatatatatactggaaatatggaaatatagtttccagtttatatatacatacataaactggaagtaaattacctaagattagcataatgactaagtcaataatggtacatccattattaagtaaccatcaaaaaatgattcctactggtggtagctcacatctgtaatcgcagcacttgggaggctgaggtggacggattacttgagaccaggagttcgagaccagcccagccaacctggcaaaacccagtctctactaaaaatacaaaaattagctgggcgtggaggcactcacctgtagtcccagctactcgggaggtggaggttgcggtgagctgagattgcgccactgcactccagcctgagcgacagggcaagactgtctcaaaaaaacaaaacaaaacgaaacaaaacttagctcagtataatttttctaaattatgattaagggaccagggtccgagtctgatgcctataatcccagcactttggaatccgaagcaaacggactgtttgagttcaggagttcaagacccgcctgggcaacacgtgaaaccctgtctcttaaaaaaaaaaaaaaaaaaatttagctaggcatggttgcatgtgcctgtagccccagctacttgtgaggctgaggcaggctgggcgctgtggctcatgcctgtaatcccaacactttgggaagccgaggtgtgaggatcacgtgagcccaggaagctgaggttcagtgagctgtgaccatgccactgcactctaggctgggcgatggagggagaccctgtttcaaaaaataataaataaataataaattaaaaaatgattaagatatgaaattcttaataaaattctgtgaagcccataaataatactttcataaggttttagatatgagagaactagaaatgagtttgtaattattaaatcaggttttaaaaataatccatctaatggaaagcactgaggcaagaaatttatttatagttctactctagccatgtctgacatcaacctaaaaattccaactgagatttaagaattctaatatcgaaaataaactagaggaaaaaaaatgtagggataataattcatataaataaatgtcttcaatattgggataattatatccatcattcagcattgtttaaatgaaaataaataatgggtatgaagtgtctaacacagtgcttggaacacaacagaaatggtcattcttactgacaataccaacctgtagtattttaacttctatatctggattatgtttagtgggttgtttttttgttgttgctgttgttgttgttttgagtcagggtccctttctgtcacccagactgtagtgcagcagcgtgatgatagctcactgtaaacttgaactcctgggctcaagtgtgtctcctctgtcagtctcccaagctcttgctatgttacacaggatgggctcgaagtcctggcctcaagcaatcctccaatctcagccttccaaagagctgggattacaggcatcagccaccaagcccagccttgtttactgtattttacactgttacactgtgatagtagttctacacacatgtaaagactgcttgtcagactaaataatgttatgtaccaatattaaaggactggccaaaaattctcttgataaaaataagcaggacaaatattcagctatatgtactttttttttttaatgtgtaaaagatcagagagaggatatttactaaattttctcattctatagatgagaaaactgaagccccaaagggtcaggttgtctaaacttctattcctagttgatgacagaacctacttagaacagggatacttgccttatcagggatgagttttctctaattaagaaatcaggcctggtccgggcactgtggctcacgcctgtaatcccagcactttgggaggctgaggtggacggatcatgaggtcaggagatcgagaccgtcctggctaacacggtgaaaccctgtctctactaaaaatacaaaaaattagctgggcatggtggcgggagactgtagtcccagctactcggggggctgaggcaggagaatggtgtgaacctgggaggcggagcttgcagtcagccgagatctgcgccactgcactccagcctgggtgacagaagagcgagactctgtctcaaaaacaaaacaaaaaaagaactcaggcctgggcgcgcggtggctcatacctgtcatctcagcactttgggaggccgaggtgggcagatcacctgaggtcgggagttcaaggtcagcctggccaacatggcgaaactccatctctactaaaaatacaaaaattagccaggcattgtggcgggcgcctgtaatcccagctacttgggaggctgaagcaggagaatcgcttgaacccaagagacggaggttgcagtgagctgagatcaagccactgcactccagcctgggcgacagtgagactccgtctcaaaaaaaaaaaaagaattcaggctgggtgcagtggctcatgcctgtaatcccaccactttaggaagctgaggagggaggatcgctgcagcccaggagtttgtggctctagtgaactacgatgacaacactgcaatctagcccttgtgacagagcaagaccctgtctcaaaaaataataattcaaatgtataatattgattagtaagaacttagaaagcaaacagaagatactttgtcttgaactatgaaaactgctcagagtatgcttcagaaagaattactggctatcatgttgcttctccttttagcttcatgatactggatgttcataatcaaataaataagattatttaggttgagaaaaatctcatgggttgggcagcagaacaaattaataatcttcaaacagatcttccctttacagatatgatcacagaaaactagaagttgtcagtgacttagaagggtctagagaaggccaagcacggtggctcacgcctgtaatcccagcactttgggaggccgaggcaggtggatcacctgagttcaggagttcaagaccagcctgaccaacatggagaaaccctgtctctactaaaaatacaaaattagccagtcgcagtggcacatgcctgtaatcccagttactcgggatgctgaggcaggagaatcacttgaacctggaaggcggaggttgaggtgagccgagatcatgccattgcactccagcctgggcaacaagagtgaaactccgcctcaaaaaaaaaaaaaaaaaaaaaaaaaaaaaaaaaaaaaaccaaaaacagaagggtctacagaaagcataaagatgtactgagagagagaggaagggagacagggagggagaggatcattgctaatgcatgatgcagtctaccctaaagtgggaaatgatgggagaagccaagaacagcaaaaaatagccaaggcagaaataaacatactttataaatagatgagggaaaaggggttacgtgtgtacatgcatgtgtgcaaaaaaataaggagattagaaacagtctggtggttccttagaaagttaaacatgagtcagaaaggccatatttaagaaaaaaaaaaggaaaaaggtagacttatttgaacaagcaatttcactcctaggtatatactcaagtaatattaaaacatatgtccaccccaaaacttgtacataattgctcatagcatcattattcctaacaggcaagaaaaagatggaaaaatccaaatgtcctgcaactgatgagtagattcacaaaatgtggtatatatacaatggaatactatgcagccataaaaaggaatgaagtgcagattcatgctacaacatggatgaaccttaaaaaacattacagtgggccggatgtggtggctcacgcctgtaatcccagcactttgggaggctgaggaaggcggattgcctgagctcaggagttcaagaccagcctggccaacacggtgaaacaaaaaattagccaggcgtggcggcgtgtgcctgtaatcccagctactggggaggctgaggtaggagaatcgctggaacccaggaggcagaggttgcagtgagccaagactgtgccactgcactccagcctgggtgacagagtgaggctccatctcaaaaacaaacaaagaaacaaacattacagtgggttggtggctcatgcctgtaataccagaactttggaaggctgaggcagatggatcacttgagctcaggagtttaagaccagcctgggcaacgtggtgaaaccctgcctctaacaaaaatatgaaaaattagcagggcatggtggtgtgcgcctgtaatcccagctactcaggagcctgaggtgggaggattgcttgagcccaggaggtagaggctgcagtgagctgagattgcgccactgcactccagcctgggcaacagagcaagatcccatctcaaaaaacaagcaaacagaaaacattacagtaagaagccagtcacaaaaaaccacatattaagtggttcaatttatatgaaatgtccatgagaggaaaatccagagacagaaagtagattagtggtagcctaagttggggggaaatggggagatggtaggaggatagctaaaggatacaaggtttctttttggggtaatgttcataattgattgtggtgatggtggcaccactaaaaaccattgaactgtacactttgctgggatacagtggcatgatcacaatttattgcagcctcaaactcctgggctcaagcaattctcctgtctcagcctcctgagtagctgggactacaggagtgcaccactgcgtctggctaattttctttttgtttaacgtagagatgaggacttgctgtgttgcccaggctgcctcaaactcctggcctcagcctcccaaagtgttgggattacaggtgtgagccaccatgcccaaactgaattgagttgtatggtatgtgaactggatctccatgaagttgttagcgaaaacaaaaacaaaaaccaaggagaataattgtggcaatgcaaacctgaaatgaaaaaacaaccagcgccaagtgtggtggctcacgcctgtaatcccagcactttggcaggctgaggtgggaggatcattcaagcctgggtgattgaggctgcagtgagccgtggtcatgtgccactgcactccagcctgggcaaaagtgagaccctgcttcaaaacaaaacaaaacaaaacaaaaatgaaaagaagctgggcatggtggctcacgcctgtaatcccagcactttgggagacagaggcaggcagatcacctgaggtcaggagttcgagaccagcctgaccaacatgaagccccgtctctactaaaaatacaaattagctgggtgtggtggcgggtgcctgtaatgtcagctattcaggaggctgaggcaggagaattgcttgaacccaggaggcggaggttgcagtgagccaagaccgcgcgactgcactctagcctgggcgcgacagagagagactccatctaaaaaaaaaagaaaagaaaaaagaaaagaaaaaaacacccaaaagtcagtgagaaaacaggcaagacaaagtacctatctcaggtatctaaaaggctgagtggagttcaagtgtagtgagctatgattgcactccagtctgggcaacagtgcaagactctgtctctaaaagaaaaaggaaaagaaaggaaaagagaaaagaagataaatgttcagaaagtgacttgcttttgataatacttgttcagtctgttacactgtgcggtaaaacttggtgtttaaaatttgctaaatgctgtggcaaacattcattgtgtgaattatctatttcgtacggtaaaatgcccactacatgaaagaatggcatcactgtaattatgcctaattcatttttgtatcccctgcagcacttagcttgatgccttatacacagtaggcattcaataaatatttgatgaaggaaactaaccatcatagccagaacttgaggttctgtaattacaaaacataactgaagccaaattttagccattaaaaaaagcagaatattatattacatttaaacattttagtgaacctttaaatgagaattttaattgttaccaactaaaatatacatagcataatttagtaatttgatatgaaagctaaaagatccatcagaaagataaggacattttgggaaatgcttagaaaatgctgtgattttattcatagtatatacaccacaaaacagacactttccattattttgattacttcaaaatttaaaatctgcttgtttttcaattgatttttttcatgacagatgctgagttctgacccatttttttcccctgacagtatcaataggctgcccgactacatgatacaattgtttttagcatttaaatttaagactatggctcagtgtttgaaaaataaataagttaacaaaagagaaacattattaggaggaaaatgaaaacatattcaccacatgataaaaaaaatcactccttaaaaatcaataagtggtgtgagcattatttcacttaacctacttggaagcactataataccaatatacaaataaaacagaacccataggtagcctggaatgatacagtggccatcactaattaggggctagttgacaacataaatacaaataaatgaaattacaaattaaaaaaaacttgtttttagcttaattgttggtgcagaatgtatggcgggggctggttgtctggcagccgctttagctttgctcgcttggcttgctcgaacggcagtttctagacgcactttcaactcaggagcagcccccattactgtcttgaaagcatgtggatacagaggtccaatatgcattaaattctggagtgcaaactcatgaagatctttggaagctgaacttgctgaggcaaaagaattttcatccagcaggtaagatatcaaagtgggaactaaaagagcaagtagctggactcctgtaaataataaagtatgaaaaaagatcacaaacataaggattataataaactttaaaaactaggcaattgccatggaagactgaacataataaaatataagtacacatgcacagcctactttagacctcaataactcgtaattaatattaaatatttactaaatgtacaagctggaaaccaggtttgttaatattgtatattttacatttatattaatttgctttacttaaaaaaaaaaaagggccaaaggttaaaaagtaataaaacactttacaattgccacctggtagaatgtatcttgagagtaagattataaaatttttacgggcattctagaatcaggagattggagtgaggaacagaaacctgaaaagcatctatttaccattatttaactaacactagttgtttctttcctctttaagtagaaatacaatacaacttttttcctatttcatcatcccccaaaactcacagtgaggggaaattcctcaaaactaagggaatacataagcttagggttaaaaaaacaagaacctatgtccgactgatataaattccaagtccttaaaaaagtatttatttggaggcttcatctccttttgttagtcttttgtctttacttatattaacaactccatcctgggatataagtttcattaaaggtgattttttttaacaattaacctttatatgtaattgtgtgtgtgtataacatctcataatcacattgagaattacgcgttctcccccttaattactgttaatttttgtagaatgacaactgacgcaattgtaaggcaggaggaagcatctggtagagaatgtgtgacactcactgatgtcagcaaggacagtgataataatcagtgaagcctttccagaatcccagttccaccctggaccttactccctattttctttccctgctgtatttttttcttcacagctcctatcaattcctgcatctaactatagatgttatatctacatctaaaattgatatatccatcatcactatataaaattgcacaaagatacatgtctacatataacagacacagatacacacacacacacacacacacacacacacacacacacacacacacacgtataggggacgagaagtgtttattgtctgtgttttcctaccagaaatgtaagctccatgagatcagggacctttgcctgttttatttcacgagaaattctcaatgcctagaacactacctggtacacagccatccagtaactatgctttgaatgaataaacatacatactctttctcttggcaactacccagaagtttccaattaaatggatttgtttccatattaagttttcagaaaagaggtaaaaagcttatttttaaagtcccaggtaaatcctccaatcttctagatttagttcaatttccctcatgtacaatgttaatagtattataggggtaggcgcggtgggctcatgcctgtaatcctagcactttgggaggccaaggtgggcggatcccctggtcaggagtttgagaccagcctaaccaacatggagaaaccctatctctactaaaaatacaaaaaaaaaaaaaaaattagccgggcatggtggcgcatgcctgtaatcccagctactagggagactgaggcaggagaatcgcttgaatctggaaggcggaggttgtggtgagccgagatcgtgccattgcactccagcctgggcaacaagagcgaaactctgtctcaaaaaacaaaacaaaacaaaacaaaaaaacccaaaaatattagctgggtgtggtggcacatgcctgtaatcccagctactctggaggctgaggcaggagaatcgcttgaacctgggaggcagaggtctcagcgagcagagatcgtgccattgcactccagcatgggcgacaaagcgagactccctttcaaaaaaaaaagttaatagtattataaaagctggctttcataataaaaataaagtagagaattataaaatatatataaaattatcttcagtatattggcttgctaaattggaagaggtttcaatagtaggttttcaacagtaggttgaaaattaaggttttggttttaacaattttaaaatataactggaggccggacgcagtggctcatgcctgtaatctcagcactttgggaggctgaggcgggtggatcacctgaggccaggagttcgagaccagcctggccaacatggtgaaaccctatctctactaaaaatataacaaattagctggacgtggtggcaggcgcctgtaatcccagctactcctgaggctgaggcaggagaatcacttgaactcgggaggcggaggttgcagtgagccaagatcaggccactgcactccagcctgggcaacaagagtgaaactctgtctcaaaaaaaaaaaaaaaatatatatatatatatatatataaaactggaaaaaatataagttatttaagtattcatcaaatatctagaaatatgctaagcattataggaaatgttacataatttgtttctacctggattcttttattatctaaatgaaaacagtagacagcacatagaacaattagagtactaagtgctaaaaaacgtgggtagcatttccgtatagaattcaccaagagaatcacaaaactgaggaatactttgggattttatttggttggttacaaataccaaataaattctatgaagggtaaaatcggagtgagctacgcaattaggcaatatttctcaaagaaaagatctaatgtaggtttaatagatttgtataagaaaaaaataagagaaaaaacaactgaagaaagtgaaaataatatgaacaatgtaagcgattaaaaggagcacagaaaggaaactggtctggtcaggttagtaggtacacgttggggagcagaaaaaatattttgaaaagcaagcaaagacgttcagacttgatgctgtaaggaaagagtaaacttttccaaattcttaagcaaaggagagataaaattactttaggtaaatttgatggggaatatcagctaggaaaactattatagttatctatttaggaggtgattagatataagaataaggtgcaagtttctcttgaaacctagagaaatttcagaaagaaatgggacaagatttgaataacagattcaataaagatgatgaacaaggagtcaaatataattctaatatttttagcttataaccttggtcatgcagggtgaaaaaacatatactgcccattcttataccggatactgtaaagttgacaacaaaattaacatctgtaaatgggatgaaaaaagttgaacgacttaaattcaaaagctgaaaatttaccctcttggaatcatgtaactatgtaaaatatgaagtgaagtataaaaatgttgccatcaaattaatatgatttacattcattcatttatttgatggtatcctcctaatgagtgtcatcttatttcaccaatgagacttgtgtgcctttggttttttatggcatttagtcttagattcagttttaattttaaaaacaggcaaactgcttattctacctcttaaaagtcttgttagagtacaaaacatctgttatctgagtagtgaagcagtccattaaaaaaatgaagaaatcacgatggtgcttttttttggtttttttttttttttttgagacagagtctcactctgttgcccaggctggagtgcagtggtgtgatctcggctcactgcaacctctgcctcctgggttcaagcgattctcctgcctcagcctcatgagtagctgggactacaggcatgtgccaccactcctggcttttttttttttttttttttttttcagtagagacggggtttcaccatattggccaggctggtcctgaactcctgaactcgtgatccatccgctttggtctcccaaagtgttggcattacaggcgtgagccaccacacctgaccaatggtgctgatcattgctacacctcattaataatgctacaaattggtctggttgatagttgaaattacaatgctttggttgttttatatcttaaactgaaaaagggtcatttatttcaaagatattgctaaagcctaactagctattaaactatatttaattatacaaatgatatatatattcttactgtcaaaaaaatcaaacaatacagaattaaaaaaaaagttcccttccctatctgtcctcatgctaaatttaactccaaattagggtgcctgtaaaggaattgatcccaagagtcaactcaaaaatattttaaatactagaacgcaataaaacttagtgctgggattacaaagtgagtaagattcagtcctcatctttatggaatttacaattagtaaaataaaaatacaaataaagttattttgatttgccaaacataggccatgtcagtcataaaatttttgcctaaataacctatattgttactaatttcaactaaatttatcaacttctccaaacactgccttttctgactttcccaattttgatgttgttttcatgcaacatagtaatacttgcttcttttcttttgccttctataaccagttaatcatcaaatcagataaacctttcttccactttctcctctgcattcttttcttctactggcatagttctggattattattttatagaggagctattgaaatcgcttttcaaaaatctccactacttttccaattttctgtgaaatgtttttaagagaagaggaaaaaatttttaacagaaaagaaaaaacaggtacagtttgtaggtggagagcaatgtgacaatatagattaaaagtctttttttcttttttttgagatggagtctcgctctgtcacccaggctggagcccagtggggtgatctcagctcactgcaacctccgcctcccgggttcaagcaattctcccgtccagtctcccgagtagctgggattacaggcgcataccacgaggcctggctaatttttgtacttttagtagagacagggtttcatcatatcggtcaggttggtctcgaactcctgatctcagatgatctgcctgccttggcctcccaaagtgctgggattacaggcatgagccaccgcgtgcagctaattttttgtatttttagtagagatggggttccaccacgtttgccaggctagtcttaaactcctgatctcaagtgatctgctcaccttggcctcccaaagtgttgggattacaggcatgagccactgcgcctggccaattaaaagtcttaaaatgtgcattcccttctctccagtcatttcactcttaggaatctgacagaaataatttaagaataaagatgctcatctcggccaggtgcagcggctcacgcttgtaatccgagcactttgggaggctgaggcaggtggattacttgaggtgaggagttcaagaccaacttggccaaggtggtgaaaccccatctctactcaaaatacaaaactaagccaggcgttatggcacatgcctgtaatcccagctactcaggaggctgaggcaggagaatcacttgaacttcagaggcggaggttgcggtgagccaagatcgtgccaccgcactccagcctgggcaagactttgtttcaaaaaaaaaaaaaaagcttcatttgtgatcttgaaaaattaaaaacagcttaatgttcaatcataagatactagtttaaaaagtacagtctgtctacaattaaaaatcatattttgaaggacaaatattgtgataaaatcaaagcttaagtattaagggaataaagaaaatatattaaactgcataagtttctggttaaatggatgtatgcagtagtttttcattaaattaaaaaaaattctaaataacaagttttgagatattttaataattatgtttggtattaatacttaactggttatatttgttataaagcttttatacctctattatgaagattagaatatattattttaaaaccctatgaaatgggcatggtagctcacacctgtaattctagcactttgaaaggccaaggcaggtggatcgcttgagtccaggaggagtcagagaccaacctgggcaacatggcaaaaacctgtctctacaaaaaatacaaaaattagccaggcatggtggcacatgcctgtagtcccagctactccggaggctgaggtgggaggattgtttcagtgcaggaggcagaggttgcagtgagccaagatggtgccattgcatgccagcctgggtgacagagcgagactgtctaaaaaaaaagaaaaaaaaaccctattaaacatctatatttttcctagatcttaagggatgcatacattcctagaaaaaaaaaaatcgctgtgttgaaatgccattggcaattcatttgaacttcctgctcaaaaacaaacaaagaaaaaaatcaactcactacattatgtaacagaagcaaaggcctggttttttttcttttcttttttttttgagatggagtctcgctctgttgccaggctggagtgcgctggcatgatctcggctcactgcaacctccaactcccgggtccaagtgattctcctgcttcagcctcccaagtagctgggacagcaggtgtgcgccacacacccagctaatttttgtattattagtagagatcaggtttcactatgttggccaggatggtctcgatctcctgacctcgtgatccacccaccttggcctcccagagtgctgggactcccaaagtgtaagccactgcgcccagcaggcctgtttctaatatcaaataagatttatatacaatacagatcttcattctgaactagtagctttttataagaatatacttactgttttgttcttcaccaagagcaaccagtgtttcaagaacttttattccttcttgaaccgctaaaagctctatgttactggctggtctgtttctttcaacagcttttagcttttcaaccactattggagctaatgaatgaatataaggagttgaaagggcacgattggaatgctggaagactgagaggagaagctggtaacatttggcttgaacctatataagaagaacatattatcaattaacatgtgtatagttcttatttgctctacaatcacattgcatcttactatgtactgaaaataagtgatactgcaggacaaaaatggaaattacattttctacttagagaaatggagtagaatagaattttgtgacaaaaattagtcaaaaatgttcatatattttaatgaccaaatcaccatgcttatacaattcctgtatttcttttttctttttttgagatggagtctcgctctgtcgccaggctagagtgcagtggcaccattttggctcactgcaatctctgcctcccgggttcaagcgattctcctgcctcagcctcccaagtagctgggattacaggtgcgcaccaccacacccagctaatttttgtatttttagtagagacggggtttcaccatgttggtcaggacgctctcaatctcctgaccttgtgatctgcccgctttggcctcccaaagtgctgggattacaggtgtgagccaccatgcccggccaattcccatattttaatactgtgaaataagttagaaatcagttattcccacttctgtttttaattcttcctttaatgtacaattgtccctcccattttaaccaaatatatttactaaggaaggttaaatatttgaatgatctgaaacaaagctataaaaatacattgcttagatatctcaaaaccacttgattccctggaaatgactgttaacaatgtaaggtttccagacctagaaaataaagtcttactggctccactttgtattagaaaggcttcagattaacacttttttaaaaaaatgaaggaaggaaagaaggaagagagggagggaagtcccaccaatatatgggacacagtggaagaaaaccatttcagtgctttggtagaacacaagtggctaaatatggctagacacaagaaaaacctgaagaacattttaaatatacagatcttggagccacctatctggagactcagattcaggaagacagtactggaatccaagaatgtttccttttttttttttttttttttttttgagacggagtctcacactgttgcccaggctggagtggtgcaatggcacaatctcaactcactccacctcctgggttcaagtgattctcctgcctcagcctcccaagtagctgggattacaggcgcatgccaccacacctggctattttttttgtatttttagtagagatggggtttcactacaggctggtctcgaactcctgacctcctgatctgcctgccttggcctccctaagtgctgggattacaggcgtgagccaccgcacctggtcttcaagaatgtttctgctttttaaaatttctgacgtgtagcaggcttgagaatcaagtttagactctgacattgtaaaataaaaaatcttactttctagacaaactagtttctagcaggttcattaaaacgtcaataatataagcttctcctttaatgtccttagcgtcatttaaataaacactggaaaacataatcatagactcttgtctctaccagtatgccctggggttaatcaaatatttcagatattgaagaatttctacatatgtgaataaacatacacatgtgttctagtgcttaaacccagtgatttgtttcagtttttccatttaaaagccatagtgcaaatacttagcttttcattatgtatcacatattttaatgaatcaatctgacattttcctgataaagggaaatgtttttatctatgtctgtgtaacgtgtaacttacccatgggtcgcatgaatttaatgcatttttaaatctgttcatgcagccattctgtaatgactggactcctattatttcattactagcagaccacaggaagagtgcaattgctgttagcatgcttacttcatcaggtgtaggtacagagtcttctgaaaatgaaaaatgaaagaagtgtgctgtttctaaaacattttggcattttatttttttatttttgtagagagagacgttgtcttgccatgttgtccaggctggtcttgaactcctgagctcaagtgatcctcctgccttggcctcccaaagtgctgggattacaggtgtcagccactgtgcctggccagaattttaatcttgaacaatcatctctctctccccacaacatttatagtagtacttgccttaatctaatacagtccacagacaactgtaagaagttcaatgtataaagttaaatgtatgcagttatatttaatgctaaattattataaaatattctaactaattttaaaatccagagtacatttttaagtgatatctcctttcaatttagtaaatatgaaaacctgtaaattccatataaccattaaaaaaatcggttgggtgcagtggctcacgcctgtaatcccagcactttgggaggccgaggcaggcggaccacctgaggttgggagttcgagaccagcctgaccacaaaattagctgggcatggtggtgcatgcttgtaatcccagctacttgggaggctgaggcaggagaatcgcttgtaccggggaggtggaggttgcagtgagccaagattgtgtcattgcactccagcctgggcaacaaaagcgaaactctgtctcaaaaaaaaaaaaaaaaaaacttggacaatttcctgaagacagtgttctaagaattttaaggaatttcttgccattacatttattcaggaatagatacaacttgaacagaaatatagtacgtaattagaaataactagaaatatgaacatttattctaaagaacaatatttctgaacatataaaatacgagttccaaacattttgtgattatcatttcttcaataaaactgatccctatcttttgtgtaaatttgacctattttggcaactgtaaatacccagtgataatcagtactttagaaggattacaaacatatatatgtgacatgctaacattatctcataataagggtaccagctttttgtaatatggaataaagggttaagaacaatagtctagaaaaagtccattaacttaatgtaaagaaataaagtttaaaaaaagagatgtcggctgggtgtggtggctcatgcctgtaattccagcactttgggatttctagaacagactggacaacatggtgaaacatcatttctactaaaaatacaaaaattagctgggcatggtggcacacgcctgtaatcccagctatttgggaggctgaggctacagaattgcttggatccgggaagcagaggttgcagtgagccaagattgcgccactgcactccagcctgggtgacagagtgagactcagtctcaaaacaaacaaacaaaaaaacaaacaaaagagatgtaaaatttgaaggatttaatcaatttataataacctgagtcacgaatgttaaaaacctgagaacccacccagactaggcagctcactcctgtaatcccagcactttgggaaactgaattgggaggactgcttgagctcaggaattcaagactagcctgggcaatatgctgagaccctgtctctacaaaaaacaaaaaaattagccaggcttggtggtgcatgcctgcagtcccagctacctgggaggctgaggcaggaggatcactttagccctagaggttaaggtggcagtgagctgcgttcatgccaccacactccagcctgggtgacagagtgagaccctgtctcaaaaacaaacaaacaaacaaaaaacctaaaacaaaaaaaccctgaaaaccccatcataggaaatttattctacatagaatataatctcttactcagagttggcaatgctgcaagcaattttttatcaaaaattattttatattcattttttaaaaattatttttttttcttttttccccccaaggaagagctggagtgcagtgccatgatcataactcactgcagccttgaactcctgggctcaagcaaccctcccacctcagccgcccgaggaggtgggactacaggcatgcaccaccatgtacagctgaatttaaaaattttttatagagacagcgtcttaccatattgcccaggaaagtccgaacttctggcctaaagcaaccctcccaccttggcctcccaaagtgctgggattataggtttaaaccaaggtgtccggccccattttatttttaaattgtgattttaagaagatggggcatctaaatatgatttttctactgaaaggaatcaaggcttttggagaaggggctgattctagaacagtgagggggaaatactcagtctgctacatcttggggctagaaagtatggaagtgctcaagaaataatggggccacattgaagtaacagtaagggacccactgaattaaaaaaaaaattatgggccgggtgcagtggctcatgcctgtaaatcaatcccaacactttgggaggccgaggttgggggatcacctcaggtcaggatttcgaagccagcctggccaacgtggcaaaaccccatctctactaaaaatacaaaaactagccaggaacggtggcggacacctgtagtcccagctacttgggaggctgaggcgggagaattgcttgaacataggaggtggacgtggaggttgcggtgagccaaaatcgcgccattgcactccagcctgggcaacagagtgagactctgtttaaaaaaaaaaaaaaaagaaagaaagtttgatgggaacagacaagcgagaaagtctcaaagtatttccccacaggttacctattaattataaaatggaaaaatggcaacttcatagtggggaaacacggcagacaacttcttaacaaagttattaaagttaagattcccaataatgggacaaagcaacattacaaagcaatatgtcttagttatatgatgtgctaagatataacattacttatgcagtattcctgccaagatgcatacattgaatctaacctgagaggaaaaaaaaaaattagacaattctaaactgagaaacattctacataatagatggctggtattcttcaacaacattaatgttatgaaagacaaaggctgaggaactgccccagattaaaggagactaaggcaatataatgactaaaaaaaaagaaaagggctctatgacggttattattaggacaagtagtgccaaatttggtaattcttctgtggttatggaagggaatgtccttgttcttaggatatccatgaagtacgtaggaatagagtcatgatgacttcatatcctcagatggttcagcaaaattaataataatattaacaataatgatatgtggattatagagaaagtaataaaccaggtgtggcaaaatgttgacaactggtgaatctaggagaagggtatgctggagttccttatgttattcttgcaacgttttttaaagtttgaaatttatttcaaagtcaaaggatctaaaaacgaaaaacaatgttgaagcaattaagagtgattcattagatccaagaagatttttgtacgtttgtacatgttcacatgcatacatatcctttttaaagtgaaagatgccagattttgtaacaggaaataggatttccataatggaaatactctattataaaactttgcttgttaagcaagggatctgcttgcctcgatatacaaatatacaaatatgcctgtggctttgatccctacttcataactggctgtgtctcctatgaactcagttccagacagaatacctcaggcaagttaattctattatcagacctttaaattcacctcatatgaatgaactagcttgataacatatcaaaactttcccttaatgaacaatttcaaaaatattgactctagaccccctcaacaaaaattaaattaattattttaaaacaaattcttatttatttattttttgagacagagtgtcgctctgtcgtccaggctggagtgcagtggcgcgatctcagctcactgcaagctccgcccccgggttcacgccatgctcctgcctcagcctcctgagtagctgggattacaggtgcctgccaccacgcctggctaattttttgtatttttagtagagacggggtttcaccatgttagctaggatggtctcgatctcctgacttcatgatctgtccacctcggcctcccaaagtgctgggattacaggtgtgggccactgcgcccagccacaaattctcaacgatttcttcgtcttgttattccttgtttttttttttttttttcctgagatggagtcttgctctgtcacccaggctgggatgcagtggcttgatctcagctcactgcaacctctgcctcctgggttcaagcaattctcctgctttagcctcctgagtagctgggattacaggcacatgccaccacaccccgctaaattttgttatttttagtagagacgggttttcaccatattggccagcctggtctcgaactcctgacctcgtgatctgcccactttggcctcctttgggattacaggtgtgagctaccatggccagcccttgttattcctatctatacacacatatacatatataaatatggcttttaatgtttcttcagtttgttaaaatctaccttaagaaacaaaataccagctcttgataaagctaaaataattttaatcacattaataaaactaaagttatccctggtaattttttagaagtcacatattcacttaaatgtattcattgtttaaaatagaaaaagagtataggagagaaagtaaaacttgtaactctaccacccagtaatagtttaaaaattaaattactatgttttggtttaatttcttcgggtctgggttaatttatatagttggttataaacatggtacttaatagatatattggatatattatccaaatgaatatactatcatgtactttataattcttcccattgccagatatagttatcacacattttcattgttgtaagatagatataataggtgataaataaccttgaacataattttttgatcagtaaggctaaagagtatgcttctattttttggagacagggtcttgcttttttgcccaggctggagtgcagtggtgcgatctgggctcactgcagcctctgcctcctgggctcaagtgatcctcccacctcagccttctgagtagctgggaccacaggcacacgtcactgcgctcaactaaataatgcaattctttttttttttttttgagagggagtctcgctctgtcaccaggctggagtgcagtggcgcgatctcagctcattacaacctccacctcccaggttcaagcgattcttctgcctcagcctcctgagtagctgggattataggcgcctgccaccacgcccagctaattttttctgtttttagtagagagggatttcaccatgttggccaggctggtcttgaactcctgcccttgtgatttgcctgccttggcctctcaaagtgttgggattacaggcgtgagccaatgtgctcggccctgatttttcttttatatgcttggtggccatttctattttctttgatacagatgtgtgttcttttctttcttttttttttttttgaaatggaatctcgcccaagcttgagggcaatggtgcgatctcagctcactgcaacctctgcctcctgagttcaagcaatccttccaccttggcctcccaagtagatggaattacaggcacctgccaccatgcccggctaatttttgtatatatatatatttttttgagacagagttttgctcttgttgcccaggatggagtgcaatggcgtgatttcggctcaccgcagcctctgcatccctggattcaagagattctcctgcctcagcctcctgagtagctgggattacaggcatgtgccaccacgcccagctaattttgtatttttagtagagacagggtttctccatgttggtcaggctggtcttgaactcctgacctcaggtgatccacccgcctcagcctcccaaagtgctgggattacaggagtgagccactgtgcttggcctaatttttgtatttttagtagaaacggggtttcaccactgaggctggtctcgaactcctgacctcaagtgatcaacccaccttgacctcctaagtgctgggattcaggtgtaagccactgcgtttggcctctttcttctttcacctattggtgagtaagtgaattttttctaagaactctttgtatattaatgatatcaacacagacataaatattattgtcagtttttcagctgtctttttttcatctaccatttaatgtaaggtgttttgatgggtagaagttaatttttttgtttgtttgtttgttttgagatagggtctcactctctcacccagaccagagttcagtggcaccatcatggctcactgcaggcttgatttctcgaactcaagtgatccttctgcctcagcctcccaaatagctgggaccacatgtgtgtgccaccatgcccagctaattatttattttttattttgtagagacagggtctcactatattgcccagaatggtcacaaactcctctgctcaagcgatctacctgtctcagcctcccaaagggctgggattataggcatgagccaccacaccccatctaatttctatatagaccaaaacagtaaaattgtcctctgtgacatctttccttgacttacagttagtcctctgccattctttttttttttttttttgagacggagtctcgctctgtagcccaggctggagtgcagtggcgcgatctcggctcactgcaacctctgccacccaggttcatgccgttctcctgcctcagcctcccaagcagctgggactacaggcgcccgccaccacgcccagctaattttttgtatctttagtagagacggggtttccctgtgttagctaggatggtgtcgatctcctgacctcatgatccacccgccttggcctcccaaagtcctgggattacaggcgtgagccaccacgccgaccagtcctctgccattctaacgtaaaacattcacctatattttctttgttttcctgtttaaaacattttatgttattattttatctggtacttgttttgattcatgatataagagcctaaatgaaatttatttctcaaacagctaaccaatgtgcttttatcatatattatattttatcatatattacattctcacatggatgaatgtctgtttcaaagcaatctgttctgttccactgattcttgggcctactccacagttttagataacgtggaaatgttttaataggtgagatgacaaatccttctttactattctttgttttcagttattttatattttctttacaaaagaaataaaccttgaaataaaaagtcaatcagaagaaaaacacaaaaatgtaagcatttcaccaaaaattaaacatagacatgaaaaatgttaatgcttactaagaaaatgagtaatgcaaattaaaaccgtaagacagtatattttaccaaacacagcaaaattaaaaagtctaacaatatcaaatactggtgagaatgtgggaaaatacagattatcatgctctgctggtgagagcgtaaattcatgtagctatgttggaggtcaatctggcaatgtctgatgacattgaaatgtaccatcgattctacttctaggtgtacatcctagaaaatctctcacagcacacgtgcatgagaaatttgtaaggatgttaattgcagcaatctttttaactgggataaattagaaacaacaaaaatatcattgacagggaaatgaataataattgataaaaacatatgacagaaactatatgggagttaaatgagagttttatatattcacattaacagatgtaaaaaaagttattgttgagtcacagaatgagatgacattatttatgtaaattttaaaacagaaatatatattgctcatagttatcttactctctatataacacatatataaatatatatttaatataactgacacatactcatatagaaaacatacttatttatatagatagatatttctaagaaaaaacataatatcaggccgagtgtggtggctcacacccgtaatcccagcactttgggaggccgaggcaggaggatcacgaggtcaggagttcaagaccaggctggccaacatggtgaaaccccgtctctactaaaaatacaaaaattagctgggcgtggtggtgcgtgcctgtaatcccagctactcaggaggctgaggcaggagaattgcttgaactgggacctgggaggcggaggctgtggtgagccaagattgcgccactgcactccagccttggcaacagagcgagacgccatctcaaaaaacaaaaaaacaaaaacacccgaaaaaacataatatcaacatgtagttccatgtgggggtacaatggagtagtgacaggtacttcaattttctctcctgttttattatttttattgtaaaacaacaacttgaagaaaacataaatatattaacacatgtaaattctggagagaggccgggcacagtggctcatgcctgtaatctcagcaacctgtgaggctgaggcaggcagatcacttgaggtcaggagtttgagatcagcctggccaacatggtgaaaccccgtctctaccaaaaaatacacacgttagccaggcacggttgcgcacacctgtagtcccagctacttgggaggctgaggcatgagaatcacttgaatctgggaggcaaaggttgcagtgagctgagatcgtgccagtgaactccagactgggcaacacagtgagaccctgtctcaaaaaaaaaaaattctggagagagatatacatgtatatatttaaaacctcccggccgggtgcggtagctcacgtctgtaatgctagcaactttgggaggccaaggcaggcagatcatgagatcaggagtttgagaccagcctgaccaacacggtgaaaccacgtctttattaaaaacgcaaaaattaaccgggtgtgttggcaggcatctgtaatcccagctactcaggaggctgaggcagaagaatcacttgaacccgggaggcggaggttgcagtgggctgagatcacgccactgcactacagtctgggtgacggagcgagactttgtctcaaaaaaacaaaacaaacaaacaaaaaccccaaaaaacaaaaaacctcccagtatatttatatatatattttttttgagacagagtttcaaaaaactctgttttttgccgagcctggagtgcagtggtgtgatcttggctcaccgcaacctccacctcccgggttcaagcaattctcctgcctcagcctcccaagtagctgggattacaggcacgtgccaccatacccggctaattctgtatttttagtagagatggggtttcaccgtgttaatcaggctggtctcaaactcctgacctcaggtatctgcccaccttggcctcccaaaatgctgggattacagacgtgggccaccacgcctggccccaacatgtttataactattaacacaagggcatttagagtcaacaatccagaaaagagtattaaagttcacatctgaaagatatgactaacatacctctctgagatgattcattgttatacagcagttttctgataagcttattcaactaattcattacttagggaacacatatcctaactaactaaaacgtttaaaactgataggttacctggttgagaatattccaggatgcaagcaagcgtgctacgaatcagagctgtccactgtttttgaacgccagcctcagttttggccattgaaagtgtcacaatacttttaatcccttgaagagctgcactgactggtggaggaacctgattatctgcagactttattgctgtgtctttcaatattcttgcaattaagaacagaattgtgggcaggattgtcatacatcctgaaagaaaaacaaatcagatcacctcataactattcagttcccatattatagttgttttcattgcttgtattttttgcatttgattgtggtttaatattgtttttttccttgtctttatacaaaatttactgtattactactactataattcaatgtttgaaaaagaaaataagaaagtgtcatattatttcaaagacagaattggtattttctttctttttccagctagccttatttttattacttctaatacttcacctatttaatatttcatgccctgtgtaatgaaaacgaaaaaggaagacagaaaaacaggaaaaaaccacaccagatactgtgggaagcatctgagtaacttcatgagttttatagcacttgtaaaacatgtaatcaatcctcagtctactaaagtcaacctaatcagaccaggaaagtaaaaggactactggggcaaggaaagaagaaatgaaataatcctagaatttgtaactgaaaattctaggtcatgaaaattcaacctcccacaaaaggaaaaaataccttcaccactctgacctgcagccattgtagcctctgcttgcaaaactccaaatatggagaattcattattttcacatatgtagggtaactctaagaggtagaaaggtcttccgtgagttgagctgaaatttatctctttatctgataccatttttaccttccagatcaggaatgtctaatcttttggcttccctgagcctcactggaagaggaattgtcttgagccacacataaaatacactaacattaacaacagctgatgagcttaaaaaaaaaaagtctcctctgacattcttcagagtttttctttttctttcttttttttttttgagagtcttgctctgtcgctgaggctgcagtgcaatggcgtgatctcggctcactgcagcctctgcctcccgggttcaagtgattctcctgcctcagcttcctgagtagctgggattacagggcatacgccaccaggcccagctaatatttttgcatttttagtagagatggcatttcaccatgttggtcaggctggtcaggaactcctgagctcaggtgatccacctgcctcagcctcccaaagtgctgggattataggcatgagccaccgcacctggccttgagtttttcagtgtcactcaagagtggcaaccagactggaaaacagagtttagttattccactttatgtctatctgctgacactgtctttcctcaacctgtagttccatgtcttatttgaaacacatctgaaaagagcaccttaggtttgtgactttttgaatctttaatcttcataggctcctaaaggtagacaaaaccttaaaaaaagaccagcttcttatttttcacttgagatttaagaggaaactgggttataacagtgcttaaaatcaaaggcaagctcatctttgtctactgtaatataatgcatttccaaatactgatcaataccgtaccagcgggtgaacaaagggatggtaaatcagagagtatggtaactgtggctgccaccaaacgagcactttcttctgatagtcgagttttagtggctatgtgacttggagagtctgacaccttggtactgagatgtggcatatgccgtactaaaatgaacatcagcagctccatagttgcaaacacaagagattttccaggaatgagaccaccgctgtcacctccttctcccaatacggtacaggcctctttttccatatcatcttcatctgaggtaaaagataatttggtgaaatttccagccaaaaaaaagtatgtaaaacaacacaagtatatttaggaaattccttcaaaagaatttataagcaaatgtcaaataatgtcacacgtccttctctgtataattctctgcctccctagaattctgtgcattgatctgtccttaaaggtaacagacagttcatttttcacttggaaaatctttatcaggtatttttattgggtatatattttgtaataggaataacacatgttaggttgaaccagatgaaattgacaaaaggtgaaaaatagtcgactctcagcaatttcatttggtcctttctaatgaaaataaaatcaatttcaaatcttctaaatgtatgattaattctttttttaattaataacttctggccaggtgccgtggctcaaacgtgtaatctcagcactttgggatgctgagatggacggatcacttgggctcaggagttcgagaccagcctaacatggcaaaaccctgtctccactaaaaatacaaaaattagctgggcattgtggagtgtgtctgtaaacccaggtactctggaggctgaggtgggaagatcacctgatcctgggagtttgaggctgcagtaagccgagattgcaccactgcactccagcctgggctcttgagagtaagactgtcccgcccgcaaaaaaaaaaaaaaaaaaaaaaaaaaaattagctgggcttggtggagtgtgcctatagtctcagctactcagaaggctaaggcaggaggatcctaagcccaggagttacagactacactgaactataatcacatcattgcgctccagcttgggtgaccgaatgagaccctgcctctaaaaaataaaataagaactatagaaatatgtcctggcgttaatattttaaaaattagagtataaaataagatttacttcaagttagtgtaatttctagtgcttacttagagtgtttcttttctcttgcaaataatcctgagcagctcttactatctgttgtacaactccagtaaccaacagctggacagatgatggattccaggtcaatagaaggcggtgcaaaacactcagcaactcaacacctatcagctaatacaaataaatacaaatacagttaagtaatttcaatctcaaagaataactttatattgttaaaatctgagaaaatacctatgtaaaaaaagaaatcaggtagctaaaattaaaatataggactacgtaacaaataagaacattgtaaaaatcttgagaaatggtcacattttactcctatgtattttcaagcaacaaatgatttattatttacatatttaaatgtgctttatattcagagatgatcattctcctattggaaggaaataattgagctaaatagtattgtagagtccagtgctgctaaaatttataatttctaacctgagctgaatatccaagaatttctacaacctctgcctaccacagattgtagaaatctctggtgagttcctcttctattcacttcagcaactactacaaacttttgccacccactttaagcttcttactcacaatcttccataccaaatccatccaatgaacctaaatgaaatttcaaagagggggaaaagacttaactgcaaccaaagccacctttacctctttccttaagatcatgtgttcagcctcttatgtgaggcttaatctgaggttaatctttccttatgtgctcctatcctaacctatttgacttcctagggattcttcaaggactctgatcatatctcgtatgttttcaacttctctctctagttaggctactcttgtcagtataatgacaatgctcaagtctttcttatcacatgtcccccctgcactattcccaaagcctccagatccttttatctaccctatgtcctcctctatgtatctggctccttcctttcccagcctagatgcttccacttcctttactctcttattcactcctcaatcttctactatctggctactggtcacctcaaacaatcctctgcgggaggtcaccaatagcctcctctagactcatttctgtgcttatttactcgattctttcttttgagactctgtctacccttcttgaaactcctcccttgtctttgataactctgttctcttttggttctcctgaaacttctctagcagtttccactgttgatttatttccttcttctcaatttttaaatgctatttatcctcaagcttccaatcttggtcctctttcttcttcctttattcagccttcctaggctagtgttatcatttctctggaattatgaaaaaagcctcagaactggcctccctgtctcccttcccatctcttacaaaccaacctacctctacgggctgacagaatgatccttctgaaatataaagttagttacatcattcctctacttaaacatttttaatgattccctatcactttcaggatagggttcaaactcttttacatgtcatcaagaaaccttcatgatttggtcttcaccttgttgtccagcctcatctaacaacctcatgttccattcatatcggccatagtaaatggctatgcccttgaacttgccgtgttctctcatgcctcctagtgttcgtatttgctattctttctgagaggaaaacccgtcccgcatgtgttgcctcactaattcctcttgaagatttgattcaaccattgcccactctgagaaaccatcctttgctttcctatcacaacatcgggctcctcctctctattctaattgcagctttacatgcactaaaatagcacttaccacactgtacctatctcctaattcaggcacagtgaaactgctttcactatctataacctcaaaccacgtttgaggcagaccaggcacagagtaaaagtaactgggtgaataaatacagggagtcagtgtattcatatcatgttaaaataggatccaatacagaaaaaaaatccatccttttttccattgtaaagcaatactcaaaaaaaaaccacacaagtatctatcatagcaatacactgtacctgatcttctgcaatatggactcgagcataaggggagtctagcaaggtatgtaaggcctgcaggcatgctgtaacatgttcaatgggctcctcaggtctaggggaacaaagaaactgtatactcacacctgaaatgcacaaaataaaaacatgttttttcacttataaaacactttatgttgtttgatcccatatttcttctctatttatgtttttacagattaccttaacatgtatttattaataccttaaagtagacttcaaaatggtttccaagttaaacagccaaactcaacataaggttgtagttttgcaattaggttaatattcaaattagctatgtgtgaaagaaggaattcccatgccatcaggttgattatgaagatattaagtttttatttctaggacttttaaaataatacattaagaaaataaatttacaaacattataaaattgtttttcattaaatggtagccaaataatttttcatgcatacaaagtttttaaatggcaagttatagaggcacaatgggtatcatagtaaacaactgcttttaatttacataggggtaaagtcattgttttggaagtttttcacattttcacttaccagatctactgatgaatccgataattacaccttattgtgttccttttcactcccagaaaacataagatcactaaaagcttcattaccatgtataaattcttaaatgttaaaaaagcatctatagctgggtgcagtggctcatacctgtaatctcagcacccagccgaggtgggtggatcacctgaggtcaggagttcgagaccagcctgaccaacatggagaaaccccacctctactaaaaatacaaaattacccgggcgtggtggcgcatgcccataatcccagctacttgggaggctgaggcaggagaatcgcttgaacccaggaggcggaggttgcggtgaaccgagattgcgccactgcactccagcctgggcaacaagagtgaaactctgtctcaaacaaaaaacaaaaaaacaagaaacaaaaaagcatttataaagcaattttacattaggattcactgaaatcttcttaaacatttttttcttaatgggataattggttaagtgccaagtaaaaagaaaacctgttgttgaataaaaaacatattacgtttttttactgaaaattgttcgatattgctgtgtgaatgagcatgacagttaagtagtttcagtagtttttaataatttaatttctaggttaaaaattcaattaacaatttataaggtgaggtgaaaaatcctttcacttttccttctctgaactgtgctatactgtacaaaatctttccatagctttaaaatgaaagatatgaattttcagaagtgataatcttgaaatatattaatatgacagacctacctaaaatcagatgcattctgtctttgttaatttctggcaaagatttagcactacccactgctcctgatgcctggtttaaattgacagatgtagaacgtttttgtaaaccagatattgctgctgcttctgtagactctgagcacgtaaatcctgtgctatttaaccaaagtgccaccgcatggagaattggggcccaggaattccgatagtgaagtctagctgtatcaatagtttcaggggtataaaatgctccacctgtaaagcaatcaaatcaattaaaaacattacttttttttttttttttttttttttgagaccaagtctcgttctgtcgcccaggctggagtgcaatggtgcgatcttggctcactgcaacctcctcctgctgggttcaagcaattctcctgcctcagcctcctcagaagctgggactacagacatgcgccgcaatgcccagctaattttttgtatttttagtagaaatggggtttcaccatgctggccaggctggtctcaaactctcaatccacccgcctcagcctcccaaagtgctgggattacaggcatgtgccactgcacccggccaaaatattactattatacatgttcgctcatttatgaaccactaacaaaaatacctgttacatacaaaagagaaatctagccaaagggcttctcctctttataaagccaccaaaagtaaccccttttctgtagctgatgaactggaatacctgtctcttcctcactgatgctagttttccagcctttcctctgctactgctgatgtcactaagtattcttaccttttcttaccctgttgtcacagaatttacctcttcattgttgccagtggctcctaaaaccctatcatcttctctttctatcacaaccagggaactctgtttcttccctctgtttctttcttcttctgctattcctctccacctcctgttgtttcctctactaacactgaggacttcctcatcactccttgctgttatgatggattaaggaaggaaaaaagggggcgggggaactccattattcttatcattaatatataggaaggagaatgggttcttcaagtaggaactaataacacactttctaaacagaaaaaaatgttgacgatttctacactgattttgataagaaaactaaagtacaatttgcaaagcactttaggaacataatttattggcacactaggaatctgaaatagaatatgaaaatacaaacattgaacagtacagcaatatacatctatggttatgcataatgacttgttacccatagctatttagaataccctagctcatacagctattattgtaacagtgcttgctaatatgtttgcttcagccaacaaaaaagctctatatcttctatctacaaattcaatatagagtacatattctaactgagacaacatcaaacttaagccacagaaatttaaactgttactatagcaactgttgttgctagtctataccgtctctattttgtttaactactactttgaactccataaaagtaaaactcagaatgtaatactcaccatctggaggaagctgactagaaaattcggctggtaaagtcaagagtgcataatcttttaatgctgctaaccacaggcgactgagtgttggtagttcaggttgtaccagtgttattaaactatctggtggcagttcatcgatggtaccacagtcgtcatcatcatcgtcagtatttttaattgctctttttggttttgactctgcttcctttttaatattcatagcgaccacatatacctaatatgatatttatgaggacaaaatagtaaggcataagataaaaaaataagatattttacgttattataaaaatacagttaaatcatcaaagataactgggtatagatattagaaagtatacactttggctgggtgcggtggctcacacctgtaatcccaggactttgggaggccaaggcgggtagatcatgaggtcaagagattgagaccatcctggccaacatagtgaaaccctgtctctacgaaaaatacaaaaattagccgggcatggtggcaggcacctgtagtcctagctactccagaggctgaggcaggggaatcgcttgaaccagggaggcggaggttgcagtgagccgagatcgcgctgctgcactccagcctggtgacaaagtgagactctgtctcaaaaaaaaaaaaaaaaaaaaaaaagaagaaagtatatactttgatcaggtgcagtggctcatgcctgtaatcccagcactttgagaagctgggaatcacttgaagccaggaggtcaagaccagcctgggtaatatagcaagaccctatctctacaaaaaataacaaaaatgctagccaggcatggtggcacatgcctgtagccccagctacttgggaggctaaggcagaaggatcgcttaagcccaggagttcaaggttccagtgagctatgatcgtgccactgcattccagcctgggcaccagatttgagatcctgtctcaaaaaaagaaaaaaaaaagtatatacaactccatgatttcctgataaacacaaaagaataattccatttgccttggagacatttttctaaaaaaactgatctgacttctgactattcctctgatggcatgttccttgagtagccttctcagagttttttctggcttccctcattctactttacaaagcaccccccgcctccacttttttttttttttttttgccacagggtataactctgtttctgcctccaccttcctagacttattagacaaccaggcattcaaagtaagcagctgagaggcaaaaagagacatcagaaaggatttccataaatatccttctaaactccttcttacacagaccttaaatgatattttgcaatctagcatttacaacagatagcctggctaatataatctgctagtcacatacattacctgtatcctttctctctagtttgtgagccaaaaagacataaaagcaactttcctaaaatataatttcaaagattcttctttattgaatcatatttattttcctttgttttgtaatacatttaggctttggctactggcacatacaaagctgaataacgtattaatgagaaaacaaaaaaagaaaggaatgacagcaagcaagaaaagaattgctctagataaaaatctcgagaaaactgtcttccctccacagtgttacatccattgtacctaacgagaaagcctaagtatggtatctgtataggtacactgcaagcttcttgatgagaagcactgtgtcttacccctattcccacaccaagcagacttacagcacagagaaaatatacagcaattgactaaattctaaaatagggactttggatctcaagttatgaatatattactgtcatatcttctagtgagtacatgcttgtttcccccctaaatttgttattacactgtttttttttttgagatgggagtctcgatctgtaacccaggctggagtgcagtggtgcgatcacagctcactgcaatctccacctcccgggttcaagtgattctcctgtctcagggtccagggtagctgggattacaggcacacaccagcaagcctgactaatttttgtatttttagtagagacagggtttctccacgttggccaggctggtctcaaactcctgaccgcaggtgatccatccttctcagcctccccaagtgcccagccactaacatttttaagaaaatgtcacaataagcactcttaagtatatccagccattcattcatcaaatccttactaggtaggcaccttttgccttgaatttgttattgttctaggactggaagcaaaaaaaaaaaacaaataatacatagtttttgctttccatgaattcacaggctaatattacaatgagagggaagtaaaaaggtgcttaagagaagaaacttttaaagatttggctttaattatttatcttctacaaagataatctttttaatgctttatcttctagtacactctacccagtgcacagacagtgtctggtacctaatgaacactcggcagtttatgcaatgagtgaatgaatctcagggaacatcacagataaacgaatcttagccttgggagtgtgagaaaggtgagaccgtttttaaggacaaaagttgacttgctcataggcagagatggaaagggagcttacaggcagagggaacagccagagcaagagcacaaaaacaggaaactgcatggtaatctaagtatgcaaatttctcatatagacggagcacaggttataagctggaagtagctgaagtttttactctgcaggcaatggggaagcaagggtgtcactgtaagactttacggtctatgtatgcatttttcctcgacttataattttattttaataattatgctataaaaagttggaaaaataagagttaaaaatgactcataacctcaatttctgggttttcatattctatctttgtaagttataattttgatgtacagagattctgtatttagttttactgataaacatgtcatagggttttcccatgtgaataccagttttcataaccattattttaatgacttacagtggatgacccacaatgtatctaccagttttcctacagttgaaattttatatttacttctaattctttacttagcattgggaatcctagaaagatgaaatacagctttcgaagacaaaagatattcatttcttcacattataaatagtgttgcaagtaaacatttttgtaaacttacctcttttccatattttggatatttttcactagactacaggcccagaaatggaatcactgggtcagtgtttacaaatatttttatgactctgaatagacactgccaaatgctttctaaaaaggttctatattttatattgctacctgcaatatatgagaatatatctttcagacctattttaaaataaatttttaggcttatttttcttatagatattacacaaaaaaggacaatcagaagcataagcaaaatgaagaaaattaaaactacacataatgctactactcagatacaatgctgttaccagtctaaacagttatataaacacgctcagttttttacctaatgtgtgcgtgcgtgtgtgtataatttctaccccaattttctagtcacttaatatcatcatctttcaagatcaagaaatacatttaggttatttccacttttttgtgaataataacaccataacaaatacccttgtagcagaacctttgtgcatatccttaaatattcctgaaaataatgtgtgcagttttttaattaattaaattttttttttttgagacaagagtctcgctcttgttgcccaggctgcagtgcaatggcgtgatcttggctcactgcaatctctgcctcccgggttcaagtgattctcctgcctcagcctcccaagtagctgggattacaggcatgcaccaccatgccagggtaattttgtatttttagcagagacagtgtttcaccatattggccaggctggtctcgaactcctgacctcaggtgatccgcctgcctcggcctcccaaagtgctgggattacaggtgtgagccaccacgcctggcctagggcgcagttttagaggatgtacagaggaaggtgctgaagacacaaagaagaagagtagacagcactgagcttcacacagtctcctcctcactctcatgcctaactgatacctcctcctatcctccatgtttcaatgtaaacatcactttctccaaaaaggctacttctgagcctccagcctattgtaactgcctctgctatgtgttccaaaacactttgtaactttgtatttctcctgtgataatgctccttaccctttggtacatctacttgtttaccagtttgtcttgctcagcaaacgtaatatatctcacccccgtattctcaactgctaacctgacagagctgaagctaaacaacactttgttgaatgaatcagagggtgggaagtaagggaatgagaaaagtttagtcttagattagcggaaaagcttaaaataattataactccaatagtcttcccttaaacgtggtttcactttctatggtttcagttacctgttgctgaataccacgaaaatagggaagtgagatactgagctggtagaggaaggaattagttacttcaatactggagggcagatgataagaattcaatagtaactggcagaaggaatttagaaaaatgaatttaaaacaatgtaattatatattttttaaagtgactgtgagaatgaaaaaggtaaaactagctattaaaaaacaaaacaagctgggcactgtggtgcgtgcctgcagtcccagctacgcggatggctgcggcaggaggactgtttgggcccagaagttcaagtccaggctgggcaacaaagcaagaccctacctttaaaaaaaagaaacaaaacccctatggcctcaatatcaaggtggcaagtcacctgaaatttaatcaaataaaagatttttggcataaaatattttctgttatatttttgagtttttcctacctaatttcctcatattatgtaggagagcccttcctcaatatagaggttttcagtacactgattaacaaattttcaaaaagtattccatatcaagggttagtttttaaaaaacaaaaatttttttaccaacaagagtagaggaacattttctcatggatgaagaaatgggtcaaaaacaatagattgtggtttagtcgttacctctgcccaagctttgagaacagccagtttttccatggtcgtggcactctctcggtacagctggctggaagatccttttccagcctgaactttgtccagagaagaaacaagaagattgtgtactcgacggagatcattgagatcactgacaactccacttcctatccatgtactacatacctagacaaagagaattcaaaaacttttgtgtaaaaaaaattaatgctgtataagaaaatggaataaatgacttttttcctagaagataaaacacaaaaccaaagaacaaaacaaaataaactacccaatgctatgctttgatattattattattattttgagacagagttttgctctgtcacccaggctgcagcggagtggcgtgatctcggctcactgcaagctccacctcctgggttcaaaaaattctcctgcctcagcctcccaagtagctgggactacaggcgcgtgccaccacacttggctaatttttttgtatttttagtagagacggggtttcactgtgttagccaggatggtctcgatctcctgacctcgtgatctgcctgcctcagcctcccaaagtgctggtattacaggtgtgagccaccgtgcccagccagtattattttttatatcaatggtaagcatagattttattgtactcctacgtagaaaacaaaatagtatttacttaacatgtttccaccgtgtactttaacaaaaatgttaacagaaataattttccacccaaagcagttcagtcttgaataattcttcaacaaaatttctgcttaccacaggaaaagggttatgcttgctgctataaaggggactttaaaaaaaaaaaaaaagaggctgggcgcagtggcttacacctgtaatcctagcactttgggaggccaaggcaggcggatcacgaggtcaggagattgagaccatcctgaccaacatggtgaaaccccatctctactaaaaatacaaaaattagctgggcgtgggcatggtggcgtgtgtctgtaatcccagctgctcgggaggctgaggcaggagaatcgctagggagccagaggttgcagtgagccgagatcgcaccactgcactccagccacgacagggcgagactttgtctcaaaagaaagaaagaaaaaaaaaggaataggaaaaaaaaatctagtccctaccctcaagtaagaaaacacagattgaatgaacacatgggaatgttttatgactgtaatatgggacacttaaaaacagacaagggaaagattaattctagcaggaggaatgggaatgtttaggtgtcaaagaggtttgtatgtatagacataggagagttacatgaggaagagatgtgattaggaaagttaattgggattagattaaggtaaaatttacattccatggaaaatgaatttagacttcattctgtaagcaattgtgagtttccatggcctctggacagggggatcatattattagaattgtgctttaggaaaactgttccagtacttctgtataagaaaaaatgtatatagacagtaagtaatatgttaagtgtcttttataataccatagaacagagatgatacggatcaaactgggaatggaataaaaaaggagaagcatctgagacagacttgtagttagaaatcccaggatatggaaactaattagctattttagggggcgggtgaagggagatacaaaaagagcaaggaatcaaaaatttctaaatgctgattgttgaagcttctgacttgaatggaaggaaggtgatactactgctttacggggatgataggggaaacaaaggaaactaagtaagtggagatgagaagtgagacagcgtgattttaattttgaacatttttacatgctgcattcaaagtgccactaagagacttgtggaaagatattcagcaggcaattaaaaacttgggtctggatttcaggagcaagttcaagggtaattacataaccctaggaattcccacacaaaggtgataactaaagtattgttaaatttttttcaaggacagctttaaacaaaaaaaataaagccttaaagccagaccagatggaacatagttacaattaagggacaagtagaataagaataaagaaagaaattgaaaagaaaataccagaaaaacaaaagaaaaaccaggcaagtgcagtgacaatggagccaagggaagagtttcaagaaggaaggggtggtctcagagtgtcacctttaacaacaataattacatgtccttactttctttttttttttttttttgagacagagtctcactctgtcacccaggttggagcgcagtggcgtgattttggctcactgcaacctccgcctcccaggttcatgccattctcttgcctcagcctcacaagtagctgggactacaggcgcctaacaccaggcccggctaatttttgtatttttagtagagacggggtttcaccacgttagccaggatggttttgatctcctgacctcgtgatctgcctgcctcagcctcccaaagtgctggcattacaggcacgagccaccgcgcccggccacatgtccttactttctcatctgaaatccttggaccaagatttttttcagagttcacaacttttgggtaaaaggtaataaggtacctgaacctcattaaagtatacacctagcaagatgtgtggcagcaccccataattaacacacagatgtatctgcaacaaaatgtattacaaatcacaataagaaagattaactaatgctacattctcacttagcttcacatcagagccaaattagtacaagtcagctcaggttttgctgccaaataaatgattaaaaaagcttttgattttcacagcatttggatttcaaatcatggctaatggacttgagttcctatattgaaaacgttttaaaagtggagaataagtatttatgtcaaattttattctcaaagaattcaaaactaattttaataaaattaataaggacatttttaactgattgttaccaattaaggagatactgatggcaaaacttaaaatgccagtcaaaactgctgaaaaataattaaatttaaagtgaaaagaaattaaatatgaacatgaaaagaaagagctgttactcccaaaggaaactaaagaacatatgggaaagatttgataaatatttctgtgaaatttggtagaaatataactaaaaaattggggaaaattataaagattaggaatttggcactaagctttctttgtaaaaacctaagtattttcttcacattaaagaatcagaaactaggccgggcacggtggctcacctgaggtcaggcattcaagaccatcttggccaacacggtgaaaccccgtctctaccaaaaatacaaaaattagctgggcgtggtggcacacacctgtaatcccagatacttggaaggctgaggcaggagaattgcttgattgcttgaactcgggaggcggagggtgcagtgagctgagatcatgccactgcactacagcctgggcaacagagggagactgtgtctcaaaaaaaaaatgacaggtgcggtggctcacacctgtaatcccagcactttgggaggcccaggtggctggatcacctgaggccatgagctcgagaccagcctggccaacatgatgcaaccccgtctctactaaaaatacaaaaaattagctgggcatggtgacgtacacctgtaatcccagctactcaggaggctgaggcaggagaatcgcttgaacctgggaggtggagggtgcagtgagccaagattcatgccactgtactccagcctgggcaacaagagcaaaattccgtctcaaaaaaaaaaaaaaaaaaaaaaagaatctgaaactagaatcacagataatgcattatggattttgtttatgaagaatgacaaagtagcattgaattagtaaaataatattcagagaaaagactttgccctacatcaaaagattggtgaatgaatgtacattttaaaattttatgctgaaataaaatatttaagtacgcattatgttcatgatctgaccctactttaaatgattttttattgatccactgattactgtacccagttgtgtgacatctgagggtccttcctataatatctaagagttaccctgattttaaagtttcttaacatggcatttgttctaacaaacaggctgggatatcattaagccaactccttactttccttaaaggaaaggaacttgtaacctactgctttacctgtcaggaaaccaggtttcctcccagcaacagaaggaaaggaggtcacaaatttaagcctgccactagaaaaaaaaaaacttcttataaaaaaaaatgcaactagggccacaaaagaaataagtttaaggcaaattcagtattcatatacaagatacaattctaatagcctttgcttttctaatgatcaggagcattgtaggagattttgtctgcttaaatgctgtgctctgaaacgtcatcatgatacacttatttacatatggacagtaattttttgatatttgtgtggcagtatcccaaaccaaattacctagtcgaaggtttgcatcacgatccagagacctatctcttaccaacaacgtttcttttctctctggtctcctgtccgtggaaagagttaatttctctgaagactgccattaaggcagcaggcttcagagatatcaatttcaaaaatggaaggaaggggcaaacttgcattcagctacagagaggataaagtcagaattttaaacctattattgcagaatcttctctgcatagaggtcacatgaagcttggccatggattctaagcaaaaatgatggaccacagcaccgtactccagaaaactaggaagaagagagttgcttatcttctctctttaggtaaggagacaaataaactgattacctaaaagattagagcttaatacatgaatcctttttcaaaatgaagcatatgaaaaagagaaactgattaaaggaataagaaaatatgcattttttggggcagggtgtggtggcacatccctgtaataccagcactttgggaggccaaggcaggtgaatcacgagatcaggggtttgagaccagcctgaccaacatggtgaaacactgtctctattaaaaacacacaaattagctgggcgtggtggcgggcacctaatcccagctactcaggaggccgaggcagaagaattgcttgaacccgggaggcggaggttacagtgagcagagatcgcatgccactgtgctccagcctgggtgacagagtgagactcagtctccaaaaaaaaaaaagaaaatgtacgttttttggtggttttgtgagtctctgcagatataacaaggtgagaataattccctgggattaattttgcaatgaaatgtctatattgtgaaattctccttagtatgatttaatacccacaaagtagcaaaattttcataatgtgtggtcaaaaacaatgttttgaccacaatgtttattacctaattattatttcatcatttcacaaagaataaaaaggaaaactgccattgttgtatttccaagataaaaatattattttgtttttcctctctctcttttttttttttttgagacagggtctcgctccgttgcccaggctggagtacagtggcgaaatcttgggtcattgtagccttgacctcctaggctcaagatatccaccaacctcagcctccagagtagcctggactacaggtgtatgttaccatgcccaactaatttttgtattttttgtagagacggggtttccccatgttggccaggctgatctcaaactcctgaattcaagcgatcctcccatgttggtctcccaaatttttctctattcctttacacaagttaaattctaagatatctatgaatgtatagaagacaactatacaaagtcccatttttcttcttacctggcaagctttcgctattatatctgatggtgtatcttgtgaaaaggctggtcttagagcagctcccacctagaaaaataaataaagcattttattttttacttttattttttgagacacggtcttactctatcacccaggctggagtgcagtggtgcgatctcggctcattgcaacctctgcctcgtaggctcaagcgattctcctccctcagcctccgaagtagctgggattataggcatgcaccactactgccaggctaatttttgtatttttagtagagacagggtttcaccatgttggcctggctggtcttgaacgcctgacctcaaatgatccacccacctcggcctcccaaagtgctgggattacaggcgtgaaccaccatgcccggcctcagtaatacctttaactgttgttattaagagttaatttatccttcattatacaaggggcaactgctatctatttctaaaaatgcttatgaaggtttgccatataaaaataacggcagcaaatccacaacactcttttgaaggttccttttatctcttaaagggcagagctaaatatctaaacacaagactggaaagctgagctggaatttctattctagttttatcactaatatgttatcacaacttaaaaatagtgacaacagcttgacacttatttcttcatttgtggggtgactaaaactaggtaacagacaatggagataaagagatgcattctacagaaataaacagattgcagttccaaatgcagtcctccaggaagtctgcacttcttcagcaatctttcaaaagatcaattttaagttcttaaataaatagaaaatctcacattagcctgatactgctccagtatcacatgacctggaaattctggctcaggcacagacgcaaacttcttgataatgtcttcaagcgcctggagcccagccattcgcagctggttgctatgatcagttgcagccatgaatgccatgcgaatgaggtcagagagatgaagtaccaagaggtcatctaaaaataaaaatagaatgcaaaaatgaaaacttttccaaaaataagtgtaataacataaaaatatgaaatgaaataaatttttgataaaaaacacaatccacatatttcacaactttgaaaatagcaaagatattatattctttcaagacaacttccatatcaatctttcaagaatagtgatatacaatacagtaatgctgatgatgttataggacttacaatgatatgttatgcaaaatacttttaacgtaactttcccaaaatgagtttctgatcctttaagaacaaaggcttggcagacttttttggtaaagaaccagatagttaatatttttggcttcatgaaagaaaacagactcttgggaccccaaaactcactatgccaaagagaaagttaagcttgggaactgagtcttgcaatactgccttttgttcccaggtagctgtaatttcacaactgtgtgtcattgcctcattttaagccaggttcccacaatgatagaaggccaaaaatcttcctaaatggcctcctctcacaaattgctcacaaggaatcttcggaatacatatcccccactaagaaccagccctaaaaccaagttctgttgaatctcaccctgacaatgtcaattaccagcttattttcacaggtataggacaatgacaagatgagaaatcatccctctctctatgctgtggccaatgcgtaactgactttttcctgtattcccccttttcacatgtaaaatgtagattcactgaggctaggcagggcgaagtggctcagcctgtaaacctagcactctgggaggctgaggtgggtggatagcttgagctcaagagtttgagaccagtctgggaaacatggtgaaccccatctctacaaaacatacaaaaattagctgggcatggtggcgtggacctgtagtcccagctactcagggggctgaggtaggaggatcctttgaacctgggaggtcaaggctgcagtgagccgagatcacgcaactgcactccagcctgggtgacaaagtgagaccctgtttcaaaaaaaaaaaaaaaaaaatttactgaggctaatcagagcctcataggaatataataaccatctgatcactgcttacccttcgttccctttttttttccttcctgctgttctttcttctttaaataaggaagttcccaaaaccccctttggaaaaaacacaggtcacagatgctcctgttacctgtgttttttcccaggtgaatccttaaccttggctaataaacctctatcaattgatatctgcttcagtcactttttggttcacactttataggctatattatctctttttatcatttttttttttgagatggagtattgctctgttgcccaggctggagtgcagtggtgtgatcttggctcactacaaactctgcccccaaagggttcaagcgattctcctgcctcagcctcccaaggagctgggattacaggcacccaccaccacgcccagctaattgttgtatttttaatagagatggggtttcaccatgttgaccaggctggtctcaaactcctgaccttgtgattcgcccacctcggcctcccaaagtgctgggataacaggcgtgagccaccatgcctgggctcaggctatattatctccattgcaactactcaactccactgttaaggtgcaaaagcagccacagacaatacgtagagaaatgagtgtgctgtgctccaataaaactttatttacaaaaaaggctgtaggttggatttggactgtaggctggagtctgccaatctctagaaaaactcttgtcaggaaacttaaatctacaaaataagaaggaaacgacctttataataagatatggaaaagggaaatgtttttccttttagccctagagtaaaagttgtcctggatctgtatgaacaaagtttaaaagcaagtctcagaataattaaaatgataccaagtaatttaactacatcccagaacaaagtccaaaattattttggaatacatcaaaatccagcactaatatcgtaaaatttacagggtctgacatctaataaaaaattaccaagaatgcaaagaagtagggaaatatgtctcacaacaaagagagagagagaaaaaaatcagtgaatagaaacaagtctagaaatgaaaaagataagataattagacagggaactttaaatagctattatcaatatgtttcctatgttcaaagagggaaaagaaaagcacgaaaataactaagggagaaatgaaaggtagaaaaaaatcacaaaggggaatttagagatataaagtaaaatatctgaaatgaaaactacactggataaaattaatagagattaaatactaaagatcagtgaactgaaaagacttagcaacacaaattatctaaagaaattattaagctcaaggtctatgaagttcttcaggaggcttcaaaacccacaaagtctttttgaagcagtgacatatctatggttcagcctgatccccaagcagttcctatttaaagaagtttttgttgtcactgttgttgtcaaagttataagatgtgtatcttcatattttttcatgtgcctaccaaaaaaactaattttagaatcttgagtttaaaaagaatatctggccaggtgcactgactcatgtttgcaatcctagaactttgggaggccaaggcgggcagatcacttgaggccaggagtttgagaccagcctggccaacatggtgaaacctcgtctctactaaaaatacaaaaattagctggacatggcggcgggtgcctgtaatgtcagcagctcaggaggctgaggcaggaagatcgctaagatcgcttgaacccaggaggctgaggctgcagtgagccgagatcacagcaccgcacttaccttgggtgacagagcaagactctgtctcagaaaaagataaataaataaaataaaaataaaaagaatatcagttgctttgtgggtgggaggcaagcagagaaggcaaaacatttggctagaagcccacagtgcttcctcacctataggaagcaaaaacacaccaccagtaaaagcaaggttttgaactaagtatgttgaagagatatctgcactctcatgtttactgcaggactattcacaataactgagatatgaaccaacctgtgtctatcaattgataaagaaaatgtggtataaatacataatggaacactattcagccatagaaaagaataaagtcctattatttgagacaacatggatgaacttggaggcattaggttaagtgaaatatgtcaggcacagaaaaataccacatgatctcactcataggtggaatctaaaaaagttaatctaacagaagtagagagtagaatggcggttaccagaggttaagggtaagatggggatatgttggtcaaagtacatggaattacagttaaataggaggaataagtgtaagagatctactctatagcacggtgactatacttaatgacaatacactgtattcttgaaaaatgcaaagatggtggatgttaagtggtctcacacaaaaatgataactaggtgaggtaatgcatttgttaatttgctagatttaactattctacaatgtatgcatacttcaaaacatcttgttgtacatgatatatatatttgtaagtcaattaaaaaaattttgcccaactgataagctagaaaagatggtaattatgttatatgtattttactacaacaaaaaattgagaaacaaacaaacaagaatgaggtataataaactactgccaaaatttgggagaaaattcccaaggcagtacaaagtagattaaaatgggtctacttacattatgccaacctaaaagtaaataaaaagacctattatttctcctgcactctatcacctaatttacaaagtctaggactatatcaatctaccaaaccaaaatctaggtaattgtttctggaacgagagcgccactttccccaacaaccagagtgctgctgcttctctgcccatctctatgtctacccttcctcaaagcaagacctccgtcttttttctaaatcctaggaaatgaactcttgaaaaggtgggaatgagaaggggactgagcaaaaacttcaaagtggaaagataattcggtggtgtattatatttggggagtagtaattccctacaattaaagcataggagataggaagatgaagagatgaagatgatagaggagagcctgaatagcacatttattgggtctatactttttcatatactctgccatgactgttcagaatcagaatggcaggcggtgatgttagaaagcatcctgttagaaaggatccagaacaaaatatgtcagacactggaatctaggtgggagctgttacaacagcttaccctccaactacagatgggaaatacatgaacaacagagaacatgggcaatccacctccacactgagagaaaattccaaatacggagagtactcttctctttcaagaatatataaacaattaagtttattaaagaaaaatgcaaccagggaaaagaacgattctgaagattcagagaaatggctaatctctggaaacagtgttctataaaaaccagaattaaaaaaaaaaatcatgcggcatcctcgataggatgaaaagaatcctggctgctatggtataaaaacagaaaaccttagagagtaaaaaggatatgatacaatggaggtgggagaaacgtagacaaattacaggaaaattaaaaaaaattaaagcagacttaagattactaatgaaggcagaaaaaagcaaaacatcaatgtataaagaaaaaacctgtgaggatctctgagaactaaggtaaaaggacaagacacaatgaggaagaaaaataacagttaagaaatccaaagaaagaaaggtcaacctaaggattttcactattccctaaatgtagtatgcacacttatgattccttggctttacaaattcttacttcctctgattctttttatttacttatttatttatttggcaatcagctttttcatgttgaatccctctgcttctaataaaccagtgtagtaggcagaatattagcaccccaaaatctccacacctaatccctagaacctgtgaatatgttaccttgcagggcaaaagggactttgcagatgtgattaaggttatggagtctaaaacatggagactggcctaaattatcaaggcagacccagtctaatcacatgagtccttaaaagcagagcacctttcctggctgcagtcagagacatgtgacgactgaagaagcatcagagagatttaacgctgctggctttgaagagagagagggagccgtgagccagggagtgcgggcagcatatacaagctggaaagaaaaggaaagggatgccccctagagcctctagaaaggaacacagccctgctgatgccttgatgttagcccagcgagactcttgttggacttctgacctacagaactgtaagatgataaacttgtgtgattttaaaccaagtttgtgggcatttgttatagcagcaatagaaaactaatgccaccagtctcttctaaccctttctctgcctttaaaactaatcttcaaaataacctcttctgtgacgtcttccctggctttataggaaatgaataccatgtgttttttaatgttctcaaagtactctaacatactactactgggacacgccataactatttgactgagaagtctgtctctctgtcttctaggctataagttcttccagggtatggactatgtttttttcttctatgtatccctaccatataccaaaaaacaggatgcagtaaatatctgctgaataattacatgaacaaaaacactatgttcatgatgtattgtgctttgctgattacctatattcagagtctcattttatacatgttgtactactgttttacagtttgtatgtttttgagacagagtcttgctctgtcgctcaggctggagtacggtggcgtgatctcagctcactgctacctccgcctcccaggttcaagcgattctcctgactcagcctcctgagtagctgggactacaggcatgtgccaggacgcccactaatttgttgtatttttagtagagatggggtttcagcatgttggccaggctggttttgaactcctgacctcaagtgatccacctgcctcagactcccaaagtgctgggatgtaattacaggcatgagccaccgcacccagcctgtttgttttaaaaatatctatgtgagctctgctgcttcttatacacaatgaaataacccaaaaggcattttcaattcatagacgtcaatattgttaacacatacaatttgtcttcagatatttaaaaaatgactgggtgatgaagagacaacaaactataggataaggaatctgttactctatcacctctcaatttctctgggtctcttcaactatgaaatgaaggtactgggtctgatggtctctttgtaaattccctataataacagattcaggggatacatggtataaaaagtttacaaaagataaaaaataataagataaaaattgtttccataataaacaattttcaccttttcaaaaatacctaatagcacttctgaaatttgagagtttgaaatctaccagtgcattcatgaattctgatactctccatggctggggacggcaaagctcactttatttatatgccttaaaattttaccatttcctttccgctgaaatgctaaaatccaggacaacgtactgagaaaaacctaagtaactgccatcattatcctttgggcaaatgattaaatagacacacagatcaatctatcttgtggaccaccttcttcaacttatcttcccaataggaatcagaagatgactagtatgcagaggggacagaaaactaagatgaaaggcaagagaacttacaataaataaatggcatattctaaagcacgctatatctgtcgcagtaaaatatctcatagcagcaaaatgtctcaaggtgtaaaaatgctttggggaaaaagtactgattttaaatttacttgtagggtttcgaagtttagcagaacgtgccaaggcaagatcaaagtgagcctggtctgcattctcacacaaattgatgattcgacacaggcaatcggcagcaaatactcgagtggcccagcgaggggccacaaagggctttgatttatcttcttcacctaacgtggtaaacatggtatcatcatccatctcatctttcttttcagcttcttcatcttttccactacttaagagagttgcagtactcatatctataacaagaataaggaatattgtaacaatctcacataagcaaaaatgatcctttaaaaagttattaatattaaaatttttttaatttaaaaaaagactaaattcttacttgctggaaaacagtaaaactagcagaattttttttaaacaatcaaaagccaaggaaaagataacataaattacttttatgtaaactacatttaaatatttcaatagttttacatactatgtcatactctagagtaacttggggtttttatacatgaaaatttagtttgaacttccaaaaaattttgaaatatattttcccaacaatataaaaaagctcatttgtttataacataatttaactttcaacattttgacagagatttgtagatcaaaagttattacttttaaataaaacctataatttacatgtatgtatctttatacatatatctatatgtatatatcagaagtaaaacaatttccattattttaagaacgcacattaaatacttaccactagaagctgccaggacatctttacaaagcattagccaatgagaaagtttttctactgccagcgaagaaagcatatgtcccaaagtgtcatgaatatcagaacataattttcgatctgtctcccggtctagcattccaaaaagaagtccctcaagaccagtttctgttatattaacaccttggtgccggcaatggatatcagttcgagaactaaccccaggggcaaaaggactgacatctgaaaggtaatttttacaaatgaatttgtatggtattttggtgtacgctataggtaacaattatgataaagaccaagtcttacatataaattcacaacagccacaaaaccagctagctatatacaatttaactatggcctctagtttacatatctttgggattataatttaatctggcaattagagtaatacctcgaactgtaaaactgattattctgagatattgtaaacaaatctcagggaactctcaataaatacttgattctaataagaaaaagtgtgggacagagatatactgctaaatatatttaacaaactaaaaaactattgtatttgttagaagaataaattgaaacttattcagtcttatagttcagattttaaaatttttataaagccagaacacaaactctaagtggattgcatcctaagagttcatttaaaaattgggaaaatccaaggctgggcgcagtggctcacgcctgtaatcccagcactttgggaggctgaggcaggtggatcacctgagatcaggagttcgagaccagcctggccaacatggcgaaaccccgtctctactaaaaatacaaaatttagctgggcatggtggcgggtgtctgtaatcccagctactcagaaggctgaggcaggagaatcacctgaacccaagaggcggatgttgcagtgagccaagattgtgccattgcactccagcctggaccacaagagtgaaactccactgggcacagtggctcatgcctgtaatcccagcacattggggggctgaggtgggaggttcacaaggtcaggagttcaagaccagcctggccaagatggtgaaatcctgcctctactaaaaatacaaaaattagccgggtgcagtggcaggtgcctgtaattcgagccactcgggaggctgaggcaggagaatggcttgaacctgggaggcggaggttgcagtgacccgagaccgtgccactacactccagctgggtgatagagactctatctcaaaaaataaataaataaataaataaataaataaataaataaaaattgggaaaatccaaagagtaacaacaaccaaaaagcaatgttgtcatgaaatagtggttaaatttcttgcttcatcagaaaatcttttcattcttgtaaacagcagcggtatataactggtggctttaagaatgagtattattacgccctctgaagtctagagcccactgaaccctgaagggagtaagacagacgaatggaactgaaaggtaactatttttgttgtgtcaccccaaatacagaataaggggaggtttgaagaaaatagccatagtgagtgacattctaaaacaatagaaaaagttaaatgaaagggttccaagaaaagagaacactaggaagagattaggcacagagacttttttttcactaagcagtagatagtgaatattttcccatttcagtaattatacttctatagtatgaatgttaacggctatgcagcaaaccaataaattaagggaaaattaattgattaatcactgaggacaaattccttaaaagaaaattaattggttagaggacaaattccttaagagggaatttctaggtcaaagggtaagcacattttgaaaacttcaaggacatagtgccaaaaaaccctccagaaaatgtgcatgactctacatttctatctgtagtacaagaaatatctattcccacttttcccaacactggttgtaattattatttttaatcttgatcacttttatagaagaaaaatgctattttatgattatagtaacttgcaattgttaaatcactggaggttaaagatatttgttatttcttctttataaaatgtgctctagtggtttttaccaggtgcaaaaacaaattaacactgcaggcctgagactaccttagtaagacttaattgcaaggttagcccttggctagcatctgggaattgggtttctagaggtttcccaccattaattccctgataaaagtggctcgctgtacctaaactgtggcttctgttgaacatctgctttccttctgagtccgaacttttggtatgtgccaggcaggccatgcctatggcatcagcccccaataaaaacattgggcattaagtctttaataagcttctctgggagaatacattacacacatgctgtcacaatccattgctgggttgcgatctctatgactccatggggacagggctctggggagcttgtgcctggtttcctctaacttcatcctacacaccttttattccttttgtcataataaacacagccaggaaaatgcctatacactgagtccacccaggaaatcatcaaacctgggggtgatcttggggactccaaacatactcatttgtaaaagctttaaacacttttatattttattaaatacatacgttagtaaataaaattagttaataaaaatatattttgtaaatatttttccctatcttagctgtttttctgtttttcttttctttctttttttttttttttttaaagagacaggatctcactatgttgcccaggttggacttgaactcctgggctcaagtgatctgtctcagccttccaagtagtctcaattttgtttatggcaactgacatgtagaagttctgaaaatttatatgtattcagaagagttctgtaactacttttggtgatgttttctctccaaaaacagtactgtctactggtagatttttataataaacttctttaatattctacaataccgtatatctgttaataaagttcttatgctatgctacaattgaagttattcttgtatcttgcttctttgtatccaagcagcttctaggcattagaaaacttttataagtaaaaaatttccctcataataggggaaatatctctgtcaattaaactcttaaaaagtttccaaaccacctacacctagatatcagaagaccagctaggaatttaagctatacctaaaaccctccaaaaaggcagaaagatagcagaagaccacctaggaatttaagctatacctaaaaccctccaaaaaagcagaaagaactaaaggaagcaaagatcatccttttgctaccaaacatctactgacatttcatagttttattggctactttggtcttaccttcttagaggaaaaattacatcgcaagaggctaactaccacccagaactggaaaccttcaagtgcccctgaaacatcctcaagaaatggcagaaatattctgatactaaatacttttcagtttttttaagctgcaaataattttttttaaatctagtcactcacacccaactttttacttatttatttacttacttccttactttaggagacatggtcttactccaccacccagactggagcacaggggcatgaccatagctcactgtaaccttaaacccttgggctcaagtgatcctcccacctcagcctcctgagtagctaggactacaggtacacaacactatgcccaacttgcaaaaatttttaaaaagcaaaaatgcaaaattatcaagaaaaccacattggaattttaaaagtggtaatggttttatttcaaagaataagacatctggccacattgcaacagaaaaatgttatttgataaatagtacttaactgaaatgtaaaagtagttaaacaaaaaacaatattgaccaataatataacttactggcactactgctctctttgtcccctgtattttttgccaggctcatggcatattcacatacttccgctgcttctctttgtgcaagttgccgaagacatgccacagctgctcgtcgaagtaacaaatgggaactacataagtgaacctgtaaatcataacaatgttaggcgatttctctttaaaaagctgtaattctttaatcttatttgcccaatgaatatatatatacatacatacatatatatgttttgttttgtttttttttttttgagacagagttttgctcttgttgcccaggctggagcgcagtggcgtgatctcagctcactgcaacctccgccttctggtttcaagcgattctctggcctcggcctcccaagtagctgggattacaggtgcctgccaccacacctggctaatttttgtatttttagtagtgtcgggttttcaccacgttggccaggctggtttcgaactcctgacctcgtgatccgcccacctcagcctcccaaagtgctgggattacaggcatgagccaccgtgccccgccctaatgaatatatattaacatcttacttctgaagatgctcttcatttaacaacctcagttgtttaaaatacagtcaaatgatggccttttgacaaaatactactactaataaaatatacaaaaaatatgttagtagccaaaataattgtcccaagatctgtgctctaaagctcatacaatatacttaaatgaaaaatccagaaggatcttctgcacatcttattttacacatggtcctattcaactttgtcatctaaattttttaagtatatagagatcaaatgtagtgaatgaaaagttagggggcagagcacaccataatatttgaaagcaaaggaggttatcaaagtgaaaaaaccaaatcaagcaaacataatcacctgaaaaaattgcaaaatggggccttttgccacagtatttttttcatctgaaaggtccctgaatatagtacactctaaaacataaaagtataagatgcaacatggcataaaagttaagaactcaggcacagctgccagactgggtttgaatcctggctctgtcacttattcctgtgacaccttacacaagttactcagcccctctgtgccttgatttgcccacatgtaaggtgggaatattaactcttcacaggaatatggtgtaaataagtaaaatgcttacaatgctggctggcacatggtaactgctcaacaaatgtaagctattataattattagtataaatctgactcatgaagaaaatattaaattatgttccatctgctgcttttcaagcaaggaagtaatcttttagaaagagtcccagacacaaatgatggggatggagaagaacacatgtatggaatatatctccccttcacaatgccagatagtatatttttaggctattaatatagcatttgtaattcaagatatacttgcataaaattcatagtcctgcctcagcctcccaagtagctgggactacaggtgcccgccaccacgcccggctaattttttgtatttttagtagagatggggtttcaccgtgttagtcaggatggtctccatctcctgaccttctgatccgcccacctcagcctcccaaagtgctgggattacaggcgtgagccaccgcacctggctgtttgttttgtttttaagacatcgccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacacagcgagactctgtctcaaaaaaaaaaaaaaaaaaaaaaaaaaagacatcgcccaggctggtgtgcagtgtcacaatcacatcttactgcagcctcaacctctcgggctcaagcgatcctctcgcctcatttttttattttttgtagagacaaggtctcattatattgcccaggctggtgtcaaactcctgcactcaagtgatctgcctgccttgggctcccaaagcactgggattacaggtgtgagccaccgcacccagccaacaaagtactttatttattcctcttcctgaaaataaagacattttggagctttcaaatactccataactaattacaaagttcaagcatggtcatatcacatgggaagaacaagtcacttagtctcttgaagtttctgcctttttatttttacagtggggacaatatccaatccacccatcttacacaactactgtaagaatcaaatggtaaaacatatatggagaacatcataacattttaatttagtaacaattacagagaattgtagctaagaaaatacattcaacaaatggtgactggcaaagcctaagtgaaagaaacaaaccactttacaaagtgttttcaaaaaccccactgcagttattctcaggtgtacttttccttttcattttaacatctgtgatattagagttgtaaagtacaatcaatggtatctttaatccctatatttattgaaaagataatcctatccaccctgaactgtagtggtaccatgtgccacagtcgtaagttatatgactgtgtatgtgtgaatccaattctggacactccgttgtgttccatttgtctacttgagtatccttgcaatactaccctgtctttcttactggagattatggtaaatcttgatagtaagtatagcaaatcttccaacttcattgatctttacaagcactttgcatttccctattaagtttacaatcagcttgtcaatttttccaaaaacaccactcttctactccacttagcttctgtgaacaacacaacctctattccttctttaatctctcttaactgcttctacatatttctggctgactcctttcctcttttctaaaattttcaagttgggttcctcaatcatgactctctccttggtgatctcatctactcctacgtctctgttttccatataaatgcatatgcctctcaaatttacctctttaaccagacctctcttttctgagctccaggcccataaaactaactatccatgtgtctaaaactgaattaatgatatccactcttcccaaccctcctcctccgatgttgccaatctcagggaattacattactatactcaagtcaaaaacctaggccacatccttctaaccctcttctccaactatgccccactaagagccaattaatgaacaaatccttcatcctaaatattattcaaatccattgatttctccccattctcttactaacttagagcaaatcactaccatcttcttccgagaataccgtaattcttaccctgtagagtccactctctatcatgcagcaagaacaaaatgtaaaaagtgcaaatctcattatgtcactcccctgcagagaacaccttctaatggtttcccactgcttgtagaataaagtccaaaggttttatgtatgtagaaagtctgcgtgatatgtcacctggttagttgtccagtctcatcatttcctctaggtcccacctctctgtcttctctctcagccttaatcacactaactaattggctctttaaatgtatgacagcccttcccagtttagggccttgcatgtatttttcttcctgtctaaaagtaaatgctgtctacttcaatatcatgccctttgtaaactaattcctatgtactctgcaaatcacaccttaaatatcaattgttttttttttttgagacagagtttcacttttctcgcccaggttggagtgcaatggcgcaatcttggctcactataacctccacctcccgggttcaagcagttctcctgcttcagcctcccgagtagctgagattataggcacccgccaccacccctgactaatttttgtatttttagtagagatgaggtttgaccacattgcccaggctggtctcgaactcctgacctcaggtgatccccccgccttggcctctcaaagtgctgggattacaggcatgacccactgcgcctggccttaaataccattttttaatgaaaatcttttctgaatgtcaggattatgataggcctcctgctaacgctctcttccaggcttttatagcacttatttgtaaataatatttttccattttcctttgtaaactataaactttactatgacagaggcttgatcttgtctcacccacaaatgtatctccagtaggttgcatggctcctgacatataacaggctatcaataagtatctgatgaatgaataaattaacaattataatgataccaacagatactcagaagtatcaatcaagctttaggaaataaaattccgagtaggaaaactaaaaatgtgatatatatatatattttggagatggagtcttgctctgtcgcccaggctggaatgcagtggtgcgatctcggctcactgcaacctccgcctcctgggttcaagcgattctcctgcctcagcctcccgaatagctgggactacaggtgcacgccaccacgcccggctaattttgtatttttagtatagatggggtttcaccatattggccaggctagtctcaatctcctgacctcatgatctgcccaccttagcctcccaaagtgctgggattacaggtgtgagccacagcgcctggcccaaatgtgatatattcttagcaaggaaataaacagttcatcaagatatttcttaaaaggtaaaagagaacaccagtgaataaaatgaattgtcataaaatgacaactgaagttcaaaaaacaaacaaaagatctagtatttgataacataaaagggtgactatagtcaataataattttaattgtacattttaaaataactatggattatttataacacaaataaatgataaatgcttgaggtgatggataccacattcactctgatgtgattattatatactgtaggcttgcatcaaaataccccaagtaccccaaaaatatatatagctagtatgtatccataaaaaattttttaaatgtaaaataaaatacaacttaaaaatcaatgaatgaaatagctctatacttacacaaaggctaggaacaaggctagatagattgacatgtcgtggtgcaaacatgtgaagctgctgaaggcaagatatggcagctgcctgaacaagagaatctgaatggtcttgtgttattgcacaacccaccaaacaagaggaacgaattgtagaagttgttgctccattccctggtgcaaaatgaaagaaaatataaaatataattattttattagtaccaccaaaaatattcctagtaaacaattatcctctaaataaccattctatccaattattattcaggttttttttgctgttgtttttgagatggagtctcactctgtcgcccaggctagagtgcagtggcgcgatctcggctcactgcaacctccgcctcccaggttcaagcaattctcctgcctcagcctctggagtagctgggattacaagcacgcgccaccacgcccagctgatttttgtacttttagtagagatgagttttcaccatgttggtcaggctggtctcgaacttctgacctcaaatgatccacccgccgtggcctcccaaagtgctgggattacaggcatgagccactgcacccggcctatatgcctatctttaaatgtaaataaggaaatcataaaaatcacataagagctacattctagttttatacgcattgccttatcattatcacttttgaaaatacttgataaacacctatgcttaataaaaggcacatatttatcgtcttcatatccctgtgacattcacaggaagaactatcctcactttcccaaagaggacaatgggtctaagcaagcggcttatttaaatcacctgtttttccctataataccagcattttgggaggcctaggcggacgaatcacctgaggtcaggagttcgagaccagcctggccaacatagtggaacccccgtctctactgaaaatacaagttagctgaggcaggagaattgcttgaacccgggaggcggaggttgtagcgagctgagatcacgccactgcactccagcctgggagacagagcaagactctgtctccctggggtggggggggtggggaatcacatatttttcaatttctagcattttctttaagtctttttctttttcctctctttttaaaaatatctgtcaaaatggaggaaacatagcatagagattaagaatgccggtaacgggctgggcgtggaggctcgtgcctgtaatcccagcactttgcaaggctgagatgggagtgggaggattgcttgaggccagcagtttgagaccagcctgggcaacatagtgagacccccatctcttaaaaagagaaaaaaaaaaaaaggccgggtgtggtggctcacgcctgtaatcccagcactttgggaggccgaggtgggtggatcatgaggtcaggagttcgagaccagcctggccaacatggtgaaaccctgtctctactaaaaatacaacaaattagctgggtgtagtggcaggcacctgtaatcccagctactcaggaggctgaggcaggagaatcgcttgaactcaggaagcagaggttgcagtcagctgagaccacaccactgcactccagcctgggcaatagattcaaaataaaaaaaaagaatgcaagcatcggaaattgatctgggcttcacttcttactccaaccactcactagtttccaaaaccttgtaaaagttcttaacctctctcagattcaatatttgatcaataaaatagagataatatcagtctctgggttgttatccgaattaaataatgtatgttaaaagctcaaccctttgaaaacatatataataaatgacaaaggagaaaaaggaaaactctgaaagtggtttatatattcaggatatctttacaataatttgctgacttgggagtctaaccattagtagaattagctcagtggaattaagtggtacaaacataggctttaggatcataaatgtgccactcataagttgactaactctaggcaagttacttatcttctcgcagtttacttcctcatagaaaattagctaatatctttttcctctagcaaaaagaaaacaaaatctagataatatttaccttatgacagtggtttttcacgctatgttcctaatccttagagttcaaaaaaatgaagcaaaagtccatgaagacatgtggatagcactctaggccaaaggaactctattattaactttcttttcatgggactccaagtaaaatttcatttaaaatgttttctctgctcaaaacttcaacaaacattatcatgtcataggtttcttgtagggattaagtaaaatgccacatgtaaaaagctgagtgccaggctttcagtaaatccaagtattcagtacatagtaattgttattacaaaatttcttcaagtaatgtgatggtgatattcaggaaatttaaagatactgattatctaactaggttccttaatttcagatgatttacttaccttgtagttcagggccaacagtagttattatagcacccaagcatcgacccaaacactgatgaacttctgtatgtgaaggcggaactgtcaacagcaaggtaagaactagagataatgttggttccacatagccacgatacatcggaccactagaatccactatcaaagcaagtgaatgaagagaccaagtctagaataaaatataatttcattttagttgtaaggaagaattcgaatgtactgaattgagtatactgaattgttacatgggtatactcttaatatttttaggcctaacaatgtgaagtagcaaatccagattgtaggatgttttcatacacattcttcatcttcactgtagttatatttacttatgtataataacgtctaaaaagaaacaacaaaaacaaaatattcaaagggtccacaagaagattcagccaatgacccaggacctacgttggggtatcacaggaagagagagaaggatggttatttaaaaaaaaaacttgatcaagctaacaaatctaaagaaataaaaaaaaagaggaaaaaagtacacagaataatacacaataaaaagaaaatatgtttgaaggaatgtatgtgaatgggtaaaattctcagaataagacagactttaagactaggctgataaacaaaatcttgctatgtactattacaaaaacaaaccctaatatatttgtcctaacaacttaccacggtcatttttatttcatagagcaaataattttccaaaaaattttctaaacttttgtaataaaaaaaccaattatattatacctggacttcaggggatgtcccatcttgtgctagagccaataaaatgctgacactggtcttcagatgttgtcctgagcctattccaccaacataacgatgcaaacaaccaagagccaatgaatgaccagtcctagatacaacatctcgagccgatttcaacctgaaaaaaagattatgcttcaagcactaactttgctatttccctataaaaacaacaacattataagtcacacaaaaactgggatttattggggaaataagaaaagattataatcagttacttctttctccactccctaacaggagttagaacttcaatttaaaataactacagctgggtgtcatggctcatgcctgtaatcccagcatttgggaggctgaggccggtggatcacttgagcccaggagttcgagaccagtctggctaacatggcaaaatcccatttctaaaaaaaattaaaaacttaatctgtcatggcagcgcatgcctgtaggcccagctagtagggaggctgaagtgagaggactgcttgagcctgacaggtgaggctgcagtgagctgtgatcacgccactgcactccagcctgggtgatagagcaggaccctgtctcaataataataatattaataataataataataattggttaaaaacatatatttgactgaataaagcctattttaattttagagaaaatttgacaactcatttttaatattaattattccttgaaaagccaagacttatttgaaatatttttatatttttaaaaaacaaaataacttatgtttggttttaaaaatagtaaaaaggtatttgttttcacagtattacataaaatattttacacttaagaaataccctataattatgatttgaacctctttaaaaaaggccaatcttttttctttgtgaaatatattttaaatgaattcaaatacataaaaagagatgaacattactttaaaaaataagctttattgagactcacatacaatattcaccaactttaggtatacaattaaattttaaatgtatactaaaatatacaatttaatgagttttgataagtatacagtatgtaaccaccacataatcattagaacagagatgtccaagatgaatacgaggggtcttcaaaaagtttatggaaactacacattatgcaagaactatacatggatttcaacattttggggtaccaaaataaactcgtactaacttgttataatatatctgaacaggacctagttttaggcaccaagaaggataagaacatcagtttgaaaagtgcccctatgagagcaacacaaattctgctaaagatgaattaagaacaaatatcaaatttatggtgaagcttgggtggaagaatggtgaaatcaccgatgctttacgaaagtttgtgaggacaatgccgtcaaagatatcagcagtttacaaatgaatagctcattttaagaagagatgaggcaggccgggcacagtggctcatgcctgtaatcccagcattttgggaagccaaggcaagtggatcactcgaggtcaggagttcatgaccagcctggccaaaatggtgaaaccctgtctctactaaaaatacaaaaatcagctgggtgtggtggcactttcctgtaatcccagctactccggaggctgaggcaggagaatcacttaaaccagggaggcagaggctgtagagagccaagatcgcgccactgcactccagcctgggcgacagtgagactctgtctcaaaaaaaaaaaaaaaaaaaagaagggatgagataatgctgaagatgaagcccaaagctgaagaccacacccatcaatttgagagaaaataatgcatcttatctgtgccctaactgaagagtattgatgattaacagcagaaataatagccaacaacatacatatctcaactggttcagcttacataattctgactgaaatgttagagttgagcaaactttccacttgatgtgtgccaaaactgttctacccaaatcagctgcggacaaggcagagctttcaatggtaattttaaacaagtgagatcaagaccctgaagcatttctttaaagaactgtaacaggagatggaacatggctttaacagtatgaacctgacacaaagcacaatcaaatcaatagataccaagaagtaaaagtggttcattcaaagcaaaagtggactagttaagagcaaaggtcatggcaaaagttttttggaatgcttaatacattttgctgcttgactttcagaatggccaaagaacaatagcatctgctcattataaaagtattttgagaaagttagccaaagctttagcgaaaaaataactgggaaagcttcactagagagttcttctccaagggcaattctgcaagagtttcaatggaaagtcattagacaatcactttatggtcctgatttggcttcttatgacttttttgttgttgttgtttcctaatccttaaaaaaaatatttaaagggtgctcatttttcttcagttaataatgcaaaaaagacttcattgacatggttaaattcccaggattctcagtttagggatgaactaaatggctggcatcatcacttacaaaagtgtcttgaacctgatggagcttatgttgagaaaaaaagtttgtattttatttgtatcttttcatcctattatttcaagaactttttgaagtccctaatagaagccacatatgtaatttaaaatattctagttgccacactccagaagacaaaaaggaaacaggtgaaattattttttttaaatagaaatgaaggttttagagtccaggctggtctcaaacgcctggcctcaagtgatcctcctgccttgaaatcaatttcaatacattttatttaactcaatatatccaaaatattaaaatatcaagatgtaatcaatataccaaattattgagatattttacattctttttttgaactaagtcttcaaaatccaatatgtattacacactcacagcgtgtatcaatttgggcaagatacatttcaactgctcaatagtcgtatgtgggtagtggctgccatattgacaacacaagatataggacattttcatcaccacagaaagttgccttaggtccctttgttgtcatattccttcccccaacatcctggcaaccactgagctgtcttctatcattatagtttaccttttatatagtttcatacgaatgaaatcagatagtacctagtctttggggtctggattattttacatagaacaaagcttttaagattcatccaatttattgtaaaagtagtttgctctttttatatagctgaacaatattccatttatgaatacatcactatttatctattcaaccattgataattgtggatactttccagtttttggctctcataaataaagctactataaaagtttgagtacaagtgtttgtatgcacatacattttcatttctcttaggtaaatacctagaagtggaactggtaggcaaaagagaagcatatatttacatttataagaaaccatcaaactatcttccaaagtgtctgtaacattttgcatttctactggcaatatataagagttcttaacctaccctttgctgagatttcaattatatgcatgttacacagcttgatattggtcccagaagtcactgagactctgttcatttttaattccagtcctttttctctctacgcctcatttttgatagtttctatgtcttcaacatcactggaatgatcttttctcaatttctgtgaattttggtcttaattctaagctggtgtaagatgtcaatacacaaatacagctgactgacctgttcttcctacctcattgtctaaccttctgtaaatcctatccagtgcattttttcatttcatacattttacatttctaggtttcctttgggctgtttttacaaattccttttctcacatcatgctcaggttttcctgtacttccttgaaaatgtaaagcatatttataatagctcttttaatattcttatttgctaatttcatctttttttttcatttctgggccgtttctattgattgatgttttctccaagtaagaggttttatctttctgcttctttatgtgcctagtaatttttgattggatacaggatattgtgaattttatgatgttgagttgctccatttattatattcctttaaatattgctgagtttttttctgggatacagttcagctactactaagaatcagtttgattttctcaaggcttgcttttaagcttttttagggtgggtcagggatgttgctcccattactgaagcaatatcgttccgagggcttcacctcaggaggtctttctattctgaatagtgggaacacaaaatattctcagccctgtgagttctgaaaattgtttcacctattcccttttggtggttccttccccagtcttgggtagtttccttgtattctgcacatatcagtattcagccaaagactttagatgatccttctgttcatagctctctccctgtgcagctctctcctctctgttattccaccctacacattctagctaccttgcctccccaaattgcaaatgctctctcctcaagtttgggtttcctatttctgtacttaagcctggaaactttcttcaagcagtaatctggagcatctttagtgttccctttgtttctttcccattcctaggaatcactgtcctatgctggctgttgtccaatgtctcaaaactgttgtttcatttattttatctgtttttctaacaatttaagacacaagggtaaatacagtccctgttattccaccactaatggcagttaaagtcctgtacattcttttaatgtttatctgaaagaataagatttcatcattttgttcatatttaactagtaatgtagagatttgaaatgaagctaacatgtaaacttcattttgaacaatggaaaggatcaaataaaagaagctatgaagaaatacttttttaagccataaaatactatgactcataatcatgcaccaatacagtcaattactattagaaaacagaacaaaatactactaggaacaatgcacctaaattaacaaagcagcctaaaaagcaatttggttgtattttcaaaactttattaaaactcttaataagctatccacaaccagacttctggcaacctcattaaaagtcaagagatgggccaggcgcactggctcatgtctgtaatcgcagcattttgggaggccaaggtgggtggatcatttgaagtcaggagtttgagaccagcctggccaacatggcgaaactccatctctactaaaaatataaaaattagccgggcgtggtggcaggcacctgtaatcccagctacttgggaggctgaggcacaagaatcacttgaacccggcaggtggaggttgcagtgagctgagattgcaccactgcactccagcctgggcagcaacagggaaactctgtctcaaaaaaaaaaaaaaaaaaatattgagagacgaataatcatccccaagactctagttggccagtttgcctactgcaaactaaagaaaattctaagtgctgtcacagaacagatgttaagaaatgtggcaggctgggtgcagtggctcacggttgtaatcccagcactttgggaggccgaggcaggttgatcacctaaggtcaggagttcgagactaccctggccaacatggtgaaacgttgtctctactaaaaatacaagaattagctgggcatggtggcctgcacctgtaatcccagctacacgggaggctaaggaaggagaatcacttgaacctgggaggtggaggttgcagtgagccaagattgcacatctgcaacagaaccagactccacctcaaaaaaaaaaaaaaaaaaaaaaaagaagctgggtgtggtgtctccctcctgtaatcccaactactcaagaggctgaggtgagagggctgctttagccaaggagtttgagaccagcctgggcaacacagcaggatcccatctcaaaaaaaaaaaataaataaataaatgtagcaatgaatgaagtgaagtaggtctatctgtaacattatttctaacatattatatccttggataagtaatctttacctctctaagcctccatttctctaagtgaaattattattattcctaaagagcagttgttttgaggaataaagaagttaagaataaatgcaatctgtgaattctaaaacattacacagattagaaagttacctttgtgttattatttctcaaaaagtaacaggttagtgaacctaaagcagaatcaatgttcacagtgataatcatctcttcacagtaaataatcttagatataagaatatacatttctcagaggtctcaaagtgactttcaattgaatggaaataaattcaactatcaaagatttttatttttatccaaactgggtcttaagcaattgaaggtactccctattaacctagaatggtttacagaatgattcctgtcttaatttctgtgaatttctgtcttaatgctaagttagtataagatttcaatgtgcaaatatacaagacggacctgtagctatagatgattttagcatttcacagtcagatattatatcagaagagatgatgttgatgaaaacagtctaatataatgaggctgtgaaagactgaagtttttccaaaatacagccagattctgccaaatctaagacaccatcgttttaaaaaatgtaccattactttacatagcagtataaaagaattaaaatgctgccaaatattatgacatttcatacagaatttcagaaaaatcccagttttaaataaaatgtgaaaaaatgggtaacaaaatcttcgtaataattatttcagatcataaggatttgaaaaagataatgaaggcaagcactgatgatacttgcaaacaactaaattggacaggtataaataaatgaaatgtccttgtgtttcatcaaagtacaaaataaatacagtaccctacagatattgaggacacattgttttttttttttttgagacagagtttcgctctgtcacccaagctggacagtaatggcatgatcttggctcactgcaacctccacctcccaggctcaagcgatcctcccatctcagcctcccaagtagatgggacgataggtatattcaaccatgcccagctaatttctgtatgttttgtagagacagggtttcaccatgttgcccaggctgatccagaattcttgggctcaagtgatccacccacctcaggctcccaaagtgctgggattataggcaaaagataacgcgcccagccaaggacacataaactaaaactccttgtaattaaaaaaaaaaattacccttcaagagctttctaaagaaacatactcctacttcacctgttatgaacagagcacaaaccattaaatggataactaagattgttactatcttttaataaatatttaataaaaagctatttcataatcaatggcaaatatttggaaagaggaaaactaatctattgctagaaaatagcagcaatcattctgcagaagattaagtgtctggttatattttaactgtcttttgcctgctcatactatccttagtgcattagggcattaccaaataacgaatcaaattgccatttacaagtcaagacaaggaaagctatttacagataggcaataattcagaaaatacattttcttcagaactactacttcatagccactgcttcatactcttttgttaatgaccatgacatagtttgctatatttaatactctatatatatgatagctaagaatgatataatttacataacacaagtgtcagttcttgacaacccttgatttttaatttctctacttatgcacttgattaacaagtcaatagtcactaataactgcaactcatcatcttaatgaaacatcactaataactgcaactcatcatcttaatgatacttatttgggtctctgagatcactctttataattaatatataagtgaatccttaaaacctgatgcttaactattctgtttcagtcataatttaagagataaacttggcagcagttagaaaaagaatggcttattccaaaaagtggataattaacagaaagaataaagagggacaaggaaagggagggaggagagaaaatgacgtcagagcacctcttcagtgaatacacataacagagaagtccttattaacatttttcttgatttcattaagcaacattcaagagctggattagaagccctctccacgcagaaagtatctaacatattacaactttcccagattctagagttgaatcaactgctaaattaaaaattgagatcattacaaaaaacccacaaaatattatcacatgctgtataccatgtggaaaacataaactccagttgattattatttaaaagacatctttgcctacacatgaaacttgttagtaaagaaacccacttacttgtcaaagctatattgggccattctagcaataaaagttgcttctccaaccacctgagccattcttccaagagcttcccccgctgcacaacgtaagatggggtttgggttgtccagaggacccataaccagtgtcagggcagatttacgaacttcctcaggtcctaaagtacttttgttttcagctaagccctacattaaaaaaaaaaaaaaaaaaaagacagcaattcataattcattattattattttttttttaaggcaaggtcttgctcccttgcccaggctggagtgcaatggcacaatcactgctcactacagcctcgaccttctgagctcaagcaatcctcccagctcagcctcctgagtagctgggactataggcgcatgccaccctgctgggctaatttttaaaaagtttttgtagagacagggtcttactaagtttcccaggctggtctcaaactcctgagctcaagcaatcctcctgcctgagcctcctaacatgctgggattacaggcgcacctggcctcgcaattcatattaaataaaggaaaaatacatgctgcaatctttctaaaatatacatacatcttcataagttattttcttcaaccagttttcacatgtatatactaatgtctagaatctgtaactgttcaattcacggtaattactttcctaaatacgatttcagaacgtgatctataacacagccatagtctgactggccctaagagacacttgcggggagtgtctctattcaaagactagtacttaaaagttacttccatatattaaggacactgtattactaaatcaaccattatttaactgattgaaatttatcactctaaggaaacattctcctatttcacctgttatgaaacagagcacaaaccattaaatggattggttctatcttttaagaaatctttaacaaaaaaataatttcagaatcaatggcaaatatttggaaagaggatatttggaagagtatttcatactcttgatgaatatgaaactgaatagtttatataaaaatttcacagaagacaattatatgacttaaacagtataatcaacatacatctaaaaacaaaatgaggcgaggcgcggtggcctaggcctgtaatccccgactttgggaggccaaggcggggagatcatgacatcaggagatcaagaccatcctggccaacatggtgaaaacccatctctactaaaaatacaaaaaaaattagctgggtgtggttgcacatgcctgtaatcccagctactcagcagacttaggcaggagaatcacttgaatccgggaggcagagatgagactgcagtgagccaacatcacaccactgcactccagcctggcgacagagtgagactccgtctccaaaaaaaataaataaactaacaaatgaggtggccgggtgcagtggctcacgcctgtaatcccagcactttgggaagctgaggtgggtagatcatgaggtcaggagattgagaccatcctggccaacatggtgaaaccccgtctctgctaaaaatacaaaaattagctgggcatgatggcgcgtgcctataatctcagctactcgggaggctgaggcaggagaatcgcttgaacctgggaggtggaagttgcagtgagctgagatcacgccactgcactccagcctggcaacagggcgaaactccatctcaaaaaaaaaaaaaaaaaaaaaaaaggtaaaaatagtaattagtaactgaatgttgaagtagtttgctcatcatattaaatgtcactctctttgttctagctgtacttaccatcctggaactttatttatttatttgagaccaaaaatctatgtcacattgcatggggaaaatgttaactacaacagaggcattagcatatctatgaagaaaagtgtaatctgtacagcaatattacagttggttcactactctcccaatcactgaaggagaccacgaccaccccactccttttctaaaaaactcacaggtccaaattagttgatggtctcctcagagtacatactaatggttatataaatggtccaaacctgtatttcttcttcttttttttttcttttttctgagacagagtcttgctctgtcccccaggctggagtgcaatggcatgatctcggctcattgcaacctctgcctcccaggttcaagtgattctcctgcctcagcctccccagtagctgggattacaggcacctgacaccacgcctggctaatttttgtatttttagtagagatggagtttcatcatgttggccaggctggtctcaaactcctgacctcaggtgatccccccgcctcggcctcccaaagtgctgggattacaggcataagccaccacgcccagccccaaacccttatttctataatcaatgcctatatatatcctttttccctgatgtttacaaaatatgacttaagcatgacctaagacatgttcatgcaaacacatatttgctaccattttattttaaaataagcttagcactgaataatataaaaagtattcaaacactttatgatagagtgcctagtatgatgcgcgaatcctgtgagataggcaaactatttgtaacagtggtcccctcttttccacaggggacacattccaaggcccaccttggatgtctgaaccatgggattaggaacctgattgctgtcaatgggaacttgtttctgttcatgccttctactcacaaacttaatgccttttcaattttaactaggcacttatcacataccatggccatgatttttgtaatttgcgatgggacagcaaaactaacacaaattcctttttccttcttcatgatttcagacagaagatttgttcttcctgtagatctcagcaactttggcatatgatattatttcttgccttcttaagttgagaactttctcttcttcacttaaaggaagcactttacagcttccctttggcatatccaaattgccagaatcactacttttgcactttggggccagtatgaagtaaaacaagggttatctgaacataggtgctgccacactgcagcagcccatctgataactgagacagatggtgaccaagtgactaacagacaggtagggtagaaagtgtggaatcactggacaaagagatgattctcatcctaggcaggacagggcaagatggaacaggacagtacaagattttatcatgctactcagaatgttgcacaattgaaaacttataaattatttcgggaaatttccatttaatattttcaaatcacagttgaccattggtaattgaaactgcagaaagcaaaactgcagataaggaagggactactgtattcttcttcatacctgtagaaactacaactcgaaaaaggttaaaaaagtttaaagaaattactctggacacaaacctagagtagcttaatgagaacgcaatctctaaatgcagcattctttcaattatgtaacactgcctcacatgatttgtggcctaaaccacagatcaagcttcagctctatttagttaaccttcagtagaatatccgatttcattcgtcaaacatctttgaaaattctgaaagaatttattggcacttgtaaaatctgaagttcaaattgaaacataaactttaacaacattaaaatataaaacatttatttaactacactgagcctaacataaagtttcaagtaatttaactaagctaacgtaaaggcacagttaccaagtgatttacatataaacattataataatcttgctatgtctggcttattaaatgcattaattaaaaacttatttcagaatagtatgtattaaaagtaaatacctttagtgcactaagaacagcagtaaatatgttaagctgcacagcctgctggcggacacctttagcttgtttaacacattcagcaaagtgatccaacatttgtaatctataacaataagaaaaaaaaatcacattagtgacaaattttattccaatatggctcaaaaacggataagaagagtacaagttaattgtttagcaaataattccccatgctatctcttttctatttcattcccacagctagtccaaaccagatctccttctcccaaaatattatatggacatgcggttattaaatggaacaagaaaagagtttcaattaacaaaataaggtcacaattgcagtggtcttcaacattaacagcactgtccaacaaagcgcctggcatctagtagacgctcaaggtttcttgcaaagataacaatcattaattatgtatctccgtggaagatttttaagttagaaaattttaaatgtagtataattctttttcctattttaaaaatactcttagaatagtacctcatgtcctagcctcagaagcttttgggaaagttcaaaaaagatttagctttggctaatttttttaaatgtaaaaaaccagaagtgaattgttttttatattaataaaaaagaatcagtttattaaaaaaaaaaaatccatggccatcttagatgatttctctgtttttttttttttttttttgagatggagtttcgctcttgttgcccaggctggagtgcaatggcgcgatctcggctcaccacaatctccacctcccaggttcaagtgattctcctgcctcagcctcccgagtagcatgcgccaccacgcctggctaattttgtatttttagtagagactgggtttctccatgttggtcaggctggtctcgaactcccgacctcaggtgatctgcccacctcggcctcccaaagtgctgggattacaggcgtgagccactgtgctctgcatttttttttttttttttttttgagactgagtttcgctcttgttgcccaggctggagtgcaatggtgcaatcttgcctccctgcaacctctgcctcctgggttcatatgattctcctgcctcagcctcccgagtagctgggactacaggtgttcgccactacacccagctaattttgtatttttagtagagaaggattttaccatgttggccaggctggtctcaaactcctgacctcaggtgatctgcccacctttgcctcccgaagtgctgggataacaggtgtgagccacaacgcccggcccatttcagaagattttgataaaaagagagtgagagagcattcttctaaaaagaaatgatgtgaaacaaaggaatccaaggaagttggatttagtactaagacaattatgacctcaagttggtaataaaatctccctgaggtcgctgtaaggatttaaagctcaatttatactagtctacaggtctcaggtctcaggtcaaagcattattcaaaactcatatgaagatacagattcagatgtacgtgtatacatgcacattttgatgtactttaaaaaattcttaaaagtaagtaagtaccttttgtgcactaagaacagcagtaaatatattaagccgcacagcctgctggttgaaaaccaaagtaggatcacttcttgctttttacctttttaatttaacattgtatcatgagcatcttctatcaaaacactgtctctacaaaaatggactttctattatttattcacttatcctcctactgttgaatatttatgttatttattatatgtttatatttttaatagaatttatttatttatacttcatcttattctgtaaaagtgatcatacagaattgagataatcctggatttcagttatagctttcataactagttgtataaccttgggtaaaccaaactcttagatatggatgtccttaagatttaaaaccaaaatgttgaaatagatgctttataagattcttccacctttaacatcatttaacatttatgtggcaaccaaatgttcttaaagatatttgggtaaagtttcatatttaaacttttttctcctcaaattaaaaagcaattaatcaagcaacctacatattaaagacattttttattttgtaatttttgtagagatgagtgtctcactatgtttcccaggctggtctgaaactccttgcctcaagcaattctcttgccttagcctcccaaagcgctgggattgcagacataagccaccacaccagacccaacaatacttttaaggcattttaattttgtaaagcttttaagttatctgtgatggtcttgtattaattcatttctgttttccttttgggaaaatcacaatatacaaactgcctactaaagctaggaatagtgtctgtggatacagaatataccaaaccaaaatgcttctattacaaaaagaaccaattatgttagtttccaagttctagacttgaaccatctcacaaacgttattagtgattggaattttcatccatttacttcctcaacaacaaagtcaacaggcttagcaaactgatgtccttaatttaagatatagtcaaaacctatgtatgaactatcaaacaaactattataatgcatttttttttttgccaacagttgtcattctagcatatataatgaaaattttgttataaaatacagtccacaatacaacagatatcagatgctagtacacagggtcaaatcttacataaagtctcaaattatgtgcaatttgcatgcaatttttttatcatgtatctgtcacttacattagtaaatctgtaagagtactgttttaagtattataataactcactttattgcagagttaactgggatgagaaaatctacttttcgtttaacataatatatatttaacaaaaattacctgattgactttatactaaccggtgtttataagaaacatgaggaaacactacaccaaaaagggccacagaagcatcaatgactgagactccgagagggaggggaccaggtactgcttctccagcaggtatgcgtaaataaatagaggaaggatcatgctccagagccccacttccagaggcactgtttggctggagctgcaaaagagtgaaataaaaattattcaaaatctactttaggaaatctacttattaaacattgggaatgaggattacagcagaggagaaaggagaaaaggcaacaaaaaaagaatgattggatccgaacatttgaaaacagaccaaaatgtaatttggtcattaaaaaatcatcagtaacaccttatacaaattttaagaaaagctttattcattcgaaaacatatttacaccacccaccttattgcgtgaacaatatacacaagatcttaatcccacaattattttaaatggggctttaatcactctttaaaaagtacataagaaataatgtattcagtgggcaaaagttctaaatcttcaacctactaactcattcctctccaacctgtcacaaaacaaaacaaactaaaacaaaacaaaataccaataaccaaaaagccagttaaaactgatctttatcacagccaccacaaggtatctaaatacacagaatattaaataaagacaatttgccaaattctcactcttcctgtttaacttttttcactatctaccaccaggatgccatctttaagtgtctaagaacactaaatggggattaaacctttctatacactattttctttttaagtgacaatgtgtaataggaccattgtttcagattaagttagtatttcattttcctctatgtttattacctggtcttcaattgatttatgatcagtttcctgaagccaagaaccaagaagaacactatcatcataatggcagagggatctgaggagggaagtagttgtgttggctgagttgtcagtcaaagtgaattccgctaccagttctctaagaagtgcattaaaagatcctaaaaaacagaacttcagatcagattaaaaagaataatttttgtgaaaattataatcattgcccacaaagagctgcaacatgttcaacaggaataaaataattaagtctctgttctcttctttaaaaaaaatctatatttaaatgctggttttaatatacaataatggtacttcctttcatatattgtattgtgtcttttagcccaaattatttaaaataaccaaaaaactcaaatagaggaaagagaggcgggtgccatagcatgcttgtagtcccagctactcagcaggctgaggcaggaggattgcttgagcccaagagattgagacaaacctctgcaacacagcaagaccctgtctgaaagacacacacaaacaaagatactttattttaaatatattaaatgtgatatgattattattatttattgcccaataatgtacaatgaaccacagcacaccaaaattctttggcatgattatactggaaagaaatcaatagtttattttactattaatattttacataatatttgatttctccctccagatcctcgaattatttgctatattacagtatataggaagcatttcagtgtattaatcaaaagtgcacactttgaagataaaccagctagatttgaatccaagctctgccacttaactacctctaagtcttgggtaagttaagtttctttaagtctctcaatctgagattcttcatctataaaatagggctaaaggcctcataagttgcaacacagtcaaaaagctaatacaaaaggctgaaaacgagacccagaacacagtaaggagtcaacaagtatcagctactctacatgaagaaaaataaaatggtggccttcctttgcacagtaagtcagtgggagagcctttgtcaagactctataatacggtgaagaattgtaaagaaaaatttttatcagataccacaaatttttaatttaccttcataagtttttggaggtaacaaagccaagatatcataaagtcttaaacggaccattgcagcactagctttcagatgagctccatgggctttcattacagatggaatgctaaaatatcaaaaacatagttggtaatggcttaccagaataagtattacttataaatttttttagcaatgtatcaatgtactgccaaactacactgataagtatacactttcattttagcttatgttgtgatctttgctgtaacaaaaacactttaagatacaactgtatttcaatccacaccattgctgtaatttttaaagttatattacaaaaataaagttttatgtttcctagatgattctagaagaaagcacaaaatatggctgagaagtatattattaatatataaaataggatgtgaacttgtctcaatcgcttacttactgtgacatcatagtcatggcacattcaataggggtcatcaattttcgaatcacatcttcagttagtagctcaggacaatgtgcaacgaagctcctcatggctagataaaatgtttaaaaggacagatttggagtagcttttgtgaacatgaattaatttataaaattgtataaatataaaggcagttgtaatacttaattattataacgtataaggttctgaaaccatgtcgaaccaaaagaaaaacttgcaacaactacaaagaaaaatcgtggaaaaggctagaaaaaaggtggatagaaaaatggaggaagagaaggtactggttagagagattcttcgggtggaaattcagaggactatgatcccataggaattcagatgactacaaagaaagaaattttaaggcattgtttatacacatatacatttatgtgtataaacaatgccttaaaatttacatgaaatttttacatatattaaatatatttttgcaacttttacagatatatatgtatatgtgtgtgtgtgtgtgtgtgtgtgtgtgtgtgtgtgtgtgtatatatatatatatatatttttttttttttttttttgagagagtctcactctgtcaaccaggctggagtgcagtggcggaatctcggctcactgcaacctccacgtcctaggttcaagcaattctcctgactcaatctcctgagtagctgggactacaggcaagcaccagcacgcctggctaatttttgtatctttagtagagacaaggtttcaccatattggtcaggctggtctagaactcctgagagtgatccacccgccttggcttcccaaagtgctgggattacaggcatgagccacagcacccggccactacatatatttttgcattttgaatttttacatatatttgtgtaaatatatatgtatataaacaaaaatggtccagtgagaaaaaaatatttttattggccccttagcaatagagcctagactaaaacacctcctagatgtgtgagagtaaaggtgcccccttgcctggctgcccttgtggtgaaacatgtatctctctcccagtttggaaaaagaagtagttttcactctgagataaaccaaaaaagaactggtacatccaatgtcattctagttatcaaacgaaacaaaacctgagcgtttcctgtaagctgttaactcccagacaaaaacaactgtatccgttatttttgtaatgttgatatctgaaaaatatatgaaggtttggagatttgataaggatgtgaaaaaacagctgtttctccattatgaaaagactaactgcaaatgccaataactttggtaatcctgagtttctttttctttaaatagctgttgggtattttttcttttttttatacatggtgactcagtgcttctttgacaggtaagatagcaacaagtgggaataagaggcctgggttctagttcctgtctaaccaccaggtctaaacactttttcagagtctgggtttcatttttattacaaaattagcaaactgaagtggatcatttataaagtttctatttaaatctaaaagcctatgaatttatcattacctagtaaaataaaaaactataaaatagtgatttttcttttactttacaaatattttagttatgtcataatattgtgaagcacaatcctttcagttcttaccacatagagctccagcacgaccttccaaagttacctgccaggtaaaagaatcgcctcgggccttctcagcttccaattcctttaaggaacgtgggaaaacatttcgccacaataacaacatcttgggcagatggtaacgaacgacagatggtcctagccaagaaaatgagaatacaaaaccatgtatatgtaacataccttacaaacaagtgtcaagcaaaatgagcccaacacaaactttatgtaattttagagatgaaaatagagtaaaatactgatgtttaacaatatctgttatttcactctatttttatctctaaaattacattattttcaacctttattcactgattaaaatatagatcaaagcataacaaaattcaccttaaactgtcaatatttttagaatccaaacataaaatacacaaaaagcaatttttaaaggataacccaactgtattgagaatggtggattgcatattatcaataaaatatatctgagacacattctatgaggtctttttcatatacatatgtatataaacaaatatacccactcacacacacatacagatacatattccttagttttgggggcaatttatgtggttaatttagtttcatggaaaggcaatatattcagacctaggaatctatatttacattgctaaaaaattcatttaacataccactgaacatacttaacataaacttctggaaatgagttgcaactttttgttttcttcagaaaagaaaagtaggtcaaagtataatttccaacagatagatgcttagatctgtgtcataactttgtagtacatatatgcacacactttttacagcagcagctaaacatatgaactaaaatatgaacataccccatcacaataataggtatttttgtactatgtacaatgttaaattttgcctacaatgcagatttgtcacactacttaagagtgaaacacattaagggttaccccagaaaagcagcactaacaataccaattaaatgtgactttaccactcttctaaaatcacactgctggttttcacttagggtatgaaattttccctcatattttcatctcttttaaacactaaactcatcaggtagacaaaggttattctgatggtaaaggtgaaactttgctaacaactttctcattaaatgtacttaagcaataattaccaaaaagagaaatctactagcaaatgacgaggaaaacatctttacaccatttttacaacttcaatgaaaatccagaatgtgaagcttaacacttttaaattaaatttgctttacaggctactgacagttatagcgtgacaaaaatcctactcaaatataattatacctaaagtcataagtgctccaagtaaaagccagccagcttgggtgcgctgtaaagatagcctgctattttgggcagcagttcgtaaaagatcttcagcaatactaactaccatctgcaagaaaagtttagaattggattttaattcaaacaagttaaattaaataaggaaacagataactagcatacattacttaaaagaagttgttggctggatgcggtggctcatgcctgtaatcctagcactttgggaggctgaggcaggcagattgcctgagctcaggagttcaaaaccagcctgggcaacacggtgaaaccctgtctctaccaaaaaatacaaaaaaattagccaggcatggtggtgggcacctgtagtcccagctatttgggaggctgaggcaggagaattgcttgaactggggaggcggaggttgcagtgagcagagattgcactactgcactccagcctgggtgacagagcgagactccgtctccaaaaaaaaaagaagttgtcctctcgtgttattagcatgtttttgaaagaggcaacatcaagacctggttagtcttgattgcactgatgactctgaagagacccagaacagtgtagtagttaaggacaagctctagggccaaatgccatctctgccatttactcgcattctcatttagcactgcttagttccatcactggtaaaacagaaataataggaatgcctatctcagccttgcaaggataaaataagttaatacagcatctatgctactactttgtcatttcatcatgtgacaaatccacttctcatttttcctgtgtcttctaagactgtaagctccaaaagattagcttacttatttgtttgttttttagagacagggtttcactctgtcacccaggctggggtgcagtggcacaatcatagctcggtgtaacctggaattcctgggctcaagggatcctcctacctcagcctcctgagtaggtaggactacaagtgtatgccaacatacttggaaaattttaaaaatttcattttttattttttgtatgacagggtctcactatgtttcccaggttggtctcaaacttctgacctaaagtgatcctccagcctcggcctccctaggcattgggattacaggtctgagccaccacgcccaggcaaggttagctcaatggtagatgcataataggagttcaacaaatctttgaatgtggaataatagtgctaataatgacagcatttatttagtggtcacatgggctagcactgttctcggtactttgctgtattaacatccacacagaatggctagtatagacttaaatttggtgcagctgaataagaggggagatgaaactctaagaggttagcagagcaaaggcttcgaagctgaaaaaggccagggaaggaaggaagataactagtctaattagagcaacaggaaatttgaatgaacggcggaatgaagtcaaattataagataccagtttaccagacaaaggagattatattttactctctgagtactgggtagtccctaagggtctctgggcaaatgtaaaatatgaaagtggtatgaggaagatgggacgtgtggggaagatggaaagtctgaggaagatgagaatgaggaagcaacgatatgacaaagtgagagggaagtctggatttcatcggtagctatgcaactgctatgaatggacatgggcttaatgtcccagaaaaaaaatcaaaatttaaaactctagccccaatctgcctatgtaaagtttcaaataatatttatataaacacttaagattactgagaagaaaaccatgatagtagtatacaacagaaagaaaggagaaaaaaaagctactcatattttttattttattttattttttgagacggagtctttctctgtcacccaggctggaatgcagtggtgcaacctcagctcactgcaacctccgcctcctgggttcaagtgattctcctgcctcagcctcccaagtagctgggattacaggcatgggccacaatgcccggctaatttttctgtatttttagtagagacaaggtttcaccatgttaaccaggctggtgtcaaactcctgatctcaaatgatccacctgcctcggcctctcaaagtgctgggattacaggtatgagccatcatgcccggccatgatttattaaaaccactcaatttttactaaacattatcaaaatgctaaatattacaatagcgtattatcctgacatctttgaatatatagcaatgtgaacttttatttctaaaagctgaaagaaaagctctgactttcaaataattactatatctaaggttgggtttttttttttttttttttttgagacagggtaggtcttggtctgtcacccaggctgaaggacagtggcatgttcatagctcactgtaacctcaaactcctgggctcaagtgatccttccaacccatcctccccagtagctaggaccatgaagttggctaactttttttattttttgtaatgatggggtctcactatgttgcctaggctgttttttttctctttccctctaaaataaattataacatgttactagacttggacaaaatctattatccttacatcagaattaaatatcaaattataatagggtctgttaacaccatagtaagaacactatgttttatgataacatagtacaactgttatttgaccaccctgttcaacactaaacacagcagcgttcctataaagaccaaagcccacgtgacagcattcccaagtctaggatctccgtcatacctttcctttggcatgaggaatgcccaaaggacactgatgtactccacctaacaaagcagccattgcaaaactatatccactgacagcttctggtgaggtcttcaagttgttgagccgttctgcacacctgtctagaaatggtgtcagctggaaaggtaatgccacagccacacagcgcaaacaccatgcagcagcaagtcgggcagccatgcttggatgaagcagcactgaagtcacaatctccaaaagccctaaacaagaaatactcaaaatattactctttaatgaagtcaaatgatttcagaaactcaaatactatctaaaaaacaataactgaaatgacaatcaccaagctttcacacatatagatccacaactttgcctaaaactacatacagtagagtacttcaaaggaacattttctatgaagaacatagtacaattatattcaatattgatgtaaaatttaatagaagtcttcaacaaattttagtcaatttttataaaaaaactaccacaattgcttttgatttctgttccaaaactttatttaaccatttaattcaatattctttacaaggaaactttttttttttttgagactcactttgtcccccaggctggaatgcagtggcatgatttcggctcactgcaacctatgcctcctgggcttaagcaattctcctgcctcagcctcccaagtagattacaggcacgtgtcaccacagctggctaatttctgtatttttagtagagacagactttcaccatgttgaccaggatggtcttgaactcccgatctcaagtgacctgcccaccagggcctcccaaagtgctaggattataggcacgagccaccacgcccagcctatcacaatgaatattaatttaagtaaaacctgatgatctgaagtgctaatgatgatgataagcaactaatcaggaattaaatatcaatcacacttatgactgaaaaaagtggaaacacatactagcaagtaactgaatgtcatacctatagatgcttcttgaataagaggggatgcggtggcattcaagctctgcaccaggctcccgagttcctggagggcacagaccatcacatgctggcttgctgcaatgtctgctgcgccagatttgttttctccacttgtgtcattcactactgcttctggaaacacaaaatcatgtctttgacataggagaaatgaattgtggtatgatttttttggtctatacaatttatgattttagccataccagttgatgtccgagtgttaaaaactatgcagttatttctcaatagaaaacttgtagaactaaacactgaagtgacttaaaaatgttgtttaatagctttataataatgctaaaatatatactgagatacatctttgcttccaggaatacaacctaattttagcaagcagcagcaatccagtgtataaaagcacagatactgcagaaagaagactcgggttcaaatcccaattccactagttatattagttatgtgacattgagcaagatgttcaatttttctgtcccaatttccttatctgttaatgggcttacatgcctatttcaaacggtactgtggtgattaaaaagtcagtgcatataaagaatttaacacaatgctgcccataatacacattcaataaatgttaacagctattattactttattaccattgctactttaagtgttccaatatattggaggtatctgttaaattactgaccagaaaatgaatctataaggaaaatgccttaagttacctcttactggaatgtttctgtaagttcccattaattaaccttgctgcctgctaccccaaccttttagcttccactagaatcgaaatgtgtttgacaagagacaaccaaagatcgcttgccaaactactaattgagaatacattctggcccacaaatccccaatacgtatcattatatttaattctgctttcaggatttaaaaaaaaatcaaataacgaatttatgaccttaacattaagaacctttaaatgatagtaaaactttcttttttgcattcattattaattaatagactataaaatacataatacagactaggatataatggattaataaattgaagactataattaaatttttttttttgagacagagtcttgctctgttgtccaggctggagtgcggtggtgccatctcagctgactacaacctctgcctcctgggttcaagcagtcctcccaactcaccctcctgagtagctgggactacaggtgtacgccaccacgcctgattaatttttgtattttttaatagagacagggtttcgccatgttgggcaggctgtttttgaagaactcctggcctcaagtgatccacccatcttggcctcccaaagtgctgggattacaggcatgagctaccatgcctggccaaataactcttgtttttaggtatttctggacttggaaatgcataaactctagcttttgattgctaaactttaagctccctgaggataggtgctgtatgcatctggcttgctattttactcccaccatttgacgcggtgtttctggcactaaacatttcctcaatgaatcaatgtgcaaattattctttaagttgtgaatctaagacagatgactattttagcatatttaaggaatgatatctcattaatttaaacactttaattcacgattcataattttcagttagctctatacatttaaaactagtttactggctgggcgtggtggctcatacctgtaatcccagcactctgggaggccaaggcaggtggatcacttgaggtcaggagtttgagaccagcctggccaatgtggtgaaaccctgtttctactaaaaatacaaaaattagcagggtgtgtggtggcacacgcctgtaataacagctgactcaggagggtgaggcaggagaataatttgaacctgagaggtggaggttgtagtgagccaagatcgcaccactgcactccagcccggacagcagagctagactctgtctcaaataaaataatataaaataaaaaataaaacgagtttactaagtaagccattataaacaacaaaaactacaactatttatatttttttactaatttcataaaacatttcatacatatatctctaaaaaataaattattgatatttattcattaaatccttatttcaaaagacctctattagtcaatataatttcccttattaaagttagtatagtgaaatagtgaataatagtgaaaaaactaaacttttagaatttatatttttgccttgcttttagtattgcttttatatttagtttataactggattaaaagctccatgaagggagaaactttatctcattcattatttaaaccctgaattactgctctgcaaatctaagacaataactatttattaaattgaaaaatttataaaactggtattttagaaaagaatttcttgtaattatgtataactgaggtttcacagtacatcttacagcgggctaataaccatctgtaattgttcctctctaagttttcatattaagcctacgaggggaggaaaagaaacaataaaaatatatgtttataaaacaacaggctctaaaagcagaaagaggacaatagattactccttgaagacagcaaccaatgtgctgctgcatgccagaaaagttataaaatccgtataggtactagaaataaaacagaaaacacaatcttaccaacataccacccaaatctttaaaaactctatttcactgtaattatgtgattttaatatcaaataagagtactcaataaaaatcactatgaaaacacacagaaagataaactaatcagtcttatggatatttattaagaatcataataaagaactaaatgactaaggtaatcaacacacataatgatactgattcttacctacggctttcatttgttttccaatagcttggcagatttctttggcagctgcaatctgggctttttcacctagcaaactgcccacagtagctcttaggataaaggaaacacatcgtctggagtacacagcctccacatgtgtttgtgttgcccgaggatgggaaaccagatcaagtacatgggacaggaacgtggcaaagctgcgctccaaccactgaccacccaatgttgtcacaaaaacaacatacgcctgtaaaaagaggaaggtacgacttcagatacacttacataactgaacagaaatcaaagataaagcaactactaaaataactgataacagcatgctgaatgaattgtatttgaggctaaaacagagaaaatttaaacttgaggtctttttactacttctggaatacgaattattagtgaagtatctttgaccaaaaaacagttcttaagataacaacttcatgaagaacacaaagggacagcagtgagagggaagggaagctgaatttaccccagtgatcgggaaggtaacaggttacagaaacaagaaaaccttaacatcctaaataaacactgacttagagctataaaacccttacgtacgactttttctgtaagttaaaaaattgtttacttatattttatacttgtttcaggatcaaggtacagttatgattttgactaaaatcgtgattttgactatgatcaccatttcatcttattaggtgttaattattattagatcattaaccataacctcttattccgtgttattttgaaattataattccaagtcagatataatcttataattacactggtgattaaacactgatagaaaatccaatcaaagcattaaccagtatttttagctacagggttgttggagaatattaaaatctaaatgctcaagctacctgaatacagtttcaatgaaaactgagttactttatatctgattttctgttaagcaaaatgtaggaacttcatttaaagatatttacacaaatatggtagacacaggcttatttatatattattaaatatctaccgaatttccatataagcatgtaatttggaatttgaatgtaattcattcattcggtaaaagaaacatttcgaaagaaaccagacaatattaaaaatgtctctgtgagctgttacttagtaacagttttccacgaagtttcacaagtgatatgaacaaaatctttttttttttttttgagatggagtctcgctctgtcacccaggttggagtgcagtggcgcaatcttggctaactgcaacctccacctccctagttgaagcgattctcctgcctcagcctcctgagaagctgggactacaggcatgcgccaccacacctggctaattttttggtgtttttagtagacatggggtttcaccatgttagtcaggctggtctcaaactcctgacctcaggcaatctgcccgccttggcctccaaaaatgctgggattacaggcgtgagccaccgtgcctggccaaaattctttcacacatacgtgttacaaacctgcgtaactccaactctcacttcacgattaacggaccctccaacttttaacatttctccaccgctctttaagaaacctgaccctccacgcagaaatcctgtggccatgagttctaagacttcatcaaatgttgctcgcttcacattctgacgcattactttcaagaagaaaaattaaagtataagcaaatatatttctgaggcactctagcttaataattcaagtaattatttttaaggacactttactacaatggggaaatggtttagtttccttataattgttttcttaaaattttcaatgtacttgtaagcctgaattcaattccaaaggaaaaaatgctcagaaaatggaaagagctagaaataaaagcaattcaataaatctacgcaaaatagtctaataataataatactatgtgtaacacaataaggacaaagcatacccacagcagatactactaactgatctcagttctcattcccgcctgaggtggacacaaaaaacttttctcatcacagtgctttctatacagtagttaccaatagattaagatgttactgggaatgcaactgaattggcatccctagtacagagtttcatattttatgaagtccttccacatatagtagcaaatgcaatcctcacaaaaattctgcagaggaggtataaagctcatggctaagaattcaagctttggtatttggctgcccggaatttgaatttcatttccgacacagaacagtttttagaaaaatagttacagaatctaagtctcaatttcctcatctataaaatagtagtaacagtccatataattcacaagggcttttatgaggattaaattttgtaatacacttaattcagtgcctggcacatagttagcactttaaaacattacatcatcatcatcatcatcatcatcatcatcatctactgaaataattatcattaaagatgaaaatcaaagctcaaagaagtgaaatagggtttcacagttaataaatataagagacaggacttgaacctaaaacatctggttctctttctatgatacagaggtggggtagaggtagggacaagactggggcagggttcactcagcatctgctcacaggcacccctgagatatctctacggaactgtgaagcaaagcaagagtaatttgaaaactcagtgctgcctctgattctgtttataatgataatcaagaaaaattaaaaattaatactgtggtacaaatggggatctactcatcagagacagaaaatagcaaataaagtgctgaaaataagtagcaaataaagtgccagattccagtaccttatacattatccaaaatcatttcataaatcttatgtgcttatatgtccagcataattgctagatatcctgtacattatcatcacaaaaaatgtgactacatcaaggaaaatgccatttgggttctttttttttttttttaattttttgagatggagtcttgctctgtcgcccaggctggagtacagtggtgcgatcttggctcactgcaatctctgctgcccgggttcatgcgattctcctgcctcagcctcccaagtagctgggatgacaggtgcatgacaccatgcctggctaatttttgtattttcagtagagacggggtttcagcatcttggccaggctagtcttgaactcctgacctcgtgatccacctgtctcggcctcccagaagtgctgggattacaggcatgagtcaccgcgcccagccaggttctttcattttatggaaaagtagacaaagatacctaaaaatttaaatccattacactgacttgcctatatgcaataactaattaggtctgttatggtctaaatcaagggcaaacaacaatacctgttgcctgttttggcattaatgctgtggccatgactgttcctaaaagtttagacactgccactcgtaccccataatttgagttttccaaagccttaaagcagagagtggctatattttctagttcagcagtccacataaatacagcttcattctgtagttctagtagacactggaattaaaaacaaaaaagtaaataacatcctataacatctgcttccagagatggaatagcaagaaccagacttaccacctctcctgagataaccaaaaaactcgacaaaataaatgaaacaacagttttcaagacactggacatcaggcaatgaagcatctttgaggaaaaaaacaagatgaaccctacaactgtcccagcctactgccttgagagagtttctagttagggagaaacatgtaacactaaaccaccacattagaaaagaagaagggtctcaaatcaataacctcagcttcacccttaaaaaactagatgaaggagagcaaattcaacacaaagtaagcagaaaaaggaaataataaaggaaattcatgactaggaaactaacaaagaatagaaatgaaaccaaagctgcttctttaagaagactaataaatttgataaatctctagtcaggctgatcaggaaaaaaaaaaagtaaaaatacaaagtaccaaaatcagaaatgagagaggtcaaatcactacagattcaacatgttttaaaaagttaaagagaatatgtgaacaactttatgccaataaaattgacaacttagaggaaatagacaattcactcaagaagaaacagataacctgaatagcccagtatctatgttaaaatttgattctgtacttcaaaatctttccctcaaaaaaactctaggagatgcctacaccagtgaattcaacaaaatgttcaggtaagaaataataccaattctataccaactcttccagaaaactgaagggaactttccaactaatcctataatgccagtatcaccttgatgctgaaacctgacaaagacactacgtgaaaaagaaactacatacccatatccctcatgaacacagatacacatttctaaacaaacttctagcaaatctaatacaataatatataataaggatgatatatcatgaccaagtgaggtttatcctaggaatgcaatattggttaaaattctaaaactaatcaatgttattcaccacattagcaaactaaaaaagaaaaatcaaatcatcatctcaatagatgctgaaaaatgatttgacaggcacatgccaccacgcctggctaatttttttatttttagtagagatggggtttcgctatgttggccaggctggtcttaaactcctgacctcaggtgatccacccgtctcagcctcccaaagtgctgggattacaggcatgagcaaccacgcccagcctggacgttgacattgatagaattcatgattttagtcatatttccccagtcttatttgtattctgtcaatatttgtacatttaacactacaagatgttgctaagagatatgaaagaccaaaataaatggagagatatatcatgtccatagggtggaagacttaatattattaggatggcaattctctccaaattcaatgcaacctgaatcaaaatcccaacatggtatttttgcagacattgacaaacctagactgggcaaaacaattttgaaaaagaacaaagttggagggctaacagcacctgatttcaacacttattacaaaggaactgtaatgaagaaaagtgttgttggcatcaagatagacaaatggatcaatgaaacagcacagagagtccaaaattatacctacacatatacacacaactgattttcaacaaagggtgtaaacggagtttagtgaagaaaagataggcttttcgaaatggtactggaggggccgggtgtggtggctcacgcctgtaatcccagtagtttgggaggccgaggtgggcggatcacgaggtcaggagatcgagaccatcctggctaacacggtgaaaccccatctctactaaaaatacaaaaaaaattagctgggcatggtggcggacgcctgtagtcccagctacttgggaggctgaggcaggagaatggtgtgaacccgggaggcggagtttgcagtgagtagagatcgcaccactgcactccagcctggggacagagcaagactccatctcaaaaaaaaaaaaaaaagaaatggtactggaagaagtggatatccatattgaaaaaaaaaacaaaaaattttgattcaaaccttgcaacatatacaaaaattaactcaaaatggatcacatatctaagtataaaactataaaacttctagaaggaaacacaggacaaaccctggtttacgaaatgtttccttagatacaacaccaaaagcacaatccatataagaaaaattgatacactggatgaaattcaaaatctcttttccttacaaggcactgtttagagaataaagagacaggccacccattgggaaaaatatttgtaaatcacatatctgataaaggaatatgtaaaaaacctataaaacactctcaaaagtcaataattataaaacaacccaataaaacaatggacaaaagattgagcacatccttcttcgaagaagatatggatggcaaataagcacctgaaaatatgcttatcattagtcatcacggaaatgcaaattaaagccacaatgagataccattgagatatgagatacaatgacatatgtatccattagaatggcttaaattaaaaagactgtcagtaacaaacaatggtgatgatatgaaggaagagaaattctcatacactgctagtagaaatgcagaatggcacgagtactttggaaaacagttttgtacttttctgaacgttaaactaaatctgccctatgaaccagctattccatccctaggttatttgcggaagtgaaatgaaagcatatgtttgtgcaaaaacttatatacagatgttcacagcagtttttttgtaataatcaaaactagaagcaactcaaatgtttataacaggtgagtgaacaaatcaatgtgacatatccatacaatgaaatactactcagcaataaaaaggaatgaactatggatacatataacaacataaatgaatttcaaaacaattatactaagtgaaagaagccagaatacacatacacaaaagtacatctcatgatgtgatactattatatataattctagaaaatgaaactaatccattggaacacaaaacataatttaaaattttaaaagaaaaaaaaatcgttgactgtttaagagcaagaaggataaagagcagtattctaaattggtcgagtactaaccttggccactgcacatcgaacagccattgacctatcagtcaagagagacctggcattcttgtaaatatcacgatgggaggaagctgctgcaccacccagtccacttagaactttctgtagactcattaagatttcacttcgcccttgagactagacatgtatacaaaacaaaactattttgtaaaataaattccatatttaaacaagaacacaccaagacaaaagttctttgggtctaatggtcttacctccaaattataaacggtaaataatgaaaagtacaataaaattaagtattctagaaagtacctggcaagtaagaatagtcaattaaataatatctttctaaaaaattaggttttaagtaaatatattccaatatttctatgaattactgaagtacatacaatataatgaaaacatgaagagattcaaaagcttcaatatcatatctcaatatataaaatatttcagaacgtaaaatattaagtaaaaaagttgagaaataatatataaatgatccaaaaaaggaagcagaaaacatccaacacatttaaaaaaacatgtcagaaatacagcaaaccttcatcttcttgtgactaactcaaactgttatatccatattctcatagtgcttattgttatttctgatagtatactcatcacagtgtatcacaatgcttattcacacttagctctcttccactaaactgtaagttctttgaggtcaggaccatctttgtatgtttaatgcctgacaaataataagtcctcaattcttttttaatgaatgaatagacaaatagttcccagaaaaggtatccaattctaatccaatgactggtatcactgaacagggaaataatttagacacaaaacacaaagggacaggaaaaaggtgatgtgacaaaggagacagagatgggagagatgcatctacaagccagggaagatcaaagatttccagcaaccactagaaggtaagaaggaaaggaaacattcttccctagatccttcagtggaaacatggccttgctgacactttatcgcagacctccagcttccagaactgtgagacaataaattgttgttgttttaagccacccagtctaaggtaatttattacagtaaccaggaaattaacacattagctatggcaccaaaaaaaagaaaaaaaaaaaagccaatccaaaagtaccataggactaaataaaaaataacaagtaaacctattccttgtcaaagaaaagcattctttcccttccccctgatatacattaaaagaagggacaagtaataatttgtaattacctccttgctaagcaatatgagaccacagtgacagaaaaagaaacaaacatattttagctgacatctaactcttgccacaagcaaatattcaaataatattggttgtaaaacttacctctgcacttttcagagatttcaatagattatttaccgtttctggaaatgcgctgcccaacattctccccattttttcataaaatgctccgacacaagccaccgcagccctgtaagaagtgacaacttcactagtcattgtccaggttaatgatacaattatacttttctcatttttagaaatcaatttgcatttgtctaggacacttttggctataatccttaatttcaactatcaaaaacaatttatgcttcataactgcaacaaatactatactctatttacactgtattcttgttaaatactatagttaaattgtattcttgttaggaatacaaaagaatctatatatgtacataataaatcatacccattctttgggaagaaatccaagcttttctttttttttttagggggagacaaagtctcactctgtcacccacgctggagtgcagtggtgtggtcctggttcactgcaacctctgcctcctgggttcaagccattctcctgcctcagcttcctgagtagctgggattacaggtgcatgccaccattcccagctcattttgtatattcagtagagatggggtttcaccacgttagccaggctgatctcgaactcctgacctcaggtgatccgcctgcctcggcctcccaaagtgttgggattacaggcgtgagccacagcgcccggcccctaagctttgcttctatgaagactttccaaattatgtcaagcctcaacaatccctctcttctttcattatatgtaacacttaatgtcaatcactgattttgacaaaattatatcatttactgtgttgtaacttgaccattttatatgtctctatcttgtcctgccagtggaaatgtaaactccagaaacggaatatagctcacatatttgcattgctcacagtgtctacctcttaatttacaaataatactatactattagtaaacctgtaaaatttaatctaaattacattaacagaacacttggaagaataaagtaataatagcaacacacttcttcaggagcaagaaatgaccccagtgtcacttaggtcaatagtaagtgaatagctgtgggtttagcttaaaggcaaaagtaggacatggtggttaagagcggatgctttggagtctagcagacctgtgcctaaatcctagaacctaccatctaatagctatgtgtagttggatcttggaagtgggcaggtggtctaccatgaggcgagtcattcccgctccaacaaataaaaataaataaaagctatgtgatctgagcaatttacagataagagaggttaactaaatttagctcacaatcaaacacataataaacagtagaatcagggaatcaactttcacctcttcaactccaaatctcatgctttttgataccctgtaggctgataataaatttaaaatgactggcatcacatgccggcatacattagagatttcctaaataggacccatggatccactggaaatacatatgaatgtataatcaattctacttaaccagaactataaaattatgtgtgtatttgctaagtggcagtgaactaaatcattaaagtattaacatagcttcaaacttcaaaacaaactagaaagtactggtactgtctaatctcctctaaaacttttgaggtctacatctatcctaaacaaaacacaaaaatctaatcacaatatatctaggtagttacctagtgataccaggtaactacctaaaagtagacctaaaaattagaatccaggttttgaataatctctccatttcctctgtaagctattacacggaccatggccccttgaatgttgacgttctagagttgtatccctaggcatcttctcttctcaaatatactactcctcctaggtaactttactcatatcaaaggattcagcctactcaccaaaactacattcccaacaaatctctaaaatcccaactagaatttccaactacctattttacactgtcatttggatattcccatttgtattccagaatcagcatgcctaaaatttaactatcttcccatcacaactcgatccacttagagctctcactgttagcagcatgtcgcaggttccacccacctgggggtttttatggtccatagtctcctactaagtttccttgaaagaaaaaataaaacttcaagggcccctattaaagtaagtacttacaattttgttggtaagtaggccgcagtgtcatctttatttctgataatgtcattgcatttatcaagtgtctgaaaaactgtgaaagtatccccaatgctataaagggctgcgagatttttagctaataattttcgtgtaggtggtccaggtgaactacttattaatccagttaattgttcaacaagttttttctgtttttcctttacatcggtctgttacaaaaaaaatttttaaaagaacatcattaaaaattttttttgttaccttttaatcaaaataaaaaacacttaacacttaaggcactctaataattaaaaatctatattgtattaaacataaaccgtgagaattttcaagttaatgaaaagttctgtaagaaatgagccattctttcctacattaaatattctccttcatgctcctccaaagccaaaaggttagctccaataaagtgactctgattcaaaaagttatgagaccaacttactaagaaataaaccaacagccaaaggatgcaaaatattgggtgtatggacaactgatgtcttacaacccagataggtttcctatgtaaaagtgaagtcagtagttcataaagttacaggtcagcaaatgaaaccaaaagaaactgaagagccctagacaacaggaaaaaaaaatacccagctctacccataatcaatatctagaattcatttatttattcaaacaatatttattatgtacttaacgtatgccacatactagggtgcaacagtgaacaaaatagacaaacaagtccctgccctcattaagtttacattctagtgaggagggacagagtttaccaaacaaacaaatgaatagtatgggtggttactgttttacgtggattaattagaaaaggcctctctctgaaaagaagtgaaggggtgagccatgcagatacccaggggaagaacattccaggctgaaggaacaagtataaaggccttgaggttggagcattcttagcatccttaaagacaccaagaaggccagtttggctgcagtggagtaagagaaagtagtaagagatgaattcagaaggatagaagggaccacatcaggtaatctcttgcaccccactatagaactctgtatgtcactctcagtaagagaactttgtatgttactctgagtaagagtttgaagcagaggagggtcgtgatctaaatgtttttaacaggctcactctgacttctaagaatactctatatggtccataaatggaaagcatcatgaccaaataggaagcagatgcaataatccagatgagagataatagcggtaaccatagagatgataaataaactctggatttgtttgtggatgaaaccataggatttgctggtgaatacaacatgaaatttgagaaaaagagggaagtcaaaaatgactctatggttttcccttgagcaactagaaggatgaaatggtcatttcctgagatagagaacatgggggaaagggcaggtttgggaggagaaatcaagaatttggtttgggtatgttaactctgagatgccacttagataagaaagaggtggagtaaacattatcctgggaatcattattttatagatgatagtaaaaatcatacaattagatgatatcactgaaggaatatgtacagattaaaaaaaaaaaaatgccctgaactgaggaagagttaaaaaagaacaagaagtagtagttagtgaagtgggagaggaaccaaaacctaacagcgtcttgggaagccacgaacaggaagaaaacttcacacaaactgtgcaaagcaatgataacaatcttattgtttaatttgggtggagggtgtacagatattcatattatgcttcctgttttatacactcttgtatttatcaatttcagaacaaaattaaagacgttttaagtgtttcaaggtgaaaagatggagatggatcaaataagacagaatactgaccactgttctgggcaatctgtcatcagtaatggctggacaagtgctgtttcagtggagtggaagtaaatccccagttgtagaggatttaagagaaaacagaaacgtctagttgacaattacaagtgaatccatgcattgttttttttttatacttcaagttctagggtacatgtgcacaatgtgcaggtttgctacatatgtatacatgtgccatgttggtgtgctgcacccattaactcgtcatttacattaggtcatgcattgactgtttctatagaaattccattaaaaccatactaaagggtagcaacaacaacaggaacaataacaacaaagcacaaatccaaagggtaaagaaaacaggagaaagaatcaacacagtatttggaaaccaactgttcccaacagggaaagctgcaaaatgacctaacttacaacacaggaccccctaagagatcacggtttttttaagccctaggtgcttttggaggtgggagtgaagttgtatgtaccttgagatagagggaatggttgagagtctaataagcagaaagaatcctcttcttcattatggaagcagactgaaagtttattctctgggaagagtgaaatattgtatgtccagactagaagagtccaggcacagttgcggtctgggaaaactgcactgaaaatggggagatgcagtgaaagttcacatactgaactttaaagtccccagtcttctcccacaactccaagaatgtagccagctagctatatactcttcagacacgacagtagaaaagtatcttctggggaatgactagcctacagaaacctaaaatactaaggtcagggaccaaactagcctacagtgaagtccagtttaaaagactggccctgctgagaaaagtttttactactcacttttaaatttgatcaggcagccaaagatcatcagacatttgagggaagtatctacttttttttttttttttttttttttttttttttttcagatggagtttcactcttgtcccccgggctggagtgcattagtgcgatctcggctccttgcaacctctgcctttccggctcaagcgattctcctgcctcagcctccccagtagctgggattacaggcgcccacgaccacgcctggctaattttcgtacttttagcagtgtttagtagaaacggggtttcaccatgttggccaggctagtctggaactcctgacctcaggtgatccacccacctcagcttcccaacgtgctgggattacaggcgtgaaccaccatgccgggccatatctacttttaaagacagaatataaaatacacagacaataaaaagtaagttgaatcaatgttgggaactggctccaaaactggccataaataaaatctctgcagcactgtgacatgttcatgatggccataacgaaacccgaatgagggcaaggaacacctggcctgaaaaccgcttaaaggcgctcttaaaccacaaacaataccatgagcgatctgcgccttaagggcatgttcctgctgcacagaactagccagacccacccctttgtttcagcataccccttcgtttcccataagggatacttttagctaatcgaatatctgtagaaacaatgttaatggctggcttgctgttaatagacacttgagtaaatctctgttccggggtctcagctctgaagcctgtgagacccctgatttcccactttacacctctatatttctgtgtgtgtctttaattcctctagcgccgctaggttagggtctccccaaacgagctggtctcggcaaatcaaggctatgcaggaagaaaaaacagattaaaaaaaaaaaagagcctattattgactcctcaaagagataagtgaagacactgggattgttaggcagcatagagagatcacttgcaacgggtgacgatgataaatttaaagtgacaccagtcatatagccatgtttttctccagttacaatgagctgcccaggtacaaacataaagaagataggcaatgagctggatttaaacgaggtttgagttttgccactaaatttcccattcgtgtaatactctcaagttccataagtgacccataaaccttccaaaacataacatgtgttttcttaagaatcatgaccacataatctcttcacgttaatgcaactgggaaaaaagagcaataccataccttgttggcagcaaccaagactttatcaagaaatcgcaaccattcaaagatgaaaactggtctttttgcttcggtgatttgagccaaagcttcttcatttagcaataaactgtgggctaactccattacggaagtttgaaattcacaccttaaatttaacagagtaaaaaatacttgtaagtattttttaatgttaaaagtcaagcttaatggaatatactcactaagaaaagtaggactactcatttcatttggggaaaaactcaacttctttgaggcaaaacctgagaacatacttttaaatgacaaaaatacaaacaaaaacagaagaaaactacttggtaaggaagagtgactcatggagtgaaaagaaaattaaaagaaattattgccaaaaaaggcattattccagaagaaatatgtccagcaacacatatgtcatttacccgttctataaatgaaaaaactgaagcactaagatcaaacaccccagccgggcttgacaaccatcctcctctttttctcgtccagggttcggtacatagcacctttaccctcccgcgctgcacctggccagagggactgaggtcaaaacacccagcacagacatcccgaactgcaggtctccaagactcttcctacgcggatgggtggggcggccaggcccggcggccgaagcgtcagtgacaacaccaggcggtccggaatgcacccgagaagcctcgcgcgctcggggtctggcttcacctggctactccaagaaccgcaagcggcggacccggggaaacaccaagaggccgccgcaagcctccgtggggttccgcaggctgtcaatagcacgaggcggcagctcggaactaagcacggagccagaaaagggaaaatgttcattacgaactcaaatgtcttccccacccgtctgaaaatgtacgtcggacaggagtccgtgcgtgtcaacatgcatgcttcggcgacctcacctcgtagtctggaagggaagatcagctgagctccgggggtagaagcagccaccaagagacccggatgccccacctcccgcactcctacctgcaggaaacaagggaagagcgcttgcgcggagggctggtcttgcgcaagcgcagtcaccacgtcctcctatccccacccgccgcgaatttccaatagagtctgcactaggaaactggtgggagccgaggtccggaagtccgacgctggtcggtgggcgcatgcgcagcgcgcgctctacggcgctgaaccggggcgagcagagagctgtcaggtaagagagctgtcaggtaagggtctggggacaaccggtagaatgataaaaggcagagtgcgctggccatgactaccgtatcacaccgtcagccacttttccatccgtgggtggttgcgtctgtgggacgcttgcagccaggaggaacgcgtgagggaagggatcagcggttcctgagcgtagtattgagagtgggacgtttcttgtcacatttatactgtaggtccatttctccacttgtatatgtaatgggactctcaatatgtctgtttcccgactacgccccctaaaaaaacaaaaacaaacctactcctacagtcttcccactctcaaaaaacgttaactccgttcttccatgtattcaggccaaaaacttagcgttatcttgacatcgttctttacgtactacctacaacatcagcaaatcctgtaagctctaccttcaagtgtaccccaaatgcgaccacttgcattgctatcactctggtacgagcctccatcatctctgccagggtatcgccttgtgaagtttatgcttatctttgatggaaatggataatgctaaagtatattttaccaatagaaagagagctttaaaagcaacctgtaaccccattcagatgtgcctggcactttaaagttaagtaggtctcttaaaaacaatgtaatcctatttgcaaggcactatgacccggattctttgtggttttgaaatagtcatttagccatactgaaccttaatttctccaacaggaaaaactcttcctaccttgtagagttgttagtggtggttaaatgtgataaaaatgtgtgatatactgggtaagtgttaaaccattatgtgtaaaaatgctgttattaccaatgaagaatctgaggtttagaggaagcgggtgaattaccataaatgctgtatataatagtgcacgtttttaacttataataaaaataggtaaactaaactgtaatgtttaaagatgcacacgtggatgacaaaactatcgagaaaatgaaggaaatgattgccataaaaaacagaatagtgactattcttagaaccaaaagagagttgcaactggataggggacaaagagggctcccaggtgcctgataaggttctacttcctgataacttttgctacataacaaattatccccaaatgtagcagcttaagataactgtaatcatttgttatctcacagtttctatgggtcaggaatttgttagcagcttagcttagtttagcatggactttcttaagaagttgcagtgaagatgccagcccaggctgagtcatttgaaggcctgactggagcaagagaatccatttccaaggtagctcactcctgtggctcatgagtttgtgctggcttttaataggaggactcagttccaatcgtgtgaccttctccatagagcttcttgagtatccttattatgtgaccactgacttccttcaagtgagtcatctaacttcaaagttagaatgacctaagagctgcagttatgaccaaaaaatcaactccatcatctccacaaaatcctgttggttacacaggttaatcctgttcactgtggaaggagactacactaaggatgtagaaaaccacacagcaagaatgactgggagtcattttggagggtaccacatggttacaagaatgtttgactcacagaaatgtattaagctgtacatttgttttatgtgttttctgtacgtatttaaaaagtgtttaaaaatgacttgttgacataggaaaaagttataaaattacaaatattaaagaccctttttatcctcattgttgctaaacaattattaagcatttgtgtttgggatgcagtggtaggtagggaggatataggggacttgtctttgtgtttaacacaagatatacattatctagttgagaagatatacattaaaaatataaaaaaccaggccaggtgtggtggctcacgcctgtaatcccagcactttgggagaccgagtgaggcaggtggatcacttgaggccaggagtttgagaccagcctggccaacatggcaaaaccctgtctctattaaaaacacaaaaattagctgggtgtggtggtggatgcctgtaatcccagctactcgggaggctgaggcatgagaattgcttgaactcggcaggtgtaggttgcagtcagctgagatcacaccactgcactccagcctgggtgatagaacgagattctgtctcaaaaaacaaaaaagaaaaccattaaaaattagtatagtaatccttttttcatccagtgtaattgtctagacacttggttgcagttgacagaaaccctacttcagcaagcttaagtaatgcagaaatgtattagtctatgtaatggggtagaatgctaagtcgcagcttcaaagaatccgcagccttggaaactaggctcattttctctatctggcttcattcttcagacaagatcccttcatggggccaagaagatggccatccacagcccagcttcacattctcccagttcagaaacacccataaaagaccttctttcccccacaacccatatattcatataatgtaaggaaaaagatggttatttctctggctgggtcatctcgtcccctggtgctggacatagagtactataattgaccatctttgtgcccaaggaaatatgggatactgacattgccaccctccactaaaaccacatgaagggcagagggttggattcccaaaggaaaagatggtaggcaggaaaaaacagtacatatgcaccacaacaagtgaatacacttttgtcttaagcaactgaactagcaacattgacattgcctgtgaacctgctagaaatgcagaacctcaggttccagccccagaatcagattctgcattttaagaagatctcagtgcaatttgtatacacaataaagtttgagaagtacttttgtagaaaattactttaaccctttaagggccaataattacatgattttaactattttggatagaaactgtccctcaaaatatttccacataagtgagttgttaactatatcaacttccaaatgagcagcttggacataaagtgctgtagagaaaggcctggagtggtcaggagaggtttctgaagggagggtagccttggcctacagggaagaaatgtttgtactctgttcagagggcagtgaggagccatggggcttgaataatgaatccttagggacagttgtgtcagattatgaaggacaacatctcatgctttgcaaaagtgactggtcccccactgcctacagggtcaggtttaatgaaggatttgaaacaggctagtaacgtgacctgacttgtatttaaaaacaaacaagcaaataaacaaaaaacctctggatggggtgcagagaatggactggaagaggagaccaactaagaagctgattaagaagctgttgtaatagttcaggtgagaaaaaaaaagtgcctgaactaaagcagtggtcacaactgtagagaaaacgtctgtgaggagttttatggaggaagacttgacagcttcataagaggtcaggaagaaggagataatgatgacatcaacatggaaacacaggggatgtagaaggctggggaaaggggaaagaaatgagttgtttagattgttgagtttgaaatgtccacagataaagatgtccaaagggcacttgaatatatagtagagctctagagacagctcatggctgcagatacagaaaggtttatttccattctgataaactaaaaaaaaaagtaattattactttatttgtagatactatagccatatgaagttgaacatggcagaagaagaggactatatgtctgattccttcattaatgtccagtaagtaaatgtgcacacccagtgcaatgatatgtataagatgtgtagattaagaaatgacattgattttattttattttattttatttttttgagacagggtctcattctgttagcaaggctggagtgcagtggcacaatcttagctcactgcagcctcaaactctccaggctcaggagatcctcccatcttggcctcccgagtagttgggactgcaggcctgcaccatcatgcccggctaactcttcttttttattatttggagagacaaggtctcactgtgttgccaaggctggtctccaactcctgggctcaggcgatcctccggctttggcctcccaaagtgctaggattacaggcatgaaccaccgtgcccagcctgacagtgattttaaatgtgcagtgggaaagtcagtcttcttgctttatggaaatacctcctatgtcaccatagaaagatactagaatctacttcctccttttaatgctaaccattttacttttgcccttgatcctttttattgccttcttccaaggaaatttactccttttcctttattacatcatattgtctcttctagctgctatacaactttgttctttattattgccaacatcctagaaacatagtaagtctaaacttactatatctgatttcttcaacttcgtgctttccttattttcctatgatctggcaccagccttcatcatttctactaaaacagccattcttagaggtcactgattatgttctaatatcataataacaaagatgatcatagaggtagtgccgaaatattaactgttgtcaggtgagtaagtgacagagttatgagaaaacttggccaggcgtggaagctcacgcctgtaatcccagcactttgagaggctgaggcgggcagatcacctggagtcaggagttcaagaccagcctggccaacatggcaaaaccccgtctctactaaaaatacaaaaaatagccgggcatggtcgtgggcgcctgtaatctcagttactcaggaggctgaggcaagagaatcggttgaacccaggaggcggaggttgcagtgagccaagattatgccattgcattacagcccgggcaacaagagcgaaactccgtctcaaaaaataaaaaaaaaaaaaaagaaaagaaaactttatggactcatctaaaataaacttttcccttattcagagaagatatcagaccaggattgccaatgctaaggcaaatccgagaagcccgtcgaaaagaagaaaagcaacaggaagccaatttgaaaaacaggcagaagagtttaaaagaagaagaacaagaaagacgtgacattgggttgaagaatgcactaggctgtgaaaacaaagggtttgccttgctccaaaagatgggctataaaagtggtcaggcacttggcaagagtggtaagtcacatgtggaaataaacaggtattccttaccacctaattgtgacttatggataaggaccaaagctgatgctttaatctttatctacacagaaattataacaacttaggctttttagtctattatgtattaacaagccttatggagagcttttcatcatcccacatccattttagataccacatgtgccatcaagagctgcttatcagcccagcttagctgaaggcactaacaacctagatggatgtggcttacaacagaagaagcaaagaatggtgataagtgatgggttgagaagtgcaatggctaaatacattgaaacaacactgaggatgatggcaagactttgccctgcttgctctgtacctgtggcagccatctgaatgaccgtccagttggagaggctcaattctcacctctctttttaggaagtgaaactgcttattaagctagagaggctatatatttatagtaacctctgtaaaccgtttttctttcctttatcgtaattgctttgctttcacttaaggctgtcaccgtcttgcaccaataatatcagtgttgttccttcttaaaactccaccttcaggtggcataggaggctgtgaatcagcctttttgatgagtaggtatttgaagacaaggtagataattgattatatatagaatatatatagatgttcagatttcaattttgaatatcattgaaacaggagggcatatgcatagagcattgtaaagttgcatacttatactgttctgtagtttgaggaaaattttctaaaatagtttgtattcattctctttaagggggtggtattgttgaaccaattcctctcaatatcaaaacaggtacgtaattattttggagcatatttgccaataataataacttacgcttaggtctaccacatatatttgctcaataaatacttttttttaaatgataatactgttacagttcagtaaaattttgttaaatttctaaacctcttcaaccagaaaagaaataagttttagtgagtataaaataaaatttaaaccacacgaatatgggaagaacaaatcattacaaccattgaatgtgcaatactgtttttgtccattgaaatgtcttaaaactgttttgctctgggaggccgatgcagaaggattgcttaaagccaagagttggccgggcgtggtggctcacacctgtaatcccagcactttgggtggccgaggcaggcagatcacctgaggttgggagttcaagaccagcctgaccaacatggagaaaccccatctctactaaaaatacagaattagccgggcatggtggtgcatgcctgtaatcccagctacttgggaggctgaggcaggagaatcgcttgaacccaggaggcagagattgcagtgagctaagattgcgccattgcactccagcctgggcaacaagagtgaaattccatctcaaggaaaaaaaaaaaaaagcagccaggaatttgagaccagcctgggcaacatagcaagacctcatctctgcaaaaaatttaaaaaattaaccgggtgtagtggcacgcacctgtagtccttgctattcaggaggctgaggcgggacgattcctggagcccacaagttcgaggttacagtgagccatgattgtgccactacataccagcctgtccctataaaaataaaataaaataaaagtgttctgagacagatttatctaccaaatgttttgcttaatacttggatgaattcaagagaaaaagatatattttattcatatttaaataaaactataacagctaatactgtttttctgatttgaaaaattgtttataatattactataagatgagattaacaatctttgtaaaaatcagattatgttttgggcttaaaaaaaaccctagtgttttctactattagtgtactcaaatgatttgtgagtgatagtactcaaatgagaattgcatttaatttgtacatagttaaatcgtcttgttttgaagcacaaagtcaggatgtttctcatcagaattttctgtttgaatagggaaaagtggcattggtcatgaggcatcattaaaacggaaagcagaggaaaaattggaaagctacagaaaaaagattcacatgaaaaaccaagctgaagaaaaagctgcagaacagtttcggtaaaactatttttgagctggttttggttctatttcctctttattgtggtatgttctctggtacttgggcatataaaatggttaaagataacgtagacctttagtttacaattttttctttcaattagaatgcgacttaaaaataagcaagatgaaatgaagctagaaggagatctcagaagaagccagcgagcctgtcaacaactggatgtccagaaagtaagccttttaccagctttcagtttagtaaagtgttttggcaccccctgtgatttcccgtttatttattatatatatatatattttatatatgtattatatatatttatatatgtattatatgtttatatatgtattacatatatttatatgtatcatatatatttatatattttttacatatgtcttatatattatatatattttatgtatttatatatataatatatatattatatatatatataaaactaagaactccaagcccggtttatctactcattaaagctttcatgtaatgtgcacttctgatctgtgacaattgatataaaaatggcttattatttactatagtaacctgagttgtctgggttactataaaacccagggttttatagtaactatagttttatagttttatactaactatagtaaaacaaaaagggttaaataaaattttacatttaattgttctctgcttatttgaatatcagttatgactattatgtgcagaaattctgttctttataatatttgattaacaagaatagcctattttcagttcctattcagtatctaatatatgtctaactattaaaatcagagtgggccaggcatgatggctcaatcctgtaatcctagcactttgggaggcaaaggcaggatgattatttcagcccaggagttcgagaccagcctggataacatttcaagactccatctctacaaaacatcttaaaattagctgcatgtggtggcacacacctgtagtcctatctactcaggaggctgaagtgggagaatcacttgagcccagaaggttgaggttgcattgagctatgttcatgccactgcactccagcctgggtgacagagtgagaccctgtctcaaaaataaaatcaaggtggaatgctatctagttcaaatttgaatagtttttaaaaaattctgtctctggctgggcatggtggctcatgtctgtaatctcagcactttgagaggacgaggctgcaggattgcttgagtccaggagtttgtgaccagcctggacaacatagcaagtccccagctctacaaaaaaaataaataagtaaataaattctgtctttgcttttatcttagtggttcaagtactctgaaaataaaatgacttcatttgaagtctcaaaaagctttgtaaaatttcccttatatatagattactggaagcaatctctcactttcctgttcttacatattactttactttgaatgtatttcatggcacttatgattttgtagcatatatgtattattttgtacccatagcctatctttcctgctagactgtcagaaggaacttaaagacaactgcacaattctaaagaattggactttgcatccccatagttcatggtacaatgttttcactttttttttgagatggagtctcactctgtcaccaggctagagtacagtggcgtgattttggctcactgcaacctccacctcctgggttcaagcaattctcctgcctcggcctcctgagtagctgggacgacaggcatgcactaccacgcccagctaatttttgtatttttagtagagatggggtttcaccatgttggtcaggatgatcttgatctcttgacctcgtgatccacccacctctccctcccaaagtgctgggattgcaggcgtgagccaccgtgcccggccagtgtttttactcttaaagccacactcagtgaatacgtattgaaagaatgaattcatgttgacatgaacatatttgtcatgctcttatgtttagtatgtttaattgagactacttctgcattttcagaatattcaggttcccagggaagcatggtactggttgaggcttgaagaggagactgaagaagatgaagaagaaaaagaacaggatgaagatgaatataagagtgaagatttaagcgtatgctttgcaccatttccttcatagggtgtctcagccttggcaacattagcactttgagttgtggtaatccgttgttgtggagagctgtcctgtgcattgcaagatgtttagcagcatctctggcccctgcccaccagataccag

SEQ ID NO: 1098 - DNA, 109069 bp, Homo sapiens
agaaacactgcatatcactccactatcctcccactgtgtgtaagttataaagattataacccttactgtgtacctgcccaaacacaattatggctacatcatggcaaaagaaatgcctttaaagtcttagctgcaggtagcttcaaatcaggtaatgcaatcaatgactctttcccaaacattccttcctgtgctaaagaacaaagctgggaaagtaatggattccactttagctgggaggtctgtcacggggaataagcttgtagccttcagctaggccattataataccttagactggagcccccacggccattttcagggcatccttactgatgtcctcatccatcatggtgtcaatcacagtttcgtagcctcatcacgttcccctatgatttgggccaataggggggatgggttatcccataccccaagtaaagtccatgctacccaagacattttatggtacctgagacatcttagcacctccttttcacctggcatggacatatcataattccagtggcaaatacactataacctttattcataatcacactgatcagtgcctaatttacactacccatacatatattttccttatgggaactgatatttccattacaccccaaaactcctcatttgtgacccaggtgcagaaacaggcttggtttgcctcatgtatcactaattataatacatctaatttaaatattactagtgtcatggtattaaggagacaatctgaggcattcctacccagtcaatttgacatgcgattggcaaagttcctctgcccttgccacctaagaatgtgccctgtcctaggccagacccaaaagatacataggcacacttacagcctttatagtctcagccacagtcatcctagcaactgctagtgtggctgtagcagctattactgaatcagtacaaataggtgcttttgtagataatttggccagaaatgtgtctaatgaacttctcttacagcagggtatagagcaaaagattcttgcacgtctgcaagcccttgaggcccttgaggctgccctggaatatatgggggagtaacaagatgcactggtattctaacagcaactaaactgcgactgggcgcataaacatatctgcgtcacttctctatcatagaatcaatcaatacatagttgggatgaagtgaaacaacacctctggggaacatttcatgacaatttaatagcagatgtaaagcaacttcaaactaaaattttagaatcccttcccactatagatctacacacccaacaaacagccatatggaagggtgtgcaagatcatcactcctggttagacccccgctcctggggttcactctttgactggaaaagaatattgctaattattctcatgattgtcttatgttatttgctaattctaggatgcaaagccggaatgaaagcgatgactgccttgcctgacagacgtgttgctgcacacatctgtacacttcagtcaacagaagagcgtgtgcacttattagatgagtgttggtatcaatggatacatgtacatatcttagttttccaaattcagggatgtaacttctgtttgccataactgattaggttctaatcctctagggttaacaccttttgtgttagaacctgtgaagtagaagtaactcagaagtgctcctcagagagtagacagctctttctctaaccgtttccagctcagtagaatttagaaaggcttctaggaggccaaccagtctttttgatccaacattgaattgtaaaaccggatatggaagccaaatttcacagtggatctaacaaagtagctaatgggtactatgcttctgagaacctgaacaggcatctgagagctgtaactagaagaaaagtaaagactccggactccagcaccaagcaggttttccttagcaatttacaacctgaagctccaaggaaaaactattttagcatacaccaaaactattcccatgtgccaacaggtaaggagacttgtacttatattctgttttattcttctctaactcgtttctgtgcactatttctatgttttctccttagttttaccttgcctgggtttgcccatttgttattcatatctatttatcaatcccaaaatactaaaaggatccaggcagggcagctttaattggtggctgcacagagtgctacttcctgtgaggcagcaattctaaccctagttggcatacacttcagattttctcaacagcagaagatgtaaccttcccaagaacccacttcaaccctcagttctctcacttctatgtccacgtgacactctgatacattttcccactatgaaaagaactgttctcttgatagcatgccatacctctcccttctctgcaactcactcaggacaatctcagtacctttattacctggtcacaagtgaggatgcttcacactcaaatctcattggctggagggaaagtcattaagcagaagtgataattcttgtcatcacagctttctccaaaccttctccatcggcattttactctcactcttagagcttagcttcaaccatcaaacagacagttgagtgttcaacagtccctttatgggacagatttttttagttgactgtgtattctaaccctgagcaatggggcccctggctaagagagagaagggaaagcagagagggaagtgttgcaatgctaccttttcagagaggaaatagagacaaatagtttttatgggtgtaatacacagcctccactgtcccacaataagagcaattgagcttaaataccaaaaagggcttttctatgtgagctgaaaacagaaagagagagcaaatgggaggatgggctggagtaatcttgtttgaagttctctcatcctaaggaagaaccttttcttcctctgtcatacacgagtgcttagggcttacataagccccatctgcacgctgctaggagcagatcatcctactcaagacaataaaaaaggaatcatcatgtaccttacatatttagagatacgtgcgtacacttttctcataaataaagcaacacacccctgcctgacctcctaggacctccatagttgaggtatagttatttggagtcagagattcttaaaccaatcctggttctgcttttttcacttcaccaaaccaaacttgaccagattctttaatggctccaaaatcacaaccctttgaactattttactcctgttttccattttcctttatacctctgtccaggtggtacagatttttcttaaaaatctatgtctgagtgtacagagcttcaagtaaagttcaagaagggaataggagatctatcaccttccttattacagaaatattgctgatattaatgcaggctaatgttatattaagtcccttgacaggtatatcaaactatttggtcttatccagttggtggtcaaccagatagttataagtgagatggagagacaggtcattctcttcccatagccctctcttccttaccctatttaccccaaaacgctgaggcaggaaataatgcatactcctttgtgcactgctcctccatttcccatttttaaatggagacatacttaaggcataatcttcagccctttgctcatctctctacactcattctcctgcagatctcagtcaccctcatggcatcaatcatgatgccacagaaaaacccattagtgtatagtctctggcttcatctcagtatatgtactgggcacatccgtctggatgttccgtcattacctcaaactctgtccttaatttttttgttagaaacatctcttctctacaaaccatgctttgtgttcagcatgctcatctggcatccagtttaagaaggatatcttctggccatgatttgatttttgtatgaaaaaaatctttgttgtagaaatcagcatactattttttttttattattattattttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccacccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacacggcaaccatccgatttctcaatcttttccccacctttcccccgtttctattctacaaaaccgccattgtcatcacggcccgttctcaatgagctgttgggtacacctcccagacggggtggtggcggggcagaggggctcctcacttcccagtaggcgcggccgggcagaggcgcccctcacttcccggatggggtggctggccgggcggggggctgacccccccacctccctcccggacggggcggctggcggggcagggggctgaccccccacctccctcccggacggggcggctggctgggcagaggggctcttcacttcccagtaggggcggccgggcagaggcgcccctcacttcccggatggggtggctggccgggcggggggctgacccccccacctccctcccggatggggcggctggccgggcgggggactgactcccccacctccctcccggatggggcggctggccgggcagaggggctcctcacttcccagtaggggcggccgggcagaggcgcccctcacctgccggacggggcggctggccgggcggggggctgacccccccacctccctcccggaggaggtgactgccgggcggagacgctcctcaattcccagacagggtggctgctgggcggaggggttcctcacttctcagacggggcggttgccaggcagagggtctcctcacttctcagacggggcggccgggcagagacgctcctcacatcccggacggggcggcagggcagaggtgctccccacatctcagacgatgggcggccaggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggcggccaggcggagacgctcttcacttcccagacggggtggcggccgggcagaggctgcagtctcggcactttgggaggccaaggcaggctgctgggaggtggaggttgtagcgagccgagatcacgccactgcactccagcctgggcaccattgagcactgagtgaacgagactctgtctgcaatcccggcacctcgggaggccgaggctggcggatcactctcggttaggagctggagaccagcccagccaatacagcgaatccccatctccaccaaaaaaatacgaaaaccagtcaggtgtggcggcgcgcgcctgcaatcgcaggcactcggcaagctgaggcaggagaatcaggcagggaggttgcagtgagccgtgatggcagcagtatcgtccagcttcggctcggcatcagagggagactgtggaaagagagggagagggagaccgtggggagagggagagggagagggagagggagaccgtggggagagggagagggagagacactattttttaaaatatggagagaagatattctggtggctgaaagtgtggtctggtgtcagatataaatgtgcaaatgccttcttgctgtcctgtcggtctcagtacattcaccttgtagctgctggaaatatcgaaggttccttttttgtttgtgtaaactctaatttctatcaaggtgtcatggacttttaaaattagtatttcattacaaatgtctcagcattggtcaatttttgccaggaccattattgatcaagcaaataaattcaacagccattaggaaaaaaaaagaaggccatcttcttttttcaataaatgtattatatagttaatagtttcatttatatagaatgcatagaaactgttcacagaatgtccagcattttgtatttttgcagtagggaacatttcttcactgaattccactttcacattagataatttaatagttttatggagaaagtaaaatgcccgcccccctcccccacccaaaattgaaaatttcagttgttggttttcatggacacaccttatcaggtaattcctttttattcctagttttctaggactttttatcatgaatgagcaaatgcctttttctgcatccatttacataattacataatttttctttgtattctgttaagatgtggaatcacattgattttttgcatgttaaacatgccttccattcctggcataaacttttatgatcatgttatatcatcctttttaatatattattgaattcaattttaaaaaatattttgttaaacattttcatggctatgtttgtgtgtctttagtttccttttcttttaatgtcattgtttgatgttagtatattggacttgtaaattattgggatgtgttttcttctgctcttttgttgaaagagtttgtattgagtttgtattgtttcttccttaaatgtataatagaattaatcatacagacattaaaagtattatgacagtattatgacagaatactatggattaatcaatgaagccatctgacctggaaaccatttggccttctctgtgagaaggatttttaaaattacaaacttaatttcttccattgacagagatttcttcttgatttagttttggtaatttgaatcgttcaagaaatgtttctatttcatgttgttaaaataaaaattttagagaagttgaatttaacagagtttatttagcaaagaacaattcatgaattggggagccctcagaacccagaaagattcagaaagctctgtccagcaacatgtgaaggcagtgtttatagataaaaacaggaagtgatactcaaaaccagccaatttattacagctcagtgtttgccttatatgggcatggcgtgatgaggcatttgccttatgggggacataatatgatcacttggcagcctgtgattggctgagactcagctatttattacaacactcttaagttaggctgtagtttgtttgcataacgcagttatgttaagttgggttagtttgctatgtaggaatttaagatatggagaaagctttacaccaaatttaatttaatttaacaatgtaaattgtcaaatttattgtcatttttgtttattggcattttcatagcattctgtcataatacttttaatgtctgtatgatttgttgtgacgtacccacttccatttctgatattggggatttgagtcttatctctttttcttgatccatctacctagagattcatgaatgtattgagccttattgaaaaccagcaattgactttgtttattttctttattgtttgtccattttattgcatttatttctgatcttattaatcttgggattcatttgactttttttttctagcttcttaagatgggaacatagatggttgattttagagtttccctcctttccaattatgtaaagttataaattattctctaattagtgtatcatactaattttgatagtgtgctttcatattcactcagttcaaaatattttctaattttccttctgactctttttaaatccaggtgctgtttagcagtatactttttaatttctaggtatttgggactttcaaggtatttttctgttattggtttctaatttaatgctattgtggtccgagaatgtattctgtatgatttcaatagagacatttatttatttagacatttatttatatgtgtttatgacccagtgtatagtctgtcctgtggaatattcttgagcatttgaaaataatgtgtattctgccactattgggtggaatattctacagatcttgattagatcacgttggttcattgataatgttatttaaatctatcatgtcctcatgaagttttttcctaaatattttattgtttactgagtgctagaatactaaaatataattgtgaatttgtctatttctgatttatttttatcatttttggtataatgtgatttaagacatattttctaagaacaaacacatttaggattgttatatgttgataataaaatgatccttttatcattatgaactatccttctttctccttggtaatatttctgagtcttatatttctgatattaacacagccaccaatacttccatggttggcattattttcgttttttttttttttactttaagttctgggatacatgtgcagaatgtgcaggtttgttacatagttatacatgtgccatgtggtttgctgcatctatcaacccatcatctaggttttaagccatgcatacattcggtatgtgtcctaatgctctccctccccttgctccccatgccctgacagaccctggtgtgaggtgttcccctccctgtgtccatgtgttctaattgttgaactcccacttacgagtgagaacgtgtggtgtttggttttctgttcctgtgttagtttgctgtgaaggatggcttccagcttcatccatgtccccacaaacaacatgaactcatttttttatggctgcatagcattccacggtatacatgtattttcccattcttttactttttacctgtctttgccttcatatttaaagagggcattatgtagagagcatgaagttggcctgtagatttttttgtgcattctgacaatctttcccttttcattagaatatttaggccatgtgcatttaattcaattattagtatggttgttttaaactctaccatcttacagtttgttttctttttgtcttaccagactttcccttttttatttctttattttgaattaattatgcttagtgttctattttatcttctccattggcctcttggctatacctctttttttttcaatagttatcaggagcttaaaatattcatcttaatacattctaccttcaaataataacacaccacttaacatgtataagaaacttacaacattatacttccatttctcccttctattctttgtgccattgtcatcatattttacttctgggtatgttataaacccccaaataatttttactttaaacaattccttttttaacttaaaaaaaactagagaacatgtttttatatttatctgaatttttaccatttcatgcttttttcatcgtaatatctaatgaacactcataaagaaacaaaatccttgctcaaataagatatttttcttcataatcatcactattctcaaacctttgaaagctctggtaatcatgatttaagttctcccacatggagtgactatggctggtaaaaattgcaatgaattagggcattttaaaaattttatttcttggctcttagtttatcatgtagaaaaatcctccatgaaatattgctataattacaatacagccttgggaaggaagctcaggggctgtgaatggaatcctaatctgcctgaaatcttgatccagacagaccaaatctcttccctcagagacttcaaacactgcagtcttcaaactacatccaagaaaatcttcatccaagtaaaatttcccccaaatatcctttctctaccccaccctatcctgtagttagggaaaaacccaggactgaatcaatatcctcagacctttccgttcaagtgggatcagaacctttagtaaccacatcggcaacagaggttgaaaccacaccttcaagaaatagtattcacatgtgacctggtcctagacttccagtaagaatgactcagagtctccccgctctgaaatactgaagtatttattggtcttagggtattctcgggaaggtgacagtgaggggttcttcaaaggagaacagaggataaaaggctcaatgaaaggataatctccatattagtgctaccaaagtgtcattaatttctatttgttggaaactttactaaggaatgactgctttgaggtaatggataaggacagagcttgaagggtcagcaattcagtcagccactggagtagttttcacatgaagtgagaagaaaagctgagatggagtttgtagggcagctggagttcagatctctcctaagtcctcttctgttcagatattttgtcacctgcagcaacacacacagttattgtcattcctgggttcagtactgtaagcccggacccatcttccccactccctttgcacccgagcttcccatttctctgccctgttcaggtcccagggagaaggtggtcatccctgcacatgccctggtcctccaggtgaagagcacataggagccaaggagttcacgaaagtcattgaatttcaccctcaaaccccagctgactgtgaggccatcccacatgcttcatgtctccaaaatatacagacaaggggaagggccacattactgagggcagagaagaagcttaaccctggaatgagaattggaagggacaaatatccaaaccatatcaatgacggcaatgaacgaaggatacttgctcacattgtgtatactgctctttgaaaggatttcaaaaaccaaggtaaattttctaaaatgacctctgttgaacatctgacagcagtacttcctccttcctgaattctttaattccttggctcatgtgacagcatattctcctaattcttctgcttctctgcttctccatttttgttaaatactcctctttggatgttttgttaatcatgtatctttgcattaattttgccttttcaagatatttcattaaaatatgatttattactgagttcttttggtatcccccaaattttgcacctaagccaggtgcatcccctacatcaccctagtcccagccctcttttccattcttcctcttaacatctgacattctacattcacttcactctgttacaaatcattatagatataattataaatgtgtgtgaactaagaaaaataaacaagaatttgtcctactggatactaacacacactacaatgtcatagtaatcaaaatactaggacactggcacaagaagagacaaacagaacagtggaacaagatggaactcagacacaggcccacctataatgggagctttcagtatagcaaaggagacactactaacctatggggaaaaggtgaactatttagtagttgtgggaacacactggcccattatataaagaaaaataaaacatgatccccatcaaacacaaagatgaatcccagatgaattaaagtagtaaatgtgaaatttaaaactgtaggagatgttttaagagtatctttgatatctcagtatagggaagacttcttttaaaaaagacacacaaacaaaaatacagttgatggacttcattacaaaatattaaggatttctcttcaataaaggaaaccaaggagacagttgccagaagtcagattagaggaaaacatttgcaatgcctaaaactgacaagggactactagcaggactatataaggatcacctgcaaatcaataagaaaatgatggaagcacatagtacaaaaatggacaatgaatgtgaacaggcaatttatagaaaaggaacccccaagtggctaatcagtcctaattatagccccaattattagtaattaaagaaatgcaaaataaaacagcatatttctttatgcacatgaaattggcaaaagttagaaaactggataatgtccagtgttgaagtccatttaggagttgcaggacaattagagtactgacaaaggaagttcagatgagtacagccattctgatgagaagatgagcagtgtttagtcaaattaaggagctgcatctccagcaaccctgcaacccctttctaggatacatacattccagggatgcaggtcaggcccacatgtatatgcagttccatgtgagatacaagcattgcttgcaatagtagagaaccaggaatgatccaggtatcccaggagcaatgtagatatgtggattaatatgatttggatatttgtcacttccaagtctcatgttgaaaattgatccccagtgttgcaggtggggcctggtgggaggtatttgaatcatggaggagaccctcatgaatggctttgtcccctctccgggtaatgagtgagttctcactctattagtgcacatgaaacctggttgttaaaaagaggctggcacctctttctatgtctctttctccctctatgaccatgtgatgcactggctccacttgccttccaccatgagtaaaagcttccagaatcccccaacagaagcagatgctagtgccatgtttcgcgtacagcctgcagatctgtgagccatttaaagctcttttcttcgtaaattaggtaacttcagatattcctttatagcaatgcaaaatggactaatgcatggacatataaagtaaaatactatggaagatttggaagaaacaaactggatgtacaaaattagatctataatttaatgccattttggttaattaaaaatacatgtacactggacactactacatattacagaggatctatgcaaataaaaggaaacatcaaattcattaaaatgtttacctatgaggtaggggtaagaggttagatatgggagtaaggactggagataaaagggaccaaataaatcaagggagagagagagagctcggaggcaccaatgatgatcatataatgaactgagaagttcttaaccttttgtacctgaggtccagcatgaataacaataataataatgaattagatgtggtcatctgcatggaagttcactgtctaatgctaagagaattcccaaaacatataaaaatataaagcatggtgagtgttatgataaatagaaacctgtaagatctctggaggggcattttttgtgtgaacattgccatggaatgagtccaagtagagacagtaagtagttacaggcacccaccacactgtgttgtaattatgtatagaaatatagatctgactccattatttggcaatggactctggagaatttgaacttggtcttttccttcacaaaatagggtgaataggacagtggataaacagtcttggatccagactttctggattggaagctagccctactacttcatagctgtgggaacttgatcaaagtgcttaaagtctctgtgtatgtaaaaagatgtaagtatctctcatgtgaaatagtgaaaataatagtacctacctcaaagactatgtgtgagaataaagtgagttaataaatgtaaatcctcagaatagcgcctgaccatattaactactcagttagttatcggtgttgttgttgttatgtggctgaatgcttttaacccattagaagatcaatgaacacttatcagattgaatttttcctcccttccttacattctacaaatcctagggcctcctctttacattcccacctttacagtatttcacagggtcccctgggcccgggggtcatggccagaacgcagagactttatgatgaggacggtgcccacgatgatgccgactaggcccagcaccaggcccagggcacagagcacagtctccgttgtctcaggcatctggattggctcttgggcctctgggggaagaatgaagagatagggtcaggaggtgcagtgagggtggtgatggcctgggatggttgtgggaattgaaggttatggaccagttaattggatgttaggacgaggagaggactgagacccagccagtgcggaaagctggtgcagaggacaccaggtctttggaatagaggatgccaggagattatggagagaaaagcagttgcataccccagtgcttgaggagcggctggtccaagccccagtgctccaccctgcagtcatagaagtcctctgctgagggcacaaaggtcaggtaatggaacttgtggaagctgtaatctgttctgggcaggaagaggctctcagcgacaccctcagtgaccagctccccgttgcacagccacgtgacgttgagcactggtgggaagaacttgtcaatgtggcagatgagggtgttgggctggcccagctccacaggctccttgggaaacacggtcacctcagggggatctggaaggagacagcaccaggttaggcccctcttctgggatgaatcacaaaggctccacctcttaggggagggtggtcctctacctcagccttagattttatggcagctctgaatcacagagaggggtatcacaccactgaccagcctcactctgctcacctttctctctcctgagaagagaggatgcaagcccttgctgtagtgggatcagcccatggccactaggggaagaggatcacacagcagggggcacttaggcttcctagtctgagggtggcagagaggccctctcatcccttccagttgggctacagaggaagaggcaaagatagggcgtaccgttggtggcctgagtgtggttggaacgctggatcaaggtattcaagttgttgttcaatatagcaatgttagccagcccgccctgagcctcaaaggaaaaggcttggccaaactcctccagatgccagacggtctccttcttgtccagatccacatagaacatctcatcttcatcaaattcaaacataaactcccctgttggtctatgcgtctgtacaaacgcggcataagttgacacatggtccgctgcataaagacagtagagaaaaacacgacaaaatgtcagtttgaatatgcaagtggtcaaagctagagaatgaataaagacttatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaactgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacgcgtataagtcacagaaggaaacacaagtgacaggacaacagcaggttcagaaggataagtgcagatacgtaggtatacacaagatgcgaccaaacagcacatcagggaaggcttcctggggaacagatggcttcaatgtaggcattcagaaaacagggcaaaagccacttctctcagggaagacagcctgaccgggagaagatactgagtttactgtggggctattgcacttagaagacctgaaagtcatctaaggagaaataatacatagatatttgtggattatgggtggtctcaggagaggaatttaggccatagaactgagagtcattagtggcaggtgcaggttaaataagattttccaggaagagtgccaaaaatcagaattgccgagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggacaggatgcagactgaaggcaaggttgttttttatcagttggtttgcacttatgtttttaaggtaaatgacatgtttaaatgttaagagactgggcagggaagccctgaagagacagctgagctcattaggaatttctaccaagaatactaaaaagtatttgcatctatgaagagaagcctattgtggtgtttattataacataacattagaaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgaatctctcagaacccgaatcacaaggctatcaagaccatgcaaccctgctgtcttgagagaggaaagcttgtgaccacccacaaagacccaggaagagccctagggtcctagaagagagggaggatacagaaacactctttgcacttcgtctcctaatgcagagtccatagctcggagttcctgtaaagcagccacaaaagatagaggctggggatcccagagagataggagggccctgatagtaggtcactgtgtgcaggaatctggggaaggcagtgtatgaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagattcctgtgagatgtaaatggggaaagaaactatgcaggagtctcataaattctggctgttattgctgttattattatgagggccagagggaacatagactatgaggaccagatagatcaatgagcccctaaaatctgtgatccctgaagcagcaattgatgtgaaccaccccatcactcaccccgacgctcctgcgtcctcctgagcactcacccttgatggccccagctcctcggagactcagcaggaaagccaaggagagggctctcaagatcacagctctgatatggaacattctgtcttcagggcgcatgttgtggggtctataattgatgactgtgagcacaggaacagtgatgaggaactgaggccgagtggaggcagatgagactgaaactgtgggcctctagcactggaaatgggtggagaggaatcagcatggctgggattcacctatcagagaaatcatagagctgacattctctgttgctgggtaaagaggacgctggaaggtgctggggaagagatgggagaattttaggtaccagcgtggtcaagagagctccagttcacagttcattttcagagttagagaaagagatgtaaaaagataagttacaccttcttctgacggcaaatgttttccattatgttccttctcccgagccccacccccatcccagacagtcagatgatctttgatgttttttggtcactatattttaaatcatgttttatgttatgttgtcaatattttacaaaaatattctgctgataattaagaatgaatgtgctatctaataaaatatataattaatctttctttcaggtccacctccctgagatacctcctttttatttaatcatttctgcagaagtgttataatttctatttagaggttttaattaacttgaatgaagttgatctttaattgtttatctattcctggttacctttgttagtgaaatttctagataatttttatttttcagatttcttagtatttgatttttcctggtatttaaacagtgtaataacatttttatctttaaattactagtcttgttatttcattttcatataagaatacccaggacagcattacctgtggtaacaatgtgcgcccatattttgatcttgtttttaagaagggtttctctaatgtttttctgttacaggtaatgttaattttttattttatattctctttaccatatttaagaaatacttttctagtctcattttaaatatttcaattttgagctatttatttgatactcatagagaaggtcacaaaacatttactatttaatgtaatgatgaagtacatatattacgttaatattttatcttatttgtggtagccttaccttgcataaataataattactaacagattaggacatgagagattctgttattagtgctttgcatgcattacctcatttaaacctcatattaaacctgagggaggtattattaatgtctactgtaaaaataaattacctgagacatcgaggaagtatttgtctaattatctatggcaggtaaatgacaaggagaaaagtcccacccaggcagttactaaaaaaactgagtttttctccacaatcctctcctggccccttaatcctactagacaccttctactacataattattttcttctcttgcattttacatgctagccttctatttacattttaatattgatttaaagaaatgatgccaatttgattttttttgaaattagaattggtggtccaacaggatcacatttataagtgtctaaagtaagaagtaatgttctttgaaagtttgtaaaaatattcactctaaacaaaatagaatcagatgctttgaaggaggtggggtctttgatgattttttttcactttcttccttatttaccagtcaatttatattctctatggactttatttttccaaagcaatttcagacctattgatctcatttgatcttaagagctttgctataaggcaggttatatcatccccatattgaagacaaggaatcgaagtccaagagaggcagtgtcgttaaagctgcatatttacatggtagggtaggtggtgtgtccacgctcccagtgtaaggtccctagactgagccctcctgaccctgatgacagtcctgtggaagaacctggtaactcctgcacatcgcaggactcacagacctctgggagaaagtaaatatgaatgggtgctaatcttaaacacacccttggacaaaggcaagacagacagactcagacctcatttgagttctgagatgggtactctaatccctctaagtcatgccactgaatgaccttttacacactaagatagcactttttccacaacagaccatgtcctgtgggtgtgtgaggtgtggcagaattggggaaatgataatccctgtagatgggccagcagaatatttgagatcaccttcagagcaaagaaaacgcataatctccccaaacatcatgacttatctgactggttaaaatgagtatcactgtctttcctccgtcatcttaagtgcatcacaggctttatattttcagacctttcatactaactttctgcctagtgagcaatgactcatacaaagctcagtgtccattggttcttttctcagactctgtccaatcccagggtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccaggtaagagccgaactgccattcttggagggtctggctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtgtctttggggaaaatgggaccaagaggtcctggataaccttggacagacaaggtttgcagagagagaagttggcaagtgcaggctcctgggcgtgttcatgtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttttgtccttgcaatagtttgctgtgaatgatgatttccagcttcctccatgtccctacaaaggacatgaactcatccttttttatggctgcacagtattccatggtgtatatgtgtgcattttcttaatccagtctatcactgatggacagttgggttggttccaagtctttgctattgtgaatagtgccgcaataaacatatgtgtgcatgtgtctttatagcagcatgatttataatcctttgggtatatatccagtaatgggatggctgggtcaaatggtatttctagttctagatctttgaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacttttcctgcttacacccttcctcctagacctctccacacccctcctaggacacacctagaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcgcccccatcccataggcagagctgtcatgtgggatgagggacagtgttgggagccaccaaggaaacccagaggtgggggagcagagagcagaagggggcatgtgatgctgggcagtgaaagggaggacgggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaattgaacaggcaggggcggatggatggcagaggaggaggaatctggactcaaggagctggggggctctgggcctggaattttagggtctggggcccaaggcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgctaggggtgaggttaataaactggagaagttaatttgtggagcatgaaacagatgagcagaacaatcacagcaccttaatttccccagtgtgcccaagaacagagcaggcctgaagatactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgcctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaaaacatgctgcccagtggcttccagaagtttctggtccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccagggtgcacagctaagaaaatgagtagaaagttcatgtccacgttttgtgtgtaaataaaaccataaaaactgccaaaaaaaattacatcaatgcctctaaacccaaaggactctacccccacaggtccctggttgttgtggtgattttcattgtgtaaaatactttccacatcttttgacaccaagtctttctgcagccatgtttgaaaattaactttcaggctacagagtctttcttataccaaagttgaagaaagttttaagaaatatatttctacatctcctacatgcaaaacaacaggagcaagttgaggaattctcaagaaactggtcgagaagagagagcgcttagctatggaaaagagaaagaaggaagggagggcttcctggaggaggtggcatttgaaccaggactgacatcaggatggaaatgtcagtcagggagttaagtagggggagcagctccgccctccacgtccccagctcctcccgcccctgttttttctcccagtgaccccacgtgaaacgtctccgcctcctccagccaccagcagaagggactgccttcccctcagtgctcgcccctccctagtgatcactcagtgcccctgagctcattcttttcagtaaattctctctctgcgtggtgagaaaacaggcctggagaggctctgcgacccgcttaggaccacagaactcggtactaggaaaactcctattttaaaatccagccctgggtgggaagatttgggaagaatcgttaatattgagagagagagggagaaagaggattagatgagagtggcgcctccgctcatgtccgccccctccccgcagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgaggtgagtgagggctttgggccggcggtcccagggcagccccgcgggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggaggtagctgggtttgaggtgcttgaggggcagatgggtggtctgatgggcaggtagacagaagggtctgcagccggggaggagactgagatacatgagaccatccagggagaggggacccagggggaagagcaaaggaccggatcctgggaactggacagttgtgatttggccaagacagaaaagcctgtgaaagagaccaaaaaaacccaagtgcagtgtgaggagaggcccgcagagaagagtcttggaagctgaggggaggtgacctcagcagcacagtggacagcggtgccagtgacttgggaaggtcagaaaacagaagatggaaagtgggtttggaaaccagggagacctggggagagcaggttggccgcagcggcaggagctggaatgggagggggtgcatgaggctgagtgtggcgcatcctcctcggggctgagatggattttacttgtcttgggttccccacggctgtcacagggcagtgtctcagttcattcgtctttttccttcaggaagtctgggtgtaaagggatggagagaggtgaggtgtgtgcagtaagaggatttctcaaggatgggacaggaaggccttggagctttggcttcctcctgtgaacttgtggggtggggagcctggtgcaccaacctgagggacttgagggagtagtatcaggatgtgggattgagccctggaccttttttctagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtgacatgagcttaggaaagttgctgaggtaattggttgagagaggtgttcaaataaaaataacgcaattggcaaaaactgttactaagactttgtagaggcaccaatcagtgacatggcagcattttctttcacagtaatcaactgccagattgcagacagccctgatgccagcctaaggagtgtgggtttctcctccaggcccgcaggtccccaacctcactcctctgaagactcttctggagatcctctgtgatgcacagatctccagactcagtgcccccagactcagattccctgggtggggaggtctggggatctctgcttgtaatcagctccctagaggttcccatgtagccagataagtattgtcagaacactgaagatttttgaaaaatgaaaaagagaaggttggagatgtgtcttcagaagactactaagggtgctggctagaggagggaccagaggcagggagatgaggtaggaaactgctattatttgtcagggaaattgcaatcaaggcatgagttagaacagggaaaacacagaggcaagggagaggtggaagggggaggaaagaagtagtgacaattccagggtggatgtccacccaaatctagaagtaattgagcaaatgttttctgggcattagagaaggcaactagaacaaacaggaatccttgccttggtgaaatgtatttgaactgggtcagaaatgaggccattgggtatcaggccttaactccagcgcaccctggaggtcactgatgtggctccaggctgacctgctcctgtcaaagaatattgagcaagatgcctctcgtggaatgttctgggaccttaaaacagatacccaagtattccccctgatttcatggttcccagaagctctatggggaagaaattgtaggtaattcacaactgagatttagacataagttgaatagtgtaatggacattgagttaaccgaggtaatgaagtagtgagacacaggtgcccctgaaataaactcacattgagggaagaggctgacaatgtggatcagtctgaaaacaaggcaaaaatacaatagggagtaagggttgtgtgtcagttcaagactgtacttttacctggcccagcgccatgttagggtatttgtgttctccaggaagtagaaaggaaagaactgagtgattagggacctagaagactaatttgagacattcctcttgatgagctgttctctagggtagtcctctgaaagagctgttctctagtggatctccctgaatgaactgttctctaggagcacttgacccttttctgtgtttgttttttgttttgtgtttgtgtttgtttttgagacaggttctcactttgtctcccaggctggagtgctgtggcaccatcatggctcactgcagcctcaacctcctgggctcaagtgatcctcctgcctcagcctcccatgtagctagaactacagatacacgtaccaccatgtctggctaatttatttttctttttagagatgggttctcactatgttgcccaggccggtctcaaaaccctgggctcaagtgatcctcatgcctcaacctcccaaagtgctaagattataggcatgaccaccatgcctggccttttctgctttctgaggaggaaaaaggtactggtggcagagatccaaaagaaaagttgccagtggcagtgtggaaattcacctgagaacaacaggacaagctggggcacaaatgcaaagatgcagagggaggcaacacctggtcatctgtgagaccttcatgggacctgaagacgcagcacagaggaggaacttgaaaaaggacgggatttctactactcaagcatgtaggagctcaggatattctgtaaatatgaagattttgagtttttgtaggtgaggtaaaaaaatacataggttttttacagaataagacatgtaaagctctcttcattttctttgtattttcatgaagttattagattcacaggccaccataatgccattgtctgtatatcttaatttcaagatattatttgagtaaattttgcttcctttgtatcaagatagaactttgaaaaggtaggtaatttcacagttgatcaaatattctttgcccaaattacttttggttaaaatttctcctaaatgtgctacagagtgcaaactctgtctccctgccattccgctatatacttactaactattattttattcaagatcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaggaaagaaggacaatctcaaattctatttcattatttttcttccacgctcctagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggagtgagtctctgatgaccctctagaccccacctctgaagagcaggggactctctggctctggggtccactcatcttatcttctgcatctataccctggggccatgtccaaaccccatctttcttctataccagctcctgagcatagtttgaagccagggaaatggagacttcctgaccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtttgacagaaaagaaatgtcagaaagctctagaggccactgatatcagataatcggggaacaaacatgacctatagcgagagagggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagagacaggtcccagaggagacaagagctgagagaccatccaaactgggaccaccttgtcactagacttcaaattttcaatattgatagagtgttttctaagagtcaggccctttgctgagtgctatgtgcagcaggatcaaaggcagccaggaggtagaggagtcttgaggtacatcagtcattggagttgaagagcagagattcaaaggaaagttggaactggagctttaaaggagatgtgaagtgggtgactcaacctctgactcagaaaaattgatacctgcagaagaaaaaacccggcgggcttaggactcccagctgagtgttgtatcctccatccctttccacctggtcccttcattttctacccctcacagttccctaacgagaaggtggtccacccaacagacaacactgcctcagatggttatcaaggggtaccctaagaagaaatcatctcaccctctctttgtccccatttgtcaagtagcagtgaggccgagccaggggatggtgaaagtggaaggaggtgggagttgggcatcgggtgtgaagatgctcttgaaaggggttttaataaccacttgctaccaggccagtgaacacttaccatagttgatgccttttgagcatgttgcattgtaaactgtccctgaaattactgtgcacttggcttatgggatgaaacatcctcctagttcttttgtctctcagcttctctgaagtctcattgagcaccttctcttcaatttcttttacacagtaagaataggatcagctgtgctaaactaacaaatacccagatatccaggtttggctcatgttacacgtccaaagtaagtcatgcaggaagctctgctcatcatcgtactcaggaagtcaggctgacagtctttctcctgcacatctgctcccagaacctccccagcagaatgaagggaacctaagaatttattcactggcttttaatgatccctcctagaaagaacacacttctcgcatttcattttccaatgtaaatcatatggctgcaactaacttcaaataagtgggaatacttgaaggtggaaaacatttaagaagtacacactaaataaataataaaatacttctacaagagatatttatggaggacctactgtgtaccaggagcaatgctaggcattatggatatcagcagcctttggctcctgaaaagcttacacactacctcctggcctaaggaggggcacagggatgctggcaacagtctatttcttcacccgggtactagttacatgggtgcttgcggtgataaccattcaacgtacattctattggtttgtgtgtttcttccaaatgtcccctagttcacaatagaaagggcttaaatagagaagtaaaggagaatttgggaatttgaagcaaaagcaagaagccactgaatcaagcacaaatattgagctttgataaagattggaataagaaacataataaatgagacaagaaataggacttttgcaactgaagtgtaattaataaacaaaaagccaaactgagaaactgtcccaaggacaatatgatcgagtaaacaatagaaaatgtaaaggacaagtgaagagaaatgaaggatagaaacagacatctgacatcttaataattagacgtctagaaagtcagggaaatagtggaggaagaggaaataactgaaaacataatagatgtttagtctttatagaaagatgaaataagttcattcaaaatgctgcatagaatgtcagactgttaaacaattttgttagagtaaaatgactgtaaacaaatgagctaattatgtgaattaagaggatggaaaagcagaaaaacagcaaaaagaaaatacatgtaaataataaggacaaaagctgaattcaatgaaatataaaaatagagaagataaaatcaaattttgaggcaatgaaaactttaatgagacctctggcaagactcctaaggaaaatacaggagattcagaacgaaaagggtaaatgacatttatacacattttaaaatgcaaaatcttacgaccaactctatacatataaatttgaaaatttagataaaacggatacgtttctagaaagatataaaggtcaaaactacaggaagaaatagaaaactaaaatagagtagagaatatcaaagaaattgtcatgggaagcaaagaatcgccttccaaagggccctgtcctgatcttattgcagatgagggtgtcctcccacatttccaggagcagatcatgcctcttacacgtgtgattctagaacatagaatggaacagaatttttgagatcattttatgaggttggttcatttatatttccagagccagctaagaatagtacaggagaacaggattgtggactaattttagccatgtcactgaatccaacagtacattataaaaacaatacgttttgaccaattttagatttattctaggaatgcaatgattcttcagtgtcagaaaatatataatgtggttaacacattagtggactccgcaaaattcatattaatttaaactgaattcagctcaagacatagacagaatttaatcaatttcatgacatgttaaaggtagtgaaccaaaaatctatagcatatatatttcaaagaaatgaggtggattgcctttgagattgtgcaaaagataggatgtccttcgttgctggaaatgtttaacatagcattggaagttctgaacatcactctgcgggcagaagaaaattaaggctgtgtaaaatgtaggaagacagatagtgactgcagatgaaataatctaaatactggacaagactgcagccactgcaggcccaaagcctgggtttaaatccaagctttgcactttgaagctgtgtggtcttcacctctcccggtgtctgattcctgctctgtaacatgaaataaataagaaccaacctccagatgtaaataagtgaacacatgagaagcacttagaatagtgcctagaacatagtaagcaactcaatgaatgtcatttctcattacatttgttaatgtttttatccagcccaatggcagtaaaacatcaatgctcaaagagcccctggtgaagtgtttctctttcccactcttcacccctaacttgttacctcgtcttttccactctgtccctaatacacctataggatgactcataggagcccctggacccggggatgctgtcagatcgcttggtctttgagacaatggtgccattaaggacccccgccaggcccaccagcaggccgagggcacagaccagcatctccatggtctcaggcacctggattagttcatggacctctggggcaccaagggaagacagagttataaggtacagagagcaggggctggccttggatgtgggaggtgttgggtattcgaaaccatgagatggtgaaatttggataaagtgaccataaaacatgggattgaggaaggcaggtgctgaggggcgatgggcccaggaaataaaggtggtgccaaggccgtgagggcagagggagggcgctccataccccagtgcctgaggagaggctggtgcaggccccagtgctccccctggaggtcacaggtgtcctcggccatgggaacgagggtcagatagtggaacctgtgtaatctgagtttcttgctgggcaggaagatggtctctgcaataccctcaatgactggctccccattgcgcagccacgtgatgttcagcactggtgggaagaacttgtcaacatggcagacgagggtgttgggctggcccagatccacaggctccttgggaaagacgcttacctcggtgggggctccaaaaggggatagaacccaaggagcctactgccattggctgattcttaaaggttccaccaccccaagtcctatattcaccagattaggggccacctctcccaggcccatcctcctgctcccctagggctcctggacagggtcacagcttctcgtgctcctgacctggccccctcagcccagcctttctcttgagtaagaagaaaatgcctcctcctctgctgtcctaagaacccagctgtgtggacccaagatttctcgctctcagggaaggggctcattcatgagtgggcatcatggcctctagttctatgtgtggcagagaggccctcccatccctccagctggactctagaggaacaggcagctataggcagtgccatttgtggcccaagtctgtttggaccattgatccgggtgttcaagtgcttccttgccatgacgatgccagcaatacccctctgagaggaacaggcagctataggcagtgccatttgtggcccaagtctgtttggaccattgatccgggtgttcaagtgcttccttgccatgacgatgccagcaatacccctctgagcaccaaagtcaaaggtgtgaataaactctggtagaggccagaccatctccttctcatccaggttcacgtagaactgctcctcctcatcaaattcaaacatatactccccagagggtctgtgcgtctgcacaaactccgcatatgttgacacatggtctgctgcatgaaggagaagatggagaatgggtgaatacgtaggatgctacacagaatgcaggaagcaaacaggtaacaggaaggttattgggaacatgaaggaataacacagaaaatgagaaatgcaaatgaaagaaaagaaaaggagtgagaagaaacaaagacagaaatgacccatggacgatataggttgtttcccttgtccctgaagacttaacatccgtctatgataatggtaatgctgaatacagtaagataatatttattgggcacttactatgtgctaaacttactcattgaatcttcacacccccatgtagaagaacttattttccatagtagggaactgaccccagaggtaaagtaacttgtccaagtcacacaactcctggtagaaacaatattgagtagtcctcctacctcattcctgtaggatctcagaaaccctacaggacaatacattaaaaattactgatatagccataaagcaaggcagggaagtggaaggatggaataaatatttcagagtggaacaaaatcgtgaaggacatgaaaatacctccagagtcttagtgacatttatagacttcaagttacattcttacttttagaagaaaaatgataccttctataattttatccacaacacttacattttaggcagagtaaatttaaaagtattatcattcacataacattcacaaaattgtcttgtggagtgtagttttcaagtgtagtttcacctggaaatacaagttgttggcatttgaaagacctatgggatagtatcttagctttacctgatacataagaagcagcaactggttgataacaaaaagtgaattattattacagtgaattacagagagtttagggttcggcctggaagaggaagtgaagccaaatgacactgcatggttggtggtccctaagtgaggatttcccctcccagcccagcatggggagaaccagtcctctacttagatgcatagtgtgacagcaggttcagtgccgcacacggatggtgagggtcccccactgagtttagggtctagaggattactcacctacagaaatgaatcccaaaggaaaaagaaaaatacatggtgtatagactgggctacacagatgtaattggttcagcttaggttactttgtatttattatatttacaaaatctgaaaactaaaggttggcacattttgaagcaaattccacacttcaaatgttaattttcattcagttaataaatgctttttgtgaactttcactctctaggtaataaggatgaaactctaaagatgggaactttgtccttaatctacttgaaattcaagaataaaacagacaaagaaaagatgattgctacatgtgtggtttgatcaccactgagtatcacaaggtatacacaagagctactcaggagcaaaattaaaatacgatttaggaaaggttcctagggacagtgttcacctgcagatagcaaaacagagaaaggggaaatggcatttccagcaggagaagcaggctcaggagcagagaggcatgaagttgcaaggagaactgcagttcttcagtgtgactgaagccaggggagatgtgggccaggcagcactgtaacctgccttgtgtgctgatggcaagtgtttgcattttatcccacaggacataggaagttgtgaagtatcttaagcaggagagtaacacggtcagatttgtgtttggatggggcacctgtaggaaggatgggctggaggaggcgggactcaaggcaagaccagtagcacttttaagccctctggtgggaagtaatgaaggcgtaggccagggcaggaacatggggtgaggaggacagcagatggatttgatggcagtaatgacatgagaggccacaggaatcactaaatcacatgccagaagtagggatatgaagaagtcgagaataaccacgcaacgtggagaattgtggcatccgtgcctgcaaaggtgataattaagtgattgagagaaggtaaaattttctgtttgagacatactgaatttaaacttctaggggaaaacatacagttgatttgaaggcagtgaaataaatggatgagtgtcatgctacattaggttagtgacataaactggaaggaggctcatggtgggtgaagttctaattttgggtcaggtcactcaagaaaagtacacaaagtcaggatagcagggatctgagtgtgtgctcctgcatccagacaaacacagacatgaagaaagaggctgaaaagcagaggactagaaattggtaggaaaacagagaggaagtgggttcataaaagacaagagacaggagaaaacttccaggaaagaggagagggggcatctcaaacacactaatgacacacataagacagaaacagaacagtgaccactggcttgagttgtataaaagtcattagttgccaccctgagaggagcatcagagatgagggaaagaaaaagagagagtacattgggttgaggactgaatgaaatgggagaaaatcgataataggctgggcacagtggcccatacctgtaatctcagtgatttgagaggccgagacaggaggatcacttgaggccaggagtttgaaagcagcctaggaaacatagtgagagtccatctctaagaaaacaattttggattccctgccttccatgagcaacacagcaaacataagctctgcagatgtgctcagacttgagcctgactcactgaagagagtgtggtgctgccaggcctcagacaccagattataatcaacctcttcccaggccctgcacaggagaggcccactctgtggggcatacagtgcccaggggtggtacaggccctgcagagaccacagactgttcacctgacaagaaatatcttgaggaactcacttcacagatccctcaagaaaggaaccactgcaggagaatacccagaaaatcgaaagaattcacagatccttttaaagaagggaggggccactgcaaactccaccagacaagtgaaaaactgtgcgttcccaaagcgtgagaggggaaaaacctgcctccggacccatgtccccactggggaactcgaaaatccagattacaggaaaaggatttaactttacctagacctgaaacagatttagcatgaaatacaaaagtacgccgggcgctgccgctcacacctgtaatcccggcactttgggaggccgaggcgggcggattacaaggtcaggagattgagaccatcctggctaacacgatgaaaccccgtctctactaaaaatacaaaacaattagccaggcgtggtggcgggcgcctgtagtgccagctactaggaaggctgaggcaggagaatggcataaacccggaaggcggagcctgcagtgaaccgagatcgcgccactgcactccagcctgggtgacagagtgagactccgtcgcaacaaaaagaaaaaaaaaatatatatatatggtagatgcagcagtgagaagagccttgtaggcacgcccagtctttagctcaagcccagggaagccacccctgactatatctcacaagggccctgggggaaggcagacggcaaaatttggaaggggtcacagtgtgaaaggagcgtccaactgaaatttgttataattctgactgggcacaaatcctctggagcagaatctgggggcgaacggaactgctggagaaagagcagaagttactgccaacattgtgggcagacagggaggcacatggcctgaaagctgtgcttgctttctcagcaggaaacttatagcctggagtgaggtctgagtccatcctgaaggctgcagggagataaattcaatgctgttagtgtggcacagcaggagcaaaacctgcctcgccaactgcatgggagctgggtgaagcctattgctaccaggtttcccctacttctctggtgacagaggcagccataatgccctctggaacataattccattggctggagaaaaaccctccgccccatccctcacagtggctgccgcaagccccccgcccgaggagagtctgagctcagacctgcctaaccctgtccacacctgagggcatttctctacccacctggtagccaatcacaaaagacgtaaactcttgggagctttatgacaccactcattgcctgagaaactgaatatttatcttggccaacttagggcaagcttatatccaccttctactattgtagctggtgccctcttgaaagcaccacatcctggctggaggccaaccaactcaggacattacaacaattcacgacagaataactgctctaagaaaggagaaaacagctaattccactggctgaaaaatcttgactaaccagtggtcttcggtctgttcacatgacaactgcactgctagcataaccagcatttgagaaagccaccacactaagtctatctacaaccaaggattctcacagagtctacttcactcccctaccacctccacactggaccccagcaatagatccaaactaagaagaaatctctgaattgctagatagagaattcagaaggttgattttaagctactcaaaaagataccagagaaaggtgaaaaacaacttaaataaattttttaaaaacacaggatatggattaaaaatgccccagggacgtagatatcataaagaagaaacaatccaacttctggaaatgaaagacacacttagagaaatacaaaatgcactggaaagtttcaacaataggatccaacaagtagaagaaagaacttcatagctcaaacaacaagcctttcgaattaacccagtcagacaaagacaaagaaaaaagaactttaataaataaacaaagcctccaagaaatttgggattatgttaaatgacctaagaatgattggcattcttgaggaagaacaaaaatctaaaagtttggaaaacatatttgagggaataatcaaggaaaacttccctggcctcgctagagatctacacaaccaaatacaagaagctcaaagaccacctgggaaatttatcacagaaagattatcgcccaggcacatagtcatcaggttatctaaagtcaggacaaaggaaagaatcttaagagctgtgaggcaaaagcatcaggtaacctataaaggaaaacctatcagattaacagcagcctataagccagaaaagactggggtcttatctttagcctcctcaaacaaaataatttccaggcaagaattttgtatccagcaaaactaagcgtcataaatgaaggagagataaagtctttttcagacaaacaaatgctgagagacttcaccgctaccaatccagcactacacaaaatgctaaaaggagttctaagtcttcaaacaaaactccaaaatacaccaaaatagaacctccttaaagcataaatctcacagggcctataaaacagtaatgcaaaggaaaaaaataaggaattcaggcaacaactagcatgagaaatagaacagtacttcacatctcaatattaacactctccacttaaaagatacagaatggcaggaaggataaaaattcagcaaccaagtatcttcagtcttcaagagtcatctaatgtgtaaggactcacaaaaacttaaggtaaaggagtggaaaaagatattccatacaaatggaaaacaaaagcaagcaagagtagctattcttatatcagtcaaaacagattttaaagcaacaacagttaaaaaagacaaagagggacattatacaatgataaaaggataactccaacaggaaaatatcacaatcctaaacatatatgcacctaacatgggagcttccaaatttataaaacaattattactagacatgagaaatgagatagacagcaacacaataatagtggggacttcaatactccactgacagtactagaaagtcatcaagacagaaagtcaacaatgaaacaatggacttaagttacactagaagaaataaacttaacagatatttacagaacattctactcaacaactgtagaatatacattcttctcatcagcacatgaaacatcctccaagatagaccacataataggccacaaaacaagcctcaacaaatttaaggtaatcaaaattatatcaagtcccctctcagaccacagtggaataaaattggaaattaactccaaaagaaaccttcaaaactatacaaatacatggaaattaaataatttgctcctgaatgatctttgggtcaacagtgaaatcaagatgcaaaattctctgaactgaatgataatagtgacacaacttgtgaaaaccactcggacacagtaaaaacagtcctaagaggaaagttcatagcattaaatgcctatatcaaaaagtctgaaagagcacaaatacaaaatgtaaagtcacacctcaaggaactagagaaacaagaacaaaccaaacccaaacccagcagaagaaaagaaataacaaagagagcagaagtaaatgaaattgaaacaaaaaaatacaaaagataaatgaaacatgaagctgattctttgaaacgatacataaaattgatagaccattagtgagattaaccaagaaaagagaggatccaaataacctcaattagaaacaaaatggaagaaaatgccactgatattacagaaatataaaatatcattcaaggctaatatgaacacattcacaggcacaaactagaaaacctagagaagacagattcctggaaatatacaaccctcctagaataaatcaggaagaaatagaaactgtgaacagaccaataaaaagcagaaagattgaaatggtaatttttaaaaaactgccaacgataaaaaatcacagattcacatggactcacagctgaattcaatcagacattcaaagaagagaattggtaccaatcctactgaaactattccaaaacagagaaggagagaatcctccctaaattattctatgaagccaggatcgccctaataccaaaaccaggaaaggacataataaaaaagaaaactacagaccaatatctctgatgaaaatagatgcaaaaatcctcaacaaaatacaagctaacataatccaacagcatatcaaaaagatcatacatggtgataaattgggtttcatgccagggatgcaaggatgatttaatacacacaagtcaataaatgtgatagatcacataaacagatttgaaaacaaaaatcatatgatctcaatagatgcagaaaaagcatttgacaaaatccatcatcgcttttttattaaaaccctcagcaaacttgacatacaaagatcataacttaaggtaataaaaaccatctatgacaaacccacagccgaccttatactgaacggggaaaagttcaaagcataccccctgagaactggaacaagataaggatgcccactctcaccacttctattcaacatagtactggaaatcctagccagagcaatcagacaaatcagtaaataggaagtcaaactgtcactgttcaccaatgatatgactgtatacctagaaaaccataaatacttatccaaaaagctcctagatctgataaatgaattcagtaaagtttcaggatacaaaatcaatgtacacaaatctgtagcactgccatatactaacagtgaccaagctgagaattaaatcaagaactcaaccccttttatagtagctgcaaaaaaataaaatacttaggaatatacctaaccaaggaggtttactgggggaaccagcccccaatatttcaaagtatgttcttttctattttccctaagtgtgggccagtctgagaaataaagagaaagagtacaaaagagagaaatttacagctgggtctccgggggtgatatcacatgtcagcaggttccatgatgcccacctgagccgcaaaaccagcaagtttttattatggatttcaaaaggggtgggggtctatgaatagggaatgggtcacagggatcacatgcttcagagggcagtaaaagatcacaaggcagagggcaaaactagaatcactgatgaggttccacatcccgctgggcacacattgtcattgataaacatcttaacaggaaacagggttcgagagcagagaaccagtatgactagaatttgccaggctggaatttcctaatcctagcaagcctgagggcactgcaggagaccagggcatatttcatcccttatcttcaaccatgtaattcagacactcccagagtggccattttagagacctcccccgggaatgcattcttttcccagggctattccttgctgacaaaagaattcagcgatatttctcctatttgcttttgcaagaagagaaatatgactctgttctgcctggccctgcaggcagtcagaccttatggttatctcccttgttccctgaaaattgctgttatcctgttcttttcaaggtgcccagttttcatattgttcaaacacacatgctttacaaacaatttatgcagttaacgcaatcatcacagggtcctgaggtgacatacatcttcagcttacaaagatgacaggattaagagattaaagtaaagacaggcataggaagttataagagtattgattggggaagtgataaatgtccatgaaatcttcacaatttatgttcttccactgtggcttcagccggtccctccattcagggtccctgacttcccgcaatagaggttaaacacctgtacgaggaaaattaaaaacactgccgaaagaaattatagatgacactaacaagtagaaccacgtcccatgctcatggaagggtagaatcaacattgtgaaaatgaccatactgccaaaagcaatctacaaattcaatgcaatccccatcaaaatgccatcatcattctttacagagctagaaaaaaacaatcctaaaattcatatggaactacaaaagagcccacatagccaaagtaagattaagcaaaacgaataaatctggagcatcacattacctgacttcaaaatatactgcaaggctatagtcaccaaaacagcatgggaatggtataaaaacaggcacatagacaaattgaacagaatagaagtcccagaaataaaaccaaatacttacagccaactgatcaaacaaaaacataaagtggggaaaggacagcgtattcaacagatggtactggggaaattggcagtccacatgcagaagaattaaactggatcctcatctctcaccttatacaaaaatcaactcaaggtagatcaaagacttaaatctaagacctgaaaccataaaaattctagaacattggaaaaactcttctagacattggcataggcaaagagttcatgaccaagaacccaaaagcaaatgcaaaagaaacaagataaatagatgggacctaattaaactaaaaagtttcttcaaaggaaaagaaataatcatcagagtaaacagcccacagagtgggagaaaatattcgcaagctatacatacaaaaaaggactaatatccagaatctacaaaaaactcaaacaaatcagcaagaaataaacaaatactcccatcaaaaagtgggctaagcagaggaacagacaattctcaaaagaaaatatacaaatggttgacaaacatatgaaaaaatgctctacatcactaattatcagggaaatgcaaatcaaaaccactatgtgataccaacttactcctgtaacaatggtcataatttaaaaataaaaaaaaaaatagacgttggggtaggtgtgatgaaaagagaacacttctatgctactggtgggaaattaaactagtacaacctatggaaaacagtacagcgatgccttaaagaactagaaatagatctaccatttgatccagcaatcccactactggaggaaaaaagccattgtatgaaaaagacacttgcacacacatgtttacagcaccatgattcacaattgcaaaaatatggaaccaccccaaatgcccatcagttaatgggtgaatgaagaaaatgtgatatatatatatgtgatatatatatatgtgatctatatatatatagatctatatatatatatatatatatagatcacatatatatatatatgatctatatatagatcacatatgatatatatgtgatctatataccttagaatactactcagccataagaaagaatgaaataacatttgcagcaacctagggggaattagaaaccattattttaagggaagtaactcaagaatggaaaaccaaatattgtatgttctcacttataagtgggagctaagctatgaagacacaaaggcataagaattatataatggactttgaggacttccaggtatgagtaggagctgggtaagggataaaagactacacactggatacagtgtacattcctcaggtgatgggtgcaccaaaacctcagaaatcaccactaaagaacttatccatataaccaaacaccacctgctccccaaaaactattgaattaatttttcaaaatgattttttaaaaaacttttattggaaggaccctccggagttctgaggaggaggcctgagcatatgtggggaaggcacagatgaacacataggagggatctctaagaaaacaatggccaccaggtcactgctagactcaccacagggccttctaaaccagggggcccctccacgagcataccctgtggagtcaaaggttaaaactcacaggtgacagggccagcacactaaaccccacttgcttctcctctttccaccacctcagccctgtgaccagcatgacttacaggttccagcactgcaggctctctcttctctcccttcagcccccggggcccatgggcagcctaagggagacacacatgtaaccccagtggggcccatgagcagccaggacaccaggcctgcccccatctcaactccaacctcgattttgggtcctctggagaccagaccagccctacccacaagccccacaggcttcctctaaatacttctgttcacaaaactctcatgcctgccaaggagatctcagggttccctgcaccccagttctcagtcccacctcagcaaacacaacctctccaaatcctgaagagcctctttcagaaagaggactttgagtctttcagtctttctccaaaaaagaaaaggtatatgcccttatgcacaaaattttatttagaatttgaaggagttcaaaaatgtaaaaaccctgcacaggttaagtatccatactccaagtaaatttggagagcatttcccagagatattccaaactcaggcctcataactgccttttgcaaaacatacagttcttgggctcagttatccaagccccagagcagccccctacaatgcaccccacagttcctctcccagcaggatgctttgcccttcttctggccctcatgtacactccaagccaaccagttccctcccttgcacacctccattcagatgcctgttcccaaatccaggccatagccaagataagggtggggagaaggtgaaacattcaccaccaccccaactccccaaaacaaagatcttcagaatgcccctctccaccttcatcctgacagcaatgatccgtttcaaaattctcccagatcccacatcaaccccaaagacccagacagcagcataaaggaaaggcagcagaagctcacgggtgccaagagcaggaggtgtgggatgcagcagcagggtagaaaaggcagccataactgcaaggcaggcagaagatgtagcagagtagacaggaagcagtccaactgacagagaatactggaagatatgagaacaactaagggacacaaaataaaatgacaaacacttggatgcaagagtgatgccagggccaaggaaaattaaacatggccaagatggccacaaaacaaactggacaaacaggaagtggctgtacagacaggaagcagccaagaaaagaggatctgggaagtgaaccttcaacaatatggctaccatgacccagagtgaaaagaaaggcacaaaacaggtacaatgggactcctgcagagggaattatgcatgcaaggcttagtgggtagatgagcgggaggtacagagtagatggaatcagatgagtgaatagatagatgggtggaattgaatacatggttgagtgaacggttggatgtgaagtgagtgggtgaggagatgggtgcatgagtgtattgaaggagagagtggttgagttccaggaaggataatggatagatgggtggctgaacagatgcatgcatccttgtatgcatgggtagatggggtgtgtgagtgggtgggtgagtgaatagatggatggataagttgaagaggacagatgaacaaaagcatagtcgaatagatgtgtgtaaagaaggggagagtcattaagcagggggaggatggacaggtgagtggatataagccttcatgcatgagtagatgggtaagtttgtgatgcataggtgggtaaatggttgcgggagtgggtggtggatgtgtgcgtaggtggactggtgaatgagtggatggatggggtggatgaggagagagataggttcaagggatggatagatggagagatgaagactgaaggatagaataagtggctgtggacagtcctgccacataagtggacatctagttattctgcagagatcagcagtcctgaagataggaaatgcaaatcaaaattcacaagaaaaaaaatgaaggcttaggaaataggaacattgcatactggggccagaagaggagtgggcacaaaataagggaccagaagtcactcctttctctgatttttgtggtaacctcaaagactttcttcatctgggatacaggcaccaacaattatcaccccacaggtgtccaacactggactagttcttcaggggagaggccgggtgactcacatcttgcagtcaacaatgagggtgacagactggcccttcatggccatagccacaaggtgccacctggtcatggagtgagaggttcaagtgactgactgaagcaggggcgtcaacagggttggagatctgttgatgaaagttgaaaccaatgacgatgagagcagtaatcacaatagctgccatttatcaagtgcttacagtgcaacaaacactgtgccatcactttctcacttgtttgtgccaattctatttactgtccatcctaagatgtagaaactgaggctcaaaaaatttaagtaacttgcccaaggtacaggctaacacaacttgcagagaaggatgcactctaagcccaaactctgggctagaagtgactgaactttgggcagtgcgtaggtgtgttgtggccaaaagaaggaacagggtttcacagtttagagcgtacaggttctagggcactttctcacaaaagtgtgggccaggcagaccagaggagcaaatagacttacttgccaactactagggtgaggcctcagaagacgggctaagcaggttgaagtcgtccagtctgatcctcatacaggaagctgacaagttggcctggctccaggctcaactgttggacacctgggcactgcagagaatcaggaggggagcttggagaccaggacgggtccagaaaacagtcaggagaaagaaatctttaggaaatcctcctggtacccgagagaaatacacacagagtgagaggcaaagagagccaccacccctttcctcctggtgtctgattccagaccccaccccattacctccctcaccgtgtcactacacttaggaagaggtagagggtgggtgtgctgagttgggcagtttatgacactcagtagatagacagataccccttgccctccagacaccatcagggaagtaggggaaactcaggcccaggagcaaatccacagggggtgcacctgggagagtccatgagggtcaggggaagggacacgccctcaggagggaataaatgggggactttgtctcagaagggagtgcaacttgcacttgtggtcacagagggctgctaagaactcctcaacaggacagttcagttatggaaactgggaaggggtaagactaggaagagaggaggctggagaagtgtgtgatgtcgctgaacagtgtgcagcaggagggaaggggtgcagatgagaagagaacttgaagggtcagcaattccatcagcctttggggtagagagcacatgaattgagaaagaaagctgagatatagcttgtaaaacagctggaattcagatctctcctaagtcctcttcctttcacatattttgtcacctgcctcgagacacacacagttactgtcatccctgggttcagtactgtaagcccagacccatcttccctgctccctttatacctgatcctcctatttctctgccctgtttaggtcccaggcagaagctaggtggtcatctctgtgccctctctggtcctccaggtgaacagaacttagcattcaaggagttccctaaagtcaattaatttcacccccaaaccccagctgactttgagggcatccgcatgcatcatgtcgccaacatatcctgacaaggggaagggccacatttctgaagccagagaagaagctcaattctggaatgatggggatgaaggagaaataattgctcacattatgtaaaactgctctctgaaaggatttcaaaaccaaggtaagatttctgaaatgacttctgttgaacttctgactccactctacttcctccttcctggaaatctttacctccttggcttatgtgccagtatattctactaattcttctgcctctctgcttctccattttctttgaatagttctcttttgacattttgttcattatatattttccattaatttagatttcttaagatatttcattaaaatatgattgacttttattactgagttcttttggtatcctcctaaattttgcacctaaggtaagtgcatccctagtcccagcctggctttccacactgtctcttaatatctaacattctctatttatttcattcatttcatgtaaataattgtaaatccttatagatagaattataaatgtgtgtaaacaatgaaaaattgaaaacagagagaatatatcctatgtcctactggatattaacatatactacaatgtcatagtaaaaaaatagtatcaaaagcctactatatgtcgaacattgttagatgctaaatattcaaataaaagtaagacataggtcttgtcctcctgatgtttacagttcacagaagagaacacaagtgacaagacaacagcaggcccagatggataagtgcagatatggggcaggcacaagatgctgctgtcaaggcatcagggaaggtttcctggggaacagatggcttcaatgtaggcagtccgaaaacagggcagaagccacttctcacacaggaggaagcaggttcaaaagtgtgggcccagtgtggcaatgacatatctgaagaacttcagctgcttcagtatgaatggagccagctttggatgtggaacagcagcaagaaaaaaggaaaaatagacaggcaggggctggatcatgacagatgttacatgcaaagctcaggagtggctactctgtcctggaagtcataaggaatcattgaaggattttaagcaggagagtgatggcgcatttgcaatttaggaagatcactacggcaacagtgggcagcatgagtgaaagaagttggttcaagaggcaagactaatagtgcctgaacaaagagtgaggaaatgggcataggagtaaaatgatggaagaagaggacttaatttgattgacattaaagggattattggtgagtgatgtcggtggcatccgacttagaaaactcccagataactcttattcctagactggccaatgcaatcatctcttttgtgtgtgtgtgtgtaagtgtgtgtcacttttctaaattattttgattgacaaaaattatttatatttatcatgtataatatgttgttttgaaatgtatgtacatcatggaccggctacatcaagctaaagaacttatggctcacctcacatacttattttttgtggtgagaacacttaaaatccacccttttagcaattttcaacaatacattgttagcaactatagtccatgttatacaataaaactcttaaaattattcctccaatctaaatgaaatgtatcttttgaaatgtatcctaaatgaaatgaaatggatgtatcctttgaccaacatctccccaacccaatgcaaacatcttgattccattcattaaaaagggtaatgagagaagacagcctgactgagagaagagactgagttcagtgtggggctattgcacttagaatgtctaaaagttatctaaggaaaaataatatgtaaacatttttgtatgatgggtggtctcagtagaggagtttaagccagagaactgagagtcatcaagcataggtgcaggttagatgagcttttccaggaagagtgccaaaaatcagaaatgcagggatctcagggtatgatgagagaacataataattaagaggagatttcaaaggatgataaggaggattcagtaaataggagaaaaataaggacagagtagctcattagaaagaagtggattatggtgcaaatattatcagtaactcaagtcagaggcactgacaagaacccactggatttgaccttctacagaggtttctgatggccgtgatgagaggatcctcaggggtgtactggagacaaaagtcagaagcttagctccaagtgtgaggacacagagagagtgtctctagggtaggatgcagactgaaggcaaggttgttttttattagttggttcatggttatgttgcttttttcccccgtaggttatagtggtacaggtagtatttggttacatgagtaagttctttagtgatgatttgtgagattttggtgcacctatcacctgagcagtatcccttgccccctcccacctttcctctcaggtccccaaagtccattgtatcattcttatgccttttcatcctcttagcttagctcccacatatcagtgagaatatatgtttagttttccattcctgagttagttcacttagaataatggtctccaatctcatccaggtcgctgcaaatgccattaactcattcctttttacggctgagtagtattccatcatatatatatcacagtttctttacccactcgttgattgatgggcatttgggttggttccatgatttgtgattgtgaattgtgctgctataaacacgtatgtgcaaatatctttttcatataatgacttattttcctctgggtagatgcccagtagtgggattgttggatcaaattatagttccacttttagttctttaaggaatctcctcactgttttccacagtggctgtactagtttacattcccaccagcagggtagaagagttccctgatcaccacatccacaccaatatctactgtttttttatttttttatcatggccattcttgcaggagtaaggtggtatcacattgtggttttgatttgcatttccctgatcattagtgatgttgagcattttcttatgtttcttggccatttgtatatcttcttttgagaattgtctatgcatgtccttagcccactttttgatggggttgtttgttttttcttactgatttgcctgtgttcattgtagattctggatattagtcctttgtcagatgtatagattgtgactactctgtgggttgtctgtttattctgctgatggttccttttgccgtgcaaaagctctttagtttaattaagtctcaactatttatctttgtttttattgaatttgcttttgggttcttggccatgaaatccctgcctaagccaatgtctagaagggtttttccaatgtgatcttctagagcttttatagtctcaggtctcaggtttaagtccttaatccatcttgagttgatttttgtataaggtgagagatgaggacccggtttcattctcctacatgtggatagccaattatcccagcaccatttgttgaaaagggtgtctttccccaccatatgtttttgttcgctttgtcgaagatcagttggctgtaagtatttgggtttatccctgggttctctattctgttccctttgtctatgtgcctatttttataccagtaccatgctgtcttggtgactatggcagggaacgtgagctttttccccgcaatcctatactggccccttctactgcataattattttcttctcttgaattttacatgctagtcttctatttacattttaacatttatataaacaaatgatgccacttttacattttctttattagattaggaggtcgtacaggatcacatttataggtctttaaattaaggagtaatattctttgaaagtttatgaaactattcagtataaacaccacagaatcagatgttttggaaaatgtagggtcttttatgacattttttcatttcttcctcattcactgtataatttttagtctcatttttccaaagcaattacagatccgttgatctaatttgaccttaagagccctgctgtaaaggcaggtcatatcatccccatactgaagacaaagaactgaagtccaagacaggcagtgtccttcaagctgcatacttccatggtagtgtaggtggtgtgtccatgctcccaggtgtaaggcccctagactgagccctgctgaccctgatgacagtcctatggaaggagccagtatcccccgcacatctcaggactcacagacatgtgggaggaagaaaatatgaatgtgcactaatctgaagcacggccttgaacaaaggcaaaacagactccaggcctcattttcagttctgggatggatactctaatctctctaaatcatgccactgaatgaccttttacacattgagatagcatttcttccacaccaggccatgtcctgtgggtgtgtgaggtgtggcagaattggggaaatgataatccctgtaggtgggccagcagaatatctgagatcaccttcagagcaaagaaaacacatcatctccccaaaactcatgactctgactggttaaaatgagtgtcagtgttctccatctgtcctcgtaacagcatcactggctctatattgtcagatctttaatactaactttctgcccagtgagcaatgactcatacaaagctcagtgcccattggttcttttctcagagtctgtccaatcctagggtcacagaagactgcttgggttcatggtctctaatatttcagacaggagctccctttaatgagttcttgttttcctgactgcagctctcttcattctgccaaccttttccaactccatgatgatcctgcaggtttcagggggcccctggacagtggctctgacagcattactgatggtgctgctcatatctgtggtccagagcagggccactccaggtaagagcagagctgctattcctggagggtctggctcagggaacaattcctaggggactttctctttatggaaccagactctgagacagcatgtggggctcctgccacggcctagtgtccttctatcacagctggagaatcaaactcacctcctataggataggttgctatccaccaggtctattctctctccaggaacatggacacagtaaataaggggaggtgctcaggggtcaagttgcttgtctatggggaaatggggccaagaggttcaggataaccttggacagacaaggtttcagagagagaggttggcaagtgcagactcctgggtgtgctcacatctgcatccaaccttgaggggactcaggcagagagcccttagctggtgtgtccagactacaagtatcactgaggattcagtgctcacagagaatgcctctcattctccagggtggagcaggagccaatgctccctggacaatgaaggcaagatgggagggagggggacaggttcgagcccctaaaggcactcttgttgaaggtatttctcccagcctccccagaacttggttagagtattaggatgggttgaaacctgtcagaagaatgagataaggatgtgtgagtacgtgaaagagattgagtgtaggttatcagacagccaagaaagcagtaaccaagggaaaaacctctgtctcctgctgtctccttgtggctggtgtaatattatggcttctatgacccattgtttttctctcaggatgttcttacttttctggtccaaatttacaccaacaccctgagaggaaggactgcagagtaggtgtcttagttttccactgacttccacctttctgcatagaccctccctctgagacccttccacatccacctaggacacccctagaaagtgctgttctcatgtcacctcctcattttccagggtaacagtattcgaatctcctgaggacagcccctcaaaccccaaagcccctcacctattacctcaggttcattgtccgggaaagggtggacaaactgcacttgtagtcacaggggtgctgagaactaaccagcagaatggctcagccctgggaactggagaggggtgaggttggggagagaggaggctggagcagcgctggtgacactgaacagtgtccagcaggaggtccatagcaacagtgtccataggcagagttgtttgtaggatgaggggtggtgttgggaaacgccatggaaaccctcaaggtgcggggtagcagaaagcacaggagggagcgtgatgatggtgggcagtgaacaggtggacgggcaaagactgggttgaggttggtaggggaaatgagatgaggcagtggagccatgtgacaggaaccgagggtgggttaccagagctccccgtgtagaatgaatgtccaatcaaaacctgctggagggagagctggagccataggggagtgggtagagtgggcagggccaattccacaattccctgcatgctcttccaactccacacacatctccatcctcagagcacaagaggaaaggcacaaggagccaggctgtggcttaaagtgagagaggggagggtggagaaaagcttggctgagacaacacctagggagcaggagatgacacggcaggtgaaaaaaccagactcctggaggcaacacccttttgtctctgacaagctttaaaatgggctttttacagctgagtttcttacctcaccccacccactaccccaagcattagggccacactcccgagtcctcctgtcacaccagctgggcacttgcagaagctcattgtgcatttgagtctttgggtactcactcttctgttaatctaactcctcaaataaaatccctagcacaaaagagaggggggaagatccagtcagcaaacagccaacaaacacttttcaaccattaagatctggtgcccatggaaagtcttcttgaggttttccagtagctcataagctgatccagttcctctttcatatgcatttatttagaattttgctcctattcaaacaggtcacacagtgaaaagaggaagggaactaagatagattgagcagtaacagatacaatactatgtatttgacatatgtgagctcatttggttctcacagcagttttgcaaggtaaatagtattattactattttgcctttcaagaaatggagagttagaaggttgtttcttgtccaagataacttagtaatcagtcgtagtgcaagaactggaatccctacctgtgacatgttccttttcttacccatatggactccattatatctttctgcaattatattttaatataacctattctgagtgagagatgaattcactcagatcattggttttcaaattgtgctctgggtaactcaattgtcaaagattccgcaaacaggataaagttttccatatacaaaaaaaaaatgaagtttcaaattccaccatatactcatcacttatatctgctttgcaggtaaaattccctttaaaaagttaaatgttgcaaaagaaagttttgaaattcttactcttgactaaaacatgttctcttattggtgaatgaggaagaggaacaaagactaacaaattaaaatgagaggatacacactcagagtggggcacttgaatagggaggggcagactaaaggggctgggggcgatgggcctgggtgtttagggggctggagcccaaggcactaggagaagaggcgggttaagatatctaaagtcctgggatcttgccttagagatgacactggaaactacaggccgagtctacggtgccgctgtgcccagccccaccccttctctactgtcctctgccaccagctgtgcatcttctatgaggggtgaggttaataaacgtgagttgctaatttgtagaacatgaaacaggtgtccaaaacaaaccttaatttgctgtgtgcaaatcacagcaccttaatttccccactgtgaccaggaacagatcaggtctgaagaggctcagacatgtgctgggtcattgctacttctgtatacacatgcacctgccggacactgcccatggtgctccctaggaagaactgcaggtggaaaaggctgccacatttctttatgtaaaaatgacaccatcaatgcctctaaacctaaaggagtccagtcacttagctttctggttgttctggtgattttcattgattaagatattttccaggtgttttgagatcaagtctttctacagccatgtttgaaagtgaaaattaactttcaggctatatagtctttcttatggcaaacttcaagaagttttaagaaatgcatttctggccaagtgcggtggctcacgcctgtaatctcagcactttgggtggccgaggagggcagatctcgaggtcaggagttcgagaccagcctggccaacatggtgaaaccccatctctactaaacatacaaaaattatctgggcgtggtggcgcacacctgtaatcccagctactcaggaggctgaggcaggaaaactgcttgaaccctggaggcggaggttgcagtgagctgagattgcaccactggactccagcctgggcgacagagtgatactctgtagaaagaaaggaagaaaggaaggaaggaagggagggagggaaggatactccattgaaagaagaaagaaggaaggaaggaagggagggagggagggaggaatgcatggaaatgcatttctgcatttccagcatgcagagatgtccagcatgcagaacagcaagagcaacttgaggtattctcaagaaactggcagagaagagagagaacctagctgtagaaagggaaagaaggaatggagggcttcctggaggaggtggcatttgagccaggactgacatcaggatggaaatgtcaggcagggagttgggtagggggagcagctctgccctccaggtccccaactcctcctatccctactgtttctctgcctgagggaccctccccctgatgagattctgctcctccctgagacgtgaaatgtctccccctcctcctccagccgccagcagaaagggctgctttcccttcagcgtgcgcccctccctaatgatcactcagccaccctgagcagtgagtctcattcttttcagtaaatcctctcgctgcgtggtgagaaaactgatgcctggagtctgtgacctgcctaggaccacagaactcggtagtaggaaaaatcgtatttttaaatccagtcctgagtgggaagatttgaggaaatagctaatattgaggaggggggtgttgttgggagtggcaccacccccatctctccctgctcttcacagagaattccgtctaccaggaacggcaggaatgctatgcgttcaatgggactcagcgcgttgtggacgggctcatctacaaccgggaggaatacgtgcattttgacagcgcagtgggggagttcctagcagtgatggagctggggcggcccataggcgagtacttcaatagccagaaggactttatggaacggaagcgagccgaggtggacaaggtgtgcagacacaagtacgagctgatggagccactcatccggcagcgccgaggtgagggctgtgaaccagggctcctggggcagccgtgggggccgggcccagggagtaggggcagccgggccggcctaagggaccttagtgccaggagggaaggggactttgagctggggattgatgggaggagcccaaccggagcttgtcaggagggtgagcacggagattgggctgagcatggagtgaggaggatggagggagagagacccctgggacttcatcaggcctggcagctgactgcatgtggggtgaggggaaacgaggccacaggacatcgtgcaggggtgcggtgtggagatgaaggtggagatggcacagcaggccacgcagagaagaaacctgcagggagatggccgggtttgaggtgcttgaggggccagatgggtggtctgatgggcaggtgagagaagagtttgcagcgggggaggggcctggcctacatgagaccacccagggagaggggacccatcgggaggagcataggactggatcctgggaactggacattgtgattttgtaacggctccattgtctggggtatataccctggttctttgtcatggccgagaaaattcacgacacagacacacgtgaggagtgggtttgggagtggaaagtttaatagaaaagaaaagagagaaaaaatccttcctcatgctgagaaagtgggttgcccaaaagagggtctgcggtttgtggtggaatgcagtcggttttgtacagaggttgaggaggcggtgattgatttacacagcgctcagggaattggtttgaccagttgtgtcatttacatagcccacgaaaagactgactctcccaccctagtcttttattattcaaatacggtctccaactggtggtggacaggatacctgtacatgtggttttacctggaggctgccatgacacctgtaaacgtggtgacaaggaaaagagagtgggaaccgccatattggatgtacctgacttccaggtacagctgccagcatttacatataaaagcttctagtttgcatatctatgcctgagttttcaggctgcttcctgttagagaagaaatggtttggggctgctttttattaaaggaaaattccactgagaatttttaccctttctagctgcctaaaaataatttcttaataactcctgtattatttcctccctcaggagacgtaaccataactgctgttagggggtgttggacgacgattctttctggctacttcctgctgaaaaggggcgtcgtgtcggggggctgcagttggggctcctcctgaggttgatctaaggcttcttggaagaatggcatgtccatgtgtggctttgtttgcagcaccatttgaagtttgattgcttctaggcaaaaagagataaattttacaagaaggtttaaaatatagggttaccatatgagtattaagattaccacctatagactgtaactatggcagtagagtttgatacctgttacaccaatggattgtaatactggtttgtctccactagatgtcgctgtacattaccagaaacgttaatataaaagcatcatttcctttgagaaaacatgtttcccccttgacttgctattagggcataatttttggtttaggccattctttataacttatgatatgattgggagaaaaacgttattgggtggctaaaataactttggtgttaatcttggcaattcctttcctttaattattaaatttcttaattattaaattctttcatgactttcacagaccctcttacaatgtactcaactttctgacttgtcttaaacaaccagtcatttccttttaggacaagaatttactatacaagatcctttcttatataaaatccctttatttgtaaccttctttccatagcttagagtgcaccatttaccaatcttcaataaaaaagtcctatcaaacttagtgatagtaaaattttcatgcttacttcttgtctgtaactattactcctgctataagcaaaacaaacttgaccaaatccttcctgcaattattaattctgtcataaagatgataattaggcaaaatattacaggaattagaattttacaaccagaattccacattgtgggtgccacagtatacagttctattgcaaataacagcatgatgataacaattcccacaaaagtgacgtagtaaataatttccatttaaaactttacttgccaagatataatgtttccctttggggatttacaaagtaacaaatgcagtcccatgtataattaaaatctctctgcaaatatgcattaaaaaaaagttctaatactgagcagtgaattttgagaggaaaggtagaaatgataaagagtacctggtgaggtaggattggcgctaaggcgagtagccctcactcatttacttaccttttatgattttcagcttaagatcttctatatctccacattgatattcaggatgttcctctgggctgtcaaaggttgctccctcagcttttcaggctttgacttgagtgtgatatattcagaggttgatacttgtaacttttactgctgggggggttgaaagaagaattgtgtagggcccttcccagcctggcttagggaaggagagagagatgagttttcaccaataccaaattttctggtggtccaatttcctggggttggcctttggctagttgtgtcaatttctgttggaagtgagctagagaggttacatttttaaacaacttagaggttttctgcctgaaaacaatctctgagcacactgatgataagttttatcctttcctatgtgaaaaagcttggtgaaggattttaaggactttccattgactggaggccagtaaatggagtttgtcatcctcagggctggaatacccttaagaagtggcttattttatttctgcaggggaatactgaggtttaatttcttttatggaggcttccgagattaaaagggcttgaagtgtgttaatgccttgaggcttccctgccgcctgcttagctccctgctcagctaacctatttcctttggctacttcatctgttcctctttgatgttccctataatacattactgctatttttcgtgaaaggaaaactgaggataataacctgttaatttcctggtgatattttataggagatgctttagtggtaaaagaatgtctttccttttaaatagcagcatgagcatggagaactaagaaagcatacttggagtcagtggaaatgttagctatctttcccctgcttaatttaagtgcacttgcaagaactattagttcagctaattgagtgcttgtgtctggggagagacattagagtgactattgcttgtcctgccttatgtatttcttgctttacctgctgtttgttagctaaagtctcccctagaggacagtaatcctgctacattatgtggggtgtaaacagttaaattatttcctagggttaatttggaggcttttttgactagtagagccaccgtggcaatggcttggaagcatgtgtaaacaataggtcctcctaactgcaattaggaggttgagaaaaatattggaatagagtttttcctgagacaccccttacactcacgctatgggaagaagagaggcctggattaaagaggagaaaagagagagagactggctcgagtgtttagaaggaggtctagtttccttccttcaatttccagaatcacctggtggctcccgtgctgtaatggcagtttgagccactggagctggggtttgagccccaggacccatcagtcctgctggaccatctgtgagactggttctgactccagtgacctccgtctccgggggcagtttgatttccagtggtctccaccacaggctggatagggttgaggtggcttcctcttgctgtttgggcactcctttttaaaatgccctggcttgccacactgatagcaactagcggatgcacctcagaaatcttggactttgcaagcttgcaaagctgctactagagcctctgtctttctcctgagctttctctctttctggggggcctcctcctggtccctattataagtggccaccctcaggaggttccccaaggtgctatctggtcctatagcgtgcttctacagtttccttctaatatcaagagctgcctgtgtaataaacttgtctttacaatgagccatcccttgactgaattaggggctaaggaagtgtgctctattagtgcctctctcagcctttccataaaagctgcaggattcccatctggcttttggtctatcatagacagttgagaggaattaagaggtcaggccttagttcttcatagaccctctaatatgcatattttaaaaatgcttccatttctattcatttgcagagctactggggtcccagttggggttgtcgagaggaactgcttcccttcctactgggaatggtgtttctgttatttttttcactttccctatctcttttcttcccttttggtgtattataggagatatgttgctcatctccaaaattatctgctgcctgcagagctgcctgcttttcaactgcggttagagtttggtttaggagcagcataacatccttccatgtgaggtgaaacacctgagttaaattctggacagcttctatatacctattggggttatcagaaaattagcataagtcttcctttgtttgcctaaggtcctgtaatgaaaagggagcttgaggttgaagggggccagcccctccacacctgtgggtatttctcatcaggtgggacgagagactgagaaaagaaataagacacagagacaaagtatagagaaagaacagtgggcccaagggaccagtgctcagcatacagaggacctgtgccggctctggtctctgagttccctcagtatttattgatcactatctctatcatctcagtgagggggatgtggcaggactatagggtaatggtggggagagggtcagcaggaaaacatgtgagcaaaggactctgtgtcataaataagtttaaggaaaggtgctgtgcctggatgtgcacataggccagatttatgtttgactttacacaaacatctcagtgcagtaaacagcagtattaccaccagcatgtctcacctccagccataaggcggctttctcctatctcagtaaatagaatgtatgatcgggttttacaccgagacattccattcccagggatgagcaggagacagatgccttcctcttatctcaactgcaaagaggccttcctctttcactaatcctcctcagcacagaccctttatgggaatcagccttggggacggtcaggtcaggtcccttcccacaaggccatgtctcaggctgtctctctcagtggggggaacccttggacaatacccaggctttcttgggcagaggtccctgcggccttccacagtgcattgtgtccctgggtactcgagactggagaatggcaatgactttcaccaagcatactgcctacaaacacatttttaacaaagcacaccctgcacagccctaaatccattaaaccttgagtcaatacagcacaggttttctgcgagcacagggttggggctagggttacagattaacagcatgtcaaggcagaagaattttccttagtacagatcaaaatggagtttcttatgtcttcctttttctacatagacacagcaacagtctgatttctctttacttcccccatattggcaaccctaaataaggggaattctcagatggttcccttggaaattgcctttctaattctgggggattattttctataggcctacctgatatgcctatttaaaaagctgggctgatcttacagtgcttgcaaaggtttagtaaaaaagccatgcccttgtgcaaaagaaaatgagtcacttttctcttcaaagtcctgaggttaaaggagttccagtgtttcagagtgcactccagaggggtgcaagctgaagctggtctgtcacccatctagaaaaagaagtgagaataaaagtatcctttcgtccccattctttcattgtgacccagggtggaggagaagacagtggaagtgtcctccctactgttttctctccttggttcctgggtcctggcaacgtgttaaatgtaccacccatggttgtaggcgtggtcctccaagccgtggaactggataaactaagtgatgggattaaccatactttacccacacaaccttagcttatccaccttatgtgatcccctttgacgtcctaaatttgtgtgatctgcctggctcccagaaaaatggatctccagagagactatgtcatctttgggtaggctcctttaacggaggcagtgtgctagattgcctgccattacggcccatgctaagacatttacccttagcaaaatggctctggttaacttccgaacctaaaatccccttgctaattaagtactatcctaattggagacggaaatgaacgtaggaacctaatggctgtttttcctgctgatgagacagtatcagaactaaaatttcactacagaggacattttactccaaactgttgaagacagtgctttctcgttcacagaagaggcttttctagcggcacgaaagaatttggaagcggcagtgttacggtaaaaaaccgacaaggtgcctgatgaagaggatttttatttccactaggtggtgctgttggcttagcactaccatgtgctcgccagagaggatagagagtaacagttactgcctgtggcatttgccgatcttccctaacaggagtgtttccctgaactgtaaaacttcccgcaaattgcacacacagagagagaggacaggagacatagtgaccacggatacaaaggaaaggaaaattttgcaacgggttagctggagatccattaccaacacctggacaggctgtcggaggctgcgttcagtccagaagcctttgaataacaccagggtgtgccctggccagaaattttcagttgccccaagactttcccagcctcatgcgatggtgaagttctccatgaaaggaaactggtatgaagagattcttgagattaaagaacagatttgacgtttgctctatactcaccactccgatgtttctatcttccattctgatttggatcccggatgagctcccaaaatgaaacagctccactgtctagggtatataccctggttctttaccatagccgaaaagaattcacagcacggacacacacaaggagtgggtttaggagcggaaagtttaatagaaaagaggagtgagaggaaaagcttcctaatgctgataaggcaggtcacccaagagagggtctcctgtttctggtggaaagcaattggttttgtacagaggcttgaggaggcagtgattgatttacatagggctcaggggattggtttgaccaggtgtgtcatttacataacctgcaaaaagactggccttcccaccctagtattttattatacaaatgcggcctccacctggtggcggccatgatacctgtacacgtgctttaacctggaggctgccttgacacctgtaaacgtagaagggaaagagggtgagaatagccatattgaattacctgacttccaggaacagctgccagcatttacataaaagcttctagtttgcatatctatgcctgagttttcaggctgctttctgttagagaaaaaatggcttggggctgctttttattaaaggaaaattccacccagaacttttaccctttttagctgcctaaaaataatctcttaataactcgtgtattaatttggccaagagagaaatcccgtgaaggagaccaaaaagcaccagtgagcctctcactaaacaaggacctttgtcctagagaaagaggaaagaatgaagggggaggaggaggaggctcaggaggtcacaccattgatccctctgttcctgggaaagtgaaaggaaggtcatctgataagagggagaagatgcacacattgagtaaggatgaggagagtgacatgggtttaggaaagttgctggcgtaattggttgagagaggtgtccaaataaaagtaatacaatttgcaaaatctgtcactaagacttcatagaggcccaaatcagcgacatggcagcattttctttcatggtaatcagctgccagattgcagagaccccctgatgccagactaaggagtgtggatttctcctctaggccagcaggtccccaacctcactgctcagaagactctccttgagatcctctgtgaagcaaagattcccccagactcactgcctagagattcagattccctaggtggggaggtctggagatctgtgtttttaatcagctcccaagtgattcccatgtaaccagataagtgtcagaacactgaagatttttgaaaatcttcagaaatcttaaaatgacaaggctggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgagcccgggaggcggagcttgcagtgagccgagattgcgccactgcagtccgcagtccggcctgggcgacagagcgagactccgtctcaaaaaaaaaaaaaaaaaaaaaaaaaaaaaatgacaaggctggaaatctgttttcagaagactgtgaagtcagttggagagagcaggaaccagaggcagggagatgagataagaaactgctattattgtccagggaaatcataataagggcatgaattagaataaagaaaaacacaggggtaggggagacggaggaaagaggaggatagaagttctggccattccagtgtggatgcccacccaaatctagaattaactgagcaaaggcaactagaacaaacaggaatccttgccttggtgaaatatatttgaactgggtcagaaatgaggccactgggtatcaagccttagctgcagcgccccctggaggtctctgatgtgctccaggctgaccagctcccgtcaaagaagatggagcaaagtgcttctcatggaatgttctgggaccttaaaacagacaaccatatatcccatgactttcatgcttcccaggacacctatggggaagaagttccacttaatctacagttgggattcagacatgggctgaccagtctgatggatgttgagtttatggaggtggttgaagtagaacgagagccaagtgcctctgaaataaaatcacatcgagggaagaggctgtgaatgtgaataatcctggacacaaggcaaaaatgccatagggagtaagggttgggggttagttaaagactgttcatttacctggcccaggcccatgtcagtgtatttgtgttctcaagaacagagtaaataaggacctagaagctctgatttggaacattcctgtaattgagctgttctctaggggcagttggcccttttctgccttctgtggaggaaaagggtactagtggctgaggtccaaaggaaaagctgcaggtggtagcgtggaaattgatctgtaagcggcagaaaaagagggggcaaaaatagagaggtgccaaggcacagccaacacctggttatctgagaacctcaatggatgtgacaacacagtgcagaggaggaacttagggaaaaggatgggatttctactatttaagcatgtaggggctcaggatattatgtaaataggacgattttgagtgtttgtaggcgaggccaaaaaatccataggttacttgcagaataagtcacgtcaagctcactttattttcttgatatatttatgaaatatagttattggattaatagaccatgagaatgttgtttatatatatattaatttcaagaaatcatttgagcaaatttttcatcttttgcatcaggatagagcactcaaaagataaggtagtgtcgctgctgattaaatattctttgtccaaaggctgttaatcagtggctgatagataagatttcttttaaatgtgctacaaactggtaagtttgtgtgcctcctattcttctcaatactatttctatagtttcaatactccccttatctgctgacctaatcacatcattcctacttttttttttttttttttttttttttttgagatggagtttcactcttgttgtccaggctggagtgcaatggtgggatcttagctcatgcaacctctgcctccggggttcaagcgattctcctgcctcagcctcctgagtagctgggattacaggcatgcaccaccacacccagctaattttgtatttttagtagagacagggtttctccatgttagtcaggctggtctcgaaccacctgcctcagcctcccaaagtgctgggattacaggtgtaagccactgcgcctggccatcattcctattttcaacatctagaaatcaattccataatgagcatgtctaagaaataataatctcaaatgctattccacttttccacttcgccactcctagtccagcctagggtgaacatctcccctccaagaaggagccccagcagcaccacgacctgcttgtctaccacgtgacagatttctacccagacagcattcaagtccgatgcttcctgaatggacaggaggaaacagctggggtcgtgtccaccaacctgatccgtaatggagactggaccttccagatcctggagatgctggaaatgaccccccagcagggaaacatctacacctgccaagtggagcaccccagcctggacagtcctgtcaccgtggagtggagtgagggtctgatgaccctctagactccacctctgaagagcaggggactctctggctctggggtccactcatctggttttatgtgtctataccctgggaccatgtccgaccccatttttcttctatagaagacactgagtgtagttttaacctggggacaatggagacttgcctgcccccggcctaggaggtcctaaggattcatagttcctctccttgtccaagaatctagggatgcagacaccttcctgaactgacgttacacatgggaactgttgtcttccttcagccttttagcttattctaagttattttgagaggcaactaattgaatctgaatttgtctgttgttgaggtcacaccctctgttctagaattgagagagtgactgtttctcagtttcctgtcatgcaaggtgtattcccctcgctctcctcgtgccaatattctgcatcaggctgcaggatctcagacaggacatgagcaggggtgcagctgctggaggtgactctgaacctgagcctgttcttcctagaggcacagtctgattctgtgcagagcaagatgctgacaggagccaggggcttcatgctggggctcatcatctgtggagtggacatcttcacgcacagaaggaggaagaaaggtgagaaatcctgtgaggtgaccgatacccacctttctcctgacttgctcacccttcttccatgatgaggggctgagacaaaaaagcaatgccagagagcttgctgaaatcacatagtcaggaaacaaagacagcttctaaggagagaggaatcccagcctggcatcttaatgcagccagatgcatgaggtcccagttactcaggctcctgcagagcgtccattgagtgatggacaatggaagtatgatggaaacgtttctctaattgtctgaggtggtttcagtagctgaatacattctctttcttcctttcatttcagttcaacaaggatctgcataaacaggcaatattcctgctttgatttccttgttgggggagttacaggaggacataagtcctttctgtacattgtgacactgaggctcctctaggaagagagtctcaggcctgaacccctgtttcaacctcagccctggggtgagtggggaaagagcattgcatggctccattgctaaaggaagctcagatcaactctattctttatcagcctgagattcagcctctcaccgttatttttctctcctgggacttaaaggaagggggccagcaacctgggattactgttttttacctccacagggttgctgaccttgcctaaaagactaatgtaccttggaacaagcattttctgtttctttagtcccagtacctgcttcgaggacagacccccagcctcccaagaggatgctgctgctgagtagttgcactgaagccagtttctatcattctgttcctggattcaatgcatgatttctctcatggggcctccaaccaagttcctttctccttagtgccatgagtaatcaaaacccaacatgattgttttctgttaagaatatacaccaagtcatgtctcatcacttttttttcttgagggttttagcaaacagtaagagttaataaagaagttcattgtggtttagacataagaaagaagaaaaccatgaaaatccatccaaactattgtataaggtggcctgttggacatagacctctcctggatttactatatttcagtgagctgccccatcctcatgtttggtgtcttcatccatttaggtctgaaaccactattcttagctattcagtggtgaacagactgcaaatctgtgttatagggcccatattaacatagcactgattcaacatataacttactaagagcatgttttagcattactgttaagaaattaaataagcatcagaatttaaaacgataaatataatctaacacactttcaacactttctttgcatgccatcacaaatactccttaaccaaatgttgcttggccttttgaatgcatcaagtagacgacatttatcctctaagtctgcattcattcaccagcctagacctcctgagctaataattcatacagtgagaaacgcctccccattgttgaaagtgcaaagcaataggtgtggcactctttcaaacactgatcttttttttacaatccaaaatttttatgtgttttgcatttcatattaagttactgtaaatcaaggtagaagacatgtttggtctaagctttccttttcgtgtagaggatggattcttaactcctgatacacataatgagcactcagtggctctctgatacatccagttgttggcttccttctccctgacttctcacaagcagcttctgggccttgtgtgcccctgggcgcctatccctggtcagtttaccagagctacccgtgttcctctcactatccaatcagagtcatctccttccatttttgtcccctggacgcatgctgtaggtgtcagccgtacccagagtggagtgaacaatctgcagactaactcttgcaggatgcaaaactgaggtatctgcacccataatgcacctgtatcctacaattacaagtccaggatatgcattcctaggaaactgagaatataaggagtcacagaaaggcatcagatgtgtctagctctgacatacacaggtatttattgaactctgggatttctcaggaaaaatgcagtgcagagaaaggtccctgatgagaccacagcatacagaccatccagtgtgggcaccaccttgtcactacactttaaattcttcatattgattgagtgctatctaaatgtcagaccctttgctgagtgctaggtgcaggaggatcataggcagccaggaggtagaggggtcttggggtacataagtcattgtggttgaagagcagagattcaaaagaaagttaggcctggagatttaaaggagaccgaagctggtgacttccttatgtcaacttctgactgagaaagtttgacacctggagtagaataaacacactggggttaggactgccagcttagtgttttgtcccccatccctttccatccctggtcccttcattttctgcccctcacagtgtgaataaactctcacagatgccagaccatctccttcttgtccaggtgcacaaataactgctcatcttcatcagattcaaacatatactccccagagggtctgtgtgtctgcacaaactctgcatacgttgacacatggtctgctgcttgaaggggaagaagactgcagaatgaggaacacataggaaagtacacagaatacaagaagcaagcaggtaatgggaaagtttttaagaatgcaagggaataacacagaaaatgagaaatgcaaaaatgaatgaaaagaaaaggaatggggataaacaatgatagaaatgactcatagaagatttcagttgtttccctggtctctgaagacttacacaaccctcacatcattccaataatgataacactgaacacaatcagaaaatattcactgaacatgtaccatgtgctcaacttattcattgaatcctcacacttccacgtagaagtgttcaaagaaggccaggcgcggtggctcacgcctgtaatcagccgggcatggtggcaggtgcctgtagtcccagctactcaggaggctgaggcaggagaatggcgtgaacccgggaggtggaacttgcagtgagctgagatcgcgccactgcactccagtctgggagatagagcgagactccttccccaaaaaaaaaaagtgttcaaagaaaaacttctggccaggcacggtggctcatgcctgtaatcccagcactttgggaggccgaggcaggtggttcacttgaggtcaggaattcaagatcagcctggccaacatggtgaaacccctttgtctctactaaacctctttgtctctactaaagatacaaaaattagccaggcatgctgtctgtagtcccagctacttgggaggctgagtcaggagactcacttgaaccgggaggaggaggttacagtgggctgagattgcgccactgcactccagactgggtgacggagtgagactctgtctcgaaaaaaaaaaacagaaaaaagaaaaaaagaaaaacttcagctgaattcaatataaaagagtcaaattgagcaatgaacgattcgtgaatcaggcagcctcccgaggcagagtaggctcagagactccattgcaggcatgtggtggaagatttatggacagaaaaaggaaagtgacatacagaaaacagaagtgaggtacagaaacacccaattggttacagctgggtgtatccttatttgaacacagtttgaacagttggctacatatgattggccgaaacttggtgattgacacaagtgtaggctgtttacacctccacttgttatagttcacgatgtacagagaaacctttaggccaaacttaaaatatgtaaggaggcagctttaggctaaacttgatttaacaattttcctcttttggtaatcttctcaatttttagagatttaccaaaactttagtcatcgatgccactatcaccattgtaaatgtacttatttggtcttgaaaccccctgggaaatagcagaacaatgagttttgtaagggggaacaaggatttcaggttattttattttattttaattttatttttgtaagggttacctccttttgttggaacgttctgtttataggagaaaaaaacaaaacctggtctgttttaggatctatgtgtttccttaaagtcttagtttaatcatgtcacatttagcacaagtgactccattttggtttggtctggtctgttggggcttagtgcatttagcctttcattaaagtccaaaacaatggcctcccatgattttgtttaaaaatgtcccctttttggtcaggttctcacttaggtgagaatgtgaccaaagcttagggccttagcgccactctcagttaccatcattttgggtttccagtctcaacacatcattcataggttaaaatgccatcatggtcacacatttctttcaatcttgtcattctagttgaagagagacaatttgacattctagagatggctgcatgcaaacatttaaaactttcgagagaatacagtgcaccaggtagactactattatgactatcaggaggataataccaagagtttggagtatgctccttacacagggtccccataaaccaaaccacccaaaattaaatagatcaaagaatgagctaaataaagagtttactcatttaagcagtctcttcattaattacctacaactgaatctctgtacacctgacgtgatgtatttctccataggccacaagtgccagcagctgcacagatacttctctgtttagccagtaagtaatctacagcaatcctactattaagcataactttcacaaaagaatgtaaaatctgttgtgtaaccatcgcccttacagtagactctgtttagagcctatcatgagggatacatttctaatcattgcctgttttactccaaatcatggtaaaaaggacctaaggaaaaatgcccttctagaagactgaaggcctcctggcaatgttctctttaacccatgatgtggaataggggagtgaatcaatgttctgtttctgactgattatgaggcaacctatgtaccattaaaatttctcacctacactgggccttcatctttcatctatcaaggtgtgaggttatccatgtataaggctggctgcaaaacccttcaccaataaaagtatacctaccccataagtgcacacaacagacccccttttcacttctactgttcatagaggcatcagcaagggaaaaaatactcagagataagagcctccatatagcagagaagtcttgatctgtgatcttggtgaaagctgttcacatcaaggataccatcttcttctgggaagaaacttccctggttagctttaccttacgggttccaatgggtgtatatttccaagaatgtggagggatccttctcagttgtgagatcatgaagccaaagttcacggttctgatgtttactgcagtgtggatggcaagggcagtctttctctgatgttctcagaagatccaatcttcaggttctagattgtgaaggggttgattgtcctcagtcagtgaaccataaaaagctttctttacctggtgaaaatacactgtgaaataataatctactgttataacatcagttcacttgtataggaaagcttttacacaaccagaaaacatgcattgaaaatgacaattgactgaaatctcttcataaatgtttaaatggctcatgaggtagcagaatgtacctgaagctttgattgtcttcccaggaatatgggtttggcaaaccaaacattggtcataaactattttagcaatttagaagtcaccacaccaatatgcatttaacttggatcattttatcttttccatgatgagtcatggaatgcagaactttaaattataaaagctttaaaagctcaggaaggataaggcagccaccttggttctccatgagtccatgcttgacacggttgtttctccaattgaggtgcatagcactgataactgatgggttatcataggtaatttgagttagaccacagagtttcttcaaattgtgtatctaaacaatttcagtattgggtgatttagcatgaaagacttgcaaagtattttcttggtattcaattaatttgtgttctacttgggatggcagttttataaaccagtcagtcttttaagctccaggaagcaggagaatggcgtgaacctgggaggcggagcttgcagtgagccaagatcgtgccactgcactccagcctgggtgacagagtgagactccgtctcaaaaaaaaaaaaaaagctccaggaattcttacccagtaaaaatgatatgattctaaagttatcagaaacctgtaatcaagaatactttttggggtcctttccatcctttcaggaacctcctaaaagacaccatattctagaattgtgcctacttgtgaagttttcagaaattgcaccagcattaagcaattaactgtggaaatgaccttccttccttccctccttccttccttccttccttccactctctctctctctttctttctttcctttattttgagacagagtatcactctgtcacccatgttggagtgcagtggtgcaatctcggctcactgcaactccgccttccaggctcaagcaattctcatgcctcagactctccagtagctggaactgcaggtgtgcagcactgcaccaggctaatttttgtatttttagtagagactgggtttcaccctgttggccatccccaaaaggatatttagccttagattttgagagggatctatctgcttttgattcctggtgtttcaggaggaaaaccgagttatatcccaaagcaggatcgtagtgcctcctctgtttttcccaaggagtcccaggctgttagaagttaccttaggtcctctcatgtgtgcaacaaaagtggcaagaagacaaaatggagaaaaacaattcagttggctaaaaagaaaaaaataattaaaaaaaaacaaagatccaagaagagaaaaaaccaaaaggccctttaaacatacctatagcttggatatccacttttaattaagctgacttttaactatagcgctctttctaaaaaaaaaaaaaaattatttgattgtttttagagacggagtcttgctctcttgcccaggctggagttcagtggttcaatctcagctcactgcaacctccgcctcccaggttaaagcgattatcctgcctcagcctcctgaataggtgggactaccagtgcgagccaccacatccagctaatttttgtatttttagtagagacagggtttctccatgttggtcaggctggtctcaaactcctgacttcaggtgatccatcctccttggcctcccaaagcgctgggattgcaggcatggaccactgcgcccagcctaaaataatcattttaaatctcttattacttgactttagccaggccaaacagccaatatgtctggcttttgaactttaccaaaggtaatctcccaggtgaaaccaataagctttaacaaggttatgacttaaccacaagtgtacgaagtattttcaaaaaggtagcaagcaatttttacaaactctagaatttccaaacgtagctcagagaaaggaaaattcaagacgagagtcagaagttgttcatgaggggaagagaatcagcaaatagcaaagatcagaaagatatcaaaccaaacaggtctcattccctgagctggaattgaaccctgcctggctgccatcataagatggcaaagcttagccactaagctacaccgttggtggtttccattgttcctcccagaaggaggagcctaagagcagccaattttcagcttgcaaaggcttttaactgctcaagataatttttagagctaactatgacatgaactccaaaattcctgtcctccagagggtggagaccaaaagaaagtaccatcatgtgattataaggtcaagctcccaatgacataaaacaagatgacagggaaaccttatccagtgtttttttgtttcagggacccgcagtttgtaactgaccagtttgccaggctggcttgaacagcagacttctgggagtcctaggcccacattttatcctatttaaccccttttatgaccaaatgacacagaaagaccaattcatagcacaaagtacaccaggtttgctacagcttaagattggctcacaaatacctttttttttttttttttttttttgagacggagtctcgctgtcgcccaggctggagtacagtggcgcgatctcggctcactgcaagttccacctcccgggttcacgccattctcctgcctcagcctcccgagtagctgggactacaggcgcccgccacctcgcccggctaattttttgtatttttagtagagactgggtttcactgtgttagccaggttggtcttgatctcctgacctcgtgatccacccgcctcggccacccaaagtgctgggattacaggcgtgagccaccgcacccagcctcacaaatcctttttatcattaattaaaactttgcagaggagacagtgatttttactactcctacaaccgtttccacacagagagaggccagaagcctgactgctaagaaattcttacccttttgccagcatgccaggcttctgggttccctctttctgagtggccctagcgaccctgttagctgcacatagcctgggggccaagccacaacacaaaggaaaatcatcttttctgatttcagggaaccataggcaaaagcctctcaattttgtaagatgctgcccaagagattgcatgagggaactgaattaacattttcccttccagccacagcaaaatacatgtgacaaaacatagacattagccactctgcttagtgcccaatattgaactggtaaggcttaaacttgcccctggtggggctctgctatctttaatctattcaaagtggggtggaatggcctccagccagaagtttcaacatgtgatctctagacaagatataatagaaagctggaaaaaggaggccgggcgtggtggctcacgcctgtaatcccagcactttgggaggccgaggtgggcagatcacgaggtcaggagatcgagaccattctggctaagacggtgaaactccgtctctactaaaaatacaaaaaaaaaaaaaattagccaggcgtggtggcgggcgcctgtggtcccagctactccggaggctgaggcaggagaatggcatgaccctcggaggcagagcttgcagtgagccgagatcgcaccactgcactccaggctgggtgacatagcaagactccgtttcaaaaaaaaaaaaaaaagaaagatagaaaaaggaaagaagagaaagagagaaagaaaagcattgtctgcagcagggtggggaaggcaaagagttcagggaggacagagaaggacccacctattgcagtgacactaaattaaaagttcagggccaggtgcggtggctcatgcctttaatcacagcactttgggaggccaaggtgggcggatcacctgaagtcaggagttcgagaccagcctgaccaacatggtgaaaccctgtctctactaaacacaaaaaattagccaggcatggtggtgggcgcccgtaatcccagctactcgggaggctgaagcagaagaatcacttgaacccaggaggcggaggttgcagtgagctgagattgtgccaccgcactccagcctgggagacagagtgagactccgtttcaaaaaaaaaaaaagttcaggcagctgcttgtcagtcatgaaggatcttttccagccatctcatcagctctcaagtttcctgctttggggagaaaaaagttccccatgtcccatgatcctgtacatgcctaatcctgtcacacacagccatcagcaaaaagcgcaaggcagatttaattttttaaatcaattagttgtttaagctttttaattcttttttgtaaagtctttaaatgcaaatattgaaattttttagaagcttctgcatatcaataggcatccctacatgagactgtacatgagactaatttgggagccctcattttcaaatgcacttcagtgcagtgttgttcttttggaatgttctactgcaagttatctttagtaaaaaaaaaaaaaaaaattttatttgagacacagtctctgtcacccaggctggagtgcagtattatgatctcagctcatggcagcctccacctcctgggttcaagtgattcttgtgcctcagcctcccgagtagctggaattacaggcacatgccaccatgcctggctaatttttttttttaatttttagtacagacagggtttcacagtgttggccagcctggtctcaaactcctagcctcaagcaatctacccaccttggcctcccaaagtgctgggattacaggtgtgagccaccacgcctggacaatttctgtaaggcgttgctccttccagggcctaatacttatgcatgtataatccagaaggaactcagttcttcagaaattcagtatcacattttttacctcaaatactggctttgctctcaggtcccttgttcaacttagccaatgattttttttcctacctaagtgcacaagaaaaataaaggagtagaacataaaaatctctgtgaatttccaaaagccaaattttacacctttgcaatattgccatttaatactggtttctttctgatccagttagatgtaagaggtctctaaccggatccaagccagttaattactggagccaatccgatcctggactcagttcaatttctttcgcgactttcaaacccaatcaggatcagaaatttactcaaagaaactcagagagctcaacacacaaatctgtggagcttcggaatctgcaagagaacttaccacgatccccagctgctccgagagagaaagagacacaatgggcctggagggtacctcgctaggtcactcagcacttctgggggtcattagaagctctacttccaaccccacttctgacaccacctgataaaagaaaaacttcagccgaataaattttaaatgaggttaattgcgcaataaacaattcacaaatcgggcagcctcccaagccagagtatgctcaaagtctccagcacagctgcgtggtggaagaaagtttatggacagaaaaagaaaagtaacatacagaaaacagaagtgaggtacagaaacagccagattggttacagctcaatgtttgcctaacttgaacacagttcaaacagttagctacatatgattggccaaaactcagtgattggcacaagtgtaggctatggtctgtttacacctccacttgttatagttcatgatgtacagagaaacctttaggccaaacttaaaatatgtaaggaggcaactttaggctaaacttgatttaacagaggaaattattttacatattggggaactgaccacagaagtaaagtaactcacccaagtcacacaactcctggtagaaacaaaattgcgtagtccccctaccccattcccataggatctcagaacccctacaggaccagacataaaaaatactgatatagccacagagaaaggcagggaagtagggagatgaaataaaaatctttcagggaaaaaaataatgaaggacatgaaaagacctccagagtaagtcttagtgctatttatagacttcaagttatgttcttacttttagaataaaaatggtaccttatataattttatcaaaacactttcattttaagtcatagtaaatttaaaaatgttgtcatgcacataacattcacaaaatgttcttgttgaatgtatattttcaagtgtagttctacctggaaataaaagttgttgcatttgaaacacctatgggatagtatcttagctttacctgatgtataagacgcagcaaaaggttgacaacaaaaaagtctattactattacagtaaaagaataaagatgagagagcatggagtccagcctggaagaggaagtgaggcgaaatgacactgcatggttgttggtcctaagcaaggatttcccctccaagcccaacacggggaaaaccagtcctctccttggatgcgtcaagtgacggcaagttcagtgtcacacacggatgttgagggtcctccactgagtttatgggctagagaattactcacctacagaaacgaagcccaaagaaaaaacagatgaaaaacatgatatacaagctgtgctacagagatgtcgtttgttcaccttaggttactttgtttttattatattcacaaagcctaaaactaaaggtccgtgcattttaaagcaaattccaccttcaaatgttaattttcattctgttaaataaacactcattgtgaattttcactctttaggcactaaggatgtaactcagaagacctgggccttgtcctcaagctgcttgaaatccaaaatccaaagagacaaagaaaagaagattgctacatgtgtattttattttgtgttttttaatcttttatttccataggttattttgatcaccactgagtaccataagatatacactggagccactcaggagcataaagagggcatttttgaaaaatgagatttaggaaaggttcctagggatagtgtttacctgaggttagcaaaacagagaaaggggaaatgacatgtccagcaggagaagcaggctcaggagcagagaggcatgaagttgcaaggagaactgcagttcttcagtgtgactgaagccaggggagatgtgcgccgggcggcactgtaacctgccttgtgtgctgatggcaggtgtttgcattttatcccacaggacataggaagttgtgaagcatcttaagcaggacagtaacatgatgagatttgtgtttggagggggcagcagtagggaggatgggttggaggaggctggtttgaaagcaagaccaataggactcttcagccatcagatgggaagtcatgagggtgtaggcaggggcaggaacatggggtgaggcggacagcggatgggtttgaatggcaataatgaaacgaaaagccacaggaatcactaaatcatgtgccagaagtagggatatgaaggagtccagaatacccaacgtggagaactggggcatcagtgactgcaaaggtaatgaaaaatgaaataatcgagagaaggtaagatgttctgtttggaacatgcttagtttgaatttctgtgggaacaaatggagttaatctgaggatagtgagctaaatggttgggtcccagggtacactaggttagtgacacagactggaaggaagctcattataagtgaagttctaaatttggatcaggtcactcaagaaaagtacataaagtcagaatagcaagggtctgagtgtgtgctcctgcatccagacaaacacagacatgaaaaaagaggctgaaaaggagaagactagaaagtaggaggaaaacaaagaggaagtgggttcataaaagacaacagacaggagaaaacatccaggaaagaggagcggacgcatcacaaacacactcatgacacacaagagatagagacagagaagtgatcactggtttgggttgtataaaggtcaccctgagagcagcatcagagacatggggaagaaaaagggagaatgcagtgggttgaagactgaatgaaatgagagagagtcactaacgggctgggtgtggtgccccacacctgtaatcttagtgctgtgagaggctgaacaggaggatcacttgaggccaggagtttgagaccagcctaggaaatacagtgagactccatctctaaggggaaaaatatatatatatatatatatatatatatataattatccaggtgtagtgacagacacctgtagtcccagttacccaggaggctgaggtgtgaggatcccttgagcctgggagttcaaggttgcagtgaactgtgatcacgtgattgcactccagcctgggcaacagagcaggaccctgtcgagagagagagaggagagagagagagaaaagaagaagaagaaaaagaagaagaagaggaggagggggagggagaaaaggaaggaaggaaggaaggaaaaaaacccacattgcagactcctatttgaggaagctgacctctacaatctacgagagaatctccagaggaggttgccaagccctggctcttctctcttcagcgagaggacgtgggggaaaggagacatttatgaatctctttgagtctcagtcttttcatttctaaaattgtgttaataaaagcctttctgaaaatggtgttgtgaggaaggacatgaggtttggcacttagggggtgttcagtaaatggtggttattattgttagaatgagagaaagcaaaagagagcctcaggcaaaacagtaaagaacagagaaaacagaacaggaaagaaaacagcatctgtgggctccagaagcgcccagagcccccaccctccctcgcccacctgcgcactcacccctgatggcccaggttccgagaggctaagcagggcagccagggccatggctcacaggaggatcctggctctgcgctggctccttcagtctttagggtgtattgcaatggccactgtgcgccagaccccaaggagaaaatgaggcggcgcagggacggaggagctccgaatccagcactcctttccctacccctgtccagggagaaaggctggagatgaaacagcctgatggggctcaaccaaccagaatacatcagaagggacgcctctgtggctggggaaggaagatgctagagctgctgggaggaagtgggagaattgtcaggcaccagcatggcccaggaagcccctgactactgcagagtgtaggggtaagtgaagaaaacgaaaattaggacatcataatcgccttcttcttaatgaggaaatacattacgcaagttgggattttttatttgtagttacttctgtgaatggatgatatttcttcacaattttacattgattctttgcatcataaaggaattaatttgttaccatttgatattatattgactcttttatagctatgataattttggagaaaatctttgatgttttcaaacatataaggagaaggaaataatatttaattatttaattagtaattattattttatttcttcttcatataaaaatgtggtgaggctgggcgcacagctgaatgaaatttaaaagagtcagctgggcatggtggctcatgcctgtaatcccagcactttgggaggctgaggcgggtggatcatctgaggtcagtagttagagaccagcctggccaacatggtgaaaccccatctctactaaaaatacaaaaattagctgggcatggtggcacgtgcctgtaatcccagatactcgaggggctgaggcaggagaattacttgaacccaggaggtggaggttgcagtgagccgagatcacaccattgcagtccagcctgggcaacaagagcaaaactccgtctcaaaaaaaaaaaaaaaaaaagaatgtggtgatacaaagaaccccactttaaattttatgtttaagaacaatttctttttctcctttattttctgtgtgtgtgtgtgtgtgtgtgtgtgtgtgtgtgtgtgagagagagagagagagagagaaagacagacagggtctcattctgttaaccaggctggagtgcagtagtacgatctcagttcaccatagcctgcacctcctgggctcaaacaatgctgccactcagcctgcccagtagctggcaccacaggcacatgccaccatgtgcctgcatgttaattcatgtacttcctctttcccaagttctctagtttatagcatgtcctttcctgaggaacataaatcacatgttattgtctgcctttcatcctgagaggaaggagataatcacatggccattttatgcttgaaggatttggtgatcactgggtccaatgaagagcctcaggatgagtcagtgtggttttacccaggcatggagaaattaacttcttgatgatgatcaagtcttcttattaaataggagtgcaactgatagaggatcttcttacatttgctttatttcatggtgctgcccaaattcatgctgtaccctcagcagcaaggagtgggaccattactcctggcgttcccagatggaacagacaccaagcctggctttgccactgaacacaatacaggactgataaaggtcagttcttaggaatatgcttcccaaatgtagaaatcaacataagatcccaattttaaataataggtataatagcataatatattattttattttatttatttagagatggagtctcactctatcacccaggctgaaatgcaatggcatgatctcagcttactacaacctctgcctccagggttcaggcgatcctcccatctcagtctctagagtacctgagagctaattttttgtttttggtagagatgaggttttaccatgttggccaggctggtcttggactcctgagctcaagtaatccacccacctcagcctcccaaaatgctgggattgcagaagtgagccaccatgcccagccgcataatacattatcgttctctttatatataatttgtactaagttatagatacacacttattccataactctatgttcaccagatcacctcttgcaggttgtacagtgaaaacacatccttagtttcaaaagatgtgtgtataccagatttttcagacataggcttggttttagaatacagtttactatgatttttgtaattcatcttaattgatgtttaataccgagagagaagtcatattgtctccagtcatttcatgttatgatgtgccactaagtccaaattttatataatagtaatcaggaggctgggcacagtggctcacgcctgtaatcccagcactttgggaggccaaggcaggcagatcacctgaggtcgggagttcaagaccagcctgaccaatatggtgaaatcctgtctctactaaaaatacaaaaattagctgggtgtggtggtgggcgcctgtaatcccaactacttgggaggctgaggcaggagaatcgcttgaacccaggaggcggaggttgcagtgagctgagaccacaccattgcactccagcctgggcaacaagagcaaaactccatcccccactcccaaaaaaaaaaaaaaagttatcaggaaaacttatagttgctacaatattattagattaatacgaattttcaaaaatggcagagccttaaccaagcttaaagagtttttctttcttaactgaacttcttggatgtgactacatgaaattttgatgaaatatggtcataaattatgatgacaagttagttttgggggattttatatattaccagataccaatgccagaggaagagctatgttaggggtcctcagagccaccccaggtgagatgatgccctaggaggactcacagggctcatcatatggtcctactcagggctctgattcattacagtaaaaggatgcaaagcaaactcagcagagggaaaggcacactgggcaaagcctaagagaaaccaggctcaggcttccaaggatcctgtccccctggagccacacaggacacacttaattcctcccacaaggagctgggatgccatgtgtaaaatattgtctaccaggaagttcgtaacagaccagcactagggcctttgggggctttgggggcctttgggggcctttgggggctgaagaagtcagacttcttcagagaaacagaatttattggatatatataggtagatagatgagtggggatttatgctggggattcactccctcaactatggaggctgaggagttccacgttaggccttctgcaagctgctgagacaggggagcctgtagcatggctcagtccaagtctgaagggctgagaaccgggggagctggtggagtaactctgagtccaagaccaaaaacctggggggctgctggtgcaagtccctgagtgtgaaggccagagaacctggagatctgatgtccaaggggaggagaatataggactccctactccaaaacagagagagagtgaattcaccttttttctgcctttttgttctagccaggccttcggccgactgaatgatgcagtgagctgaaatcacaccactgcacttcagcctgggcaacagagtgagactctgtctccaaaaaaaagaaaaagaaagtcatatattggtacagaagatactcttaaatcctacttttctggaaatattggttattatagaagatataggactaaattcattttaaaatttttattttgaaattattattacaaatgttttatgaatcatattagcatataggcaagttttggaaagccaaagttacaaaccagggattcagatgagtgttctgtgaaatttttaatttttgcagaacaccatgagaaattacacattttctattctatatttcttgtaggaaatagaggctgcccatctctcagtgccacatatgagaaagggaagttgtcattttatatatccactgtcaagcatcttggtaaaacagaagaaagcaggctgggcctggtggctcatgcctataatcccagcactttgggaggccaaggagggcagatagcttgaccagcatgggcaacatggcaaaatcctgtctctacaaaaaaataaaaaaaaacaaaaaataaatgtagtcccaggtactgaggaagctgaggcaggaggaacacttgagcctgggaggtaaaggcttcagtgagccgtgataatgccactgcactccagcctagacaacagagtgagaccctgtctcaagaaaaagaaaaacaagagggaggcaatctactttatacccagagaattttacatgcaaggaatttgactatgaataagcctccattgcttaagagagacttcactatttgggattttaagaaagaaatacacaaacaagcaaatctcatcagcagaggactgagaaaccagtgtttataatacccagtgattaatgtaatattgtcttcagtcatcattaaaagggacttagtttaaaagtcatttcgattgatcgccaactcagagtcctcaacatttcaccttttgctttatgaaaagaactagtagattaatttagagtttgacaaggagaagcaggtctcccttgattttctgtttggccaagaatttatcctaacatggtaccatcagaatactgtcagaaagctgtgagtcaactcagatttctcaccattgagtcaagccgtgaagccagctgtcttgggggtaaggatttccatacagaaacactgtaagtaaataatttagcacttgtttcctattcctttttattggataactacagagaattaaaactgtgggttgttttgaattcacaaaagaaatgttttaaagctttcgaggaaaaagccagattatccattgcaaagcatcgaaattcaaaatcatgttaaggctatagagaaataggatcctatccccacctagtggccaacactgaaatctgggcttagaacaggaaacaagggaatttgtcaacaatttgggaatactccagcattctttacaaaaaaaagttagagaaaaagttaagcacacaaaaaacacaagtcaaaataaatacgaccaaatacataggttttggcagcacatagatttctgtggttttgctatgcttttagcagcggctgtaaaaagcattgcacactaagcattgctagattgccaaacaaacctaattacattttttgtttggttttttgtttttttcaaaacctcctaacctctgtgacctaattatgtttttaatgagttgattgtaaaaactaacatcagcgaatacaaaatttcagttagacaggaggaataaattcaagatatgtactgtacaacatggtgactctagttaataacaatgtactgtgtacttgaatattgctaagtgaataattttaagtgttctcacccaacacaaaaaatatgtaaggtaatgcacatattaattagcttgatttagccattaaacaatgtgtgtgtgtgtgtatatatatatatatatatatatatataaacatcatattgtataccataaacagattcaatttttgtcaattaaagaattaaatgaatacatatatttttgttgcacagatgtatgagagattgatcaataaagattctaaaatatttgttaaaagttacaaactgagggaaagccttcgacatcgtatttgcaagaaagaaagtgtacatagttagacagtcctagtatctgtaaagtgggtgtgatcatcggagagcaatcccttgagcagtgctgtcctatacaatgttctgctgttagggaaatgttctgtatctatccaaccgagccgccactagccacaggtggctcttgagcacttaaaatgctagcagctggtgagacgaaggggctgaagttctcatttaatttcaaattaaggcagaaccgcctataagagaaagtgctaaagaattggaaaaatgaaaaagaatttgagaacccagtgggaatggagctaacgtgtatggtcatggctcattagatttggggatatcggaatcccaacagcacaatgggctcattagaaaattaacaaggttacaaaacaggttaaaggaagtatcaaaaatagtccaattttagcagatacagaagctgcaaatttagcagtagttttggcaaaccctcaattcatgtaatttaacagtgctagggaccaaaccgaaggggaatgccaagacaaaaagcttataaacgttaagagctcatttctcttagaacatacagaaacagggcacttccacaccttcgattcattctccaagcttaaagagctttgccctaaaaccagatcctctcatacgatgggacaaacagccccaatgttcttccctccagatctgttccaacctgtgtctggagacactctgcactcacgttaaaacagtttagacaaaggacaatgtttaggaattccagaaactttgggatataacatcaatggcaacttttaattaggaaaacccaatctaataagaagggctattttgaataccagggtatgtggaggggaaagtatgaaggtggaaggttatgaaacattaatgggagatacagagaaccaagaaagcttctatggtgatttctcctgcccctgggcatgttatctgaacttacgattgcaactgtgggagctggaaaagctcttaagaacctctagaattccacttccccacaaaacaacgtaatatgaaatagtgacaaatccctaggagaatatgtaaaataacaattatgataacattgttggagaaatctgagataaagagtaggactctttaacaactcattttggccagtcaaaagggaggtggagcttggaagtgaattgtgaattacaccgatattaagaaaagcagctaattctgaagtagtattaagtggcagtgactattctaatcactttaaatatttaactcaattatgaaaaaaatgtgattagcactgtacatgatattatttccttagtagaagatcttgctaaatcaacccttgattagcattcatgcatcaatctggctgatgtatccttttcaatcccaataaattatattcaccaacagtctgccttcacttggcagccccaacctttactaagttgccagagtaaattctcccacctccgaggtacaatccattgagcaaaatttaaacagcctaaatccaattcaagaattaacattgttttattatcctaatgacacattaaccaggagtgacttgaaaaaagctgtgtccatgaggaaactttttggggtaatagaaatattatcttcattgtagtagtagttacacaatgaatatgtttgtcaaactcataaacaactgtacagctatggtttcactgtatttaaattatatctcagtaaacctgattttatttatttatttatttgtttatttatttatttatttatttatttttgagatggagtctcactctgttacccaggctggagtgcagtggcgcaatcttagctcactgcaacctccccctcccaggttcaagcaattctcctgccttagccccaagtagctgggattatagatgcgcaccaccatatccagctaatttttgtatttttagtagagacggggtttcaccatgctggccaggctggtctcaaactcctgacctcagaagatccgcccacctcagcctcccaaagtgctgggattacaagtgtgagccactgtgcctggcctgaacctggttttttttaaagcaactgcatcaaaaacctctgtcttccattattaattttatgagttaaaagaaacagactataaaagagcacaaattttggtaaaattttggggagaaaaattctgcccaagaccaggtaaaagcctttgtgcttgaaagcccccaacttgaaaaagaggaacagaaattaattggcgtgtttgaattatgaagactgcatatcccacatctgtattaaacttgggtctcttcattgaattatgtgggtccttaaaagagcctcagagctgtgctgtctaatatggtagcactagctagctacctgtggccatttaaattaaataaaattaaaattgaatttcaaattgagtttcttagtgcactagccatgtttcaagtgctcaatagccacatgtgaatagtggccaccacattaaattgcataaatgtagaacatttccatcatcacagaaagtgctcacagacttagaggccaaactgtcttagaggccaaacaggtatatagaccactggagtttaatgacttaagtattgaatacaaaattaggtggcatatgtctctgaaaattcaattggctgatatttctaaccattaaaaccatcttgagatggccaggtgcagtggctaatgcctgtaatcccagcattttgggatgctgaggcgggtggatcacctgaggtcaggaattcgagaccagcctggccaacgtggcaaaaccctgtctctactaaaaacacaaaaaaattagctgggcatgtatctggggaacccacccctaatatttcaatgcaggttctttctattttccctaagtgtcggccagtctgagaaataaagagaaagagtacaaagagaggaattttacagctgggccgccaggagtgacatcacatatcagtaggtccatgatgtccacctgagccacaaaaccagcagctttttattaaggacttcaaaaggggagggggtgtacaaacagggagtaggtcacaaagatcacatgcttcaaagggcaataaagatcacaaggcaaaaggcaaagcaaagatcacaaggcaaagggcaaaattagaattactgatgagggtctatgttcagctgtgcacatattgtcttgataaacatcttaaacaatagaaaacagggttcgagagcagagaaccggtctgacctcaaattcaccagggtggggtttttccccaccctagtgagcctgagggtactgcaggagaccagggcgtatttcagtccttatctcaaccgcataagacagacactcccagagcggctgtttatagacctcccccccaggaatgcaattattctcccagagtattaattatcaatattccttgctaggaaaagaatttagcgatatctctcctacttgcacgtctgtttataggctctctgcaagaagaaaaatatggctcttttagcccaaccccacaggcagtcagaccttatggttgtctttccttgttccctaaaatcgctgttattctgttcattttcaaggtgcactgatttcatattgttcaaacacacatgttttacagtcaatttgtacaatagtggccctgaggtgacgtacatcctcagcttgtgaagataacaggattaagagattaaagtaagacaggcataagaaattataagagtattacttgggaactgataaatgtccatgaaatcttcacaatttatgttcagagattgaagtaaagacaggcgtaagaaattataagagcattattagggaagtgataaatgtccatattaaaatgaaatcttcataatttatgttcctctgcctcggctccagctggtccctccatttggggtccctgacttcccgcaacaggcatggtggcaggcacctgtaatcctagctacttgggaggctgaggcagaagaatggcttgaacctgggaggcagaggttgcagtgagctgagattgtgccactgcactccaacctgggcgacagagaaagactccatctcaaaaaaataaaataaaattaaattaaattaaaaagtcttgatccacgttgcaaatatcctagtggtgtactaacaaagccagaggcctcctcagacagccagacacctcagaggcagacatatatgcagaggtaactaatggtggcctcacgaggaaagggggcagctactccatgagcacaagctctagatacttagccttcaaatacttcaaaaaacaaaacaatccctcggggagagatttccgagcaaaacaaaacagcccatttgtttttagactcctgctataatgctttgcctaaaggtattggccaaggcgggtggatcacttgaggtcaggagtttgagaccagcctgaccaacgtggtgaaactccatctctactaaaaatacaaaaattagccaggcatggtggcacatgcctgtaatcccagctactcaggaggctgaggcaggagaatcgctagaacctggggagcggaggttgcagtgagctgagatccactactgcactccagcctgggtgacagagcaagactccctctcaaaaaaaaaaaaaaaagaaaaaacgaaaaaaaagaggggttgtccttatttcccctttctccttcagctgactggaacacaaacatgaaagctggaattcaagcagtcatattggacctgagagagaagagctatgttgaggctggtggaagaaaaagatagatagaaggaacctgagtctctgacacttaaacactacaccagccctagggttgcatgtgagagagaaatgaacttctatcttggtggagacactgttgtttccagggttttctgtttctcacagctgaagctaatcctaaccaagcagaacaagcacaaagtcatcaaaacataaactggagtttgcaaagcacatgtcacttccaagcatcagatacagtaaaatgatgagatgtttttcccaagccctggctcaggaccctccctaacagctccccgacaagccctttgtcttcttagtaatcatgccttgcatggtgccttttccaacatcatgcccctccgtggagctcattagtaaggagcaagtgagattctttttatttatctaatcagtgaattccaaaaactgacaaacaggataaagaaggaataccagccactgttatgaatgtcaataagacatttgttcagttcaggaccatctcaatttcagaagggacctgcatagatttatttgcagtaataaatcaataacaattcagtggcaattatacttcccagtttcccacactgcatctatagcttccaggtacaagtcttagtatcttcaaagcatttgcaatagccataaaatggctctttcatgacagcaaagtggtggcaggcatttctacagctaaggggtgccgaacacgtctcatgcgtcttttctttattggtgaatgtcatgtttgacagtgatgtaaatggaacagctattatgaaaaacgtgcttatagtttagccaaagaaaatatgtaagggtaacattgtaggagggtggagtgtaaacatatgaagagtctggaaccctgatggcatcattaaatgctcaaaccaatgctggaagctgtcatcctcagatttcttatgagaaaaatgaattcctgtttattttagcccctgttttttgggttgtctgggcctgcacttgcaagcatttctgctggatgcagcaggtcccaggaggccctttcagacctagggcatttggttgcctttcccactctgtgcctttgcttatttcttttttttttttttttttttttttttttttgacagagtttcactcttgttgcccaggctggagtgcaatgccgtgatcttggctcaccgcaacctctgcctcccaagttcaagcgattctcctgcctcagcctcctaagtagctgggattacaggcatgtgccaccatgcccgactaattttgtatttttagtagagatggggcttctccatgttggtcaggctggtctcgaactcctaacctcaggtgatccgcccgcctcagcctctcaaagtgctggtattacaggtgtgaggcaccacacccggccatctttgcttatttccttttttttcttttcttttcttttcttttttttttgagacagggtctcattctgtctaccagactggagtgcagtggcatgatctcggttcactgcaacctctgcttccctggttcaagtgattctcctgcctcagcctccccagtagctgggattacagacacgtgccaccacacctggcgaattttttgtatttttagtagagacaaggttacaccatgttgaacaggctgatctcgaactcctgacctcaagtgatccacctgccttggtcccccaaagtgctgggattacaggcatgagccactgcacctggctgcttatttcttacgggatctctccagtttagagcagaggttctcaacacagcctgcactttggaattgcctggggaaattttacacaagtccctttgctcacgccccaaatgggttgaatccagatctctaagggtgagcacaggtgggcatgactatttttaacagttcttctagattagtgattcccaatttttttaaatctcaatttgaaaaaaatctctcaatgttttaagagtataaaccccttaaattactgaaaacactgaaaagctttacttacaatattgttattgatatttactgtattcaaaattagaactgaaaaagatttttaacatgtattaattctttttaagatagcaataacaggcaaggctcagtgggtcacacctgtaattccaacactttgggaggccaagatgagcagattgcttgagctcaggagttggagaccagcctggacaagatggcaaaaccctgtctctacaaaaaatacaaaaattagccgggcatggtggctggcgcctgtagtcccagctacttgggaggctgaggctggagcatcgcttgagcctgggaagcggatgttgctgcagtgagttgagatcgtgccactgtgctccagcctgggcgacagagcaagaccatctcaaaaaaaaaaaaagcaataataaaccacttttgtatatgcttaaatttgtccataataaaagtaaacaaaaaggactttaaataaattacggaaaatgtagatctttaaagaattagaagaccatcagctttatttggatcatgagtcaaacacacacacacacacacacacacacaaaacctacaaaacaatcttggaaatctgaacactgactggatatttgatgacaacaggaatgattattaaaattgtggtaacagaattgtgattacattttaagagtaaaccagtaaaatctttaacaaagacacaaggagggcccatggatccattatgtacagtagccacagtgcctagggcccacaatactcccatggcaatgtttacatttcttttaaaatagaaaaaaaattaaggttgaagaaaatattttaatatataatattaatatagttgcctgtgtatcaacacaatcataagtatgatttcaaatttattgtttagaaaagtgcatagggcccgcagaagtcacaatgcagccctggatataacggccatgaaagtttatgtgctgaatcacaaagtggcaaaatatgaactggcagagatgtcggcctctgaggttagagaggtcatggccacagctgctgaatgtgactttgggttgcccatccaggagattgggtggcagggagagcaaatgtgatcatgaaggggctggttgtatcacgctggtcaaatgcatacaaaggagtctgtttagacagaagcgaagaagggaaagcaagcggacacctcctgggggcctcaggatcccacattatctggaaacagtgcccccaacacccctccacctccaccaaaaggcatcctacatacctcttggttggtacactgggccctcagccacagaaaattggttctcagggacagagataacccaagctaagccaatcagattgtctctccatgactttgaaccatggggcccagagacacagaggtcaagagcagctctgctgagcggtgagtatccacactccagggacaaagtccatgagcccctgaggttcccagaactgctctcagtcttccctattgagtcaactctgtcttcaaatcctgagaaacccaatatttttacaatcaattccttttggagcttaagctattctgaatcagattttgcgatttgtaacaagaaaataataatagtaagtatagagttttaacagcactaaaatcaaaagtggaaaagggacagcagcatgccccagacacccgtgtgtcagcaataaccaagacatggagatggaaccaagacagcttgtcaggtccctcccctcactttccattgcaaaggctgtcagtaaagggggaattattcctttacagagcaagtattatcccactttgcaggtgaagaaactgatgctgaggttaagtgtgcaactcagaagcaaagcatccctgacaagctaagggaaggagaactctcagttggaaatacagagaggcccgctgccagctagaatcagtgccacctttggccctaagtctgctcaacccacccaaaactagaccacctgccactcaaactcttttgtctgagtccctctctccccagggccccaatcaaacagggtgctatttctcatcttctccctaaccctaatgtctctgaaacatgtttgttgggtttggggtttgtttgtttctatagatttgcagttctaaaagtaaggaaaacctgcaggtattaatacaaataaccacaactgggaagggatggaattataagaaatctctcccagcattagtaataccagtatgccttatttcatgaggagagcaggccgattacctgacccaacaatatagcccaggcccgggggagatgtgaacacaatgaggaagatatctctatgacccacattctttggcctgaggctctgccggagtccaagcctgttataggtgaagtggccaagacctggaacatgacctttacatgagctgctgtacagccagtgtggcttttatctgttgtactttgggaaatcatccatgcctcaggaaccaaaagtccttcaacctagagtaaggcgtttttaatagaaagagaggccagataggccaggcgcggtggcttacgcctgtaatcccagcactttgggaggccgaggcgggtggatcacgaggtcaggagatcgaaaccatcctggctaacacggtgaaaccccgtctctactaaaaataaaaaaaaatagccgggcgtggtggcgggcacctgtagtcccagcttctcaggaatctgaggcaggagaatcgcttgaacccgggaggcggaggttgcagtgagccgagattgtgccactgcactccagcctgggcgacacagcgagactccatctcaaaaaaaaaaaagagaggccagataatcccagcactttaggaggctgaggcagggggatctcttgagcccaggagtttgagaccagcctcggcaacatggagaaaccacgtctctactaaaaatacaaaaaattagctgggcatggtggcactcgcctgtagtcccagctactcaggaggctgagggggaagaatcacctgagcataagaagtcaagcctatagtgagccatgattgcaccactgcatgctagcctaggcaaggggagtgagaccctatctcaaaaacaaaaaacaaacaaaaaaagagaggccagagcgaagtacacaaaatggattgacctgctcctgccaactgagggaaagccagacagggtgatatgctggctctcgctgaagctgagagctgtgttcattctaccatcctggccgtgtggggagagccctaaaggagaagcccatgtagatatccttggtctttattcaaggactagcaggacaggtcttccctactgagatggcagtctgctgtcagtgccagttcccatgaaactactctgaagatgaaagaaaagataacagaaggccagttataagcacttaaggtgacttctgcttactctaggtttgagttgagaaacatagctatggcctacacatgtacagtctgtgaactgcacagctcgacagaaagaagctccagtgtggccctgatgctccctgctgaccacaccacacttgcaggaaaatgggctaaacaaccacaaaacaaggtggccaccagctactacacagaaacttatttctgaggcagctggagccctttgtttgtttgtttgtctgtttgtgatggggtatctctctgtcacccaggctggagtgcagtggcaagagcatagctcactgcaacctcaaactcctgggctcaagtgaacctcctgcctgagtctcctgagtagctgcaactacaggcacatgccaccatgcccagctaatttttaaattatttttttgtagagaaaaagggccgtgcgtgatggctcatacctgtaatctcagcactttgggaggccgagatgggcagatctcttgagcccaggagttctagaccagcctgggaaacagggcaaaatcccatctctacaaaaaatacaaaaactagtggtacatgcctggagacccagctactcgggaggctgaggtgggaggatggctggaacccacggaggtcgaggctgcagtgaaccttgatcttgccactccactccagcctgagtgacagagaccctgtctcaaagaaagagagaaagagagagagagaaggagttttgctttgttgcccaggctgagagccttgttttgactcactccctcctctgtctcatctccacccccacctgccctggtccattcaaaactacaaacctcagcatgcaagacagccaagggagggcaagaacagctctgtgtagcccatggccttctaggatatgtggtgctcccaggtacagtgatataagtggtctgtaagttatttttattttatttcacaagttattttttaaccataagttacagatgctaaaaatataagcccaaagctgaaaagcagctccaagggtgtgacaggccagaggacccaccccacagccctccctctatacatgatctcccacgcggtggctcacgcctgtaaccccagcagttgggagaccgaggcgggaggatcatgaggtcaagagatcaagaccatactggccaacgtgaggaaaccccgtctctattaaaaatacaaaaattagccaggcgtggcagtgcacacctgtagtcccagctatccgggaggctgaggcaggagaattgcttgaacctgggaggcaggggctgcagtgagccgagatggcgccactgtactccagcctgggcgacagagcgagactctgtctcaaaaaacaaaaaaaaacatgatctccctgtgcgccccatcccaaaccctcctctccttcgccaccatgccagcgcacaattccatcatatcacttgccttttcaaacaccatctatgactcttagtttttgggttcaagttcaactccttccataagcagtcaatacttttcagaatttggcccctccaacaagagtttatgttctgccccaatcaaacccaaagtagttccctaaagcctctgcctttctcttccctatctcctcccaccccacccagaagcctccattgcccaccagccaatggagacactgccactacccacaggcccagaggcctgggcacttgccctgttcacacccagccccaccccaaaaccccgcctctacagccctgcccttaaacccctcccacccttccttagagcctggctctagctttctggaggggaggaagaagttagctgccaagagaaggctgtgggcctggcctcctcaacagcaacttggcacagactccctcgtgaaactgttagatggggttggttggcagcactgtgtaattaaataggcttttgtggattggcctggggacttagccgccgtatataaatgttattcgagtgactgtacagcattgtttccatgcagaaaagccctcggaactcagagcatctgaccaaacgtgacctttgggaaagtcctcttgctgttcggggggcgacctctgcgggtttggctccagctgcagaaagagcgccaaagaaatctcaactccagcccggctaggctgggagtgggtgcgggagaaacagatggggggcacctatttagatctgatcttctcttaatgtgaccctgagagggagggaagggggtgtctgaagcccctgggccttggatattgagatggagagcatgggtgatcccagaaaacctatccaccaccggacccctgacagatgagatcaggggcttcttcctccattcggccttcggggtcagggggttcagcgggtgacaagggagaggcgtctgagggaccgggattattcagctgacccggtgcggggccgcgttctcagcgcgggcactagggggcggcagaggcggaggcgccagcgccgaggagaggcttccaccctcgagaagtttttccgcgcacccgcccgggccagagtggccgtctagacgcccacgtggggcttcctgcgatcgagaatgggttgggaccgggacggccaagccgatgctgtcggggacacgctgggaggaagaagtacggggaggaggggcgggggcgcagcctacccgggctcgggctcggggtgaagggcagccctgccaggcccgccccgaggccgcggatgcgaaaccgggacacaaaggcacgcactcttgattctggcgcccgcgaggaagagggttgaggaagaggaaattgggatgaggccctggaacacgttttaatgcagcgccctgacaggcaggagccaggcaatactgcttgggaatgtgaagccccatgggcaccagctagggggtcccggctgcgcggccagccttggaagagaggacttcttggacacctaacccggagggagcagagcttctgagtgcccaggagagggaggctagggaagtgggggacagtcaagagtggggggacacaggcagggactgtgcgactccacccaacacaaagactcaacgagtatgcacgtgactacacgtgagtgtggagggcttggccacagccctgtcttcatgacagcacagcacaaggctgatggggagggataaggtgaccagaggtacagatgcagtaaatgtcttggaagtgggcctcagcctccccatttacagagattagactgggctatgtagcaccgtcccacccacacccagaagcaatcgcacacccgtgtcagaaactggagccatagggaccccaaacccctacctggtgtccctggggcattgtttgtaattttatgctagtcacccaggctttgtaaactctgggccctgacaccccagctggacagggcttgcagggtatctggattaagccatacaattctggtaaccacttagctgggaagaggaagcatcagatgggtgtcgggggagactgaaataacaacacaagcagtgacacagacacctgggaggagacaatcacattatttaaccatcagtcagcatggaagctgggcacagggtcctgggagtcccttccatatgccacacattaaccctttaattgcaggatcagggaaagtgaggggtgcccaggggagggacaggggtggcaatgaacatactcagtggctcagggccatggcaatttaccagccaatatagaagaattttaatattccagccatctgcgggatgcagccctgcacacaccccacactattccgtttcttccctgggggagcatcctggccctcaagtagcaggcagtgcctgccaaacccagaccaagtggaagagacagtgggcacatgggccaggcagccaacacctgtgggttagagagccccaccctggcagagtcagagccctgaggccagggagaccacatattccaactttcacagtgggtgcgacaggtgaggtgggaggaaggtgggagggaggtggggttcagccctgaaacccccctacacacagtcactgaggaaagtcctgactccaggatgtgggtgccggagcccacccccgagacccctgtcttcaacatctgctgatttttgttggcgtttctcttttttgttattttgctttccacactttaaataattaatacaattacttttaaatacaaaatacgccatgtcctttctcttctcttccatttgtttggggtgattgggaggtgagttttaaataagggtctcagctctctaacgggtaacaggctccaggtgggagggccaagagccccagatgccactcctcccgtggggtgtccaggcaaccacttcacccctcccctggcctgccccgactgagggctctccacgccctggcccagggctccctagatagtgaggagccctcttgggaggtggcacagagctgatgttgtgggattccaggtgggcctggttccgaatggacaggatcagacagagacggtcctatcccatgaagcagacaggccccagcagcacccctccccgcctcggtggggctcccaggtctgagaaggaggcatccagcactggcagctgctccagcacaggcgttcgcacctccagcaccgtccggccttgctgtgtcttcagggggagacaaggaagaaagtgtgagcaggatggaggcaccccccaccctctaacctcaggcccaggctcacctctcctctgagcaccttggccccatcagggtgactcaggatgtacagactggcagtgtctatgtgcccatgcgtgtgtgtttgcttctcccccaccgtgtgcctctgctgggcagccatgtgccagtctgtgtacacgtctgcattaacctgtgtgacgctggtgtttgtacccaagtgaacctcaccc

SEQ ID NO: 1099 - DNA, 26778 bp, Homo sapiens
agagtcaacaggcaacctacagaatgggagaaaatttttgcaatctacccatctgacaaagggctaatatccagaacctacaaagaacttaaacaaatttacaagaaaaaacaaacatcatcaaaaaaccctcatcaaaaggtggacaaaggatgtgaacagacacttctcaaaagaagacatctatgcagccaacagacacataaaaaatgctcatcatcactggtcaccagagaaatgcaaatcaaaatcacaatgacataccatctcacaccagttagaacagtgatcattaaaaagtcaggaaacaacagatgctggagaggatgtggagaaataggaatgcttttacactgttggtgggagtgtaaattagttcaaccattgtggaaaacaatgtggcgattcctcaaggaatttttagttctagaaataccatttcacccagcgatcccattcctgggtatatacccaaaggattatacatcatgctactataaagacacatgcacatgtatgtttattgcggcactattcacaatagcaaagacttggatccaacccagatgtccatcaataatagactggataaagaaaatgtggcacatatacaccatggaatactatgcagccatataaaaggatgagttcatgtcctttgcagggacatggatgaagctggaaaccatcattctgagcaaactatcacaaggacagaaaaccaaacaccgcatgttctcgctcataagtgggagttgaacaatgagaacacatggacacagggaggtgaacattacacacaggggcctgtcggggagtcgggggttgggggagggatagcattaggagaaatacctaatgtaaattacgagttgatgggtgcagcaaaccaatatggcacatgtatacctatgtaacaaacctgcacgttgtgcacatgtaccctagagcttaaagtataataataataataataataataataataataataataataataaagaattcttttttttttttttgagacagagtctcgctttgttgcccaggctgtagtgcagtggtgcgatcttggctcactgcaagctccctgggttcatgccattctcctgcctcagcctcccaagtagctgggcctataggcgcccgccatcacgtctggctaattttttgtatttttagtagagacggggtttcaccatgttagccaggatggtctctgcctcctgacctcgtggtctccctgctcggcctcccaaagtgttgggattacaggcctgagccaccacacccggccaaaaaagaattcttaatctgtaaaagtaataatagaatggtacaaaaaattggaaaatttaatagaaaggttgaaaaatgtaatcaagaaaatctcactgacatttaaaaagacatggccaggcgtggtggcccaagcctgtaatcccagcactttgggaggccaaggcgggcagatcattaggtcaggagatcaagaccatcctggctaacacggtgaaaccctgtctctactaaaagtacaaaaaattagccgggcatggtggcgggcgcctgtagtcccagctgctcgggaggctgaggcaggagaatggcgtgaacgcgggaggtggagcttgcagtgagccgagatcgagccactgcactccagcctgggtgtcagagcgcgattccgtctcaaagcaaaaaaaaaaaaaaaaagacaatgaaatgtaatatgtggtagaaaagctaaaacagagaatagaccaaggaagtccaacctcaggttacagagctagagagaccaacagagaagatgaagggagaaaattatcaaaacaaataataagggaaaaatttccaaatatgaaggacccaattctttaaatagaaagatattgccaggtattcatcaaaattaatactcatcttgaaatatatcattttcaaaatttcagagcctcaagggttaaagaaacatcataaaatattccagtaagggaaaccaaaatgaaactgacaacagacagaaagtcggactcctagatgcttctattaagataataagaaaggccttgaagttctaatggaaaattatttttattaataaatgtagaccttttcggcctggcacggtggctcacgcctgtaatcccagcactttgggaggccgaggcttgcggatcatgagctcaggagatcgagaccatggtgaaaccccgtctctactaaaaatacaaaaaaaattagctgggcacggtggcgggtgcctgtagtcccagctactcgggagactgaggcaggagaaaggctgaacccgggaggcggagtttgcagtgagccgagatcatgccactgcactccagcctggggacagagggagactccatctcaaaaaaaaaaaaaaaatgtagaccttttcaaaatcacaatcaggcacagagaaagaataaaaatactgttggatatgaaaggacataaattttacctaccacacagttttattagaaattgactaaggatattacttagtaaagtgaaactgttaatcaggaaatgggaaggtaaagaatccaggaaactgaatttaatgcaggacctcactgaaaagggatcctactatagcagttccttggcaagcaaagaatgtctgatacatgagtgatatttagaaaatgatgaacaattttttcaacttttagaattaagctacgagcaaagcccaaggatgcttagtgttacagcagaatgtcaaaatggtcagctttgacgatattgaaaaaagggtgcatgtacctcattttgtcaagtggaagcataaagtggaggggaaaggaagggtaacaatgtcaataactttcatcttctaagacggaggaaagagacattgcccatagttaaggaagaagtcacaaagatcactacatttaaattacatttgtaaccaaaagaattatgaaagatggctcatgaattaaagcagggttttagaaactgtattattattcagtcacaaaaagtcttcagcctaacccccagggagttctgaagctgtaagagcctttcagagttggcccaaattagggaaagggtttaggacatttatacccccacactgaccagtcattataggtggattcttcctgggaagtggagtaaaatccgatgaggcaggtttcatcacctaaggcaattccaggggatggctgacagctaagggcagtcagccagcaacattcccagcaatgagagaataaatccttcagtcccaaagggaggcaggtagaacagaacagcatccacaacagaaacagtgttctagttcctgagaatacatatatattcatgtggaagaaaacaaacaaataaatgtatgtttgttgttgttgttgttgttgtttgagacagagtctcactctgtcacccaggctgcagtgcaatggtgtggtctcagctcactgcaacctctgcctcccaggtgattctcccacctcagccacctgagtagctgggactacaggtgtgtgccaccacacccagctaatttttgtatttctagtagagatggggcttcactatgttggccaggctggtctcaaactcttgacctcatgatccacccacctcggcctcccacgtgctgggattacaggcgtgaaccactgtggccggcccagataaatgttttttttaaattcatcatctctttaaaaattaaaaatagaactaccacatgatctggcaattccactcctgggtacatctgcaaagaaaatgcaatcagtatatcaaagagatatctgcactcccatgttcatcgcagcactactcacaatgggcaagagatggaatcaacctaagtgtccatcagcagatgagtggataaagaaactggtctatatacacaatggaatactattcagtcttataaaagaaggaaatcttttacatcattatgttaaagaacctgggggacattatgttaagggaaataagccaggcacagaaagacaaataccacatgacctcacttacatgtggaatctaaaaaagtcaaaatcacagcaggtggggaaatgggggtagtagggagggcgacaaggaggaatgagaaaatgttggtcaaaaggtacaaagaagggcaggttgtggtggctcatgcctgtaatcccaccactttgggaggctgaggcaggtggattggttgagcctcgttcaagaccaactggacagcatgctgaaactctgtctttacaaaaatacagaaattagccaggcatggtggggcatgccagtagtcccagctactccagagattgaggtgggaggatggactgagcccaggaagtcaaggctgcagtgagctgtgatcataccactgcattccagccagaactaggccctgtctcaaaaaaaaaaaagtacaaagtttcagttagacaggaggaataagtactggagatcgactgtacagcatggtgactacggttaataataatgcactgtcatttctcagcatccatgagagattggttccaggatcctctctgtataccaaaatctgagaatgctcaagtcccttattaaaaatggcttagtttttgcatataacctaagcttatcctcccatatactttaagccatctctagattacttataatacccaatgcaatgtaaatgctatgtaaatagttattatactgtattgttttggaattggaatttttttattgttatattgttatttttcatttttttctatgtattttcaatccacagttgaatgaatcagaggatgtggaacccacagatacagagagccaactgtattgcctatttgaaaattgcactgggcatggtggttcacgcctgtaattccagcactttgggaggccaaggtgggtggatcacctgaggtcaggagttcaagatcagcctggccaacatggtgaaaccctgtctcgggaaacccctgtctctactaaaaatacaaaaattatctgggcatggtagtgcatgcctgtagtcccagctatttgggaggctgaggcaggagaattgcttgaatcccagaggcggaggttgcagtgagtggagacagcaccaatgcactccagtctaagtgacagagcaagactctgtcccaaaaaaaaaaaaaaaaaaggaaattgctaagagagattttaaatattcataccacaaaaaaagtgaagtgatggatatgttaattagcctggtttaatcacatgtatcaaaaagtcatgtagtaccctgtaaatgcagttatttgtcaattaaaaatgattaacgagtttaaaattttttcgaagtgtaacatttttaactttttcttgttcaaataaagttttctgttttttaaaatcacctcttaacttccattaactcaattgattcaccctattaacttaagaactctgttccttaagttaaacatttcatgataatcaggaagggcaaggttatgttgcaacaagatcttaacccacagtaaaaagtagatctcagtggcttaactcaataaggagacttaatttcacagttattcaagtgactcaggttatggagtttccagcatctcatacaccaccatgcacctacttgcaagttccattggctactgtcagtcaaatgaccccaacttaacagcagaaaagacggaaatatacaggagctttggaatactggcaagcaccactgtctccaaaagatatactgttattatctaaggtaaggacaaatgctcaggactggtaggtttttctctagaacacctacacactttcctccaacttatatgatgattaagactcagttctttgtgttagcaaacttatttattatcggggaacctgccctgataatcaagtaggttcttttttatttttcctaagagtcggtcggcttgagaaataaagagacagagtacaaaagagagaaattttaaagctgggcatctgggggagacatcacacattggtaggatccgtgatgccccacaagccacaaaaaccagcaagtttttattagggattttcaaaaggggagggagtgtgcgaataggtgtaggtgacagacatcaagtacttaacagggtaatagaatatcacaaggcaagtggaggcagggcgagatcacaggaccacgggactgaggcgaaattaaaattgctaatgaagtttcaggcaccattgtcattgataacatcttatcaggagacagggttttgagatcaaccggtctgatcaaaatttattaggcgggaatttcctcttcctaataagcctgggagcactacgggagactggagtttatttcatctctgcagcctcgaccataagagacggctacacctcgggggtccagttcagaggcctacccctagctgcgcattctctttctcagggatgttccatgctgagaaaaagaattcaatgatatttctcccatttgcttttgaaagaagagaaatatgactctgttccacctggctcactggcagtcagagtttaaggttatctctcttattccctgaacgttgctgttatcttgttcttttttcaaggtgcccagatttcatattgtttaaacacacatgctctacaatttgtgcagttattgcaattatcacatggtcctgaggcgacatacatcctcctcagctgacaggattaagagattaaagtaaagacaggcataggaaatcacaagggtattgattgggaaagtgataagtgtccatgaaatcttcacaacttatgtttagagattgcagtaaagactggcataagaaattataaaagtattaatttggagaactaataaatgtccatgaaatcttcacaatccacgttcttctgccatggcttcagccggtccctccgtttggggtccctgacttcccgcaacaatttatacaggatgtacttgtaattctaatgaaattatccattaaagatcatattatccagtgaaatttgggtgcaaaaaaatagttgtttctatgaaactgtcaatggaagaaagagaagaagattttgaccctctcattaataaagaatctccagcatgtgctcagtgtgacgatgttgaactgtaagaattatagggcttatgcttcaactagaaaaatcagatctcgatgtctccctaaactttgagtctggttcaatccccagccctgcctcttccctttgcagggtcaaaagcaagaagccacatgaaggggtggcctgcccctccacacctgtgggtgtttcttgtcgggtgggatgagaaactgagaaaagaaagagacacagagacaaagtatagagaaagaaaagtgggcccaggggaccggcgctcagcatactgaggactcacgccggccccagtctctgagttccctcagtatttattgatcattatctctaccctctcggagagggagatgtggcaggacaatagggtaatagtggggagagagtcagcaggaaaacatgtgaacaaatgtctctgcatcataaatgaggtaaagaaaaaggcgctgtgcttttttgtgcacatacataaacatctcaatgcattaaagagcagtattgccaccagcatgtctcatttccagccctaaggcagttttctcctatctcagtagatagaatatacaatcgggttttaaaccgagacattccattgcccagggacgagcaggagacagatgccttcctcttatctcaactgcaaaaaggccttcctcttttactaatcctcctcagcacagaccctttacgggtgtcaggctgggggacagtcaggtctttcccttcccacgaggccatatttcagactatcacatggggagaaaccttggacaatatccggctttcctaggcagaggtccctgtggacttccgcagtgttttgtgtccctgggtacttgagattagggagtggtgatgacttttaacaagcatgctgccttcaagcatttgtttaacaaagcacatcctgctttgttaaaccttgagttgacacagcatatgtttctgcaagcacagggttggggatagggatacagattaacagcatctcaaggcagaagaatttttcttactacagaacaaaatggagtctcttatgtctacttctttctacatagacacagtaacagtctgatctctctttcttttccccacagctacacatagagactgaggacaccctggacaacccagcacatgctttccccatttccccaaaagtggcactcccttttgatccctatggtcaatgacaatgcccaccctgaggaagaggacaaaatcagcacaaaacttttgactccattcagcattctgcttggggaaaattcagaccataaccctggggagcagaatctcaagtgttggtgcctctttgtgcgccagtgtccctgtctgaggacctgcatgacagcctggagtacaggagatgaacgtcccaaggagacctagttctccactctgacctcatccataagaaggaagagcctgccaaagactcctcacgcccagtgtgtgggtgagggagaaaggaagatgggatgtctgctttcagggtcatggccttccataacctcgcagaagctcccagactctgtcttcatgatgaaactcagagactgagatgtagaccagcttcagggctgggcccacatcaaaggggccacagtgtgtagtgacctccctcataaccgggaaaagagtgtcatcaggaatcaacaggttacaacgtcaatgacaaagggagctcagacaaggagtggaatgactgtgaacaggtacccccagtgagggaccctagaaccagagggagctctgccatttgtcctgtgggctccacaagaaacaaactgccccttacacccctccactgtgaggacaggctctggaggctgaagtgctccacatgactggtgtagacatctgcacactggaagtcatttccaggaccacaaggatctggaaaatccagtcctccttcctaataagagcgatggacacaatgctggctgtcagcatcccgtgcacaggacaatgtgtttgagaggtgtgcatgttacccaggcttggccaatcagaatgtttcctaaagttgtcaaaactctggtagacaagtctagaaacatatataacagagacagacaaacagacacacacacaaacacacacacacacacagagagagatgaggtaagatatgaagtgataaggaagacaaatacagaaaaatagatgcaaaaagaaacatgaagatagaaaaaatgcagataaatagtgacaatggattagaaaaatagaaagaaaggcaacaatgtagtgaaagacaacaagggcacagagacaaagatgcagagagacacgcagaaagaactatacaaggacaaagagacacagagaaagtgagacagatgcccagatagagacataacagaaagagaggtgaagatctcgttgaatatctggaactagtaacttgtgaaatcaacttgactctaggcttcctttgtaccatgaacaaaatatatttgggcttctatcatttagactcaaaaatagtatttttattgctggttatgctttcttaaaaataaaaaatattcttgatcgatgtgactttccagaatgtttgaaacaccagtgaccaaggatcactatatatgtctccaaacaattctaccatgcttatttacacagcactcaccaaaccagaagagaggctgggatattctaaggccaatgcactgagcatcagtattaaagaaccatgaatgatgcgacaattgaattattttctacctcctctgcccacccttacttcacaccccaaaatgctttcagtgtcttttcaaggtacaatcctccttctggccacaggtttgctgggtcacctcaagggatgttccttcattctgcagtgatttcctgcctcttctcaattaagaaagttcagaatacagataactcaggatcatgtttaattatgtaaaaaagctctaaagtcaggtaatgtttttcatgtgcttctcttgagcagtctgaggaaagaatagaaacagaaaccccttgggacctgagtagacgcagctggccatgcacaggcagaggctctgggtcagtgcaggaagcagagtcacagccagcgccttggggtggggatgaaaggagatgacctggtggctgcgtgacagccactgtaggactttgatctcagggggacaagctgacacaggcagctgggaattctgggcaggcataagcaggcatcacagaagagtgataaccaatcctagttaaaatagtctcaggagtcagtgcagaagccctggagaagagagaagagcattgatcagcacagggtatcctggtgggcctgccatctcccccacccttcaggggccccctgcagcttcagacagagaaagttgaggtccagggtgtattgtcatcacctcccccaagatctgtgcaaaggtgaaatcagctcatgaggacacagaacttcagcttgatgcagatgtgtgggaggtggggaacagctgttattcttctggggaatatgaagggttcagtctttttaggaaattggatgatatctcttcccgaccactagcagcctctttcagtcactggaaaatgcttacaggcagtagccaccatcatgtggcacaaagtgggcatcatcctagtgtctaacatttaagctgtggttctggctccacatttcacaagaagatgccaccaaagttaaggcttggttctggggaacaatgtctggagattcctagaaactggcaaacttctcccctaagtcttgatcctcatagcagcaaataggccatgaacatggaccactgtggtcaggtacactcagctcatgctcttccctcttatacctgtgcctccccacactggatcatggctgaaatattacctgctggtggaggcccttgaggtcttacaaaaggaagttatgcagagaaaggtctcattacacaaacagccactctctcaccccaaaggaaaatgacacacatgacttagagttacattctcttcccacccatgttcttccaggccttcagcaccctaatttaaaatcccctaaaacaaaggaaattgtcactagaaagaaaggaagctgaggctctgaccctcttaatggaggaagcttttggaaaggagccagtgagacaatgatgaatggtaaggatgccctggaataagctctatcagtcagctctgtgacagcgctacctttcaaccagtaaaatcagattccaatgcctcctcccatcttgtcctgtctcctcgcacttcttctcagggtcaggaggaaagagctaatctacagacaggaccactctgaacagagggtctgggtcacagcccatcttccccttttcccctggggttcctcacctttctgactcctttgacggatgataaggcccagcccaaggaagatcagccccagcacgaagcctccaacgccactcagcatcttgctctgggcagattcagactgagcccctaaagagcagaactgagtgtctgtgtttgtccccacaccccatagcatccctgctgaggagttgaagtccagtctgaggtgcagaaggtgaaggcatcaaaggaacctagttctccattcagaccacccctaaggaggggaaagaccagccaataggtccttggatacagtgaataggtgagagagtggggaagcaaatctctgctcttcaagaactcatccataaccttagaccctaagatcccagtcaccagccctaagaatcagtccctcagagctatcaggactgggattcagagcaacagtatgtagagtaatttccctagcatctggaaaggtgatgagaccaggattcttctgatgcacttgccatggagcaagaggtgctctagtctcctgtgattcccagctcagtagtgacatcagggataagagatgggaaggaatgggtcagaaggagctctttgtcttgtgggcccatagtaacagaaactcaatatccccttacgccactccacggtgatggggctctggaggctggggtgctccacgtggcaggtgtagacatctccacgctggggagtcatttccagcatcaccaggatctggaaagtccagtcaccattcctaataaggggggtggacacaacgccggctgtctcctcctgatcattccgaaaccaccggactttgatctggcctggatagaaatctgtcaccgagcagaccagcaggttgtggtggttgagggcctctgtcctggatggggagatggtcactgtgggctccactgagggcagtaacagacaggaaaagacataggagtgagatgtgagaacacacaccacgtctaccatgaggaaggatccctccttggaccagagtggaaagatacctggagtcgaagtcttggattaaggttcattcaacaaatataaatttgacaatcactgagaattcaaagataaataacatactatggtccctgcatttatagaatgtgcaatctagtaacagacagcaaaaaacaaaaagaatgttatttcaaaagtttgtaatatttgaaaaaaaagtagaatgttatttcaaaagtttgtaatatttgaaaaaaaagtaggcaggccttcaaaacaaataacccttgatcaaacatcatgtttgtccacaactcaattcctttatcttctcagattgctgctcatagtaaaaaaaatgacacatctttccccgcctcttttacacatctcatcctttccttttaggccactttatcacatttcctttattctcttagtgtgaaactatagcaaatatttaatgtgtgctttctttatttagtaatatgttctctcattttctttttttccttaatttctttttaacgcacaagtgagtttaattactagctgtctaccctactccatttccttgctattgacaattactttcttgttctgaaatcagacattatcgtgtatgttctccacagaaaatattctgagatccgtgcagaggtcggcctgggctaatgagcctgtaatgtgaacatatacatataactgggatttgctgaggtcagcaggtggcaccccaattaaatggcactcttgagccatcatccggaaggaatcatggtttctgcttggacttgaacttttctttaggttctccttcctggaggccaactgaaatcagagtcagctatgtggccttataagatttgttcatcttcaacagactgggagtaaaaatagagggcacaaatttatgagaaaagatgataaaataaattttatggaaataaaactgaaatagcaaaaatataagtacttgctggcattaggatgtgagtcaaaagaaggcaagggagtgtaaagcaaactaaaagttttgtgaacctgcatagataacaccggggtcagactagggattgattaatcatgaattttcaatgccgcattaacacacagaacaaacaggaatagactcattgctgcttctggtcaaaactggctttaacaaggccttacatcccttagactctacatatgtgtagtgaggaacataagaatgttgtgtactttgggaggcttaagatcttggtgagtaattgtgggctgattacttaaagtgtttatcatgtaccaatattaggatatataaagtggtgatgctaatctctaatgcacaggtagctgtgagattaaatgacataacatagatggtatttgataaggcaactgtctagaaataagtgcttcctgaatgggtaaaattgactttcagaatgtttattcctgaagtggatagtgatgggggggaggggataacctaggccaaaagcaacctgaaactatttttatccaataatttaatagcttcaacctatttattcccaaacttctgatctttgcatagtgctatttgttcagcttttctaagaaattaaaactctgccttacaacatcattcaagcattgtttttatttttagcaaacacattttcctcagactttgtattcacaaattctattaagatccaagtcagtaagagtttacttgaaagcattaagcaaaatgttagaaaataattgataaagttcatttgtaagcctctgtttttttcttgaacctaactggattggcagctgagtacatttattcatgaatttaacagaagatcattgagctcacaccacataccagtcaatgtgtcaggtaccaggcatgcaataattaaacagtctctcgcctcaaagatctccgccattagtggtagccatttaagaaaacagaattacgatgaataatgatttgaagccaaaaagtcaaaatatcttatttcgcaactgtaattgctggatgccctgcgcgcagctgtggggcagccctaactccaccaggccaagcctgaagcttcctgcggcgcaagctgcgcacgtgggccttgctgggtggggcagtgctagcgaggccggcgggcaggggaagagggtgggcactgggggcagagagaactgcttagcgaaggtaaggtacgaggaggcaaacacataaggcacgaggcgagaaacgtgcagagcggaggacgaggccgacggacggggaggctgggggggacactaggcagcctggccaactctgcttgtccccctgctctgccctaggtccccgcccctccgatgcacctgcccccaccaccccgccgccgcctcctttcccctggggtggaatgaactgggctcagatttcagagacctcgcccccatcgcccctcccggcacagaaactcggggtctcggccaagggtgggcctcacggaggggcgacgacgctcacctctcctctgcaagatcccgcggaacgccacctcgtagttgtgtctgcacaccgtgtccaactccgcccgggtcccctccaggacttccttctggctgttccagtactcggcatcaggccgcccctgcggcgtcaccgcgcggtacacccccacgtcgctgtcgaagcgcgcgtactcctctcggttatagatgtatctggtcacaagacgcacgcgctccgtcccgttggtgaagtagcacatgcccttaaactggaacacgaaatcctctgcggggaatcaccggccggtcagtcaggccccagcccggccgcccccgcagccgccgccctgacccggcctggagctgtggaaccgcccgcgcgacctccagttcccgcccgcccgtgcctggcgctccagacctgggatcctcccggcggctctgcccagctctgcccgccttctttgcgggcttctggaatctgccttcctacatccaggaaagggaggaaagccctgtccctgcctgagcctgtgaacccagcgaagaggcagtcgggctgattttacatgcacctctgcacttagagggatcagggcgttctcgcatgaaatcccatttttcatgaagctcctggatacctcagagataaagttatccacataaatctgagagttcaacggaatgacgagataggtccaggaattaagcctggcctcgttctgacacgcgtattctcttggtccctgggtaaaataccttccttcccatgcctagatttaccctcccaagtcccgttgaggttcactcccttctatgttggaaaggacctacacctctgagtcctagatagagacatttattcatggaaagagcacaagcttttgaatttgataaactagattccaattaaactgtggcagtcaccagtttgggcaggttatgtaacagaatatccatatcacaagtataattgtgtaaaagaaaatcatgatatctacacacaggatgttagaaggagtgagagagaagttatataaagtattgttctgtctgaagtgagtggtttcacaatatgtgttatttcccttctttacatcctccttcctactaaattcagtccaccattaactcgggtctctgaatcccactcaagtcaccatttgcccataaatcagtgaaacccgaagactccctctctgtggtcagccagtcagcttccctcagcaccaagattttgcctccacaaatgctccactcggtcaggaatagagacaaattttcctcaaatacagagactacagacaccattgctgcctcacattttccaatgcaggatctcataatcctaagtccaggcagtcttggggcacgcctaaatgacaaatcctgctgtgtctttggagaaattcatatcttcaaaaataaccccatgctcactttgtcctatcgctggtagtaaatgtacactttatctcctctttctctcctctctcctcctcttccaggcttaagcctgtaggatggggattggattgtcctcatctcatcactaaaagataaatgggaatgcaacatagctttctttcccaagagagaggaaatgttgatgaaagattgtgtccaagatcatagagatcaccatcccccataccccagcccaaggagagcctgttcccagagtggcggctctggagagcagctgccctgcacttaccgggagagtctctgccctcagccagtagggagctcagcatcgccagcatcaaggtgacagttgctacccgaaggtctccggggatccgcaaagccttcttccaagacataactgagacgaagggaaaagcagtggtagtcaacacagctcggacctgatggatctgatgtacctggcagaaagaataaaaacctgtggatgtttccgtgagtggcaggattggatggtccctcggaaaagaaccaatcagcactggagctgaaggacctcatctgtctctgggcagacattttttttgtgaaggttctcaatccagtgcctggcactgtgacgtcttcaaattgtactggatgaacatctgaggtgaaaatttcctctcgattatagaagagctgaagaacgaatgcctcggggattttgagaggcaaaagaaaaaaatgcgattcaacagtaaacatctctgtaatattgttaaaaaccagttgttattatacttgggatttttaataaagcaaattaggtggggatcatatttcaggggagagaaaattgctgtcacagaaatttttactgctgttgtcttagacacgctgaagagccttaagtcctggggagaagagcaaagttcttagaaggaaataatggtaagttgcagttccaccactaatgtgctttagaagagtcaacaaattactgaatttatttttgccccaggcttctctttataaaatgtgggtcatgtttcatgcattttacatctagatcttcacatgtacaaatttaagattaatttgtcttgtttaatattacaaaagtctcctcaactgttatgtgtaactatcaggttaatatgtggaacaagaaaacaagccaaaaaaaaaaaattgatacccacccctgctggtaaatgattcttcattatgcaagaacatattgtatttatgctcttctagtgaaagtatttgaaaagttaattaagttgacatttcttttttaagttcttcagctgtttaaatcctccctgaaccatgaaatgatgcatctgatatcagcaaaggcacaatacacagaattttacagtattcggatgcagtcatgtttcgttttgaagagagagcacaaaacctgtggagaagcatttcctgggtcctgaatagtactaatgatggagaaagtgtttagagtcacagagtgtactgtgccagccctaaacattaaatcccaaatggcagaggtatcaatgtgtttttttttcaattctatttttttaacagttcctcatggacatatctacatcaatgtgtttttataaataaacataacttatcaggctcctcttgacagtgactaggggcaatactaatggttataaagcaattagaacaacgcctggcaaacattacttctgacctcaaccaagacaataaatatctccacttctcttcttctctccctttctctctttcttttcccaaaatgttaggttctgcttttaaagtagagaatacaatctaaaatcagaatataagtttatcagataaaaagaagcagggaagaggcaacagcaagacgtttgcaatagtggcacatgaaagcgttgagccactccaatattctgtattattcagtgcataattctagagcacctgagactgggaaagttgccactgggcgtccagcagcagtggtgtactcaggatcagggtaaacccagtctaaggagggtctccactgctgtgatggacgcataaaggaggaaccaaatgcacacctggaatggagttggggcaaggaagaataggcagagagacctgaaggtgccctcaatgtccttcctcagcccctacatcagtgcgcctcaaaatagaggtctctaatccatcctctccttcctgtctaagggaaaaacttcccgcaggtttattctgaggcaaaggctgcgtcatacctggggattccccagtctcacaggcctctttgcacagacttttcagctagcaacaagtgtcactttagagcctttttctgattggctaaaacctcactggaaaggttttgctttgggcttctgccagttgtgtctgcctggcccagccttctctacagttgactaccctggccctatccctgctgcattattcagggcattcaggcagaaaaaggccagagaagaaagaaactaggtcaagcatccttattccgagtgtctcacctgaattgcctgcccagcctctgtggaggcagagcaattaaagcatttactccatatgggtaaatgggctaaaaagtcactgccattagtagggagggtcaggattacattagggagactgtctttaggggacatcctctcttccttcaggttggaagaaaaagttgtggactcctttgtgaaaatcaagggagaaatcatcttctctggtcaacatctcttggaatctgtgcttggtcagtggagttgaatgtgaacataggagccattctgtcaccagaaggaccatccaggaccctaccctgcatttacttcaggaatcaagaatcactgtatattctgaaaggttctgtggcttccttaatgccaatggtaataaaactagaaatgctgcccccagaatattgttttcctttaattaaaatttatcaagcaattatccttaaatttttaaaaatctttgtgaagcttcttacatatttctcttatatcaacttctaggtaaccagctatatataagaatttttcatggcacatataaactaggtcctttctcttggcacaaagttatctctttaaaatctcagtctagagaatctgaagaaagagccaaatcagtagcattcaggggctgtgttcagacagtgcctcccacaagcaagtggccatggtgaaactccagggtggaagtcatgtcagaattggaggatgatggagcgtgaaggagtaggagtatgggaaaagctttagcaggaaggtagaaaatcaggtgatacaaagcatttggaacatttgagggcaaatgaggaacgtgggtgatcttggcacagaagcccagacctcaccagtcccacggctcctcatgctctatgaaaatagcccttgaagaccgaagaagactgggacaaaaacccaagctgcctgctgtgggtatgctgtacaatgaagctttgtttcctgatctatcttttcaggttcctttttcctgtcagtctcctcatccacgcattgcctcagttggaccactggtgattaaacctcccagagctagcctacacatgtcactctttccaacacacctctgcctgtctctacttctggttccctagtgatgcctgggatatttccagagacagctcttcccccagcctctagattagtagtcaccatgctccttcattcccagaaaaaatttaaatatttctctgtgagatctttataatgtctcctttttctgtaagttcttaccagtaaagagaggccctaatgttcagccacataaaaatatatgtagttcttgagtacttaaatccatatccaagtactcaagaactcatgtgtccaagaactcagctcaaggccatggttcatgcaaaacagcaacatcagcagtaatattttggggagagtactcttatatcatcaaataggaaaacttaagatattccatttaaaccacaatgacatatcacctcacatcagtcagaatggctattatcaaaaagataaaagataacaagtgttaaggatgtagacaaaaggaaacatttgtacactgttggtggggatgcagattagtacaaccattatggaaaacagtatggaagttcctcaaaaagttaaaaatagaactatcatatgatgtagtaatcccatttgcaggatgtagacaaagtatttaaaattagcatgttgaaaatatacctatactcctatgttccttgcagcattattcacaatagtcaaggtatagaatcaacctgtgtcattcagtggatgaaaagataaagaaaatgtggtatatatacacaattaaatcctattcaggctttaaaaagaaggaaatcctgttgtaagtcaaaaagtgactgaggtaggtctcaatcaattaaaggtttattttgccaaggttgaggaatacacctgggaaaaacacaaaacacaggagcatctgtgatccatgcttttgccaaagagggttttgagaacttcagtatttaaaagagaaagagcaagcaggaggggaaggagaaaaaaaaggaggaagagtaggccatgatacaagtggttacattcctgagtctttgattagcttaagtaaatctacattttacctgtgaaaagagagtagaagaaaaagttaattataaattatcttatgctcagtaaatctacattttacataaaattaagggaacttgaaaagggggaaggagtagaggaaacgaggttatgacacggggttgtgaaattaccgttatctgtttgggaacaaaaggaagacagtattggtgcttcagtcctcaagattaactttcccttggcataatgagtttggggtcccaagattctatttttctttcacactgttatttgtgacaacatgcatgaacctagaggacattaagctaagtgaaataagccagacatggaaagacaagtaatgcatgatcttacttatatgaggaatctaaaaaatcccatttttgaattgaattgtttattttattttattttgttttatgttctagcgtacatgtgtaggacatgcaggtttgttacatgggtaaacgtgtggcatggcggtttgctgcagctatcaacccatcacctaggtattaagcccagcatgcatgagctatttatcctgatgctgtccctgcccctacccctcacaggccccagtgtgtgttgttcccctccctgtgtccatgtgttctcattgttcagctcccaattattagtgagaacatgcagtatttggttttctgttccttcattattttgctgaggacaatggcttccagctccatccatgtccctgcaaaagacataatctcattcctttttatggctgcatagtattccatggtgtgtatgaaccatattttctttatccagcctatcactgatggacatttgggttggttccatgcctttggtattgtgaataatgcttcagtaaacatacacatgcatgtatctttataatagaatgatttatattcctttgggtatatacccaatgatatggtttggctgtgtccccacccaaatctcaacttgaattgtatctcccagaattcccacatgttgtgggagggacccagggggaggtaattcgatcatgggagccagtctttcccatgctattctcataatagtgaataagcctcacaatatctgatgggtttatcaggggtttctgcttttgcttcttcctcattttctcttgccgcagccatgtaaaaagtgcctttcacctcccacaatgattctgaggcctccccagtcatgtggaactgtaagtccaattaaacctcttattcttcccagtctccagtatgtctttatcagcagtgtgaaaacgaactcatatagtaaattggttccaggagtggggtgttattgaaaagatacctaaaaatgtggaagcaactttggactgggtaacagacagaggttggagcagtttggagggctccaaagaagacaggaaaatgtgggaaagtttggaacctcctagaaatttgttgaatagctttgacaaaaatgctgatagtgatatgaacaataaggtccaggccaaggtggtctcagatggagataagaaacttgttgggaactggagcaaaggtgactcttgctatgtttcagcaaacagactggaggcattttgcccttgccctagagattcgtggaactttgaacttgagagagatgatttagagtatctggcagaagaaatttctaagcagcaaaacattcaagaggtgacttgggtactgttaaaagcattccgttttaaaagggaaacagagcataacagttcagaaaaactgcagtctggtgatgcagtagaaaagaaaaacccattttttaggaaaaattcaagccagctgcagaaatctgcataagtagcaaggagcctagtattaatccccaagaccatgggaaaatgtctccaggccatgtcagagaccttcacagcagcccctcccatcacggaaccagaggcccaggaggaaaaagtggttttgtggaccaggcccagcgtccccttgctgtgtgcagcctagggacttggtgccctgtgttccagctcctccagccatggctgaaagaggccaatgtacagctcaggctgtggcttcagagagtggaagccccaagccttggcagcctccatgtggtgttgagcctgcaggtgcacagaagtcaagaattgaggtttggaaacctccacctagatttcaggagatgtagggaaacgcccaaatgcccgggcaaaagtttgcttcaggaacagggacctcatggagaacctctgatagggcagtgtggaagggaaatgtggggtcatagcccccaaataaagtccctactgagacactgcctagtcgagctgtgagaagagggccaccatcctccagaccccagaatggtagatccactgacagcttgcactgtgggcctggaaaagccacagacactcaaagccagcccttgaaagcagtcaggagagaggctgtaccctgcacagccacagaggcagagctgcccaagaccatgggaacacacctcctgtattggcgtgatctagatgtgagacctggagtcaaaggagatcattttggagctttaaaattgactgcagctgggtgtggtggctcatgcctgtaatcccagcactttgaaagaccaaggtgggcggaccacgaggtcaggagattgagaccatcctggctaacacagtgaaaccctgtctctactaaaaatacaaaaaagttagccaggcatggtggcaggcacctgcagtcctagctacttggaaggctgaggcaggagaatggcgtgaacccaggaggcagagcttgcagtgagcagagatggcgccactgcactccagcctggacgacagagcgagattctgtctcaaaaaataaataaataaaaataaaaataaataaaataataaaataaaaaaatttgactgccctgctggatttcagacttgtgtgtgccttgtaacccctttgttctggccaatttctcctatttggaatggctgtatttacccaatacctgtacctccattgtatctaaaaagtaactagcttgcttttgattttacaggctcataggtggaagggacttgccttgtctcagatgagactttggactatggacttttgggttaatgctgaaatgagttaagactttggggaactgttgggaaggcatgattggttttgaaatgtgaggaaatgagatttggagtggcccaggggaagaacagtatggtttgtctgtgtccccacccaaatctcaacttgaattatatctcccagaaatcccacgtgttgtaggagggacccaatgggaggtaactgaatcatgggagccagtctttcccatgctattcttatgatagtggataagtcgcacgagatctgatgggtttatcaggggtttctgcttttgcttcttcctcattttctcctgccactgccatgtaagaagtgcctttcgcctcccgccatgattctgaggcctccccagacatgtggaactgtaagtccaatgacacctctttttcttcccagtctcgggtatgtctttatcagcagcatgaaaacgaactaatacactcagtaatagaatagttgggtcaaatggtatttctggttctaggtctgtgaagaattgccacactgtcttccacaatggttgaactaatttacattcccgccaacagtataaaagtgtttcttttttctctgaagccttgacagcatctgtggtttcttgagtttttagtaatcaccatactgactggcatgagatggtatctcattgtgattttaatttgcatttctctaatgatcagtgatgttaggcttttttcatatgtttgggtgctacataaatgtcttcttttggaagtgtctgttaatgtcctttgcccactttttaatgttctttttttcttgcaaatttgtttaagttccttgtagactctggatattagacctttgtaagatggataggttacaaaatttttctcacattctgtgggttgtctgctcactctgataatagtttattttgctgtagagaagctcttcagtttaattagatcccatttgtcagcatttgcttttgttgcaattgcttttgatgttcttgtcatgaagtctttgcccatgtctatgtcctgagtggtgttgcctagattttcttctagggtctttatagttttgggttttacatttaagtctttaatccatcttgagttaatttttgtataaggtgtaaggaaggggtccagtttcaactttatgcatatggctagccagttctcccagcaccatttattaaatagggaatcctttccccattgcttgtttttatcaggttttttgaagatcagttggttgtagatgtgtggtcttatttctgagttctgtgttctgttccactggtctgttttcgtaccagtaccatgctgttttggttactttagccttgtagtgtagtttgaagtcaggtagcatgatgtctccaactttgttctttttgcttaggatgattgtcttggctaatgggcttttggttccgtgtgaatttttaaatagttttcttctaattctgtgaagaatgtcagtggtagtttgacgggaatagcattgaatccacaaattactttgggcagtatggccattttcatgatattgattttttgtattcatgagcatgggatatttgtccatttgtttgtgtcctctctgatttccttgagcagtggtttgtaaatctctttgaagagggttttccctttccttgttggctgtattcctaggcatttactctttgtagcaattgtgaatgggagttcattcatgatttggctctctgcttgtctgttgttggcgtataggaatgcttgtgatttctgcacattgattttgcatcctgagactgctgaagttccttatgagcttaagaagttttggactgagacaatgggattttctaggatctaggatcatgtcatctgtaaagaaagacaatttgacttcttctcttcctatttaaatatgctttatttctttttcttgcctgattgtcctggccagaaattccaataccatgttgaataggagtggtgagagtgggcattgttgttttgtgcatgtgtttaaggggaatgcttttggcttttgcccattcagtatgatattgtctgtgggcttgtcataagtgactcttattattatgaggtatgttccttcaatacctagtttattgagagtttttaacatgaagggatgttgaattttattgaaggtctttcctgtgtctattgagacaatcatgtggtttttgtctttagttctgtttatttaatgaattatgtttattgatttgcatatgttgaaacagcctggcatcctggtgatgaagccaacttgatcgtggtggataaactttttgatatgctggtggattcggcttgccattattttattgaggatttttttttattagtgtccatcagagatattggcctgaagttttctttttttgttgtatctgtgtcaggttttgttatcaggatgatgctggcctcataaaataagttagggaggagttcctccttttcaattatttggaatagcttcagaagaaatggtaccagctcttctttgtacctctggtggaattcagctgtaaatctgtctggtcctgggcttttatttttgttggtaggctatttattatgcctcaattccagaactcgttattcgtctattgagggattcaacttcctggttcaatcttgggaaggtgtatgtgtctaggaatttcttttagatttttttagtttatgtgcataaaggtgtttatagtattctctgatggttgtttgtacttccatggggtcagtggt

SEQ ID NO: 1100 - DNA, 50143 bp, Homo sapiens
gataaaactcaaatacacaaagaaaacccatgcggacgtggggagaacacacaaactcctcatggacagtggccctggccaggaacctatttattttctcaccaacattgtaacaaaacgttgaacaaaacaatgctgtaggaggaccctctgtgtttctcacagtcctggaggctgggaagtccaagatcaagatgctgacaggttcaattcctggtgaacttagaactgaaggctctctggcaggggtgccttgtggctgcaggctgggtatagaaactcaggctccccactaggcctccacttacagaatcctgactgggagggagagggtctcatcagcgctcccacatggcctctactgacaccaggaagggagaagtgcctccttacacctggacagtggtgaaagtcccagctttctacttggcctcctctgacaacaccttggcaaagtgggtgaggagtgcttccttgcaacagggcaggtggaagtccaggctcttcacatgggcttcactaacaccacagtgtggaggtggctgattactgataggcaggggcaaaagtcctaggtccccagttggcttcctctgacataagcctgatgggtctaggtagtgtctcattatcgccaggcaatgggataagacaaagctcctcactcagtgtttgctgactgaggcgggatggaagcccctgatttttctgtatttgactggagtagtgcggttactgtcagttatctgcctggtaggctgctctttcttgttcccttggatagagaaacatgctttccttaggatatttttgtctgtgactactgatgtttcctgttttccagtttctccagcactcattcctggatatattaggcagaaagaagacctatgaaactcaccactctgtcattccccaatcccatggtctgaggccaacctgcttctcctctccatcattcaagggctttttatgtctgtctgtagctgtacttagcaggaggaataggaagaattgtacctacttcatcttgtcttagaaccagaaatctctcaccatattttttaaaatatgtttttgtcatatattaaaatattatacctctatccttagatccttaaataaacatataatgtatccttagagttaagttaatttggtaacaaaaataaaacaagactaaaactattaattatgttaaagccataaaaatatgcaaattttttcccaaaatatgggaaatgtgcgtgtgtgtgtgtgtatctcctatgtatacacatataccatatgacatatacacataaaaaaagacataaaatgaaaattgccgatgtatcaatacccgggggcagggagtattctcaggtttaactaaatactcatattcaagtttttaccataggccacacctggctctcagattcacttagaaggatattagacaggagtcaaagtatgccaaagtgctgaatcaggtctttttcttcagtgggagaagttcttgaaacagtctataatttattccaggtgctagtttcatcctctgcccccatcccccaagtgacaactcaggtacaaggagctgaatttacacctgtggaagttgtgtccaccctagcttagaatcctcatgtcatctacgagctagtacctcttataacaaacccatgggcacagcttccagagtccctgtaaagggcatgctcagttacaagggtcactgcatttggaaatacccaaactatgggtccccgtcatttgttacggttcatgaaatattcttcccagtaaagatacaaaatgccaaccagaagccatttgtgccataagcaatgttgtctaaaaatccagctgacattcttcctccatcaggtttccagaaaacagctagaaaattagcctaagattaaatacatcatggagaagtagaaagggtgttataaagcatttatccacaagattcaaaatgaaatacagttaattttgtccgttttaagacattatttcaaccttcaaattatttaaaagaagtacatcctatattttgtgtgcttattcaaaaaaggcatggtaatacttataaaaagactttaaatatttttataagttttaaatattttataagtaattttataaataaaattacaaaccatttaagtgacctaattaaatcaaacacactttgagtatgcacataagaaaaaaattagttgaagcatcctgacttaagaaatccttgatctttcataaggtgtctgaatactcaatgtcaaaaacacttatgaagaattaaacactgttgaccacaagagggaaacctagtcccagttatactataaattagaaaatcaagggaaaaatatgtgtcctgagaacttttgaaatagtcacatataaacatagtatacaagaaaaaaccaaccgtcatccctacccaaggacatgtttgtggtatgagtggttttagtgttttgagtggactggttcttggactccacatattattggctacagagatagagacttgatttagaaaatcacagttgccactttctaagtaagcccttgaccaaaagactagatttctttaaacccagttttctcaggtaaaatggaaatacaactattatctaataaatataagtaagctttagtgtcatagtcatagcagtagtattttcaattggtaaaaagaaactggaccccaaaaaagaatttcagtgaaagcagtaacagtcttctggcatatttctcacctttctttctaccttaaaggttcaaagttcctaagtaatctcagaaacctaaaatagtttattctctatcctcactattggtttttaaaaaacattttgcagcatggaccactgctcgtgtacagatgctctccaacttaacaatagggttatgtcccaataaacccattataacttgaaaatatcttaagctgaaaatgcatttaatacaccaataaacccatcataaagttgaacaatcataagccaaattataagtcagagaccatctgtattagcttaagtcttggaatggtttattttttagatgccatttagccacttatattctcttctattttattgtgagaactaattcccctcttacattctgtgcttgacccatgctatacttagtgtgaacaagagccaccttcttctcatgacttctatttttttgtgaaaatttccttcactcattcacgacatttggatttgaaatcttacctacttaagtactttaaaaaatcattttctaccatctttcttatcaggaggctctagtgattccttctccacacttctaacttctcatcttcacactccttgtcttcctaacttcactacagtaagtgttttacatgtttagaactcagctcctttactatgattgctaaccatgtaccttaaataaaccatcttctagttttttgtttcttactctcaattataccttttagaaaagaattaagagtagaaaaagactgctacatagacattcttatgatcttcagaaatgagcacagatcatgcttaatgaaaaaagatttccaaacaatgctgcatatgtccagagaaaaggtggcagaaatgactgtcgtttgggggcactattgtctggacatggccagttctcagaactccagtccctaaattcccttctaactaaaggaaaagcctcttaagggtcttatagaaatcctgccactttcacctgaaagaataatcttcagttatgtggcacatggccaagagtaaaagtctttagtcacttggaagcagacagacactgtaatgctaaataattggacataacatggaacttactgaggcctcaaatatcaattttactttgggaaaaagagcagcatccttaaaagtgattgaaagtaactcaagtttattccttaacagagtgatgcttaatctaacaaaaaacatgttatatgcacactcttctccattaccttgtaagaaaactggactaggaaacacagctgaaatggccagttctgcctccatttcctaaaccgtgttataattatgtctatgtgaccagtaacagacaatgaccatgatttatactttttcatatgtttgttgttttgttttcaatgtttgtggtctttcctcagtatcagctaagaggccattaacacagatatctgtttatggacatgcgacactgttgttcacctcttttgcagaattcataaagaaatgatggggaaaacacatcaaagatagagtggataaagcaaatgtgccacatatacaccatggaatactatgcagccatgaaaaagaatgagttcatgtcctttgcagggacatggatgaagctggaaaccatcattctcagcaaaataacacaggaacagaaaaccaaacactgaattttctcactcataagtgggagttgaacaatgagaacacatggacacaggggcctgttgggggggtggggggcaaggggaggagagcattaggacaaatacctagtgcttgaggagcttaaaacctagatgacgggttgatgggagcagaaaaccaccacggcacatgtatacctatgtaacaaacctgcatgttctgcacatgtatcccagaacttaaagtagaataaaataaataagtaaataaggaatgatgggacaaacaagtttctgttattgtctctctactgaccaaagggtggtcagagagtataggatgaagcagatttgtgatatccttgaatagatctgctctttactatgaattctatcatctactcccagcgtatgtgggaaagggaccaacttacttgcctggaatttagtgaaattgttttctagggggaccaagagtttcctctacttgatatgaagttgggtggttgaagatgataggattggcttctgcttccatcagaatcctaaagggcagggtatatggactagttggtattggatcttggaaactgtgatgcattgggaatggtcacactcccagagtttgtggacacaaagaatgttttagtgtcccctacacaccagacacgggccatgaaggaatctgaagagcctaccaaaccttgcacaagagaaaagctttacttggaacatcatccaggctcagagaacacaaatatttcatttccagtaagacgtttctggtctttttctcttcctccccttccctgaacctaccctagatgagctatggcctcaaagtgccagtagaacgtaagaaggaaggagaaccacactcattcctgccttcaacaatttacacagggatagaaagagatttatattaaatcaagttgggactttcaattattatatagtaccaaacaatctaattgctgaactaagatatacttgtgcaatttaagggaattgtagaatagcatattaattagaatcaagaaaataattcatgaagtatgctataattcctacccaagcgcaggggaatagcatctctaatgaaattctctaaagaggcaagagcaggcacaatgagtttttgtttgattaaagattccatttagtgcttatccaacctagcaattacatttgtatgcttcagatgttttaaaaaaataaacaaaagaaagtaccttaaataaagaataggatcaaatagtatttaaacaattgagtaaattaaaaaattatatgaattagattgattgaaattgatactttcctaattctcctccttcaacacacagacacacacacacacaacacgtatgcatacaaacacatctgaattctataaaatcattctgaccttgatgagattccatagtttactcatgcaacagaacataatgtctaaatgaagtttctggtctctgttttacatggatgattgagtaaaatcattccctattcctggaagaatagctaagaaaggattcacaggtgaggacatgcgttttttcagaagatgagaacaaagatgagaagatgagagcaacagaatgtcctatatcctaattctctgtgctgacttcggagtggccaatatgatagagatggaaggaactctgaaaacaaattgccagaatttctaaggaacaggagatgttgagtgagtgaatcaagccatggactggctgtatgggggcagctattagagacaactacccttagacttctttggtgattggtcaagctaatcttttccttcagagtctctcaattataagacttagcttgtgccatttagaacagacaagaacacagagaattatagaacaatctgactacaggttctcaagttaaagcaatgaaacttgtagttggccggcaggaaaatattctgagatgtggattcaaagtttctaagtgtgcacacgtacacacacacacccctacctgcatgcattttgtaatttacaaagactagtcaagtaaagaggggtaatttcacaccccaggaggtctgtataaagataactctggtctttaaagcatcaggtttcaggtagaggtgaagagagaatgaatcaaactcaaactgccatcctcccaggttaaagatgagtccagtcatcgtggaggcctctattaacacaggacatgctaggaaggcccattaacccactgccctagcacatttgttaacgtcctagtgcatttgttgatatcaacagttcacagtttttattctgatagggatctattccagcagaccagcttctgtgacctctcaggatgagaaaaagtaacacaagaaaagcttcttatgtagtgaattgagaaggaaatacctagatcaatattccctcagcacctctggtaggaagtccttagtaggagaaaaacaccatgaagacccttagtgcagaaggaaaagggggtagggggtggtggaagggaagctaaaagaaggggctggaggttctcagaattcaaaccacacaaacaaatgaagtattgaggtcccagacttgatctgggcccagtgtgaaagccctaacttatttctccagaagaatatgtcctctggttttagacttggcactgtggggagaaccagagtgatctatggtggatatacacacaaacatagacacacatatttgcatttagtaatttttgtaaaatttccatttgcttctctgatcctgtctgtatctttgggaatagatgtaagaatattacatctctcaggcttgctctgccccaggtttctgaacatggaatacatttctccagtgaaactcagtattatgagatttgggaggtggaagttaggccacagccatctcagggacaggtttcacagacatgagttttggcagcagccttgtgttctaaagacatttactcctaggggctctagaggatctgcaacatcagcagaggcttcctgtgggttcctgatcttttaaaattaggggtctgcagtgacttgtgctcctccagaccccctaacagttttaagggctaattccctgtaatatattcagttctgcttagactgattacagggattcctatttcttgactgaattctcatggctatagtgtctcgtcaccatttgacatcaccaagaagtcctcattcaggtgcctttggaaattccctcaaacacacaggaaattagagtttgaaagaaaacggagaaccatgagcactgtccaaataggaacttctctcctatcacagagaaagggaactgaaagtcatttctcaagtgtcccaaatttagtaatctcacaagaagaaccaatcagtgttctaggactaaacagtgtcataagttgctgagcaacaacttggattgaagatgctattataatatatgaaatgtctttgaatttaccatgtttttctcaagcaccatttaagaacaaggcattatggcagccagcaaagggcagacatagaaaattatacatggttttgcctctaaaagaggagatgacaagcttaaatcataggatcagactcttagcacagactgataccataggctctcatctggcccattctcctgactctttaactttcaggaaaggtattcctgaaaaattgcaggagagaccatgctgtaggtctctttctagcgatctaggagttaatgccacagtgtgttcaaagccctttgatgcgatcagataatcagtaatgtatggaatatttgtgttcataacttgtgagaacggctgcatggcaggacaagaccccagcacaacagtatggaaaatccaccctaagcagacatgtcatgactgatgttgaacaatggactcaccagccaggcacggtggctcatgcctgtaatcccagcactttgggaggcagaagcaggcagatcacgaggtcaggagatcaaaaccatcctggttaacatggtgcaaccccgtctctactgaaaatacaaaaaaaaaaaaaaaaaaaaaaaaaaaaaaattggccgggcatggtggcgggcgcctgtagtcctagctactcgggaggctgaggcaggagaatggcgtgaacccaggaggcagagctttcagtgagccgagatcgtgccactgcactccagcctgggcgacagagcaagacttccgtctcgaaaacaaaacaacaacaaaaaaaaacaatggattcaccatccgatgggctccctcactgccaggtcactcttcatggaagtatttgtattccagtcctttctgtggaaagaaattaacattctccttttcataacactgtatcttcagaaacaagagagtcgaagtctcctaattttcaggactgtctatgttgaacatcaaaatatattctttagagcagatctttaataatcatatgacaaaagaaaaactttcataatcttatgacatgagggaaggaatattaaagccgttctgtgggttattatctctaacgttcccaatagaataggctttgccagctgggtgtggtggctcatgcctgtaatcccagcactttgcgaggccaaggcgggcaaatcacgaggtcaggagtctgagaccagcctgaccaacatggtgaaaccccgtctctactaaaaatacaaaaattatccgggcatggtggtgggcgcctgtaatcccagctactcaggaggctgaggcaggagaatcgcttgaacccgggaggcggagattacaatgagctgagatcacgccaccaactccagcttgggcgacagagcaagactccgtctaaaaaaaaaaaaaaaaaaaaaaagaataggctttgcccactatactctctcatattcattgacctgaatcctcaaatgaggtgtgtccattagtcaactccaatctcttgtcatatataagatggtagagatgagaagaaggtagctcctttacagcccactatttccactaactactacctgtgtttcaagatacagcctttcatccttctccagtgttgagagtgttgaacctcagagtttctcctctcattttctctaaatgagatacaatgccagccatcccaagctcttggcctgagttgatcatcttgaagtctaggactccaagaagcatgaaagagcttctttagtgaagctatgtcctcagtactgccaaaattcagacaatctccatggcctgacaatttaccttctatttgggtaatttattgtcccttacgcaaactctccaactgtcattgcacagacatatgatctgtatttagctctcactttaggtgtttccattgattctattctcactaatgtgcttcaggtatatccctgtctagaagtcagattggggttaaagagtctgtccgtgattgactaacagtcttaaatacttgatttgttgttgttgttgtcctgtttgtttaagaactttacttctttatccaatgaacggagtatcttgtgtcctggaccctttgcaagaacccttcccctagcaacagatgcgtcatctcaaaatatttttctgattggccaaagagtaattgatttgcattttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaaggtaggtgctgagggaatgaaatctgggacgatagactacgaagcattggagaaaagacctatggacatttggaagataatgtgtggagtgaaagaatagtgtgacaggtattatgtggtctcgacagaaagtataacaaattgtggtttggtggagttcttccctcaccacaaactgaagtaagtcaaatttggtttagagggtcaaaactgagttgtgtattgatgaatagcaaggtcctgctacaagccaaactgggggtgggggtgggggtgggggaggaagaatattttctggcaagcattaacaagttatatttctgggctttaattattctttctggaaaattagtaaaattaaaaactaaaaaccacacatagttttgctagaattaaatgaaaaaaaaaaagttattagccctgttcttatctgaatacatgatacagtagttattttttggagtgtaaatcctgtcggtatatattgagcacatatattgtgttgaagattactagaaggaaaagtcatcaaaaagcaacaatttaccccaggaaaaggggagggaaggcatgctgatatgagttgcctcatgggacagtgatagccattccctgccttcccatctccatggtacagcagatcttatatcatgttaacttagtaatatttccaagagagtagaaaaataagtaaggaaatggggaatctgatattattctctctcatctccagagcaacattggtgctgttgtaaagatgtactgtagaaaagtattcttcacccagcgtgacccccacagaaggtgtcaggtagacttgaaataagcaaagtaataacccagctcccatacccatagtggcaattgtagatttctattgccccaaaagagccatacatagggatacttacctagaaagacagaggatcttcccttggtttgtgaagaggcagctagtatatttgtgtgtgtttgcatagatgcaaacggtaaataaattcctaggtttatcaatacacagtcaaacattaaaatctctcatcttggctgggcacggtggctcacgcctgtaatcccagcactttgggaggccgaggcgggcggatcatgaggtcaagagatcgagaccgtcctgggcaacatggtgaaaccccgtctctactaaaaatacaaaaaattagctgggtatggtggcacacgcctgtagtcccagctactcgggaggctgaggcaggaggattgcttgaactcgggaggcggaggttgcagtgagctgagatggtgccactgcactccagcctggcgatagagcaagactccgtctcaaacaaccaaaccaaaacaaaacaaaatatctcaccttatctttgaagactaaggaaaaaaaaaatctcccactcatcgatacactccacagaggcagcatactctcccagtgtagctttctcttttcatgttcattattcccttggtgttggttattctcaatgtcaatcataacagaacatcttccataataacagtcccaatttaaggagcattaagataaaaggtggaattgccaaggtcaatccagacgagaaccttctcatagaggtaaccaccgtgtgggtttggatgctgggaagcagggggactatgacgctacaaggtctcagtcttaatttttggagtacttcagtccccaggtatattttccatagatttggcccttaaataaagagaagcttctgactctaaaatgtaaacagtgcttgttacagtcttgttgatatattaagaaattactcaccttatctcatttaatcttaaaaacaaacccctgacaggatcaaaaccacagcagggctacataataggaaaactatacataaataggtagaataatctgctcaggatcactaggtaagttgctgaataagaattcaagatgtttttgatcccagagtttaaaacccaacctttcaaacagcgtttctttcttcttagagtacaatgttctgagaaagagatcctctggaattctggcctaagtgtatttaatgcccgggtaaagaaagtgagagaacatttctctttaggggctgctgctggatttctaaaaagaaaataatttctcagctagtaacatggagccaaacaacagcttcacaagactctgggttctttagccctcatctccttcaatccaccctctttataaccagtccttcttgtttttcccctcccagctttgttcagcagcatgcccttcacccagaccttgtcttgtcactcatccctactcgccatcattctttcattcctcttggcccaatctctctccactacttcctgcctacatgtatgtaggttattcatttccctctcttgattccccccacccaactctctttctccatttcttgcctttcagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatggtacctccctctctgctgcactcctggacatgggaatccatagtttgaaagtagttgcttcagctctttgtgttagattattgtaactgattttccctccaagggtctaaccttgccattaacaagccccaaattctcatgccagaggtctgagaactttatgggtttgatcctatcttgttgtgctcaagtcttgtctctgtcatccatggtctcctacgaagtcattgccctaagttcatgctgggggagccagaagggaagtccttggatatcttatacctcaatattggctcaatttcttggggagggggtgctgtcagagattgttatctgaggatgtgacatagatttctcagggcacaatttcaactactttttcagctttagggtttttagatacgtttgtaccacaattgagcatgggagggagaggggtgagcctaagcagtgatggctgatttctgtcatgtctgtcatgtgtcccccagtacctccagaggtaactgtgctcacaaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactggggtatggaccaacactcaatctcctttatttcaaggtttcctcctatgatgcttgtgtgaaactcggtgttctaactgtttcataatatctgctacaattaatataactgtcttctcctactatccagcttcctcctttttttaatctgtaattctctcaatacatcattctgtcttcctcttctttaatctatgaataacttttctctttattaagaaccctacatttgattctgagtgttacttcttcccacactcattaccatgtactctgccttatttccccccagagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgagttaggtgtggtcagaggaagacgtatatggagatatctgagggaggaaaacagggtggggaaaggaaatgtaatgcatttaagagacaaggtaggaacagatgtggctcttgatttctctttgctagaacgaatcagacattcgtatcatctggtatcccaaagcttcagggtctgtcatccctttctatagacgggcaccttgatcacggctccagtcttagaaatcatctccagtacctaaaaccattgtttcacattagaatactgagtctagggatctagaaaatacattagaatatggagtctagggatctagaaaatactgagtctagggatctagaaaaataagcctcaagatttgggcacatcctagcttgtatttcctggggcaggtcatcagttcagaagcatttccagatcctggctcctttcaggttagggtcaattcattgcatgaaatgggaatctcttagaggccaatgcctgcttttgcttctttagtctcaaatgtagtatgagaaactctaaaaaaaggtaaagcatggttgcttattatgttcagttggagagtagggtatacagttagttcatgttggaaaggttagatgaacattgaaagaattttgcaaagtcaaaggattaagagagaagaggaaggaatctgaagcaaggagctcaaaactgatcttcaactccttggtaactatgtgtgtcttgctataggtgatggtgtttcttagagagaagatcactgaagaaacttctgctttaatggctttacaaagctggcaatattacaatccttgacctcagtgaaagcagtcatcttcagcattttccagccctatagccaccccaagtgtggatatgcctcttcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaatttttggtgtttaagccagttctttgggtggcggtggggggtggggagtcggtcctggggaatatatgtgatcctttcccggtaaaatatctgaatgttgaatttatcttataaattctagaattcatcagacatatcccggttcatttgggcttggtctcattttgtgcatctgcaggcaaccctcttgttgtggtctagtcctcatcaggaaaacctaaagtgggattggtttgttgggagatctctactgagcaatgatataactctatcttcagtagagtgaatctgaaaccccaaggtatggatctcagaatgcatgggatggaggggagcagatggggttagagtggggagaaggaagacagaagaatccataaacattgcaggatttacatatcaacatcgttcattccagatttaatgagcaaagagattggacactgaagactggccttacccattctgttagacatagtctcagatgcctattgtattaccgagagagtagtctgactgattcttgaaaccaccttatatttgaagatgtgtctttgagtggaaaagctgagtgaaatttggggttggggagaaagatatgacattaagatgagaggaaggaatatttgaaacacgatgaactgttgctcatttgtctataaaactatgacttgatatttatctctaaaatagtttctagaacctgccataaaccactaaggtaaactattcatgatagtgtggtagactgcaaataaatgctgttgaaatgagttaggcttgggtttcatcttggctgtatcatttactagctatgttttcactggtatcttacttaacttagcctcacattactcatgaaaatactggtgttaatttttactacattgaattaatatcagaattaaaaggaaaacgcaagcaaagtaattagatacatgcttagtgataataaaatattgcaaaaaattatacattctgttgtttttctcaaaatttctatagagtgatgataaaaatctaagagaagctaaacaaaacaaggataaaccaaagcatcatgaccttctaagccttactaataaataagaagtttctcggctgggcacggtggctcacgcctgtaatccagcactttgggaggccgaggtgggcggatcacaaggtcaggaaatcaagaccatcctggccaacatggtgaaaccccatctctactaaaaatacaaaaattagccaggcgtggtgataggcgcctgtaatcccagctactctggaggttgaggcaggagaatctcttgaatccgggaggcagaggttgcagtgagccgagatcgcaccactgcgctcctgcctggcaacagactgagactccgtctcaaaaaaaaaaaaaaaaaaaaagtttctctactgttggttcagagaatcaaagcagaatcttgagactactgatggtagaataggtatgaatgtctttcttacatgactacaaactttattataaaataaatagcttaacacagagaatacactaaaacttagacaagcatggattaagaaagcaaaaagtaaacccatatactaccatgtaagaaaaccgtttttggccaggcgcggtggctcacgcctgtaatcccagcactttgggaggccgaggcgggcggatcacgaggtcaggagatcgagaccatcctggctaacatggtgaaaccccgtctctattaaaaaaaaaaaaacaaaaaattagccgggtgtggtggcgggtgcctgtagtcccagctactcgagaagttgaggcaggaaaatggcgtgaacccaggaggcagagcttgcagtaagccgagatcgcaccactgcactccagcctgggcgacagagcgagactccatctcaaaaaaaagaaaaaaaaaaaaaaaaaaaaaaggaaaaccattttaatagacttttatttttagagctgttttaagctaacagaaaaattgcagaaattgtatacagagctcccccacccccagtttctacaatgcttaacatcctgtattaatgtggtacacttgttacaattgatgaaccaatactaataattattattaactaaaattcatagttatacgagggttcactctgtattacacagttatatgggttctgacaaatacataatatcatatatccaccattacaggattaaacaaaatagcttcactgatctaaaaatgacccaggctccatctactcatccttccttcctccctctgagccattggcattctctgagctatttactattgttttgcctttttcagaatgtcacatacttgtaatcatacagcatagagctttttcagatgagattcttttgcttagccatatgcatacaggtttcctgcgtatattgtcatagcttgatagcttatttttctttaatgttaaataatactccattgtataaatgtactatggtttatttacccattaatctattgaaggacatcttggttgcttctaatttttggcaattatgaataaagctgctataaacatccatgaacagatgtttgtgcagacacaagttttccactttggataaatacatagaagggcaattgctggatcatatggtaagagtatgtttagctttgtaagaaacaactagaatatcttccaaaatggctgtatcattttgcattcctaccagcaacgaatgagagtccctgttgttctatatccttgccagcatttggtattctggggtttgggatttcagcaagaaagccattttaatatttttttattttaaaataattatagattcaggggaaattgcaaagacagtatagagacattctgcatacgccttcacccagtttctccaaatgtttatattttaagtaattatagcacagtagcaaaaccaagaaaataccttgatacaatgtgtatgtatagttttatgcatatgtcttatcacatttgtagattcatgtaaccaccaccacaatcaagcacagagctattccatatcacagagatcttcatcatgcttccctttatagccaaattccccccacacaatcaccttaacaacttaaaaccactaatttctttgctattaatctctagaatagtgtcattttgaaaatactagttaaatggaatcatgcagtatgtgactggtgtttttcacttagcataatacccatgagatccatccaagctgctgcatatatcaacaatcttttttttttttattgctaagtagtattccatggtctaaatgcagcacagtttgcttaactatttgcctattgaaggacattttggctgtttctagtttggggtcactataaataaggctgttttgaacatgtgtttaaggtttttctatgagcatgagttcatgagttttcatttctctggtataaatgtctgggatataattcatgggcatatggaaatatatgtttagtttttcaagaaactgccaaacttagccaagtatgatggcttatacctgtaatcccagcactttgggaggccaaggaagaaggataaattgaggccaggaatttgaggccagccccagcgtctacacttttttttttttttgagacagagtctcgctctgttgccagactggagtgccgtgatgcgatctcggctcactgcaacctccgcctcccaggttcaagcaattcttctgcctcagcctctcgagtagctgagactacaggtgcacaccaccacgcccaattaatttttgtatttttagtagagacagggtttcaccatgttggccaggatggtcttgacctcatgacctcgtgatccgcttgccttggcctcccaaagtgctgagattacaggcatgagccaccgtgcccggccaaatgttttgttttgtttttgttttttgtttttttgtcaggtggatgaggtggcatgcccctatagtcacagctacttgggaggctgaggtgggaggattgcttgagcccaggaattcgaggctgcagtgagccactgcacttcagcctatctgacagagcaagatcctgtctccaaaaggaaggaagggagggaagaagcaaggaaggaaggaaggaaggaaggaaggaaggaaggaaggaaggaaggaaggaaggaaggagaaaaaagaagggagggagggaggaaggaagggagggagggaggaaaaaagaaagaagaaaggaagttaaaaagaagggagggagggaggaaggaagaaaggaaagatggaagaaaggaaggaagggagggaggagaaagagaaagaaaaagaaggaaggaagaagggaaggagggagggaagggaggaagggagggagggtgaaaggaaggaaagaaggaaggaaggagaaagaaaaggaagagagaaagagaaagaaaaaagaaagaagaaagaagaaagaaagagagagaaggaaaggaaagaaggaaggaaaggaaagaaagaaaaagaaaaaggaaggaaggaaagaaggaaggaaggaagaaagaaaaagaaagaaagaaggaaggaaagaaagaaagaaagagaaagaaagaaaccgataaactattctctaattgctttgtgggagtatggccactttcatcatattgatttttcctttttttttttttttttttttttgcgatagagtctggctctgtcgcccaggctggagtgcaatggcgtgatttcggctcactgaaacctctgcctcctgggttcaggtgattctcctgcctcagcctccctagtagctgggattacaggtgcacaccatcacgcctggataatttttttgtatttttactagagatggggtttcaccatgttggccaggttggtctcaaattcctgacctcaggtgattcgcctgccttggcctccggaagtgctaggattacagatgtgagccaccgcgcccagacaatattgattcttccttttccatgaacatgatatttttttccatttatttgtgtcatctctgagttctttgagcagtggtttgtagttttccttgtagagatctttctcctccctagttagctgtattcctaggtatttcgtgtgtgtgtggcaatcgtgaatgggattacgttcctgatttggctctcagcttgactgttgtggtgtataggaatgttagtaatttttccacattaattttgaatgccaagacttcgctgaagttgttaattagcttaaagagcttttgggctgagactatggggttttcttgatataggatcatgccatctgcaaataggcatagttcaatttcctctcttcctgtttggatgcctttaattctttttcttgcgtgttgccctggccaagacttccaatactatgttggataggagtagtgagagagggtatccttgtcttgcgctggttttcaaggggaatgcttctagctttttcccatttagtatggtattagctgtggggttgtcacagaaggctcttattattttaagttatgttcacttactactcagtttattaagagtttttaaatgaagggatattgaattttatcaaaaaccattcctgcatctattgagctaatcatgtggcttctgtctttagtactgcttatgtaatgaatcaaatttattgatttgcatatgttgaactaaccttgcatcaccaagataaagcatacttgatcattgtagattagctttttaatgtactgctggattcagtttgccagtattttgtggaggatttttgcataaatcttcatcaataatatttgcctgaagttttcttttgtgtgtgtgtctgccaggttttggtgctgatcctgatgatgctggcctcatagaatgagttagagaggtatccctcttcctcaattttttggactaattataacaggaatggtaccagctcttctttgtacatcaggcagaattcagctgtgaattattctagtcctaggggttttttttgtttggtagtctacttattactgatttaatttctgagatcattatcagtctgttcagggattgaatttcttcctggttctgtcttgggagggtgtacgtgtccagaaatttatcaatttcttctagttttcctagtttatgtgcatagaggtgtttttaatattctctgatggttatttgtgtttctgtggggtcagtggtaatatccccattgtaatttctgagtgtgattatttgaatcttctctcttttcttctttattagtctaactagaggtcttttttttttattaatttttttttaggaaaccaattcctggactcattgatcttttgagtgttgtttttttttctgtctcaatctcctttagttcagctctgattttggttatttcttgtcttctgctagccttgatattggtttgtacctggttgaccagttcttttagttgtgatgttaggttgttaaattgaggtctttctttttcatgtgggcatttgatgcataaatttcccacttaacactgccttagctgtgtcccagagattctggtatgttgtatcgttgttctcatcagttttaaagaacttctcaatttcttccttaatttcattatttacacaaaagtcattcaggagcaggcggttcaacttccatgtaattgtagggttttgaatgaatttcttagtcttaatttctaatttgattgcactgttgtctgaaagattgttttttatgatttcagttcttgtgcatttgctgaggagtatttgacttccgattatgtgatcaattttagagtacatgccatgtggtgatgagaagaatgtgtatactgttgttttggtgtggataattctatagatgtctatcaggtccatttgattcagtgctgagttcaagtcctgaatatctttgttaattttttgtctcgatgatctgtctaatattatcagtgagttgttaacatctccaagtattattgtgttggagtctaagtctctttgaaggtccctaagaacttgctttatgaatctgggtgttcctgtgttgggtgctgatctggtttggctgtgttcccattcaaatctcaccttgaattgtagctcccacaattctcacatgccacgggaggcacctggtgggaggtaattgaatcatgagtgcgggtctttcccatgctattctcatcatagtgaataagtctcatgagatctgatagttttataaagaggagtttccctgcacaagttctcttgtcttgtctgccaccatgtgagatgtgattttcaccttccatcatgattgtgaggcatccctagccatgtggaactgtcagtccattaaatttctttcttttgtaaattgcccagtctcaggtacatctttgtcagcagcataacagactaatagaggagagtggagcactgctgaaaagatatctgaaaatgtggaagtgactttggaactgggtaacaggcagaggttggaacagtttggagggctcagaagaagataggaaaatgtgggaaattttggaacttcctagagacttgttgaatgcctttgcccaaaatgctgatggtgatgtggacaataatgtccaggctaaggtagtctcagatggaaatgaggaacttgttgggaactggagcaaaggtgactcattatgctttagcaaagagactggtggcattttgtccctgtcctagagacttgtggaactttgaacttgagagagatgatttagggtatctggcagaagatatttctaagcagcaaagcattcaagaggttacttgcgtgctgttaaagccattcagttttataagggaagcagagcataaatgtttggaaaatttgcagcctgacaatgcaatagaaaagaaaatccaattttctgaggataaattcaagctggctgcagaaatttcatgggtaacgaggagctgaatgttaattattaagacaatggggaaaatgtctccaaggcatgtcagaggttttttttttttttttccagagtctcgctctgtcgcccaggctggagtgcagtggtatgatctcagctcactgcaagctctgcctgccaggttcatgccattctcctgcctcagccttccaagtagctgggactacaggcatccgccaccacacctggctaattttttgtatttttagtagagacggggtttcaccatgttagccaggatagtctcgatctcctgacctcatgatccacccacctcggcctcccaaagtgctgggattacaggtgtgagccaccatgcctggccatgtcagaggtcttgatggcagccctgcccatcacaggcctggaggcctaggaggaaagaatggtttcttgggctgggcccagtgtccccgtgctgtatgcggtctttggacttggtgccctgtgtctcagccactccagctgtgactaaaaggggccaacatagagctcaggccacggcttcagaggatgcaagccccaagccttggcagcttccatgtggtgttgagcctacgtgtacacagaagtcaagagttgaggtttgggaacctccacctagatttcagaggatgtatggaaatgcctggatgtccaggcagaagtttgctgcctgggcagggcactcatgtggaacctctgctagggcagtgcagaagggaaatgtggagtgggcaccctcacacagagttctcaatggggcagtgcctagtggagttttgaaaagaggaacaccatcctccagactccagagtgatggatccactgacagcttgcatcatgcactggaaaagctgcagacactcaatgccagcccatgaaagcagcttggagggaggctatatcctgcaaagccacaggggcggagctgctcaagaccaggggaacccacctcttgtatcagtgtgacctggatgtgagatatggaatcaaaggaggtcattttttggagtttaagatttaagtgctctgctggatttcagagttgcatggagcctttaagtcccttcattttggccagtttcttccatttggaatgggtacatttattcaatgcctgtaccctcattgtgtctaagaagtaactagcttgcttttgattttacaggctcataggcagaagggacttgccttgtctcagatgagaatttggactgtggattttgagttaatgtagaaataagactttggggtactcttgagaaggcatgattggtttgaaatatgagggcatgagatttgggaggggccggtggtggaatgatatggtttggccctgtccccacccaaatctcaccttgaattgtaggtcccgtaatacccacatgttgtgggagggacctggtgggaggtaatttaatcatggggtaggtctttcccgtactattcttgtgatagtgaataagtctcatgagatttgatggttttatgaaggggagtttccctgcacaagtcctcttctcttgtctgctgccatgtgagatgtgcttttcaccttccaccatgattgtgaggcctccccagccatgtggaactgcgagtccattaaacctccttcttttgtaaattgcccaatctcaagtatgcctttattagcagcatgataatggactaatataaatgaatatatatttaagaaatggataaattcctggacacatacaccctctcaagactgaaccaggaagaaactgaattcctaaacagaccaataatgagttctgaaattgagtcagtaataaaaagcctaccaaccaaaaaaagcctgggaccagatggattcacagctgaattctaccagatggataaagaagacctggtcctattcctattaaaattattccaaaaaaattgaggagaagggattactccccaattcattctgaggccagcatcatcctgataccaaaatcgggcagaaacaacaaaaaaagaaaatttcaggccaatattcttgatgaacatagatgcaaatatccttaacaaaatactaacaaaccaaatcaagcagcacatcaaaagctaatgtaccacgatcaagtagattttacccctgagatgcaaggttagttcaacatatacaaatcaacaaatgtgatccatcacataaagcagaatgaaaggcaacaaccacctgatcatctcaatagatgtggaaaaggcttttgataaaattcaacagcacttcatgttaaaaatgctcagttcacgcctgtaatcccagcactttgggaggctgaggtgggcagatcacaaggtcaggagattgagaccatcctggccaacatggtgaaaccttgtctctactaaaaatgaaaacttagctgggcatggtggcatgcgcctgtagtcgcagctactcaggaggctgaagcaggagaatcgcttgaacccagaaggcggaggttgcagtgagccaagatcccaccactgcactccagcctgacaacagagaaagactccatcttaaaaaaaaaaaaaaacctcagtaaactaggcattggaggaacatacttcaaaataataagagccatcaatgacaaacccacagccaacaacatagtgaatgggcaaaagctggaagcatcactcttgaaaatcagcaggagacaaggatgccctctctcaccactgtttttttttttttttggagacagagtcttgctctgttgccaggctggagtagtgcagtggcgcgatctcagctcactgcaatctccgcttcccaggttgaagcaattctcctgcctcagcctcccaagtagctgggactacaggcacatgccaccacgcctggcctttttttttttttttagtagagaccaggtttcatcatgttagccaggatggtgttgatatcctcacctcgtgatccacccacctcagcctcctaaagcactgggattacaggtgtaagccactgtgcccggccctccctcaccattcttattcaagatagtattggaagtcctgaccagaacatcaggccagagaaagaaataaagggcattcaaagaggaagagtggaagtcaaactatccctgtttgcagatgatatgatcctgtgtctagaaaaccctaaatctccaaatcttggcccaaaacttcctttagctgataaacaacttcagcaaagtttcaggataaaaaaaatcaacatataaaaatcagcagcattcctatacacaaagaacactcaagctgagacccatatcaagaacataatcccactcacaatttccacacacacacatattacctaagaatacagctaactatggagatgaaagatctctacaagaagaactacaaaacactgctcagagaaatcagagatgacacaaacaaatggaaaaaattatcatgctcatggataggaagactcaatatcattaaaatggccatactgcccaaagtaatttatagattcaatgctattcccattaaactaccattgacagtcttcacagaactagaacaaactactttaaaattcatatggaagcaaaacagagcctaaatagctaaggcaatcctaagcaaaagaataaagtaagaggtactatgttgctcaacttcaaactatactatgaggccacagtaaccaaaacagcatggtactggtacaaaagcagacacacagacaaatggaacagaatagagagtccagaaataatgctgtacaactccaaccatctgatctttgacaaagatgacaaaaacaagcaatgaggaaaggactcctcattcaataaacagtgctgtactaactggctagccatatgcagaagactgaagctggactcctaccttacaccatatacaaaaatcaacttaaaatgaattaatgacttaaatgtaaaaccaaaaatcataaaaaccctggaaagtaacctagaatataccattctgaacataggacttggcaaagatttcatggcaaagacaccaaaagcaatcacaacaaaaacaaaaattgacaaatgggacctaatttaacttaagagcttctgtgcagtaaaagaaactatcgacagagtaaatagaaaacctagagaatggagaaaatgttaagtcctaattcgggaaaaggagtcaggctggtgggaccagaagaaagcaaagaggtaaaacaaataagctgtaagtctgtctttcctcatggtccagaacacacagccctcctgtgcaaataactcacagtcttcccgtgcccaactatcatcagacatctataagctagctcactgcaaccctggcattgttgctactgcacatagcactctgcagcctaagaaccatcctataaaatctcctgcaagcccttgtttccgtgcagtcagcttctcttctgctggcctgcctgcctgttgcctccttgcaacatattttcctactttctctaataaatctgcttttttttctacctacaactgtcttggtaaattcttttaccctggcgccactggcccagatagttattgctcacctgcaacagaaaatatttgcaaactatgcatctgacaaaggtctaatatccagaatctataaggaacttaaacaaatttacaagaaaaaaaccaaaccacctcattaaaatatgggcatgaacagacatgaacagacacttttcaaaagaagacatacatgcagccaacaaacataggaaaaaattcgcaacagcactaattattagagatatgcaagtcaaaatcacaataagataccatctcataccagtgtgaatggctactattaaaaagtcaaaaaataacagatgctggtgaggttgcagggaaagagaatgcttatacactgctaatagaaatgtaaattagttcagccattgtggaaagcagtggggtgcaaagaactaaaaagaaaattaccatttgattcagcaatcccattactgtgtatatacctaaaggaatataaaccattctaccataaagacacatgcacacatatgttcactgcagcactgttcacaatagcaaagacattgaatcaacctagatgcccatcaacagtggactggttaaaggaaacgtggtacatatacaccatggaatactatgcagccataaaaagaatgagattgtgtccagaattggttccttccggtgggttcttggtctcgctgacttcaaaaatgaagccatgaacccttgtggtgagtgttacagttcttaaagatggtgtgtccggagtttgttccttcagatgttcaaatgtatcccaagtttcttccttctggtgggttcgtggtcttgctgatttcaggagtgaagccgcagacctttgctgtgagtgttacagctcttaaaggtggtgcatctggagttgttcattcctcccagtgggtttgtggtctcgctgacatcaggagtgaagctgcagactttcacagtgagtgttacagctcttaaaggtggtgcgtcctgagttgttcgttcctcctggtgggtttgttgtcttgctggcttcaggagtgaagctgcagaccttagcagtgagtgttacagctcataaaggtagtgcggacccaaagagtgagcagcagcaagatttattgcaaagagtgaaaggacaaagcttccacagtgtggaaggggacctgagtgggttgcagctgctggctgggttggccagcttttattcccttatttggccctgtccacatcctgctgattggtccattttacagagtgctgattggcacgtttacaaacttttagctagacacagagcactgattggggcatttctacagagtgctgattggtgcatttacaaacctttagctagatgcagagtgctgattggtgtgttttcacagagtgctgattggtgcttttacaatcctttagctagacagaaaagttctccaagtccctgcccaacccagaagcccagccagcgtcacctctcaagatcatgtcctttgcaggaacatggatggagctggaggccattatcttatgcaaactaacatagggacaaaaaaccaaataccacatgttctcacttataagtgggaactaaacattgagtacacatggatacaaagaagagaacagtagatatggggacctacttgagggtgaaggataggaggagggaaaggatcaggaaaaatacctgtgagatactatgcttattaccttggtgatgaaattatctgtacatcaaacacctgacatgcagtttacctatagagcaaacctgtacatgtatccctaaaactaaaataaaagtttaaaataaaaaagaaagaaattagttcaatacttttttctcagtgaaatgcttatgcaaacaaatatcatacacttttatttcagagatttcgggatcataaagggagtgtaccaaggacagtttgtgactagcctcctcacattatccctcacattatcatttctcatctcttctcccctaaactttcatgccaacagcagactaggtaagtttccctttcctgcatctctaatgattcagggcgattaaggtctccttctccagccccctgcaccaccattcccacccccatctcatctcatctctgcccagaaggctggaaggacaagctgaagctccctcctgtgttccctcccacagcagacacacagacaaatccccactctacactcacctacctgagccctcctaattccttctggctcacaatcctacaccctcccacagggtgcttacgtgtgcatacacacacactccctgttctcagggaccctactcccctcccccacccgccttgctcacctcgcctgtgcatggagaagctctcaaaaaccccgtagttgtgtctgcagtaggtgtccaacagaccccgcaagcagcccaagaggttcttctggctgtttgcattcctggactcttctccgctccagctccgccaccgcccggaactttccgacgtccctatggaagcgcgcatactccttccggtgtggatgagtctctgcacaaaccgcatccgctctgtcccattgcagaaatagcactcgtgtttaatctgctccaagaaatgtgccgcagggacatgaagaaccggtttcttgggcggcatcctaggaaaagagtgatggctatgcccacaatcagcagggcgaggggcggaacaccttgactggcccccaccagccacccccgaccacctaggggttcctcttccatctgcctgaggcggagggaggctgcgaggggcgtggaataccatttgggatccgctacccatttccgagctgagctggacgcctctttgcaaggctctggatcaggatcaccttcctcatcactgtctcctgcgcttcctcctcctgggagcctccatccaaaagacacttctgctgcctcctatcatgccacactctactcattccttaaacaagacccactgcctccattctgtaaatgcttccttagtgcttaccttgtgtctcatctgtgccgtctcctgggaatccaaacgggaaaaatagacctcatccctccgctggaggagcttaaagagaagtgaaattgatggcaaaaaaccaaacacgcaacaccttatacaggaacgaaaaatgttaagagaagtgtggagttctagaagaaagaataggatgatctaaattacattagggtgccagagaaggactctgagagtgacagctcaaatgtgaccttacaggtttagtgggtgtgagccagggggcagagtggagcccgtgtgtgtctctggacaaaaagggaggcacatttcaggtaagcataatatcatgtacaaaagcttgaaagaattgatgaacttcttcaagaaaccagaaaaaagttcactaaagcacagcatgaaggaaaggaggggaaaagattaaactggagaaatcacaagaagggaacaattaaaatcattgtcatgttaggatttcgatttatactaaatgtaatgggaaacagttgaagagtccatgaccccaacacaggtccacaaacttttttttttggactttctaaatccagaaaactcacgaattcacttgctgttgtttttaatttgttgccgaaactcatttggcaaatctgatctgaagaggtaaggactcaaaagtgtcacagagctcttactggtgacatgtgcatctgtagtttcaatatatataaacatacaaacatacgtatgcatgtgtaaatacacacagatttcaaatactgtgcatgtatatatttttgatgtttttgtatttatgtttaaatgaactatgaaaaataaaaaataaagaaaaatccttgtgtttaataaaatgagatgaatagaaagcatttttaaaataataattttttttttaagttctgggtacatgtgcaggatgtacaggtttgttacacaggtaaacatgtgccatggtggtttgctgcagctatcaacccattacctaggtattaagcccagcacgcattagctcttttccctaatgttctccccagctctgccctcccccagcagaccccagtaagtgttgttctcctccctgtgtccatgtgttctcattgtttagctcccatttatatgtgagaacatgcggtgtttggtttcctgtttctgtgttaatttgctgaggataatggcttccagcttcatccatgtctctgcaaaggacgtgatctcattcctctttatggctgcatagtattccgtggtgtatatgtaccacagtgaatagaaagcatcttacattatcagtagtataaaatgtagaattactacagaaatctgaagcattttactgaaaaatatttgggatagtcgtcaccatttatgacttataattaccagttgttgaaagttaatagagatagtaattatcaagaacacatcaaaattttgaaataaactgcataacgcaaaaaagtaaaaatgaaaatcttgaacctgcattgattgaatggattcatcaagaaagcagtgaatttatgcaactgtctagtttttttttttttttttttggcaatgaaacaagcaaaactaagccatgaagagctgaactaagagataaatgtgttttaaaagtgtgagtctagaatttttagaagaaacacaatgtaaaccagtgttctcagccttggcactattgacattttggactagataatattttcttggtgagaggagctgtctactagggtccctagcttctacttgttacatgtcagaagaaactcctggtgtgacaaccaaaaatggctccagacattgccaaatgttccctagggagttgggagagggaagggagggacagaggggtggtgaactatccctgggtgagacccactagtgtaaccatctgaaaaatctatggttaaaaagccgctattaattatggaatatttgagatttacactgaaaactctgccaatattctatctatttaaaatcttggtcctacataaaacttaggatttttaggaatctagtcccagtgcagagctatttttctagcaaaattaattcattcagaaccaaggtttactgatttatttgccttcccagtcgccaagtcatattcttaatttctgtgtcactggtccactactcactgcctcagctaattcattttctaactttcagtttcctactcccaacaatacaaggaggcatcaaattaccaaccttggacagaggcagaactctcatttctgtagttaagccttctcagaaggggagtgctatggtttggctgcgtaagcatttcaatcttgtcttgaattgtagctcccacaattcccacgtgttgtgggagggaccaggtgggagatagttgagtcatgggggcaggtctttccccatgctgttctcatgacagtgaataagtcttatgagatctgatggttttataaagggaaaaaccctttcgcttgctgtcattcttctcttgcctgccatcatgtgagacatgcctttcaccttccgctgtgattgtgagatctccccagccacatggaactgtgagtctattatagccctttttccttataaattatccagtcttgggtatgtctttatccgcagcctgaaaacagactaatacagggagaaactaagaagatggcattctctcatagatagtttccaaaaaacgagcaagtccccagattttgcgtagagactttcacaagctcccttcacccttcagaaatgatagcagagaggagagcactttggatgagataaggtctatcttattattcctaaattctctgagcaccttcttcacagataagaatgttgaaaaataaaaatatgtgaagttgccgtcactgtagcttgcatagttagcactgcagtctatgctcatgtgccaagcttagattgccatatttagcaaataaaaatagagggtgcctagttaaatttggatttcaaatacattattgttgtttatctgaagttcggatttaactgggtatcctgtactttatttggcaaccttagcccaacttgctaataatgctcagaaggagtgaatttaatacttctttgttttctttaacacatgcctatgacagcgtgcacatagggaagttttcaaatgataaatgcaaaatgaatgaaagtttctcctttacattgggactagcagaccttgcatctctctcccaccctgagacacaccctgtacataagaaattctatcaataattcagactcagtctagtcactattcactagtggttgtaagctcaggctctagaatcaggaaatctgaatttaaacatgaccccttctacttgggttaattttaacaatcattaacctttaaatatatatataaaatggatccaacagtaatatattcctcacaggattattgttgagggtaaaactaagcagtggctcttcttagtgctgataatataataatcactctaatatattaccattttatttttacaatccctataaaggaaagcttcattatttttctattccttaacttctaaagcaagtaacgtctacatcatgatttggcaattgtcttttattaatttagcactaattaccattttaaacacatgaggacagaaacactggtttatatataataattcacatgcctaaacctcacacaaaaggagattgctgatatcgaagagagggacttcatatatactcagatttaaattgcaatcggatttctagcactaactttgtgacagtgggtaagttcattataccctttgaattttagattccaaagatgtatatgcttttaaataccaaagatatgataggataggtattagatttccataccaaaatttataagcctggtaattagtcactgcaaaatattacaatactccacgctaatacagaccagatttgctttgtttattactccattctcatcacccaaggtaataactagtatattctaagtcactaataaatattggctgtatgaactaatagccttttgcataacctgtcaccactgtacacaggggccttctagtgcttcattgccaatgactgagcatctgtctctggttcacaggtcatccagcttctttgttcattttctttagatccagctggctccctgatcccagagcatagtctttccctgaggctcgctactcaaaagagtcaaacttcatccagccctcacttcttccacccgctcttcaactggtccaatccactttccatcctggatactccactgactgcaaataccaactcctccaaacccagtacttgcgtctctgtcacgttcttacttcactcacctgtcagtggttctcaccacaactggccactccctcgcctcgaaaaaatcatttttctttgattcccatgcatcacattccttgggttttttttctccagcatctctggggaatcttctcagtcccttatgctgtcctgtggccctctgatattttttctacacaaaaatctatctccctctgcaacctcttccacttccctggaatttaacacagaacctgcatcgaccccaacataaatacctccagccctggcctcaccctgaactcctctcttatattcagttgacttcctgattgcttcatgtgagttcaaaaatcatctcaattttaataaacacaattgtcatttctaatcaaccacttcaaatcatttcctcccatattcttccctatttcaataagcagcaccaccatccacctatttatcaaggcaaaatacttagaaataagttacatttaatccattaacaagacatgcaaaaagacatcccaagtctgttcactttatctggatctgtctttgtcactactacactacatgaagccaaaaatttgtcttccctggagaattctgctgttctccacttgtgaaccccaacaatccaatctccacatagtagctagaattatttttaaaattgaatattatcgggggacctgcccggataatcacgtagtttcttttctattttcctaagcatcggccggcttgagaaataaagggacagagtacaaaagagagaaattttaaagctgggggagacatcacacgttggtaggatccacagtgccccacaagccacaaaaaccagcaagtttttattagggattttcaaaaggggagggagtgtgcgaataggtgtgggtgacagacatcaagtacttaacagggtaatagaatatcacaaggtaagtggaggcagggcgagatcacaggaccacaggaccgaggcgaaattaaaattgctaatgaagtttcaggcaccattgtcatcaataacatcttatcaggagacatggttttgagatcaaccgatctgatcaaaatttattaggtgggaatttcctcttcctaataagcctgggagtgctatgggagactggaatctatctcacctctgcaatctcgaccagaagagataggtacgccccgggggggccagttcagagacctacccctaggtgcgcattctctttctcagggacattccatgctgagaaaaagaattcagcaatatttctcccatttgcttttgaaagaagagaaatatggctctgttctgcctggctcaccggcagtcagagtttaaggttatctctcttattccctgaacaattgctgttatcctgttcttttttcaaggtgcccacatttcatattgctcaaacacacatactgtacaatttgtgcagttaatgcaattatcacatagtcctgaggcgacgtacatcctcctcggctgataggattaagagattaaagtaaaggcaggcataggaaatcacaagggtattgattggggaagtgataagtgtccatgaaatctttacaatttatgtttagagattgcagtaaagacaggcataagaaattacaaaagtattaatttggggaactaataaatgtgcataaaatcttcacaatccacattcttctgttctggcttcagccggtccctctgtttggggtccctgacttcccgcaacataatattaatggactctccttgtaacctcccaggagcttccaatatgtttaaataaaacttaattccttactatggccaccaaggccgaatatgatgcagctcctgactttctctctctcttacctcatcttctgccactccaccccttgctttccatccttcagcccctctaaccttctttctgtctcttcaacacagcacacgccttcccattccttggcctttccccttttctgtctgtctggaacacttgtcccttagatcttcacatggctgtcttattgttcttgtctcagctaaatgtgagctctcctcagggagggctcccaaactacctgtgaatccaatgtgaagttgggtgaatccaattctctctgtcctatcaccctgatgtctttttttaaaggcattattgctctctgaatttttcttttttgttaaatatttattgggatattgtctgtctcctctggtattgagttccatgagagtagggatcttttttatcctattcaagtagaaatctctgagcctagaacagagaccagaacaaaacttttgctcagaaacatacctgtggtctaaatgaataaaccgaagttctgggaactgatcactctgggtattctagaaagcagaaaagggctcaagctcctacaccctttcattctaatgacatgctatatcccttctcctccctgtgagaaattaaggcaaacttcttttctctcctctttctagttggaagaaggattcacagataaggaaacagtgattgtaagaaagaaaaaaattttcattaagaattacctcttttctgccgggcgcagtggctcacgcctgtaatcctagcactttgggaggctgaggcaggcggatcatgaggtaaggagtttgagaacagcctggccaacatggtgaaaccccgtctctactaaaaatacaaaaattacctgggaggtggaggttgcagtgagctgagactgcaccattgcactccagcctgggcaacagagcgagactccatctcaaaaaaaaaaaaaaaagaattatcggtttttttttttttaatagtttaagttctagggtacatgtgcacaatgtgcaggtttgttacatatgtatacatgtgccacgtggtgtgctgcacccattaactcttcatttacattaggtatatctcctaatgctatccctccccccttcctccaccccacaacaggccccggtgtgtaaagttccccttcctgtgtccatgtgttctcattgttcaattcccacctatgagtgagaacatgcggtgtttggttttttgtccttgcaatagtttgttgagaatgatggtttccagcttcatccatgtccctgcaaaggacacgaacttatccttttttatggctgcatagtattccatggtgtatatgtgccacattttcttaatccagcctatcattgttggacatttgggttggttccaagtctttgctattgtgaatagtgccacaataaacatacatgtgcatgtgtctttatagcagcatgatttataatcttttgggtatatatccagtaatgggattgctgggtcaaatggtatttctagttctagatcattgaggaatcgccacactgatttccacaatggttgaactagtttacagccccaccaacagtgtaaaagtgttcctatttctccacatcctctccagcacctgttgtttcctgactttttaatgatctccattctaacaggtgtgagatggtatctcattgtggttttgatttgcatttctctgatggccagtgttgatgagcattttttcatgtgtcttttggctgcataaatgtcttcttttgagaagtgtctgttcatatccttcacccacatgttgcttcggttgtttgtttttttcttgtaaatttgtttgagttttttgtagtttctggatattagccctttgtcagatgagtagattggaaacattttctcccattctgtaggttgcctgttcactctgatggtagtttcttttgctgtgcagaagctctttagtttaattagatcccatttgtccattttggcttttgttgccattgcttttggtgttttagacatgaagtccttgcccatgcctatgtcctgaatggtattgcctaggttttcttctagggtttttatggttttaggtctaacatttaagtctttactccatcttgaattaatttttgtataaggtgtaaggaagggatccagtttcagctttctacatatggctagccagttttcccagcaccatttattaaatagggaatcctttccccatttcttgtttttgtaaggtttgtcagagatcagatagttgtagatatgtggcattatttctgagggctctgttctgttcccttgatctatatctctgttttggtaccagtaccatgctgttttggttactgtagccttgtagtatagtttgaagtcaggtagcatgatgcctccagctttgttcttttggcttaggattgacttggcaatgagggctcttttttggttccatatgaactttaaagtagttttttccaattctgtgaagaaagtcattggtagcttgatgaggatggcattgaatctataaattaccttgggcagtatggccattttcatgatattgattcttcctacccatgagcatggaatattcttccatttgtttgtgtcctcttttatttcattgagcagcagtttgtagttctccttgaagagatccttcacatcccttgtaagttggattcttagatattttattctctttgaagcaattgtgaatgggagttcactcatgatttggctctctgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggctagaacttccaacactatgttgaataggagtggtgagagagggcatctttgtcttgtgcccgttttcaaagggaaagctttcagtttttgcccattcagtatgatattggctgtgggtttgtcataaatagctcttattattttgagatacatcccatcaatacctaatttattgagagtttttagcatgaagggttgttgaattttgtcaaaggccttttctgcatctattgagataatcatgtggtttttgtcgttggttctgtttatgtgctggattacctttattgattagcatttgttgaaccagccttgcatcccagggatgaagcccacttgatcatggtggataagctttttgatgtgctggtggattcggtttgccagtattttattgaggatctttgcatcgatgttcatcagggatattggtctaaaattctctttttttttcgttgtgtctctgcccggctttggtatcaggatgatgctggcctcataaaatgagttagggaggattccctctttttctattgattggaatagtttcagaaggaatggtaccagttcctccttgtacctctgatagaattcggctgtgaatctgtctggtcctggactttttggttggtaagctattaattattgcctcaatttcagagcctgttattggtctattcagagattcaacttcttcctggtttagtcttgggagagtgtatgtgtcgaggaatttatccatttcttctagattttcaagtttatttgcgtagaggtgtttatagtattctctgatggtagtttgtatttctgtgggatcggtggtgatacccctttatcattttttattgcgtctatttgattcttctctcttttcttctttattagtcttattagcggtctatcaattttgttgatcttttcaaaaaacaagctcctggattcattgacttttttgaagggttttttgtgtctctatttccttcagttctgctccgatcttagttatttcttgccttctgctagcttttgaatgtgatcgctcttgcttctctagttattttaattttgatgttaggttgtcagttttagatctttcctgctttctcttgtgggcatttagtgctataaatttccctctactttaaagctagaattagtttctaaaactgaacatgaattgactctccttgtaaccatccagtagtgtctcacatctatttaaataaaattcaggctgggtacggagactaatgactgtaatcccagcagtttgggaagccaaggcaggcagattaccggaggtcaggagttcgagaccagcgtggccaacatggtaaaaccctgtctctactaaaaatactaaaaaattagcctggcatggtggcaggcccctgtagtcccagctactcgggaggctgaggcaggaaaatcacgtgagcccaggaggcagaggttgtagtgagccgaggccacgccattgcatccagcctgggcaacaagaacgaaactccatctcaaaaaataaataatgaaataaaaaaatgaaaataaataaaataaaattcaaatttcttaccatggacatcagagcctaatataatgaggctcctgacttcctctctgcttcctacctcatcctctgcctctgcatttccttgaatgctatagttcagtgtctctagctttctttctgtccctgcacgtaatttcccacaccagggcttcctgctccccctgcccccacattctgtctccctggaactttcgtcccttagatcttcacatggctctctacttattttgttgtctcagctgaatgtcactttctcaggcagagctttctaaacacatgagctaaagttgggtgaatccatttctctcttttccacaaacctgatgtcttttcttcagtgcactattactctctaacgttatcttctttgttaattgcatattgggttaatgtctgtctcctctattgttgtgtaacttccatgagagtcgggaccctctctatcttaatcaaatacaatgatttgaacttggaatggagccgagtacacagtagctgctgagaaaaataagtgtggtttacatgaataaaccagggatctgggaactgatcactgtttggatcctggaaagcaagaaggggctcaaactccagcactctttcattttgatgtcacactagaccccttctcctcccggtgtgaaatacaggcaaagttcttctttctcctccttctagttgtaagaattcacagataaagattaacagtgatttaagaaataataaatttttaaattaagattcatctattttttgcctgggtgcggtggctcaaacctataaccctagcatgttgggaggtcaaggctggaggattgcttgagtccagcagtttaagaccagcctgggtaacatagcaaagtctcatctctagcaaaattacaaaaatcagctgggcatggtttcctgcctgtagtctccactactctggaggctgaggagggaggctcgcttgagcctgggaggcagaggttgcagtaagcctagatcataacacggaactacagcatgggtgacagagccaggccttgtctcaaaaaaaggaaaaaatctctttcaatggatctcatagtgctctgggtctgtgcaagctttaggaatttctggaaatgatgacaacatagctggggaaaaataaaaactggaggaagaggtaagcagacatggctaattaaggaaagctgagggcataatgggtgaacctatgaaatttaagacaagaccccagtaagacaatgagttcccaggacttgctcattgactttcagccctatgggatgtgaacaatgtccacattgtctctataaccccacacagtatatagtttgaacattattaaatttctgatatttgactgtttttgacttacaaaaatagaatttcatataatttatcctacgttagttgaatatcttcttgttatgtctagttagagcatgtaggacatgtaggagaaatttctatagaaaggttagaagagattcgtaataaacactaagctgggccaggttttccgaggatgccttaagttctttaggcacgaaagaacaccccagagatgctctttatctgtagggtgactccaagtactaaagatcttagcttcagttccagggatttttccccataagaaagacagagcactaagtataacttctgtcagagaacctacatacactacagggatataggctttataaacattggagttagaaagaaaaagaaaggagataatggggaggccattggtacatcctcacatttgaggaagaggggccaacaccaaagttcctgtggaggacataacccaggatcctctagaagagaccctttgaattcccttgactcccacaaaattttcagtaaaaacgtcattttgtctgacgtaagtcaacataataaagggaagtgccgtatggggaaattattttagcatccttatttccaaatcctctaaacaccctgaggacatgtgatgcaaaggttttattggtggagatttgaaaagaaatgatctgtacgaaggccccttacacagtctcatggactgtgtcatgagcaagtagtcaagctcctttcgtggaggagataatttgggatccaataatacagatgcacaatctctgaccaaaaagtcacaaagtcttaagggacatggcctgggcacaatgttaacaaaactccctattttccccaccccatagtagctcaacacccacaatgtgcacttatatccggtgtccccagccaaagccagtgggaagctcagcaccatcagtgtcactgtcagcgctgccatgcgggagcctccagggagcttcacacaccatgctggagaacaggaaaggaccaggggccagaggaggaggcaagtcttactcaggaagaactatgaacccctccacccacattccaaattatggggaggaggttactgacttccttgctcctgggttgggtaatctcgtgttggagaaccaatcagcatctgagttcaatagcatcatcagttgctggtcagagatgctgtatgaaggtcctcttctgaaacagaatttccttctttaaaggattgtttttaaattagtacttgaaagatttgatccagttgcatgtaaaacactttaattgggtccgattgtgagccagctctgtgctggtcagtgatgtgttcataagtttgagccttgtaagagcattcatttcccacttaacaagacaactgtttgcagaagtgagtgtgtgagtgtgtttaggagtaaaggagatggaaggaacatggttgtaaatccggagacatttaaactggtccttattgcaccatatcttaatgttgtagatttgggaaaattatttcatgtctcacagttgaaatgaaggcactgtgatctttcaggtctttcgatactggaaaatgctgtgattctgtggacgcctgaaggagcagcagccccgggtatctgataatatgacagaatgacagctattgactagagagcttaatccgtacctgtttacaggtagggatgtctttaataagttaaaggaaattgaaagtttgttaataatttaatctgagtaagaatatctttttcaagtgtgtctcctgatgctgcccccaggtttagtggcccctccagaacacacacaggcaaggggctaacaggggccacctatgtgcaatggagggtctgaaggtgcctttgtatggcatttaccctaacaatgtgataaggtcaactgtgcaatccaagtattcatgggtctgagagatcgatcgaagactgtgaaagttagctgttcatagaacaactcttttttttttgagacggagtctgtctctgttgcccaggctggagtgcagtggagcgatctcagctcactgcaacatctgcctcctcggttcaaagattctcctgcctcaacctcccaagtaactctgactacaggcacttgccaccatgcttggttaattttttgtatttttagtggagatgggtttcactgtgttagccaagatggtctcgatctcctgacctcatgttcttcctgcctcggcctcccaaactgctggggttacaggcgtgagccatcgtgcctggccacattatgttttaaaataatgaatattttatgtgaagagtgttcaatccctcattcttggttcccattatgatttcctcatttgattgaggctatagcactttatattatgtttctcttgttttatcataagggaagataaaagacgactttgctaactaatacatttcagaatattcaggaaagagaacactagggaaaactatgaattacatcagttgatgtaactatgtaatattaaacatattattatacatttagataattactatgctttttattaatataaatataacatctaagattcagaatggacttcagaatacaactatgcttataaagttctgcattaattcacatgctaccacataggcactcatttgtctttttttttttttgtttgtttgtttgtttgttttgagatggagactcgttctgtcgcccaggctggagtgcagtggcgcgatctctgctcactgcaagctcagccccccaggttcatgccattctcctgcctcagcctcctgggtagctgggactacaggcgcccgccacaactcccggctaatttttttgtatttttagtagaaacagggtttcaccgtgttcgccaggatggtctcaatctcctgaccttgtggtctgcctgcctcggcctccgaaagtgctgggattacaggcgtgagccaccgcggctggactaaagtctgtaacctgtctttatggagaactacttttgaggccgtacacttctttcagtaacaatattgtctaagtaatggtatggcaaagttgtttctaccttttctggagctattttgacattccatttagttaaagcctactttgtttcttagaataaccgatgtaagatttgatctgtaggagtggccaaaagaatgtcatccataaaatgaatgatgtaagcagtaggaaacatatttcgaggctcctttaatgcctgtcctacaaaatgctgacataacgtaggactgttaagcatgccttgggataaaactctccattgatagcaagaaacaggttctttttgattaatagaaggcacagagagggcaaatcgaggcttatccttcttgtgtaatggtatagtgaagaaacaatccttaagatgtattactacaagaagccaatctctaggaatgaccactggagttggcaaaccttgctgtaatggacccattggttcaatttgtgcattaactccaaacatgcagcagtcaccaccttccggacttttttggaataacaaacactggtgaattctgggggcttactgactcctctacatgtcctgtgtcctgttgttcttatactagctgctgaagttgtgtcagcttctcctgagataggggccattgatccacacatacaggtttgtcactggccattctaatggtaaggcagagggtggaggagaaatatcaatgaccctcatcagaaatcctgacgtcctagccctcttctatctgttttttccagttattgatgttgggttagcttttcctcgtaggaatttccctaaacctttcccactctgatatcccatgtccttcaacattttaaattctgggttatcaaagttttcatttgtaagtctcatattccatgctgtaagtaagtctcgatcccataaattgattgccatatttgcaacataaggctgaaaagtacatggctgtccatccggaccaagacaaggtaaaatgtcagcactctgttgaacacttttagctgctcctactcccactagggatgtggaggttagtctgagagaccatactgggggtcagtccttactggatattactgacacttcagctcctctatccataagtcctatgggctatgggatgggatagatagatttcccttgtagttgtgctctcaaaccctttatttcctcgtttctcctttcgtggagaaggatttaatttgcagggaataagcaacgaccgagcaatatattctcccagttcaaaaatgcaaagattttcgacattaaaactacttgaatttctccttcataaatggaatcaactattccagggactacagtcatgccttgcaagttaagggggcttttgcctaaaattagtcctatgtatcctgttggtaaatatccccaaatgccagtgggaaccttggtaggtttgtctcctccaactaatgtagttctttctctggtggggatatctaatcctgcacttcctggtgttcctgaggtgaggaacaccaggaatcaatgtttttcctgagacccatccctgaagtgggactgtggtctgaactggaaatgccctcattgcttgaggggcccgggtccacgcccccttctagtttcgtgacaggtgggtgctgttttgatgaaattttgagcggcactgattagcctagtgatttcctttgttacagtgaggacaaagtcctggtgtttttttctgctgggtggggcactgcatcgtaatgtcctttctgtcctgagatctggcggaattcctttttaaaatgtccagttttggctggacacggtggctcatgcctgtaatccaagcacttcgggaggcagaggtgggcggattacaaggtcaggagatcgagaccatcctggctaacatggtgaaaccccatctcttaaacaaatacaaaaaattagctgggcgtagtggcaggtgcctgtagccccagctacttgggaggctgaggcaggagaatggcgtgaacctgggaggaggagcttgcagtgagccgaggttgcaccactgcactccagcctggacgacagagcgagactccatctcaaaaaaaaaaaaaaaaaaagtacagtttttccacggttataacattttcccattttagggtttgacccttggttccttttagatttgtcaactgctaaattagccattgcctgcactaatattgtagagcaatgaagctcatttcccacatcttgacaagctctgagaaaatttcccaagttttttgtacacctcacaggtgccgatgcacgtttacaatctgcatttgcattctcaaaagctagagttaaggttagcatctctgcagcagtggtgtgataaatctgatgcttcattgccttctatagtcatgcaagaaattgtgcataaggttcttgtgacccttgcatgatatgtaaaaaggattgcactgggactccctcttctggaattgtggcccagtcacatttagcagcctgtgcacactgctggcatttgggagtgccatttgatgttccaggtctgaataagggccattacctaagagcatgtcctctgtaatgtctctgtgtccagccacacaattccgtctagcctggtctgcacacatttcttgccaatttaaattccatgtcaggtatgcactaggagacaaacaagtgtgagccaaattctttacattgaagggtagaaggcgcacagcaccaaatacagatactagcaatcctaaagtgaacaggctctgtacaccattatttaccacactcctttcaattccttcaacaacttaaactctagtggagtgtgttcatgaataagctgctatggattatttggatcaggccttacagaaataggaaaagtgcaaggtcctaagggctctccagctatggcagcaaggtgtaaaattctctgtattggggtctctatttctgctaccgaaggaggcagtacagatgtttctgctattggaggaggtggtataggccaatttttatcctccttctcctgttttttattttcaattggagctgtgggtgggacaacagattttttcagatttttagactcagaacatcactcctgctgtccagcagaataagaaggagataatggcagaaggacagtatggactaaactccaagtggagaaaatggaaggatcaactttgagacctttttactgagcccgttttaatccttctgctctgtcccaattttccatatcaagagtgcctgtctgtgggaaccatgggttatgcataataacctcctgcagcattgtagttaatgtctgagatctaacctgagcaccagattatttcaacaaaactttaagcaactgcacataatgtttttcttcgatagacaaattctgcctcatgttactctgattcagaaaacttcccattcccaatacttctttagagcactgaccttatattgctcccagtacctctttagggcactgaccttatatcagctgccagcagactcatctcgggatccccattcatcttgtcaaattcagttcctctgctccaccagatcttctttgttcacattctcatgtccctgtgtttagaaaccactatggtgtcgccctgtcgctgtttgaacatcactatgccatggaccctgttggactgaacagaggaggatgaatgtggaaataaagacaaaagagtatatttggaagaaggggtcaggggcaccttgctctttgtgaacaaaggccctgagccttgagcttcctttgtatttactgagaagagatagcaagaagggggtcgttgtcggtctgctgcttgctccagagcagccttccaagactgcattccttgaacaatagattctagatgtcccagtagataacctgaaggagctcagcgccagggagtgattgccctcagcaaaccttctggtggccagcacagaggagagtttgcccctgctctgtattcatgataaacagtttgctgtttgatcatattgcctcagtggaaattctgagttggtcatgattctccagcctctggctctctacactgaatggattcaacaagaaagtggttgaatttatgcaactgtctagttatttataatgaaacaagcaaaaattagccataaagaagtgaattgggtgatgattgtataaaagatgtgagtctaggccaggcatggtggctctcgcctgtaatcccagcaatttgggagtctgaggcgggcagatcatgaggtcagaagatcgagaccatcctggctaacacagtgaaaaccagtctctattaaaaaaatacaaaaaaattagccaggcgcagtgtcaggcacctgtagtcccagctactcgggaggctgaggcaggagaatggcatgaacccagaggcagagctggcagtgagccgagattgtgccactgcactccagcctgggtgacagagcgagactccatctcaaaaaaa

SEQ ID NO: 1101 - DNA, 50749 bp, Homo sapiens
tcacttgggagcttctagttcaaggaacactatgacaaataccatttcaaataagtaacgttttttaaagaaagagaataatcaagtgaaaatgtccattctgtgattcttagtctcttaaatcaggtttgccaaaaggagggtccctgctccccaacatctgccactatgaataagtggtgcatttataaactgcctgctgctatggtctgctctggactggagaccagcgacccatccccaggcctggctagatttcatccagtcctggtaccaggatgcacatactctgtttcagtggcttgaagaactctctacatgaaccagttagagcagccaaagagctgtgaacaacagctggacatcttactagtttaaaattttgaatttagagcaaagatggcaccaacgtggccgggtgcggtggctcacgcctgttaatcccagcactttgagaggctgaggcaggtggatcacgagatcaggagatcaagaccatcccggctaacacggtgaaagcccttctctactaaaaacacaaaaaatttgcctggcgtggtggtagcgcctatagtcccagctactcaggaggctgaggcaggagaatggcatgaacccgggaggaggagcttgcagtgagctgagatcgcgccaccgtactccagcctgggcgacagagccagactccgtcccaaaaaaaaaaaaaaaaaaaaagatggcaccaacgtgagtggcagctgcagatagcaccaagaacccttttctctgagtggtgagtgacagtggcactaagcaggtagaagccaatcagcctcaagaatgtggtgacgcggtttataagacagtgggggtgaaggaaggtgaaagggtggggggcagggttgggccaggttgtggacaaaggtcagcagactaagagaggcaaacagcgccagatgagactcccaggaaccttccaaaaagcccgggagccagaaaagtccccaggccccacttcctgctccagctgccaagagagggaagcagctctcaagttcaatgagggcagaaatcgggctcatgtcccaaggcagctgtaagctcaggcgcccaaggcttcagataggtgtcccacgtgggcctgagggtgaaaaagctcattcttcaaaagaagtctgatttttggatgaaatttcccacttttcaagacactacatggacgagacaaaacccatctgtgggaatgcagcagggagaccacgtgggatacacaagacttgggtggaagagggagccctcaggggcgggcatcacctcgggcacagaacagggaccccccacacaggttgggaagatggaactgcctcctccctccgtgcaatcgggccggcgggggggccctaccttcagctccagatcagtgtaaatctgcggcctcagcaggctgagcaggtaggacgcgcgggagaacttaaaccctgaaaccgaatccgatgaagactgtcaccaggggtcaccagggatgaggaccgtcaccaggggtcagcagggatggagaccgtcaccaggggtcagcagggatggagaccgtcacccggggtcagcagggatggagaccgtcacccggggtcagcagggatggagaccgtcacccggggtcagcagggatggagactgtcaccctgagtcactgccctccactcccccatgccacatcagagctcacctgggatgatctcctcagtgacagctgcacccccgatcacatggcgcctctcgaagacggcggtgttcacccccagtctctgcaggtacgctgcctgggaagtggggcagcacacagggccctccctttatccctctgaaatgtcagggctccctcgggctgacccgcagactaaggtcctcactataggccagtatgggccacaccccatggcctccctgccccgctcatgctgttcctgcctctgggaatgcccttccctgtgcttccctttccaccctcgccttttctagatgtcctctaagatccgacaggcctgctcccgcccctccacttcccagctgaaagtggtcttccctccttagaggcctggtgcctcggggactcacgctgcttcctgccaccctgccctgggatgtcgctctcctccaggcagggagccagcctcatttctcctacaagcgcagcacagtgaggtggaacttgtgaatgctgacccttccacccaggttcagtccctcgttctctctctgctgctgcagcctcagtacctgatccgtctggcctcagtttgttcacatgcaaaagtggggctgatgaaagtagtcccggctttacccacttcataaggctgctgtgaagattaactgagctggttcctagacagggtttaagtggtccctggcacagagaatgtactcagtaaatgaagcggttcatagcagagctttattttgggagaacaaatgatgcaaggatttctattaatttttttctagcacttagtggaaaaatcaataaatatttgttgaaccaaactggtcatgaatctaccgatctaaaatgctggccctgtgaccacaggaatggtgccatgcaaaagtcggacttttcaaaaagctcacttggcagctattatgtgccagaagcagtgagtacattgtcttgtttaatttttcccaccagccaagaggtaggtactatgattctcccattttacagatgagaagactgaggcccaatgaggttaacagcttgcctcaggctcacagagctgatgagtagaggtgttgggaattgaaaccagacagcgtgaaaccagcatctatcctcctaacataacctcctatcataacctactgagaaagaaacagcagctgtcactcagtggctgaggcctggcacgcaaggtgagctgcgtcattctcctattacacaggaacgatctcacagattgacaacctcaaataaggtttctatgagactatgataaaatgaggcaagcacaaacaaaagcaatgtctctgtgccatccagaaaataccgaacacccctcttggctgaaatgagtgactgctacttctttatcaattactgctctctgcacactcgtctctcctccctacagatcagatttcttgagctgcccagttgcagggctgtccctccttcctgacagtatctaatctgtggcaacccctattttcgtaggccttccctcaaatcaccaaagctcaaatcctgtgctaggttctttctaacaccttcctactgaggcaacccgaggttcccctgatgtgagttccctcgctgcaaagagcaagaaaccaaactagactaactacaagtgtgttcctggtgggctttgggtgaagggctgtggatgccagccttccttggcctggaaacttccagtaataacagccaccatttgggcaaggctgcatgtgccaggtcctagcagcaaatgatctattaccttcacagcagctctgtgagggcaggtgccattgttccattttaccgtgactcggagaggctaagtgacaccttaaccttcacaaagtggcagagctgggagatgaatctttgtttatattaatataaaatcaggccgggcgtggtggttcacgcctgtaatctcagcactttcagaggctgaggcaggcgggtcacctgagatcaggagttcgagatcagcctggccaacatggcgaaaccccgtctctactaaaaatacaaaagttagccaggcatgatggcggctgcctgcaatcccagctactcaggagattgaggcaggagaattgcttgaacccgggaagtagaggttgcagcgagccgagatcatgccattgcactccagcctgggtgacaagagcaaaactccgtctcaaaaaaaattaaaataaaataaaataaaataaatgttttaaattactgatccattgagttacaaaatgccgcacgtaaaatgttcaagtaaaacttagacatcaggcaaagtattaaggtttaacatcagtccgttagcacagccacagtttccccctatattgatgttctagagctgctgctgcttcaagaagatgttccacatttgttttgtggccttgaatgccttctgtggcctcctggaggtatctggactcaggttacagaagcataagctaaggatagctctgggatatccagctcagtttgggatcttgaagtcagttgtgttggggacagggcacaggcccttctgctagactgagctcctcaatgtctccagggcacactttggccacatagcagctatgtactccaaggtggtacctggcctggacctggctgggaacacagggctctagacacaagggctgcctatgatctggagtcaagggcccccaccccgccccaggtgcccaatcccctggttcccacctgctctcatgctgtgttggttacatgcttccccaccttgtcagcttgtttctggaagctccctgactccctcacaggccatggggaaaccacctttccccattaggggaaggggaggaaaggagcctgtgatgtccacagctggctgcagatgagcattcgacccagcccccagtcagcactggagagcagagagcatcgactaggctgccttttccttctctctcaaggcccttatcccacctgcttcttcacactccttcccaggctgctgagagccacacgcccagggccagtgaagtgggatcaagtggggaggtactcacagccaccagtccgttgtgtcctgcaacaaaacgggacagggaaggaaaacatcactggtcagcgggcgggcagacagacagtccttgaggaatgtgctccccgctgcccgtccccatgccatgaagatccttggtgaccctcccctccccttcccgcactcagatgttggaacagcatctagttcaactccatgaaacaccagatcttcaaggagtcagaaaaccctggttcttgccttggctggaaaagtcctgctcccctggcttggtcaggggctctgctggagtgaggggctcatgagagcatcgccagggcttccattgcttgggaggcgcaagtgatggtgtctgagggagcagcacggttgagttggcaagcaggagaagcaatgggtggctggcatgctgctgcgccaacgtcccgtctcgcatggcagcatcagcatccaggggagtgctggtcatgtaggtagttgctatcaagcgcggcttgttttgtccacgtgtggttcacaatcggcacagtggtgccctagaaggctttattcacatgggttttttttttttttgccaatccccagtgttccaaaaataaaacatgaacagttcaacatgaagtaaacatgcacagcttcaacatgtgctggagtgactagctgtgcttcagggtgccttgagctgagaggcctgaatttggctttggcatctcacgttccacaccaagcccctgggtagcaagtgcctctccagctctgataagctcagaatcacctggaaggttgtataaatgtcgactcccacagacccccttcccaggagtctgttcagcaggtgtttcacagaaccaaaagtttcatgagctaaaattaactcttaccatatgagaagcatgtgagaagctagttggttacagttcatcttaaaaagtgctggttgacatactctttatttgtatgggcttttgaaaatgttcataagaaagtttaaacaatccgccagtgggactcatgaacagatggaatctgtctctcaaagacatgcagcaaactaaaggcagacagtcctgggctcagcccagcctctgctatttgccagggcatgacctcagagagtcatcagctgccctgagccttgagtttcttcacatggggaacagagggtgccagggaccctgcagtgtggcaaggatgagataaatgggagctatttgtcttttaattggtgctgatgatcgatcttggaaaactcatagtcttccaggcaactgggtccagttcaatcatggcagacctcaaatgagtaaggtcaaggatccaaagcacaagaccccctcccagtgaccaccctcaagtcctggctgagccctccttggcttctggtgacacctctgttcccttgaagaggacttcagctgcgggctctgctaatccccagacctgcctcaggggccccatagcaggcgcctgggcccttgaggagctgctctgggcgtgggctctgcagctgcctgcatcaggcagtgttggttgggtggatgtgctgacctctgggagacacctcccgccctcagaatgctcgtcaccaggtatggggccaggaatctccattttaacaagccccctcagtcactctcaggcacatttagtcaaatgactaaatgagattcatcttcaaggtggcggccaggtgccagtgtgccttcagggactcagaggtaacccttgtctcagaagatgccgttctgttcctcactgaggcccaagatgcctttaaaccaggctttatggtatgtttagcaactaaagaaatcatgtcaaggaaaagctcacacactgagactcactcgcacttgtaggcaagtcaccaaggcagctggtgacctaaagtcaaccttccccattaggagacagcagggtgagctgtggctgagcacggaaggaggcagggggcttctctgaggctaagtgaggtgctggagatggctcccaccagcccggggagtttgtgagccggctgtcaaacagccattgatataaactaaattatataagcttacaattaaataaattaaaaacaaaggtaataaatactcaaaacacactacctcctatttgttttactacatttgactgttgcccatgccctggcagtcactggcctctatgtacatatctgcatggtggacacactatacaatgatgtgctactgggtatctctcctaaatcacattgagcaacctcatcttggtaacagaaaaggctatggtgggagtatttacaccactgtcatcagcaaatattacacagaagggctgaatttattttttgtggtcaggcttaagaaagtgatgggaaaatgctaataatgcagattaaacctaacagtgttagctgttatagcatgaataaatagcacaaaaattgaaggaaatattctagtattagaacaatattatcttatttgagtaacatcattcctgtcatttaaagaaggaggccgggcgcagtggctcacacctgtaatcccagccctttgggaggctgaggcaggtggatcacaaggccaggagtttgagatcagcctcgccaacatggtgaaaccccgtctctactaaaaatacaaaaattagccgggcgtggtggtgggcgcctgtagtcccagctactcgggaggctgaggcaagagaatcgcttgaacccaggaggcggaggttgcagtgagccgagattgcgccgctgcactccagcctgggcaacagagcaagactccatctcaataaatgaataaataaataaaataaaaataaattttaaaaaataaaggagtaaggttgggacataaatctttgttgtttcatttgtttcacgatcatcctactctttacagaaaatatggagcaccgttctctttggagctaccctcatttgtcatttgcaactataggttggctactgagtttggcaaaaatcaaagaaagcctttggtaagaatcactcgggtagactgcatttaaattgagagtattgtatctttatttgtaaaattgtgtgcagtgtatcttttatttcaatatttaaaataagcatgtgtatatgtgtatatatatgtacgtaacacatatacatatatatacacatatatgtgtgtatatatacatatatatacatgtacacacacacatacatcacacatttttccctggagaggtgagtgttgagtatctaccagctcgcaactgctctagtacatatgaaaatgaaggcatgccctcaaagctgcatgttgagtgccgtctgctttcggtcccgtcattatctctgtatagacccagttggcaatcatgcatttggggccctctgcaagtgtgaaaggaaggcactaaggaaagaccacctggtcctgggcctgcctcttcccctagcacccagtagactgtgatactctgagcccaggggttggcaaagtgtggcagatcactgcagatccccaaatgtcccagagctgcaaggcaatggggtccatctccctctgcagacacgcagtaggaactctgggactcagttctgttttatcctaactggcctttatgaaatgactgcagtttcttgtgacgaggggtggcctcagtggtaaggtagtggtgaccagaactcagggcactgagggggcggggtgctggatttcacttgtctgttggcccagggctctttccaacccttacaaaccataggctgagaatgtggtggaaactaggtcactttgcaagagatatagggaaacccctgagctcacctagtcttcctgtcattctccatgggaagatccaagcccagagaaggcaagcatttgccccaggccacacagcagagccagcaccggaatcccaggtgcctgcctgccagatggaagggctttccattgcagcccctgctagcgtataaacttctggctgggttatgccagaggagagagcagtggggcttggctccccctccccctccccaccaagctctgagcagggctgtcttcccgcccctcagctctggcccggcctgctttaccactttacctgctcctatcaccaccgcatcatactcaggcttcagacctcccctggcttccgtgttatctcgtctccacgccgggaagggagaggcggccacagccttgcagagacctcggccacttgcagccatttctgccccaggctgggccttgctaggcagggagtttgctagcgattggcttttgtgctgccctaggcacggggtggagcagggaggaagcaggaagaggaggagctgcagtccccctccaggccccctccaccatgcattcttggccacaggccagcctcctgctgccctggggctgtgctgggccgtcgggagtgttgcctattaaccaggcggtgtcacctccaggatgcaggggataatggcaaaactgacaatccactggggttcctatgtcaggctggcattgtgctgaaccctgtaggcaaaactccccattttacagatgagggcgctgaggctgcggggttagggaatgagtggtggaggcagagtggagctcgaaagggccctctcctcccctgtgcatctaccttctcagtcagaactgaaacgcctgggatggcaagtgctcgtgtcagactctgctccaactccatgctgagtctgccagtgcagagtggtgatgcctctacgcccacaggaggcgcccagggcggccatctagcgtcaccacgaccagggccttcagacaccgcagaggcagctgtgtctgtcgctgaggagcactggagtcctctcctaaatgctcaaacacaaacccacaacgagggcttaggggcaagttcgctgtctgtaattctctggtgttttagttttgaaggcctggccagttctcctcttttggcaccttgcccattttccaagaatccccaaggattcgaggtcacatctgtaaatacctccagctaaagttctttctgaccctcccttaggcctgccttgaattaggagcccctttgttctctgcccattacttagcagagtgttcccctaggaggaaaaaaccccttggagcggagagttcctgcactgctctgatatcgcagtgtgacggaaacctgctattggtaacgaatctcagaactgggagagtatgtggagatgatcctaagagggggttccgaggacccctccacacaccatggacagttaccccgcatgtgagcatctctgctaagatctgattcaggatgttcactcctgtgttatttattatatagaaagatcaaggggactggttaaactagacatatcacatccagccgctgctaaaaactaaagggaaatagtaggtgacaaaagcaggggtcctgaacagtggtgggctcaggggattggagttttttcctttatgtttttctgtattttccacaatccacgcttttcattgccattccatcagatgatgttaaggaggaacacagatccagtcacctgaggggatacttcctcactgccaccttctcagggtttagaccaacatgtgggttctagttcccccagccccaaagctgttccctgcaaggaagagatcagtctttgagcaaattttggctcaagactaaagacacagaaggcgaggctcctgcatgcacagcacacggccatctgatcctgtgctgcagtggacgctgactttcgccacgccgtcctctctggcccagcaccggcctcctggcctcagaggagcagacactcccagtcccagggctctcagggtctcttgtccctgggtccattctgggacaggaacttctcggttggaagagaggggctgtacccctcgggtggtggttctcaatccagggcgcaccacagaagctttgaaagacatcaaaggctgggctccacggccgccaagggaatccaaatctctgggccagggccaggggcttgagaaccccagccctagggcagacgccagccaagcatgaaggggctgggacttagcaagggcttatcagcactgacagaagggtctagaagcactagcatgttgggcttcagtgataacaatgaccaacatttattgagcacctaccacactgggtaatcctcacaccaccctgggacggaggtgccatcgctttaaacgtggggaatagaagaaacttgccaggaggtgcagagaggaagtggcagcgctggaattcaaacccaggcaaaggagcaccttttacctggggtaggagagagcttgctgggtgggcttcctccacgcagggaacagcagagatggggcttcctccccatctcccaggataaaggcagaggcagctctggaagaggagctgttgccaccgttgttttacaaacaggacccctgggcttccctcttcctccagagagaaggatctggggccttgctcagtacctgacatggagggtggtctaggtggggttttagaagccctggggccaccctgggcactctgccctatcctcaggatggccactgcagacaggaggctctcgtcatggggaacagtggcaagcaagggtggctggaggacaggatgcaaaggcagactgcggccaccttggcctagagcagggggatacgggaggcctcccagaggcgccgggccagctggccggcctgctgcaccagcaggtcagtggggatgacagacaggtgcagggccagcagctcgtagcacctgacagcctcggttgggcggttcttgctgtagtagcgcaggagcttcctggggaggaaggggaggatgggattcaggagtgaggctgtggcactcctccagcgccagaggcctctctgggccctcgcaagcaaatgcccatgccctcggtcatctcactaggcccctgcatgtgggccttgacaaccgctccggttcctcactgacctaacagtggcatcctggctacgaggtagcagtggggatgttctgggccgggcacagacgttccccgtgctgccaagaccatgccagcaggaaggtggtaggaacacagatgtaccctccacacccgtcctccctcgctgcacacagggccagccgggaaggtgttcccagcgtggatttctgggtctgaggtagggcactgctgaagcagaagctgctcccggcagaggcgagcacttatcacccaaatgggggcatctgtccccagtggctcccaacgcagcgtcacctgtagtagtctcctcccagcatgccgataggcactgagtcgtcggagaggacgggcacctcgatcatctggagtttgtacccctgaggagggaggacagggaggcagtgggtgtgggggtagtgcaagggcctgagtcagacgcaccgggcttgcggcctggcttggctctgtcatgtgcgctgggtgcttgggaaaatgcctggaccttgttttttcatctttgaagtcagaatgacaacagtcaccttatgaacattagagaaaaagtatacaaagcttcaagggccggcagggtagctctcattaccgtcaatacctggacctgtacaggccacaaacacacgctcaggagggcaccctgcagggctgtcatacaggtcttgaagagcagagcattcacaaaaggcccaagcctctgctctgaaagaattgggaattcccagggtgggataaggtggggaagggaattaagatctgctggacgtgccgtgtgtgccaggcatgaacatggcacttagctgatgcttgcctgggcaccgtggcctgccctgcagggggagtggactccctagtgtgcagggctgcccccacggcaccggctgggctgtgtggctggcattcaaacctggcctctccagcccacagctctgcctcactttatcaccccacggggccacccaagcacacagactcctgtccctccctagaagtgaaggtaaaggtcacaggaattttctagcacttctgttgtacacacgtcctgggcacttctgagggcacggaggaaagctgggagcctgcaggccgggggagcagagcttgggctccggcttcctcacttacagcctcggtggccctggccatggcgtctgatctccggatcattgtgtctccatccgtacaacggggtcaggaatccctgccccagccactttacagggctgtgagggggtaactgagagaacagtggtggagagccccagtaaccgccctgccctatggaaagggatggctgtcaccctcagtgaacaaagagtgcagggtgggggcaggggaaggcacaggagtgcagggacccagagaccaagggctgcgagggaggaggaacactcctgagagctggaacaaccactcctgagagctggaacaaccacttatggtgacaagcgagatgcaaataaaagagaaacaggaggaaagcgaagaaagggaaaagacagagaggagggagagacaggaggagaggagtcccagccactgcacccctcacagccctgtgcagtggctggggcagggatccctgaccccgttgtatggatggagacacaatgatagtaagctccccccactggaccctactctgcagtaacagtgaggcccagaagaagcagtgcagggcctggaggccagggccccgagccacaccaccagtgtctcctcaggcagcctggctcactgcttcaagcaggggcctatgctcttgagttcaggggcctatgccacagggatgaccatgtgccacacttggcatgtgacgctggcgacatggaagcactagcgacaaagtgtgtggtctgagtcgcatttctcacagtggggcatgtgcctttctgctcacatgtgtgcctggatgccacgtggacaatggcaagagtttgccagacagctgggcagagggatcacaaagcagttaaacgcccatgtgaaaatgtgacctctgaactctggctcccaacctgctgggcttaccagcaacaagaagagaagatgagacagacagacaacaattcagaagaaaggaatccaagagttacagagcgggaagtgtgtgtggcccgtcctggcccagggactcagcctcacctaccatgtcattctcgaaccacaggaagtaggagcagtagaaatccccctcctggaacagcagcgtggtgtagcccttctgcaggtatctgcgcgccagctggatcagagaccagacctggggaaaagacagcaagcatcaccactctcccagccttggtctgcctgggcagctctcacctccgaaggaaggaaagggcacagccgagaagctccgtgagtgccaggggcctctcctagtacccgggcactgccttggctcagagcaggaggctcaacaataaatcattattggatggatggactaccctccagttagcgtgggggcaaaatatatgtaaaaaagctttgtgtaactttactatacacatatgccataaattagtgaactgggctagtgtggtggcttacgcctgtaatcctagcactttgggaggctgaggtaggtggattgcttgagctcaggagttcgagaccatcctgggcaacatagcaaaaccctgtctctacaaaatatacaaaataattagccgggtgtggtagcacacacctgtagtcccagctatttggggggctgagatgagaggatcgcttgagcccaggaggtcgaggctgcagtgagctgtgcttgtgccgctgcactctagcctgggtgacaaagtgagaccctgtctcaaaaaataataatattaaaaaaaaaataaattagtgaaatgatcattcaggccagagaatagccagggacatcattaatgaacacaggagaacaaggtgtggtctcctgaatcccctcctctgcctggggtcgcccactcacctagtgcccttcaggctgggaactgatggcacaggtgagtgaccctgtaggatgtgctgagccaggggggaagtccaaatcagagttcaccaaggggtcagatggaaacacagggcctgagaaaccacgtgccttagctcccctgggaatgtcctcctgcctgacgcagggactgtcaccagtgctgccggtgaagtgccccagggaaggcagcagggacagtgggctctctgccacctctcagggctgggaagagactcgaggagccctctcctctacccttaacgggagggacaggcgatctgctccaaactgcatcgccgtgtgattactcattaaatctgccatggattgactgtacttttcaggaaagtaatttgacaacatccatcaataatcttaaaaacattcctcccatctgacttaataattccatttctaggaatccatattggggacataatcagagatggggacccagatgtatgcaaggtgtatactgcagaattatttataacagcaaaagcctagaaataatctgtatgtctaaacatcagggaaatggttcaataaattatgttacattcacatgatggactattatggagctgctaaaaatcatgtctataaagagttaatggcatgagggaaagcatctgatataatgtgaaatgaaaacatggtagcaaagttgcacatacagagtgatctcaactacaacaaactgcacagaaaaccaacagaaagaaacgtaccaagataaccccaactgtctccagaatgaggggcaaggatgaagatggtgatgatgatgccaccagtaagtactgaatgaactgtatctgtattttgtgctacgtgctatgctaaatatttgatacgtatcctctcatgtactcttcataactctgtgatgtaaatagcactattatttccttctacagatgaggaaactgacccttgggctaagtactgcccaaagccacataactggtgggagacggggctgggcttccaacacatgcctccaccacccatcttcccatcttgttttaaacattagaatacactttacttgcctcccccaccaaaacaaagaaagaaaagaacacacacacacagacacacacacacacacacacacacacacacacacacgtatagtttttttggagagtggcaggggtcctccccctatcaaaaatacaactttgtcatgaaaaacagtcagttaaataaggagaataaaagaatttccagggaatgcttccttaacagaaatcaccttgttttaaattctgatgcccaactgatggaccttgccgttctctccattctagctcattcaacaaatacttgtcgagcatttatttatgccggcactggccactgcctccttgggcctgctgcccagcgcactctgctagccccaggcatgtggatcacaccaggaagggctacccaatattggctgaggcccacccatccccgccctgggtccaaatggttaccttagttttgacaaaggcagccagcggccccttgcccaactccgacgaggtcttttgactgcagttgagggaaggcgccaccatctgcccagtggtgcggtccacatagatgaagtgcaccaagcctgggaagtcttctaggtaggtgaaggtctgagttaaggtgcttacaagccaggagctagggacggcctgcctctgtcctgggcttctagctgtgcccagtcatggtggcaggagggccaggactgcctctttccagcagcttccatttcagctaagccccctgtatccttgcttcctcagatcccccactacctccaagctccccaggccttgaaaagctgtaagatcctcaacacttgcacatttgacacgggcagttctggccctacaggaacatggtatgcatcattttcatgagggatgaatttaagtcagacacacgtgaggctggagtgtgagcacagccacttggttcatgagtgagcctagctgactgcccagcctatgcacctcactgtgatcttgctaaacccttacacttcatcatgagagtttggaaggctcccatttgggaggggaagagacatccatagaagggcagcagctggtggctaaagaggccctctggcatcctttcacctgcccactgaggacctgcctcaggagactgggggctggacatttcagagatgatatgggaaaagctgctttacatgaattttcatggaaaatcagtattcgataaaattagtgttccataataaaagggtcaaatagtcttaggaatggcttctgaaacagggataaacatttgccgtaggccttctagagcttttacatgccactgtgcactgtcatgatctaagaaggacaacggccctttcaaccaaactagaccacaggaaccccccccccggtccccacccctcgtggaatacctactaccattttgccagctgggcaacactgacataaagggtctttatggcttttgtgaattaactttgggacaggaggaattcctgaaatttcagcttgaagtattcctatagacaaggcacatgggccactatgtcccattattttccttcagagaggtggtgagcagctgatggggtggaacatatatcccccttccctggggcccatagtccctccagggagcaggtgtagaggcagcagatccaagaggcttgttgggctggctggggccccggcgtcaggatatgacaccatggtgatgttcctcctgctcttcaccagcaagaagtccttccagtccgtcagcttctccctgccgagggaagctcgggctgcgtgaaggaagtacgggccccagaccctgccctggccacccagggggccgcactgcacttaccgcatgagcctctgcacttggtcctgcaggtgctggggcaggtgtgggcctcccctgctgggggctgtggtcagaaagttcagccggtagatggcgcagagctgccgcttcagcttcccacatgcctggagcagcctgagcacgagagaggagggcattacagcagaagggacctaggggagcccctcgccctgtgtggaccaccttgttcctgcacccaggacagacagacctggggagcccttcccccttgtggaccaccccactcttgtacccaggacagaccaacctggggagcccctcactcccaggtggaccaccctgctcctgcacccaggacagacagatggaaagacctaagggggcagccacagctgatcaggcaatgggaaggagcttcccagcttctccacgcggtgctccacgtatgtgggaagaaatctcctttcttgaaattattttgctgataaatgaagggcagtggtggaggagatgtggcctcccagggaacagtcccctgggcacacgacccaccccttgtcctgaggcccaccactcactcccaggaggatccgggctcacttttggagaaagccttggccttaaactccagccaggtgctctggaaggaagacagggggcaggtttgcatcccgaccatatttccagtgaggtccaggccaaagtccttctcagatcaggctctgagagggcacagggcccccagacaaatctgcccttctggccaatgcaggctaccctggcaggccccaccagccccctgcagacttcagtgtgccatgttctagtcactcagcagcgtttatttaaagggcagtttccaggggctcgctgtctgacgggcacaggcacacatagtagcaccgtcacagcaaccaggccagcccctcggggtggggggcacacacagggcagcggctggggtgtgcggaggaggtgctgctgcagaagctgggagggtatggggtgggcatggggtagccatgcagggggcggcctcacgggatctctataaagcagaagaacttggtgttctagtgaaagtgctccttaggacaccctgaggcactgcgggatgtggcactgcctcctccagccaatcctgcagccttcagactgacaggcactccagccacaatgggtcccagctcctcaaacaccaggcgcctccactgcttaaatccagagtcaagccccaccagccccactgccgtccaggccctgatctgggctttgtcagagcacggggtgatggactgtttctactgcctgcacattctcacctgtctcctggtctcagctccccacctgggccctaagctcactgggggtggggtggagccgtgacctgcacatccctgtgttgccctgtgagcccggggacacagccccgctgcagagaggaagcccgtgacgggcggatcccgactgcacttgctcactgcatccgggctctggctccactgctcatgagctgcataatcttggccaagttaaaacttgtctaagccttagtttccacacctaaaaaaggggaattataattcgtattctgccaaacacacataaaaagattctgaaaaccaaaaagcagctaagttttcaatatcatttcataatagggaaaacaaggatcgtaggcccgggggaggtggagcccggacaggaacccaggcccattggcccctcagctgctgtggaccggatgtaccctgctgccagccctgcctcttccccaggtggggaggactggaacttgggtctcacctgaatctcctgtgcccctcgattcttgacaaacttgtccatcctctggcgcaggtctcccacgaggggctgggagcgcagggaggccccgggctccggcccttccttcagcttcttctccagcatggagaagccatccatcagctgggacagaaccagggccaggggcgcgctggggctctgagggtaagggccgagaggcgggtgaacggggctgcccctggggaagacgtgccaaccctaagcatcatcagggcagggtgaggggctctcctaccctggtcaggagcaccaggttgatgccctgccacaggggcaggcagtacatggtgtggggcactagggggcagtagctttccttcacgttggcatccaggaagatccttctggggccggaaggcacagggcagtggggaaccagtgtttggagggtgtcctctgctatctacagaggaagaagagctgcagtgagaggtgggatccctaagttggacccacccattgcggccctatctgtgaaccacaagaaataatcatttttagctccaagaaactccagtttttaaattcctgcactctgctgaacctgccctcgcagctccagtttcgctgttgcccctctccctcagctgctcctgggcctttctgcccagagtctggcccgggtgccaagcagggcagtgggcaggggcagaggggctgggtggtggcacagaggaccgagaaggcagggaaacactcgtggatggggagtggacggggagaggtcccctccccacatttgcaacagatggaggtatctaatgttcaacattgtatcatttcaatcaccctcagaacatcccaacagccactcaaattggggaaactgaggcataaagtgaccaaatgggcaaggctccagccttacagagggatctaagcaagaaagcctttagtgcaaaaaattatagaattaaggaaatcatgagagatgccacaaaaattcctcttcagtgtcatacctaacagcaaacactggacacatgacgcgattttcctggggatttgctagataaataacatatgcatgtgatggactaccaatcattacaaaccacactgtgggagtgcttaggaaatggaaaaatgtttaaataaaaaagtataatgaaacacgttagtatccaaatctgattttaaaaatacacatgtgtacatatgtagtgtgtgtgtgtgtgtgtgtgtgtgtgtgtgtgtaaagtcataggaaaaaaagactagaaggaaacaccccaagatgttaatctcattttgaggacgggattaagagtaatttttattcccttttttatagtttacttttgtatttcccgatttttctacaataaatatacatgctcacttaaaaaaaaaattctattggactttcactcccaagaacaatggagctgagggacagcacctgggggaggggaggggcaagttcgccacccctcacagcccattcctggaccctgcctctgggctgagctctggcaccaggacaggcacctgcactgaccagccctggggtgggcaggaggagggctggcacgggtagagtcaccctggaggcgaaaccctcagagcccccaatactcactgcggcatctcagatcagctggcgcccaggcaggcacaggagaaactcacctgaagggcatccatggggggggtgcccccctccagccagatggtgctacctgcaggccacaggtaataacataacgatgtaagtaccatgagatgtaagcaatggctcaacagcatggggtagggggcccaggtgccccccacaacctcagcccttggctgccagctccacgcaggggtgctaatgtggctggggcaacaccccttcatcctaagttggcaggcacaaggtgaactctgcagtaccagggctaaggcggcctgggcctggcagagaagctgcccccagagccagctgctgagaatcaagctcctgaggacatgtttggtaatggtggtcagggggtagaggggcatcttcctcccccctcccttgcccccaatcccctccttgttctgtcccctgtattccttcaggcctcaacccgcccctcaggagtcagcacacacagtccacgtttgcccattcatttattcaaccggcaagctcttactgagcacctgctgtgtgctgggaattgaggtggatttccttcctaatataacgcacaaaaacctactgaacccaccacatatctgaaatattatgtgtctgtaataatactgttacctcttatatttcattgcaaacaaccctcatttataatcatgtttctttgggggaagtgtgttcctacatcttaaacacctgatttacaaatggatgagtgcaacccaaaccatttgtaagttgtgagttctctgcacggtggaacagcattattttttacagttttaaggcataaaaaaccactatcaagagagagggactgggaggaagatggtgatgaatgaggaagggagtggtaagaggaacttcggagattacccagaactctgcttctcaacaggtctcaggctcatcaagagctcagggaatctgaagatagctaggaaccctcaccccaggaatgcacaggcatcagtgagttcacacacagtctcagggggtcctaggcttctagccagacctaaagttaaaagcatctaacccagtggttgtcaaccttggctacacacgaaaatcatttggggacttttacaaaatcctgacgcccagggcatagctcagaccaactgagtcagcatctccgggtacaggctcagcttcaataattgttaaagatccccaggtgagttcaatatgcagccagggggcaaagcatgctgtaacctaaatctgtgcacagcagtggtttgcacccgaggcacactgaactcacctgggaaaatttcctagaagtattcacacctgggtcccaggcccacagactgtaacttaattgggctggctgaagctgcctggtgattccaatgtgccagggttgggttaaaagcagccacataataaattcctttcaaatcctagtccccagtaggtttctcctcctgaaaccctggccttctttcttccatcagatgatgtggagggaccacaggacccttttttttttttttttttacctaagaacttcagaaataaatgtaatgtttattcatagtgaccacaacagtctggattttggtttatctacttctctaagcaaggttgtccattttttgttaacattttgaatatttgtagttttgttttgtttttttttttgagacagagtcttgctctgtcgcccaggctggagtgcagtggcatgatcttggctcactgcaacctccacctcccgggttcaagcgattctcctgcctcagcctcccgagtagctgggattacaggcgcctgccaccagacctggctaatttttgtatttttagtagacatggggtttcgccatgttggccaggctagtctcaaactcctgacctcaggtgatctacccgcctcggcctcccaaagtgctgggattacaggcgtgagccaccacacctcaaccattttgaatatttatagtttttttttattgtttacccacatactttggagaaacaaagtataaactacagatgctgaatatattttagaatgtatagaaattagatgattattactaaatttaacttaatttttaattttaattacaaaaaagatgagtctgagaatgcatgtacagaagttttaaatgaatcaacttgtcatcaacagctttagggatcagtggagtggtcttaacaatccttgagttcaggctggagctggcagggaagatggggagccgcagacagcgtcctgtgctctaggaacacgggtacctgcactcaagccttaggaggcacgggggtccactggagcctaagacagatgtcctgggctgcctgtcgctcgcagctagctattgtttcctcctgctttcctccggtcctcacctgagctctgatcgccaggggaaggagctggtgtgaagtactcctcagggagggagaagctgtctgtctcctggaatggagaaggtggctcaggttgagaggctctcccagctggctcaaccctgtccctgctctcccaggagggatgggaaaggcctggtcgcctgcagaggccgatcccctcctgcccctgactccacgaagtgcacagcacacaccgtctctgcagagctccccccagttgggcccgtggagtgagggctccaggcctgctgcacggggatgttctggctgctccgggccctccgcggggaaggctgtgcagggcaggggagaggctggttagctcctatctgacctggctccctccaccccttctgcctcccagcgcttcacagagaagcctccacccctccacccctccacccgttccgggtgcagtcctgggtgtgtggtcctcagacttcccagggattcgattctaggcggtctgttctgtggaaattcgagaaattccaacacaatggtatccaacccaccactacccctggtgatgaggtcaacagcgatggtggtggctgacactcactaagcattcactatgccccaggcagtgccaggttctgtgggaaccaccccttttgtccctccaaatacccctgagaagtagatgctttgttattcccattgcacagataagggcactgaggctctgggggtgcaagtacgggctcagctcacacagccaggtgttgaagctgggtttcgaaccatggctgacttgaaaaatctgcacttttaacccactggaccatgtgcactccagaattccccttacatctgaaagcagtgggaaagaagtcacgcccaaccacacacccagaattgtgacttagaaaacatggagtccccagggggagcctgcccaccatcttcaggcaggttttctgaactacctccctaatggcctccctctgcccagaaagctgccctgagacctgaatgtcgtcctctgctgtgctctcgctggggtagaggtcctgaaccaggaggatgagggcaagcaggtcggccgggcgcagggagctggcactgtggctgcagacacaggagcatggccacccatcagcacatgcccagcaggagacggggcaggcaggttaaaggagtgtggagcctggcccctgccctcaaggagcaatgtacttctggagatgggcaaggcacaaatacaattaattaactcgtcaaatttcaaaataaaacttggttgtatagaacaaagaaaagaaaatgatttagcagtgggaaagcaccagggaccaagaacaacataaaaggaagttctagattgagactctaagacagtgttccaggaaggaatgatacagagaaatgggtgagctgaaaaaggttggagaatcaaatctgggaaggtttcaggcttcatggaggaggtgattcttggctgggcaggtggtgcttttcaggcagaggccataggggagtgagaaggccagggagcctttagccaccacatgccagaccttgagctcacctagagtagaatgccagcagcttggagtgcacgagcaggaaggcatgcagggcctcctcgcctccccgctcggggctggtgttgacagcctggatgacgtgccgctccagcgcctctatgcacagctcacagagctgggggtgaatcagtcgctccagggcctagccagggcaggaagggagaggaagccatatcaccaacaaccttgccccactccaagccctgggctagtggggacattcactctgtccacagtgagcttggactctgcaccagatacttggaaacagggggactaagacccaccaggtcccagccttcctgaggcttactgtctggtcactagactccagtggatgaggcaaggcaatacacaaggaaataaagtaagtgccatttgtaagtaagcaccaagtacaaaatacacagcactaggctagagagaaatagcagagacctccttgggtagggtgtccaaagaaatgtccctgaattaggtcacctttaaactaatatctaaacaaccagatggcccaccagagaaagagggagagagagaacactgcaagtcaaggagactgcatattcagaggccatgagatggggacagagtttgcaatggtgctgtccaacagaaataaaagaaaggccctatgcataatttaaatgtttccagtgaccacattaaaaaagtaaaaagaaacagttgacattaattttaatgatatatttcattttactgaatatatccaaaatattatcaccatatgatataaaagccttattaatggaatgttttacattcttttttgtgctaagttaccaaaatctggtatatatttcacatgcatagcataactcaatttgcactagttatatttcaaatgttcaacagccacatgcagctaatgactatcatattggacagatctaaatatagagttttcctgaaacttaaagaagtttcatgtgactagcactcagtaagcgtggacaagagaggcataagatgaagctagagtgaaataggcagcgatagatcacacagggcctggtaggcttgggaagagtttggattttatgctaatggcattaggtcacctcctaaaagaagtctttcctaatgtcccagaaagagtttaccactccatctcttgtgccaccatagcttttgatgaaaaacctaatatggcaccaggattctttattatatcttttagtatatacatggctgatttcccctcaagggcagtgaatatgtctttattcatctctttattcccatggcctggcacacctcttagcatataataggtactatatgtttattggaagagtgaatgagtgggggtatgagaatgaattccttcagatctattttccagctcattaattctccctctagctatgtctcatctgctatttaacacatcccttgagtttttcattttaacaactatgttttcttttctaaaatatctgtacgtgttctttttcaaatttgcctggtcaatttagagtttcttcttatctcattttgtgattctacatttcatatttttaaatatttcatagttattttatattctatacctaatagttccaatgtatcaagtgccttgggatctaaatctgttggtgattgattttcctgactctcactcgtggtggcttattttcttccatatctgattttcttcagttgtgagttcacgtttgtttgatctttacctttcctgctctagcagtggttttcaaagtgtggttcctggacaagcacaataaacagcacctgggaattttttagaaatggaagttctagggccgggcactgtggctcatgcctgtaatcccagcactttgggaggccgagtgggcagatcatgaggtcaggagttcgagaccagcctgaccaacatagtgaaaccccgtctctactaaaaatacaaaaattagccaggcgtggtggcacgtgcctgtaatcccagctactcaggaggctgaggcaggagaattgcttgaacccgggaagcagaggtcacagtgagccaagattgctccactgcactccagcctgggcaacagagcgagactccatctcaaaaaaaaaaaaaaaaaagaaatgcaagttctagagcccccatcccagactcgctaaatgagaaaagctgaaagtgaggcccagtaacctgtatttaacaagccctacagaggattctgacacacactggagtatgaaaaccactgcttgaaagagaatttggtttacctctttaggaaggcaaggagtgctactgaccagcagccactttagtttttatttttaattttttagttttttatttactagggctttataaaaggaccagtagccactttaactttttggggctgggcttaacctagagttgcaggctcagctctcctatgctgctgctggcctaaggctatttactggctgtagtgctggtatcatttgcactcagggaatcttgcctttagcgctgtgtttttctccactgctttcccctccagttccagctcaatataattttgtgggaaaaggaggggagggttgaaggaactgtcttcaaagattcctgtaatttacagtgaacccaaaaattgcattaaaagtatgtgttatccaggatcgagctgttttaccatgggaaagcccatcagggtacccaaccctccatatggccagaaagaacaactctctctgaatacacgagtttcaggggctgcttgtgccttcattcattagggttaaaacatggtcttaaaggtggacgccccctctgacctgacagcttcaagtcctgaggactcccgcgcccagtagtcacctccacggcgaagcactgctcctgctcccgcaggcggctgtaggtccacagcaggctctggaagtgctcccacagctggacacgctgcgccaggtctgggggccgcagcctgggggcagagccagagagggcgggagagatcacaagaaagctggtctcccccacacccaaccaaaggaccacagtctcagctcagcatcagagcttggtgagcccatatgacctgcccacacagctgggaaagggggccaggtttccggccgagctctaactgtggagtggggtgggataggcacggagccggaaggcaggcagctgagcaaatcacctcactcctcagcctctgtcacacaaacacatgtcatacaaagccagctagagagagccagggtgatgcttaagcttctcacacagaggccactgaacacagaaagatctggtccatcatcagggccctactcagggtcgcagccatctcggatgctggcaacgtctgcactggccactgtgattcatgtaacaggcatctgccacctgcagcatttgccactgacaccatgacctatctgggctaaaatgactcatgaaacaatgtttgtgcatttgagaaatgcctcaatatgggtagttgctcatatcgccacaaaactaaagtcccagagcttcacactccgcagcttcccaatccatcttagagaatcagggggtggtgatactacgaacttctcttttctaggtctacatttcaactacaagccttttctggggtccctcccacctcagtgtatactctgaaccatgattctctttccccaagttctttactgtgggcccagagacaggttttaaggtctgtctcctgagaaaaccttcacgagactgtatgaatgtgcatgggtttgtgtttttctggagagagagtctgaagcttgagaagccagagaggactagctcagaccagatttgtaatgacgggtgatgatgttgggaggatggaaagagcactggactgagagtcctgagctcaaatatccagtttggatgtggccaccaaccagctagatgaccccaggcaagtgagttccattctctgctctgtttcaccagatataaagtcagagggtcagaccagatggtctccaaggttcacttgagctgtttctctgacctagggacccagctgggggcagtatgtgaaaaatggcagcttcacaggggctgggcacacgctgcctggcccagcgagggtgctcggcaaaggacagaggggaccagctttgaagactcactcctttcggataagatgaccgtccacagtcaccagcccaaagtgcacttcaaacaggtacttgagcacatacagcttccgccgcaggtccccctcgctctcggtgtggtcaccattgatggcaatgaacaggcattctccaaactgcaggcacaggcaggccagtgtcagccagccccaagggcactcccttcacctgccctggtctctgcagacaagccaggggaggctcgggtcccaggcgggtttgataagatgccgtttctgccttctaaaggagtctaaagttccaaataagagaggcctgtggactccccatcaagctgagggaagaggaacatgggccccagagctatagactcaccaggtgaaggacatacaggaagttgccattttccgtggagaagcaggtgtaggtgtccgagagcttctccagcatcgtcatggaggagatgatgaccggggctaggagggtgctgagctggtcctccagggcagggagctgcaaaaatgggggaaaatttcacagcttagagtgggccagacaccaagaactaaggaagggacaagatcaggccttgatatcaagggttccatagtgttagaccctcctgggagggtatcactgtcctggtagggaggggagcaaaaagagactgtccccaacacttcgggtggtggttaggaagaatggggagggccagctgggtaatggtgctgtttaggctctgaatctagaaggaaacattaaggaattgggcctcattacaacagtggaatgtggggagcactgaacggggagctggaaggaagtttgtagcatgtaccaaagtctatgctgttttttgcaataagtctactttggaaaatttgtcctaaggaaaatgatcagagattgggacaaagatacatgcacaaagatgttcactactgcctaatttataatagcaaacaactggaaaaaaaatgttaacatctagtatcagggaaatagttaaataaatagcagcacatcaaaattatggaagggtctatagccacttaaaatattagagtgtttcaatgacatggaaaattcctctgatacaatgttgtagctaaaaataaaacaagaatgtgaatgcatagaaaaaacgaagtattgataaaatactgagaaagccaacactattaaagttacttctggatagaggaattaggagtgatttttttccctctatttttaagtatgtttctgtacttttcctattttccataacaagcctgcattgactttgataagctcttcctccatccattctctcagctctccaaaagaaggaacaaaacaaataaacaaaaacaaaaaggaactggacaagtttgttgcaaatgtgtgaataaaatgggataaagccagtggaacagttacaactcaaattctccgtagtggaataaaaagaaaggaagaaaacagcagacttcccaagaagatttcaggagacgtgaatgaaatatggggaaggcacagtcctaacttggagctggggaagtctacaagaagctgagtaagaccttgccttgaaaagaaagacaggcaactggccagcgggaaggtgcagcattgaagtacaagtgggacacagcactatggagtaggttttcctgccaacattcgggaaccaaggactgtacccagctcccacagttagtctgtccagctttcacagtggctcctacttatcattctggttccagctcagatttttttttttctggccacctcaggctaccgccctccacctctgtcactccccatcccataccccatttaacttctccagactatttgtcactatctgaactcatggtacttatttgccatctggttcactgtacaatgtccttctttagactctaagttccatgaaagcaaggatcatgttgctacgtttactgctttaccccgagagactggcacatggtaggttcccaattaatatttggttaatgaataccccacagataggcgagaattccataaacaggcaagaattcaaatatttgctgaattattcatataccatgattttcttgaacaaattttattaatagagaagtcacttatgaatctagatgttgatagaaactcatcgtaaaagcagtatagtcacatactgaagagcaatgttttggtcagcaacagaccacgcatgatagtggccccataagattatactgctttatttttgctataccttctctatgttcattcagatacacaaacatttccattgtgttacaactgcctgcagtattcagtacagtcacatgctgtaggtttgcagcctaggagcaacaggccatactgtacagcctaggtgtgtagttggctacaccatctaggtttgtgtaagcacacactatgatgttcacatgacaaggaaatcacctaatgatgagtttgttattaacagaatgtatcaccatcattaagcagggcatgactatagctttttctgcaggaatagaacttttttttggtgaggggatgacatggttaagctttgtgtccccatcaaatctcatcttgacttgtaatccccataatccccacgtgtcaagggagacctggtggagataactgaatcatgggggtggttcccccaggctgttctcaacttgttctcatgaaaatgagtgagtcctcaccagatctgatggttttataaggggctcttccccacttttcttgacacttcttcctgctgccttgcgaagaaggtgccttgtttcccctttgccttccaccacgactgtaagtttcctgagttctccccagccatgctgaactgtgagtcaattaaaccttttttctttataaattacccagtctcaggcagttctttatagtggtacgaaaacggactgacacagtaaattggtaccacagagagtgaggtgctactataaagatacccaaaaatgtgaaagtgactttgaaactgggtaacaggcagaggttggaacagtatggagggctcagaagaaaacaggaagatgtgggaaagtttggaacttcccagagactcattgaatgcttttgaacaaaattctgatagtgatatggacaatgaagtccaggctgaggtagtctcagatggagatgaggaacttatttggaactggaacaaaggtgactcttgttatgctttagcaaagagaccggcagcattttgcccctgccctagagatctgtgcaactttgaacttgagagagatgatttggggtggaagaaatttctaggtagcaaagcattcagggagtgacttgggtgctctaaaaagcactcagttttatgcattcactaatagatggtttggaattgggacttatgtttaaaagggaagcagaacataaaagtttggaaaatgtgcagcctgatgatgcaatagaaaagaaaagcccattttctgaggagaaattcaagccctggctgcagaaatttgcataaataatgaagagccaaacgttaatcaccaagacaatgggaaaaatgtctccagggcctgtcagaggtcttcacagcaggccctctcgccacaggcctggaggcctaggaagaaaaaactgtttcaggggttgggcccagggccttgctgctttgtgcactctggggacatggtgccctgcgtcctagccatggctaaaaggtgccaacatatagctctggctgttgtttcagacagtgcaagccccaagctttggtgacctacatgtggtattgggcccacgggtgcacataaatcaaaaactgaggtttgggaacctccacctagatttcagaggatgtatggaaatggcaggatgtccaggcagaaatttgctacaggggcagagccctcatggagaacctctgctagagtgattaagggaatgtggggtcagacacctccacacagagtccccactggggcattgcctagtggagctgtaagaatagggccatcatcctctagcccccagaatggtagatccaccgacagcttgcaccatgcacctggaaaagccgcagacactcaacaccagcctgtgaaaacagctgggaagaggactgtgccctgcagaagcacaggggtagggctgcccaaggccttgggagcccacctcttgtatcagtgtgacctggacgtggatagagtcaaaggagatcatttcaaagctttaagatttgactgccccactggattttggacttgcatgggtcctgtagccccatagttccaatttctcccatttggaatgggaacatttacccaatgcctatacccccattgtgtcttggaagtaacttgttttttattttacagggtcataggtggaagggacttgccttgtctcaggtgagacttcagtcttggactttttggttaatgctggaatgaattatgactttggggaactgttgggaaggcatgattggttttgaaatgtaaaagggacatgagatttgggagggtcctggggcagaatgatatgattaggctttgtgtccccatccaaatctcatcttgaattgtaatccccataatccccacaatcctcatatgtcaacggagaaaccaggtggaggtaattgaatcatgggagcagtttcccccatgctgttcttgtgacagtgagttctcatgagatctaatggttttataagaggctctttccccttcactcagcacttctccttcctgctgccttgtgaagaaggtgtcttgcttcccctttgccttttgacatgattgtaagtttcctgaggcctccacagccttctgaactgtgagtcaattaaacttctttcctttacagagtacccagtcttgggcatttctttatagtggtaagaaaatggactaatacaggggagataaaaatatttggtgtatataaaggagcatactcatatattacttggcggaattataaagtagtacaatatctttgaatggcttttgactcaacatttttatttttaggaatttatcctaaatttatcctaggaatttatctgacatgagataaaatttaagcacaaatgtttcttaaagcaagagtgatatagcaaattaggagcaatatttatgtccatatgaggaaaatggttaaataaaggatgatacactgattcatgtactggagtacaatgtttccattaagaattatgcttctgagactatttaaaaaaatagaagaaatatcttgatataatggcaagtggaaaaaaaaacaggcagtaaaactgtaaatgtggtataatcccaattatatagaaaaaataaagacccaaagaaagtatattaaaaagctaatagctctgggtcatggaattataggtcatttaaaaactatctctttgtatttccaaatttcctacaattaactcattatttatatgatgagaaaagaatgtgttgcacattaacaaaaaaaaaaaactttaaagaccacctttcctttacactactcatttttaggaactgaaaattcaggagttcgttcctttgccaggttttcaataaagaggaagagaaaggccaccaaatagtttgcttcttaagttgacatagttgtaacagtagtttaaaaactgaaatatttaaaaattcttaatttaaatattatatgtattgactgttaaaaaataaaaaagcctaacagttagcttaaataaaaccacttgaatgtctatgatctctgatatcttgtgtttgcctaaagactgtgatgagaacacgagtgatgttgatggtaaatggactccctgaggtggagtcagctcactcattggctggatgatgagaccccttagagcagaaagggacagagaggcaatcagcccatgctgcagaaatgtaagaacaccttccactgcatccccagtaaaaatatttttaacccaaaattaatctggaaaacattttcaaaataaattactcctttaaaatgtagagtggaaattatgtaagtgaaaatgacaagtatttctgagttgtaatgttaaactgttgaactggatgtccacatgcaaaaaaaaaattatcttcaatccatagctcataccacacacaaaaattcaaagtagatcatcagacctgatataaaacctaaaactataaaactttcaaaagaatatgtagagaaaactctttgtaagttgggcaaagatttcttagatataacactaaaagcataatccataaatgcaaaatggataaactcgagttctaatacttctgctctttgaaagataccattgagaatacaaacacaagccacaaactgaaagaaaatatttgtaaaacatgtatctgataaaggattccatccaaaatatattagaagctctcaaaactcagtaagaataagaagaagaaacaatcaactcaaataaaaactgggcaaaagatatggcaaataagcacatgaaaagatgctcaaaagcattagtcattaaggaaatgaaatttaaaacacagtgagattctagtgaacatctattagaatggctaaaattaaaaagacggactatagtgttggtgaggatatggaggaactgaactctcaaacactacaggtggaatcaaaaattacacaaccactttggaaaagtttggcagtttattaaaaagttacacatacacctacatgacctagccagtctatcctaagtatctgtccttggacatgaaagcatccatgtatacatagacttgtacgtgcatgttcatagttgctttatttgtaatagtcaaaaactgaaaataacacagatgtccatcaacaagtaaatgaatgaacaaatggtggcatcctgatacaatagattactactcaatgacaaggaatgaacgattgatacatgccacaacacagatgaatcacaaaataattatgctgagtgaaagcagtcaaaccaaaaccaaactaaatccaagcacatactgtatgactccatttatataaggccatatgatacaaactaatctatcatgacagaaagcagatcagcagttcctatgcgatggggatgggaaagaagggattacaaatgtttgaggtggtagatatattccttttattgattgtgatagaatcataggtatatacatatcaaagcttatcaaattatgcactttaaatatgtgcaatttatggtatgttaatcataccttaatacagctattaaaaaattaacgtgttcagcttacgttaaactttttttttttttttttgctctgtcgcccaggttggaatgcatgggcacagtctcggctcactgcagcctctaccacctggactcaagtgatcctcccacctcaacctcccaagtagctgggactataggcacgcaccaccacacctggctaatttttgtattttttttgtagagacagggtttcgccatgctgcccaggctggtctcaaatccctgagctcaagcaactggcccaccttggcttcccaaagtgttgtgattacaggcgtgagccaccgcgcccagccttgttaaactttttaggttacagaaactgatggctccaagttcttctgttacgtgataaaattcgacttcttcttgccctcatttagtccagagaggactggtggggtgtgggggtggggtcaccgagctcagagcatcaagaggccaaccttgaggataagggtctaggtgtgaaggatgctggaccccacccagcaccctgctcatgctgcccaggacagggtgaacacaggttttcctgcctctctgcctgctgggagttttgtatggttccttcctatccacccctcctgggactgcctaccctgcactcacctcttcttcctcattctctgactgcccgaacttcagccggagactctcttcaaactcctgatctgtccagtagaagaggacctctgcgccctcagtggccaccaagacgcacttcatctgccagggaaaggcaaggtcaaggtcagcctccagccccaacatctatgagctcagtctgagtaacgaagaggaccccaacctcagcaaacattcagtgagccccttctgcacaccaggcatcacaagggacttccatttttgttgcaccctcacaactggacaaagtagaactcttcaggtacccccattttagagagcaggacacaggcacagcctgaagtggcaaagctgggatctggacccagacctgtttgatgccaaggctggggccctttcctctgtggtatctggtccctctcagcacagcaacagacccaccacggggcctactggaaccagactggcacaggaagggacccaggtcttggcctagacatggagccgaatgcccagggaggccatgctcacggcagccagttagtgcctggtgtggatcggagggcactggtgcacctccatctctgggcagtccagagatatctctccctcagataaaaacagttccagggctgggcgcggtggctcacgcctgtaatcccagcactttgggaggccaaggggggtggatcacctgaagtcaggagttcgagaccagcctggccaacatggtgaaaccccgtctctactaaaaatacaaaaattagccaggcatggtggcaagtgcctgttatcccagctactcgggataactgctgaggcaggagaattgcttgaacccgggaggcagaggttgcagtgagccgagattacaccactgcactccagcctgggtgacagagcgagactctgtctgaaaaaacaaacaaacaaacaaacaaacaaacaaaaaacagctccagaagatgagcctcaaagcccctgaatttacttcagcaccacagaagtttcattcaaatgctgctctccctgttcatggtgagaacagaggctgcctaaagcccctgtacctagtaggctgcagcttctagggccacagccaccagtgtcttcagccctcccaaatctccttccccacccccccgccacacacacacacaccacacactctgtgcttgattatgtaagaaatgtcttaactattcacccactggaagatctttaatacagcttcccacactgtgtgccatggccctctgcgtgcggcaaaccctcgatcttctaaaacttggggcagcctgaccaggctggtgaggacagtgctccaggctggctgctgcagctaagaggcctcaggcagtggtttcaaatcctcttatgtgcctcagggtgtcacgcagatataatcatgtggtatgtgcgctaagccatgacaatgattaggaagctctgctgtaactctcacacaagtggatttccagttttcttgggaggatcacagcatctccaggtcttgtgttccgtcatccccatgtccagcttagtggtccttactgaattcctcccaaactaacttggtgcaactggtcccaaggtatttatggcaaatgccaggagacataacagcacagtgaagaaggaatgcagcctattcccacagaattactcaatgccaaggcagacactgagagtgcaacaggtgtgaaaaggaggttgctgggagaggcgggtggacctgaagaggctgctctgggactcccaggtacatgtgacaaagctgaccagagtgtatgggttagggagcagtgggctatggaatggaggctgtggttgtgagcggagaagtgaccggctggctggagatgggcaggtcaaggtcatgaaggcggtcatctaggtgcgggtgtcaggtaatgagtgctcaccccttggtgggggctgggaggagctttaaagatgcagcaggctgtgatgacctgcctggattcgaggggtgaaggagagatgaggcatcaggatgggggtggcctcaggatgcagggctggggaggggatgagcaggtgtgcagagcccagtagcactcagtccactgcctacctcattccatctgcctcccaaagccccagggtggatgctgcctgcctccctgtcctccccaggtggggcaagatcatctaccttggcaagcacagtggagcatccagacggccagaggttcagaaagggctgcagcagaccgactcggtgactggctcatgggagagcagcacagcatccctggtcctgcaaatgcttaaaacagagagaatatgagggcaggcagatgccctggtcttgactgctgcccgttgagaaaggacaagctggagaagggctgcgtggtccctggtctctccaggccctgaggcagtctgctaagaacatatctgggatcctgcccctcacctcccataatggagaataggaacccggccagcacagccctttgcacagagcaggtgcccacttttgttccttcctcctttgttcccatgaagtgctctcacttctgcgggtcactcagagctccccaagcagccccagggagcttgctaggagtgactgacgggagacagcatagcacatcccaggtggtgaggatgcagtcccggtgaagggagtggggatcctgggatgatacgatgaatggaaggaaactaacaggaaaggcatctgggaccaggttctagttttggctttgccaagtcccataaacctctctgagcctcaaactcctgcggagaaacagagcaacatcccctactctacctccctacagggttagatcatgggagtgaccaggcaagctgcaaagtaaccttagcaaactgcgttcttacataggtgtggggatcattattcctatttcccagcttcccttcttcaaataacaggattaatcaatctggttccggaatcattcatatttgaatagagggcaggaacaacagaaaacttaattaggaagtcaagcactgtgagccagtaagaggcaagtgactacccgccacagagactgctgttacgagttcggcctttagcagccgaaccctgagacgggctccatcacccacatgattggcccgaatgccatattcccgaaacagggggatgcttcccaaaggctgctgggaagagaacctcgccggtgtcacactgagacttccgcttcacctcgctatcttgccctagaaagggaactcggaggggactcactgacgaaaggagctccagatggcggggggccaacctggggcgacccccagcgcccactttcaccatctggaccccagcaaacctccctgtggcccttggtcccgtcttcagcagctccttctggggtcccacaccttcggagcccggccctgcccctgagtctctggagagagcgagtcagcagttcgccgccgcggggctcccgtttgcctagcacgccagtttctgtccagtttcaccccaaatccccacctccccccacccccgaacctcacggccaccctgggaaggaggcttgacttgtgacatccacccctcttcacggctgaggaactttggccccgagcgaggaagcgaccggcccacggccacacgcccggagtgggtgaggctaggagtgggcccgctccgggacccctagggaccctacctcacttccgggagggttgaaggggggctccggagggaggatcgccgcccccagaggggacagcccggaggcccacgtaccggatcgcggcgcgcacagcgccccgcctgcaggagcccgggcgcgcttccgggtaggaccgcgtgatcgcgcacgtgaccgcccgccccgggaggggccggagccgccgtcgccttccgcgggttcgagccccgcccctgccaggccttgcccatgccccattttacagaagaggaaacggaggcgcagagagaagaaataacttgctgagggtccgaaccaggctcagaacccaggtttcctggctcctcagctgatcccttctctcctccccatgccccggaacctcaggctttgcctaatgaactgaagttctggggctagagctgtccttttgtgactgctctccctgacctttggggaggtgacatagcgcacagaagggctcagttgcccccagagtgccaacgctggaatttataggagttctcaatctattttgggagtggagtgcacattaggagttttgtgttgaacctatgtttgcaatatttattttaaaaaatcgtatgtgtattgggggtgcctggaagtggagggggcgctctggaagggcctaaatccccgaacagtccacccctcagtgcctgggtgccacctgggagctttgagcccagcccagcaaggtatgggttgcaagaactggctggggatatagtagattgagcatctcttgggggaaaggcagaggctaagaatcaatacttccaccacctgcagatcaaagagagcatcactccccccaacccactacccaccccttccagcccaccttagggcaaattcttccaactccccatctacagcacatagccctgccacacgcatctctttgctcagcccaccgttgagatcgttcactcactatgctttcagtggtcgaatgaattccatcaaatggatatgctgttatttacttattcattcccctactggtaatttccatttcccaactgcaatgtatgaggattctgatttctccacatcctcaccaatgcttgttattgttgatttttttttttttaagtatagtaacccagcgtggagtggtgtcttgtgattttatttgcacttccctgacgttcggcatcttttcatgtgctttttgcctatttgtgtaccttctctggagaaatgtctattcaaatcctttatccatttttaaattgtctttattattgagttgtaagagttctttatatgctctggttacaagccccttatcagatacttgatttgcaaaagtttttttcccattatgtggcttgtcttttcactttcttagtggtatcatttgtagcaccaaagttttacatttttatgtaatccaatataatctattttttagttatgtacgggttttttgtgtcaacatgtttctttttttcaaatttgtttgtggtaaaatacatataatgtaaaattgatcattaagcattttaagtgtattgttcagtggtattaactacattcctaatgctatgcagccatcaccaccatccatctccacagctcttttcatcttttaaaactgaaactatatccattaagcaataatgctggccgggtgtggtggctcacacctgtaatcccaacactttgggaggtcaaggcgggcggatcacaaagtcaggagtttgaggtcaccctagccaacatggtgaaaccctgtctctactaaaaatacaaaattagcagggtgtggtggcacacagctgtagtcccagtgactcaggaggctgagtcaggagaattgctggtaccaaggaggcagaggttgcagtgagccaagatcatgccactgcactccagcctgggcaacggagcgagactcccatctcaaaaacaacaacaaaaacaacaacaacaacaattcttcattcctcctcatagcaaccacaatgttactttctgtctctatgaatttgactactctaagtacctcatataagtagaatcatacagtatttgtctttttatgactggcttatttcacttagcataatattctcaaggtgcattcatgttgtagcatatgtgagaattccttccttttttctttatttttaagcctaaataatactctatagtctgtatatactacattttgcttatccatttatctgctgatggacaattgggttacatccattgtgaataaggccattatgaacatgagtgtacaaatatctctttgagactctgctttcaattcttttgggcatatacccagaagagaaactgctagatcatatggtaattctatttttaattttttaaggaactaccatactgttttccacagcagctgcatcattttacattcccaacctggaacaagtgttccagtttacccacatctttgtcaacacttgctattttctattttctttaaaatttttatagtagccatcctaatgggtgtgaggtagttcaacataagtttatatttctcttaggtaaatatctactcatgggattgctgggctgtatggtaagtctgtgtttaaatttatattaaactgctgaaccattttccaaagtggatgtaccattttacattccttctagcaacactgagaggtgtaattgctctgtagtcttgttagcacttgatattgtcctattttaactttagccattctagtaggtatgtggtagtatgttaagtgttcaaattttgcctatttaaaaattggattgtttgtcttattatttatttatgtgtttgaattcaagccctttattatatttttttttcccagtctgtggctttgtcttttcattttctttacagtgacttttgaagagcagaaatctttgtgcattttgtgtcctatgtaaagtctctgcttagccagggtcacagagattttctcctgttttttcttttttgcagaaatttaatagtcgtagattttgtctttaggttcacaatccattttgagttaatttttgtgtgtgatgtgaaagaaggttgaggttttagtcttttgtgtgtgtgtgtgtgtgtgtgtgtgtgtgtgttttgtatatagatgtccaatttttctagaaccatttgttgaaaaaaaatattttctcagccaggcgtggtggctcatgcctgtaatcccagcactttgggaggctcaggagggcagatcatctgaggtcaggaattggagactagcctggccaacatggtgaaaccccatttctagtaaaaatacaaaaaaataaattagctgggcgtggtggcatgcacctgtaatcccagctactcaggaggctgaggcaggagaatcgcttgaacccaggaggcagaggttgcagtgagccaagatcgtgccattgcactccggcttgggcaacaggagtgaaactccatctcaaataaataaatcaatcaatcttttctccattggattaattatcatggcacgttgtctcaaatcagttgaccatctgtgtgtgaatctatttttggagtctatgttcaataaatttaaaaggagtttattgattttcttagaggcagtttttggttgaatcaatttttattgatcctgtttttaaattcatcagtttctgttctgatagttactatttcgtgtcttctgtttactttgggtttttttttcttctagaaacagaggccactgatttgagaccttttgtcttttctaatggagttgagtgctgtagatcttccccaaggtcctgctttatcagcatcccacaactttttatctgccatgttttcattttcaattactttaaaatgctaatttttcttttgatttatttagagtatagttcagaggtcagccagatatttgagtgtactttgtaccagctttttaagtttctcccacctgttccctttccctctccattcaattttcagctgctctggcagtcttgaacaccaatgtcactccacggtctaatataatagctgcttgctgatggaccttgctctttgttgtgaactaggggaattccttcaggagaaaagccaaataaatgtggatatcacccagtgtgattttcttcattcaagagctatatctcctgcagtttctgcctgctcttagctgttctgcattgccttcaaagaattgttttttcaaattttgtctaaggttcgtaattgttattggcaaaagggtcagtctgatacaactgtaacattaccagaaattggaagttctttctgcatatttttatatgtagtcttttccatttagtttaaaatattttctttttattgtgatttctgatttttttctcatggaatattaagaagtgtgtttcttaattttcaagcacagggagattttctagttttctatctctctatctatctatctatctatctatctatctatctatctatcatctatctataatttccacttatattccactgctgtcagaaatacattgtatgttattattctttgaagttttttgaaactttatgtcacagtatataaccacgttttataaatatttcgatgtgttgttgaaaaaggactttattcatttgttgttgtaatgttctccatatatcatttagataaaatgttaattgtattgtttaaatcttttctattctttctgatttttgtctgccttttctctcattttctgagagaaatagcagttaaaaatctattataattgcaaatttttctatttctccttttatttctgttagatttttgcttcacatataggagatgtcattaggtacatgcagatttataattatatatcttactgttaaatcaaaactttcatctttatgaaatgtccctatcactagcaatgctttttggttttacaaaagcatttattgtctcatataaacataaggacatcaccttttgttgcatggcatatctttttcttactccttttaatttcttatattttagatatttcttttgaaatagcttttaattgaactttcttttatcttatctgacaaccttcatcttttaatcggagcatttattccatttacatttagtgccattacaaataaatttggttttaaatctattatcttgctagttgctttctgtttgtcctgttcttcattatctttgtcttctttcttgctttctgttagatgaagcgtttttgttatgattccactgcctctccattcacttaaagaatatactcttttaagtattctttcagtggttaccatagagactaaaacatgcatccttgacttatcaaagtttaatgtaaattagtagttttacctctttcttgaaaatgtaaggatgttaatatatcttccatttaccagctttcaatatgtatggtattattgtaatgcatttttaattatttacctattttaaattgcaagagacattgttattattagattatatttatttagagtttcccacataattacccttcacgttgctttttattctttcctgcatctctcattgcattattttgattgttcattctttctctccctgtctgtcttcatctttcctttcactgtctcctccaattttctcagcctcccaccacccatgcacttgtagacatagttgagttccaagacattaggtgcatacgtggtgaaattctactataatacatttcagttgctgctggagcaaccccacgtacttgtcttaaagttcaatttaactaatttctcctatgtgaggtcaatcttttccttttaaaaacctaacaaggtgggtatgccttggggcatgcttagtctgcattaaatatgcactaaatcacggcttggaagaaactggggtggcaagagtcaagtaattaactcaaaaataaaatcaggacactatccctgagggtgagaggatcttcaaaacgtgttatctgtgttgaatttcatgtgcatgcattctagaaggcacgttgcatttaggtagaaatagcaacaatttaaagctaactttgaaacttctcaaaaggatgttatctaatatataagctaacatgaggaggaaatagaaaaacaatagcacttggaccagagaccatctgacataacatcagacaacagggagtttcaggtaaacttagatttcacttaaatccaaagtcctcattttatagatgagaacactgaggtccagagaggctgagtgacttgtcttctgaggtggataaaatcagtggaatagcctgttgtgatctccaggtgtgactgttcattgggtctagagttggcctctatgattctctagttaccttttaacccactttgctatttgaggtttcaaattatatttttgatgtttctggtacagggggcagcatcttctactatgtgcatctacattggatggcagtggagcaacacagattgttttctgacaaaaatcagccaagtactaggagaggcaggactttagaagtggaggagatggagaaggaagcttaggttactatggagtgtgcaaaaaggtcctgtggatttagataccaccacacacaaatggtatgtaatactcacttgaagacaaatcagccagagggatctaacagcattgacccattctctggtcttctagcatccatcatagttttgtgctccttttccatgaaacacagctgttgttggaaggtacctgcccagataaggactgcatttcctctagcatccagatgggaccaaatgactgctggccaatagaagtgagtggaaaggactgactccagttccaggttgggcctccaactgctctgggcacgtcgatggaacagaacaccacctccaccccaataccaccaattcaactttacatgaattataagcgagaaataacttggactgtgttaagtcattgagtttctggggtttaactgttattatagttaagaatgactttaactaatatagtcaatgacatctaactggagttatgaaattcaatttctacttagagtaattgaagcaaaggttgtgggggaggggaggagggcagcacaccatgaaatcagagatccccagtacgtgttagttcatcagtcaatcagtcttaaggtcagggtgtagtgtgggcagcagttgcctccctctccccacagaacaccctgagaataggaagttagagtagtcgcatcttattacttacaaaacattacctcaaaatgcaaactaccccctggacccaaactctctacaatcaccaggttccataaactataatctactctgttttctggaagaaaatattaacctgttaaaattccctgcacagagaggaaactttttctgggaggtattcctgaactcattttgccaacttccagatgaacaaaactaaagtttctttttgcttcttccaaaaacataaattatcaaataacatttataacttgaaaaagaatcctagaatattttcatgaataataattagaagagtaatgttcacatgggaagggcgtcttttctctgctgtgtgcataggaccctgggaccctgggatttaagtcatatggaacttggtcaactcctccaaaatgctcccagcgctcacaggggctgccttggtgtttggaaggaggtggtgccaaagcagttggtttgctggattttgactttctttttttaaagtggtatttgcaaatactaccccgagggcaatggttaatggatttgacctttgggtcatgggggccagggagcagcactcatagaagctgtgtgtgtgtgtgttgcggggcgggggcgggctgctgactggctctgccactcacctctcaggccttaggaatactgaagattctcacctacgattggtggcgatggtgggagtggtccttaaaactgctttatagaaaatcatagtggaggccaggcgccgtggctcatgcctgtaatcccagcacttcgggaggccgagatgggcggaccacgaggtcaggagatcaagaccatcctggctaacacggtgaaaccccgtctctactaaaaatacaaaaaaattagccgggtgtggtggctgacgcctgtagtcccagctactctgaaggctgaggcaggagaatggcgtgaacccaggaggcggagcttgcagtgagccgagatcgtgccactgcactccaacctgggcgacagaaggagactccgtctcaaaaaaaaaaaaaaaagaaagaaaaagaaaaaagaaaatcatagcggaacagaccaggatgaccactgatcggccaaggtgaacctggactcaaagttctacagcaaaggctgtccacaacactacttactactcactactcacaagagcttctagttggcatcctcaaaccagagagcagttgtactgggggtaaggcactgctagggttctctgtaggacacacatgagatgttaaggaatctagctgtgggcaatacagagatgagaaataggtggctacaatcagtcaggtgagaggtagcacagtgtagggatagcaggctttgaaatttttaacagacctgggttcaactcctagttttgccacactgtttttctgggtggtcttgaacaagttctttctctaatcctccccatctataattgggtctgaacacttaccataccacccagcactgctgtgagcattcaataaaatagcacgtctgataagaagaaggcacttgatcaaggaagggcagccacagaagccttcgtgccatggttagtggaactcagagagaagggttctgtatgtcccagttgtttgggccttataataataataaaattcattttagcactatctctctttggagtacttcttatctgcttttcaatcctggtatatcctaagaaaagattacaaacaattctaaaatggaaacttcacttcaatacagcagatttccctgggctcctggctgggcacagagtggctggcagaggggagtctgtggacgtggagagtaagttggtggaaacgagcactcagcaggggccaggctggggcagttgtgccgatgctggagagaggagaagtggaggaagccatgctaggtaaagtttatgccctttcttctcttgccttttccaagccacagcactattaattttggttgctctattgatatttcaaaatgttagtcttcccttccccttgtgtttttatcgtcagagggatccacctggttcacctttgcttctgcagagactcaacactgcccttttgttttcaaacataaagctactctcaatggatttccaaggtgaatcctgcagctgcatccatcccagacactggggccttgagtgcctgtggagcacacctgcagatgctgggcctcgccatgaccaccagaggctaagtggttagcacacgagtcctcactgccagggggccacagagactcccagtgctgacagcaggtgggagcctcttcaggcagcatccaccagcaacctctgccctgctggagagtgcaaggctttgagcccacctgcctagggaccgcccgcctgctggggaagggtcaggctgcagagggccactaggcttttgggaattgagcttctgggagccccaggccttagtctcactgtagcccagttctggtattttcaaacttttctccagcagagataatgctaataatcccacagctgcagcattgttcagggcactagaagaattgggactttctctccaaataacaatgagtatttcttctgagcctttgtgataagaaatgagaaagaagatcattcctagaggcagaagcagaaaaccagctcaacaataggcagaaacttttcattatacattattagtctttcaaatgagcatttctgccagcccattctaggtttaaaataaagtggcttttaagtctcagattattatggccacatcttgttttaggaaggaaatatctgatctggggcagctgcccgaccagctcttctgtgcttttgtccctgctcccagctggcaacctgctcccttgaagtgcattgtgatgctgcattttgccacaggctgtctttttgcgggtgagtgtgataggggaatccctatgacaagcaacccccacccc

SEQ ID NO: 1102 - DNA, 24645 bp, Homo sapiens
gcagcaggcagagctggtggaagtaaatgcagttgacacggaagttgcattaaaagagggcaataatagattaaaagctgccaggatcctggcgactggccgtcgatatcctttattccctatctcgccccaattctgccccctctgtgcactattagcccaaatcgatgggctgtcaattgacatcactggctacagcattaatgcaagctcacaaaagaagcccgaccctagattatcacttctctcgcttccaaattacaacataatgcaggccgcgggcagcttgtgacatgttaacactatacacgatttgttgggattggactaaacatttcatagctaaagatttcatcagagacttgatgacaggaataaactgctgcccacggggaaatcactggaaataatagaattaggcattgtttgggaatccggagggacgctggagggacgaggaaggatgtcggggagcaggacctatagctggtggcctgctgtgggagcagcttcagggaaagagatggcaattaaaaggcctttttgttggtcccactaaaggacaggtatttggatcttgtctagggcttacgtactttctatttttgtgcaaaagctgggaagggaatttctcttcagtgataacagggaatataactgctgtgggtcaaattgtgtcctttctccctgcggtccacccaaatatgttgaagtcctaatccccagaacctcagaatgtgaccttccttatttggaaatgggggtctcttacagaggtaatcaagttataatgaggtgcagtaggacatgtgttcctatagaaaggggaaatttgggctgggcatggtggctcatgcctgtaatcccagcactttgggaggccgaggcaggcagatcgctttgagctcaggagtttgagaccagcctgagcaatatgaagaaacccagtgtctacaaaaaaaaaatgttttaaattagccaagtgaggtgtctcacgtctatagtcccagctacttagggggctgagactggagaattgcttgagcctgggaagcagaggttgcagtcagccgagactgtgccactgcactccagcctgggcaacagagtgagaccctgtctcaaaaaaagaggggaggggagtggtgggaatctggacacagagacagacaggtacagagagatgatgtgaagacacacagaaagaagacagccatgtgactggagtgatgcaagaaacacctgaagctactagaagctcatagagaggcattggacagttccctcctttaaaggaagcatggccctactgacaccttgatgtcaggcctctagccgccagtagatttctgttgttttaagctacacagttgttggaactttgctacagcaaccttaggaaacaatactaattattacaatctaatagtgataatagcccccatttattgagcatctctgagagtctggcaaagactggctaatttcatcctcataacaaaataatggttgagtattataacccccatttcttttttacttttttttttttagacagtttcactcttgttgcccaggctggagtgcagtggtgccatctccgctcaccgacctccgcctcccaggttcaagcgattctcctgcctcagcctcccaagaagctgggattacaggcatgcaccaccacacccggctaattttgtatttttagtagacacggggtttctccatgttggtcaggctggtcttgaattcccgacctcaggtgaggttgggagttgcctcagcctcccaaagtgctgggattacaggcgtgagccaccgtgcccagacaattttaattttttttatgtacaatttctattttatttttctccagagaataatccatcttcagtctttttttttttttttttgagacggagtcttgctctgttgtccaggctggagtacagtggcacgatctcggctcactgcaagctccgcctcccgggttcacgccattctcctgcctcagcctcctgagtagctgggattacaggcgcctgccaccatgcccggctgatttttttttttttttttttttgtatttttttagtagagacagggtttcaccgtgttagccaggatggtctcaatctcctgacctcgtgatccacctgcttcagcctctcaaagtactgggattacaggcgtgagccacagtgcccggctcgtcttcagtctttaaggactcagctccttacatgggctttggtgggggtcatggggcagcacccacgggtataaatggaccttgctggtgtcatgagattaattcctgactactttgctgtgaattgcacaactcacacagtaatgtagcttcacattcagcttgggaagcacataggtatcgaagacgcttgcttcagaaatgtccctgattgctgcagcctccactatgtttcaaatgacaaattttttttattttttttgagacagagtctcactctgtcaccagggctgagtgcagtggcacgatcttgcctcactgcaacctctgcctccctagttcaagcgattctcctgcctcagcttcccgaatagctgggactacaggcgcttgccaccatgcccagctaatttttgtatttttagtagggacgggctttcaccatgttggccaggatggtctcaatctcttgacctcgtgatctgcccaccttggcctcccaaagtgctgggattacaggtgtgagccaccgcgcctggccaaatgatgaatttctcaatggccttatccttgggcacgcatcgggcacagttcttgcagtgaatagactgcacgtgaccgaagcccttcttggcaagaccgttgttccttctttcctttctttctttctctttttgacatggagtctcgctctgtcgcccaggctggagtgcagtggcgcaatcttggctcactggaacctccgcctccctcgttccaatgattctcctgcctcagcctcctgagtagctgggattacaggcatgtgccgccacacctggctaatttttgtatttttagtagagttggggtttcaccatgttggccaggctggtcttgaactcctgacctcaggtgatctgcctgcctcagtttcccacagtgctgagattacaggcgtgagccaccgcgcccataaggccacaacccaccttcttttcagtacaatctaatcttttcccagctcctaaggggacctgtatccacttggtttgagtgaccacaatgtctcaaatgaaagtgtagaaatttttaaaaaaataaaaaacaggccagcacagtggctcacgcctgtaatcccagcactgtgggaggccaagatgggtggaccgcttgaggccaggagttcgagaccagcctggccaacatggtgaaaccctgtcgctactaaaaatacaaaaaatttagccaggcatggtggcgcatgcctgtaatcccagctactcctgaagctgaagccgacaatcctttgaactcgggcagtggaggttgcagtgagccgagatggcgccactgcattccagcctcggcaacagagtgaaactctgtctcaaaaaaacaaaaacaaaaacaaaaacgaaaaggtctggacccagcagaatggctcttgcagagaagggcggtgagaaggaccattctgccatcagcggaggtgatcatctgagactccaccatcaacatttacatgcgtacccgtgaagtgggcttcaaaaagggtgccccttgggcactcagagagatccggaaattggccatggagatgcggactccagatgtacacattgatatcaggcttaacaaaactgtctgggccaaaggaataaggaatgtcccatactatatccatatccatgtgcacagaaaacatgaggatgaagattcaccaaaaacagcgctgtacctatgtacctgttaccactttcaaaaatgtatagaccgtcaacatggatgagcgctaactgttgattataaaataaaagtataaaactaccaaaaaaaaaaaagcccagtaaacccagcacagccatgattattccattctttgagagtaagaatcttattttttttttctttttccttcttttttgtggagtgggggggcggacagagtctcactccatcgcccaggatggagtgcagtggcaccatctcagctcactgcaacctctgcctcccaggttcaagccatcctcccatctcagcctcccaagcagctaggaccacaggcatacgccaccatgcccagctaatttttgtgttttagtagagatgagattttgccatgttgcccaggctgctcttgaattcctggcctcaagcaatccacccacctcagccttcagctgagcaatattgttcttcctcatccatgttcccaattacaatggtaggcctttgtctctgtctctgtctcgctttctcttttctccttgcaggggaaaccagccctacgcctctttctttttcagttaatatatgtatttattgagatcatacaattcacccatctaaagtgtgtaattcaatatttttagtttacagaattgtgcaatcatcacaattaatttagaacaatctgatcaccccaaaacaaatatcccataccctttatcactctgtatttctccccgtttttcccctcagcctatgcaaccatcaatcttttttgtcttaaaagatttcctattctgcacatttcatatcaatagaatcatatgtgtttttttatgactgggttctttcacttaccataatgtttttaaggctaatctatgttgtaccacatatcagtactcaattcctttttttttttttatttgagacaaagtctcactctgttgcccaggctggagtgcagtggtgtgatctcagctcactgcaacctctgcttcccgggttcaagcgattcttttgcttcagcctccggagtagctgggattacaggcacacaccaccatatccggctaatttttgtatttttagtagagatggggtttcaccacgttgcccaggctggtcttgaactcccgaccgcaggtgatccgccctcctcctcggcctctcaaagtgctgggattacaggtgtgagccacagcgcccagccccatcagtgttttccaaaatggctataccaccaacagtgtatgagggtcctaagttctctacatccttgccagcttgattatacgagaaattcctaatgtacgagaaattctatctctgtgataacttgcatttcactggtggctaatgttgagcatcttttcatgtgcttattagctatttgtttatcttcattgaagaagtgtctattcagacattttgcccattttaaaaaatgggttgtctttttgagttatgagtgtttttcatatattcgggataacagtcccttatcagatatatgatttatattttatctagttttatgggtttgcctttcactttcttgatggtgtctttatcttggcaacatggcaaaaccccatctctacacaaaaaagtacaaaattagctggccgtggtggcatgcgcttgtggttccagttactcagtaagaggatcacttgagcccaggaggcggaggctgcagtgagctgtgatcatgaaactgcatcccagcttgagtgacagagcaagaccctgtctaaataataataataataaaataaaataaataaaaaattgagctggctgcatgctctgaatgttctgtgctgtggcccagtgttctaggacaggccccattgctccaggcaggccctgacagtcttatactgcagactagctacactgtctctgttcatcccactgactccacatagtgcccagatctcaggggcaatgtaaagacctttattccggtcaagatcttggcaattctgttattgccaactttcctttacccaaatctgctccaggtttgatcactttcttctcatcacatgcaactctaatgttggctccccaccctgcaaggaacagagagtgagtctgagctcatccagcaaccaccctcccactcttccaagagagatgatcatgagcagactattataaagcacaaagggagcacattctaccctcttgggtacctgctccacccacccctttttattcattcacttgacaaatatatgttgcttatgtgccagacactgggaacacaggtgtgcacacaggtgcttctccattcttgggtgagcttcctgaggaatttaagcatttcaccaaagtgtgttgagaaacccagaagcagttcagggggatgagggaaataatatggggacttaaactagccagtgtggctccggaaaggctatattctctgagctttttcttcacctcaccctctgtattctaaacctgtctgtattacccatccctccatacccattgcccaagtatcctgagatctcaactcaagccattactcccacctaagcagggcacttgctcagttgagaatgctgggccgggcgcagtggctcacacctgtaatcccagcactttgggaggctgaagcgggtggatcacccgagctcgggagctcgagaccagcctgaccaacatggagaaaccctgtctctaccaaaaccacaaaattagccgggcatggtggcgcatggctgtaatcccagctactcgggaagctgaggcaggagaattgcttgagcccgggaggtggaggttgcagtgagctgagatctcatcatcgcactccagcctgggcaacaagagcgaaattccatctcaaaaaaaaaaaaaaaaaaaggagaaaaagaatgctttgcctggaaggtaattgtggatatttagagctgacttccttttccttcttcattatttgctgtgcttccagctagaaagcacaacaaacagcacagacaatgctacagcagcttcccccggggtactctgatagttttataaatagctactgccatctagtggacaaagatgactacatcagtacgtagacccacagatacggaaactctcagcgtttctatttatgtcctgcaaccacttcatcccaccttaatggaatccaaaagaccacttttcctttgaaagcctaaagcctggaacattgtaagtactcaatatagtttggacaaaggatttttcacgggcattgtcattttttaattttatatgtaacaaatattgtagtaatattgttggataattttattattgtggctttatactattgccttagaagtttaagtctattaagggccaggcgtggtggctcatgcttgtaatcccagcactttgggaggcgggcagattgcctgagctcaggatactgagcctcggtacacgatgaaaccccatctctactaaaacacaaaacattagctgggtgtggcagcgtgcacctgtagtcccagctactcaggagacttaggcagaattgcttgagcccgggaggtggaggctgcagcaagctgagatcacaccactgcactccagcctgggaaacagagcaagactcccatctccaaaaaaaaaaaaaaaaaagaaaaatgtctaataaggtcaagtagaaactgagagagctatagtaataaaaatacattttagaatataaccatattgccaagttcaccagaaacctgcatgtaactcctaaactggacctagagattaagttttttggcctgtcttcccaatccagtagcgccctgtgcagcagggacagaaccatctaggtcatggagtttcctcttataaactcaaacctccttacagtaacttgcaaaagcaaattttgccaccgtgtagatttgtgcatgcacagccagagcatccaaacatccctccattgtaaggttatttggagaatcaaataaggggagaagcaattgccattaactcgaaattcaatgggaagtggtagacactgctgtccctatggttaccttctctttctctaagccttacctaacagctaattagacatttatagggtttaaacatctttactggttttttaaactactagcccacagcagaaccctaattacaaacaataggccaggcacagtggctcacacctgtaatctcggcactttgggaggtcaaggtggggcaaaccattttgaggtcaaaaattcaagaccagcctggcaacatggcaaaactcccgctctatagaaaatatgaaaattagctgggcatggtgtcccagctagtcaggtgggagaatgcaaaggtgggaggatgcaaaagtgggaggcaatgtctgcagtgagatcgcaccactgcactccagcctaggtaagggaggctggaggctctcaaaaaaaaaaaaaaatccatttccccagattagactatgtgatgacattaagtgtccacctgagcctcagtatcatctataaacacattctggtttataaatagatgaaagtataatacgaataactgagaaaacctagcaaatattaattcccaccttcccaggccccaattccttgctatacattacacatgtccaacaagttattatctgtataggggaaacattgccatatttactcctctaattttgtgttttgctaatgaacattaagctaacattaacctgaagttcaaaaatttacagtaacagctaccactgaaaaccttccacatatttttaagattccacatgaaacgagatcaaagtatatttaccctttagtctcgttgagtcaaggcatcaaaaaagtttgtagcatctcaaatacatggtatggccatgtgcagtgacatacacctgtagagccagctacttggaactaaggctgggtgaccacttggacccaggagttccagtccagcctgcacaagtgataacacacccctatggaaaactgaagcccaggtaagattctcacccaaacaaaagaaacatgccaaaaacgtgcattgctgtcaggtgcagtgactcacacctgtaatcccagcattttgggaggccgaggcgggtgcaccacctgaggtagggagatcagcctgaccaacatggagaaacctcatctctactaaaaaatacaaattagccaggaatggtggcgcatggctgtaatcccagctacttgggaggctgaggcaggagaatcccttgaacccaggagacagggtttgcaccattgcaatgagatcgtgctattgcactacagcctgggcaacaagagtaaaacccttcaaaaaaagaagtgtgtactacttgtcattttttgtaaccttggagaaaatatggaatgagaagtatatcaaatcgtgctacaaattcccactgagatacccagacattagtagcccttcagtaccaaagagaaaaactgcagctcctccatgaattagctttttggcatatgctaagattagctagtccactgaaatctgtcacgtacgtaatgacaggtaacagcctgctcccctaggctatcacaactcactgttgggaccttaattaaccaggtggcagcttagctccatccccgaccttctgaataatcttaactcaggaagaaatggaagcccacagggcagtggctcatataagggattgacattcagatacctctgccatgtagcttaatattcactgcccattatttgattctgatctctaaattcttactcatctagcacaaccctccaggaaagcctctgctcctaggcaggcttacacacagaataagtttagaaaacaccattaagtcagctttctgcctctccagcctaaggactaaggttagtttgatccagatccaatttcttatgctccccttctcaaagctctgaattccaaaatgtaccatccacaatgctctgaagggcaacttgccacccagcccttgttaactcaagcttaagaggaaggagaaagtaagagtcacataatcacctaagcctacttctcccaccagctggcctgggagattatttaaagactcaaagcaattgtatggtgccaattttaaatagttttatttaagacattgcattttccacttacaatacagtgtttataaagtgcaatgttatttccttcccctgtgcatatgttccatattcaagtattgagaatgcccagtaacttactatagcagcttaactttttaaaactgccacagaatttgctacgaatttaggtccttcaaatgttttaaatgtgtggaacaatgctacatctacacttggttggcttaatcaacctcttcaatggtgggccctgaggaagcaccaccagagggaggagctccaccaccaggaaatcccccaggcattcctcctggcatgcctcctgcactctggtacagcttggtgatgatggggttgcaaactttctccagctctttctgttgatgttcaaattcttccttctcagcagtctgaggaagagaaaaaggaattactgcaagttcttttaatgttaataacccttctttctccctgacgcaatctgatactaaaagtctggcgcaaactcttacaagagggccactaccaacattaaaatagggccttattcttccttaacatcttgggtcactcagacatccaaggaaggtagttgccaacaccttgaattctggtggaaaccgcgaatgttttggaccattcatcattgtgaccctacactgaaatccagctcaagcttggtttaccatccccttcccctccattgagtgggggaggaaaaaaaaaaaaaaaaaacacaaacctgattcttatcaagccagttgataatttcattacacttgtccagaatcttctgtttgtcctcatcgttaatcttgccttgaagtttctcatcttcaacagttgctttcatgttgaaggcataggactcaagtgaattcttggatgacaccttgtccctctgcttctcatcttcagctttgtacttctcagcttcctggaccatacgttcaatgtcttccttgctcaaacggcctaggaaagaaattaactctaagtaaaagccttaaattacctgtgtatgtgtaactctagtttctcttagctagacgcccttaggcaccagtaactcaattgaaataccattatccctgtcaagaccagatgacagtgcctccttacccttgtcattagtgatagtaatcttgttctcttttcccgtactcttgtccacagcagagacattgagtataccattggcatcaatgtcaaaagtgacttcaatctgaggaacacctcggggtgcaggaggtatgcctgtgagttcaaacttgccaagcaggttgttatcctttgtcatggcacgctcgccttcataaaccttggtaggaaataaaacaaattactacaatggactccaggtctgtgacagtgctagggtcctgctaaggaagaatggtcgctcaaacatccaaggaaggaactggccaacataagactttctggtggaaactacgaatggttttggaatccatcatcatagcgagtcagtcaagacttccctttatctgttatcagtaagccaaacaagagaagtacagaaacatacctgaataagcacaccaggctggttgtcagaataggtagtgaaggtctgtgtctgcttggtaggaatggtggtattacgcttgatgaggacagtcatgactccaccagcagtttcaataccaagggaaagaggagtgacatccaagagcagcaaatcttgaacattctcagacttgtctccagacaagatggctgcctggacagctagcaaacaaaaagttaacgttaaaagaagttaaaagaaaacccagtacatagctcctgttttaactatcactcgctcagacatccaaggaaggtgttgccatcattagccaagcttttggtggaaactacgaatgtttaacaatcactcatcacagcgagtcaccttgggcctgcctgcctttagggttaattgagataccattgttacctgcaccataagcaacagcttcatcagggttgatgctcttattcagttcttttccattgaagaagtcttggagaagcttctgaatcttggggatacgagtagaaccaccaaccaggacaatatcatgaatctgtgacttgtctagtttggcatctcgaagggctttctctactgggtccagggtgccacggaacaggtcagcattcagttcttcaaatcgggcacgggtaatggaggtatagaagtcgattccttcatagagagaatcgatctcaatactggcctgggtgctggaagagagggtacgcttagcacgttcacaagcagtacggaggcgtcttacagctctcttgttctcactgatgtccttcttatgcttgcgcttaaactcagcaataaaatggttgaccattcggttgtcaaaatcttctccacccaagtgggtgtctccagctgtagacttgacctcaaagattccatcctcaatagtgaggattgacacatcaaaagtgccacctcccaggtcaaagatgagcacgtttctttctgctccaacctgccgttaaaaacaatctcatttaaatttacgatggatcaaattaatcttaaaataatccgaacttgcatcacaaatggtacatacctttttgtctaagccgtaagcaatagcagcagcagttggctcattaataattctaagtacattgagaccagcaatagttccagcatctttggtagcctgacgctgagagtcattaaagtaagctggcactgtgaccacagcattggtaacagtctaggaataaggaaaagaccacagattggtaactattatacttacatatatgcaaactccagcaaatggattaatgctggtgaaagaacagctggagcaccccccccaccaaaatgtaaattactgtgtaattgtcaagattcactggtttctggtgttgacagacccatctacctagagagcctagggcactgttgggcacgtggtcttaaccctgagctgagccccatctgttcccctccctcgccaggtgccagtgcccccgggagtcatcgggcttttaactactccggaatgcaccccatactgaaaaaccaacctcaccttcccaaggtaggcttctgcaatttccttcatctttgtcagaaccatagaagacacctcctctggatagaagcttttggtctctcccttgtattctacttggaccttgggcctgccagcatcattcaccaccataaagggccaatgtttcatatcagactggacaacagcatcatcaaatctgcgtccaatcagacgtttggcatctgtaaaaggtgtcaaatgaaaacactttcaatttcatagctcttctgataaaactcaagtccatgattactcaaatacctaacagttcataggtaggtgaattcaactaccatataggtagcaaaggttcaaacttcaacctcctacgttatccagatttcagcctgaaaggtttctacaacctgttttataacagacttgataacaagtctctcagctcagtttttctaaaatcaaaaagttccctcctcacgtttcataaacttttgtgcttcctagccctgttatatttgttctgtcatttaaaattaggaactcaccaaaaactgtgttggtggggttcattgcaacttgattctttgcggcatcaccgatcaaccgttcagtgtccgtaaaggcgacatagcttggagtggttcggtttccctgatcattggcaattatctcgacttttccgtgctggaaaacacccacacaagagtaggtggtgccaagatcaataccaactgcaggtcccttggacatggttgctgaaaaaaagaaaaatctggtttaaaaattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttaactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctggggtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaagctcgcccccgctctccggacggccccggggaaagggagggtggggcgcagcgagtccgcgcgcgggagtcctcagttaccccgggcgggggaggggagcgtccacctctacgcatgcgcccccagcttccgcgggagggagggggcggaaaaaggaggaggaagaggggcgggcaaacttggaactaaccaatgatagcggcgctagccgggatcttggccggcacagaactgggggcggaatcgcgcggggcctgaagggaggggtttgggcgcgggagccgggcaggagaagacggaagtggagcgaggacaaaatggctgcgaaggttgttgctcccctcccccacccacgtccgaatcctcctttccatgccccaccttcgtgttccagacgggcctctaagtgccccgggtttcgcgaatctgtatttcatagcgtggctttggacaagggctgaccccgaggggctggggcgaaggttccggcttcagggtgccactagggctgctcgctcacggccccccaggattgggattggagggagccgccaggccgccgcggggtggggcgggttagctcggcaggcctcccagcacctgcatttccctacggcaactgtcgggaggcagcccccgacgcagaggtttaaggggcccggcttttcagaaccgcctcaggacgcggtcgtgtctggatccctccgcggaaaagaaggcgaaaccgcttctctgagccctgaccgttaggccccttcccacctccgtctagaacagattcggcttcttggctcagtccttccccaactagcccaagccctacatttccccgttgtttataaaataaacaggtttaaatggtggcgagtgtgttcttggttaggtgaaccaggcattaggaatcataggttccagtagccgtgcgtccttgatttagactttctgaacgtttgtattttcagtaacatgaggtgatatctttcctggtttgactttcatcaaaaattaaacgacagaccataccgacgctttgaaaacgtgactgagctggtgcacaaaacaatggtgcctagaattttgaattgtgcaatgttgtgcatggccgcggatatgtggggccttgtggttccaagagcctgtctcaggtaccttgaacactccctgtatcctttcaagcaggcgaggtagctgttattcctatttagtagataaataggcaccgatgggggaaaagattttttaaggctacaccaaaagaacttttagtagcagggctggaattagaaggtctctagactgcgaaaaaggctgtcagaagagcgaggacatcttgtccttgtcaaagccagtaaagggtagagacagactcaaacatatgaagaatttccttttcatattttccttttggggaggaatgttggcttagagttcatggagatatattcttagcctctcccacgtcccaagaatttaattttatacaatgctttcactacatacaaaatgctttcatttgtcatttaatcatcaacacaattctctaaggtgtgtattattcatccccatatcaggggaaaaatgcagctcagagataatcatttgtgggaagataagcagctgggtaagctagaatcaaatctagcttttttttggttcaagatttgttttatgttttttgttagttacgctacagtgtaatttccttcctggaaataaattgaactcaactccagaaagagttaagatatgtactgtgagccactgttttcagtttcctttggtatttggaacccccagtcccccacgctaactgctagtaatgttatctggaatctttcttttcacaccccagtgcctagagtttaacaagcacaaattttaaactacaccctgtgctgtattttgcgtttttgtaattattttaatcattgaatagtggaaaatagaattggggcgcacatccacttgtttgggatatcccatccaatagcagtgataaaagaaagcagaacaaataacctctgtttctggttactctcaaaacgcgttctgggacttgggctatgtcttattaaatggaatgatttaccgtttatatatttaaagctcagaatatgataaaggtcctgtctccaccacttcaaacgcacagggtttcaaatgacacagttaagatctaaaattaaagtttggttgcatgggactgcagtggagcctagagcctaggacttctgactggataaaaggataatgatttaacatttttgtgtgcctaccacatgccagccttaacctcatttaattctcaccgtaaatctaagcggtagcaactattatgatcgtcattttgtaaatggggaaactaaggcacgactccgtctcccaaaaaagacagtctcccaatggagtctcccagaaaagatggagtctcgctctgtcccccaggctggagtgcagtggcaggaacttggctcactgcgacctccgcctcccaggttcaagtgattcccctgcctcagcctcgcgagtagctgagactacaggtgcatgccaccacgcccggctaatttttctattttagtagacggggtttcaccatattggccaggctggtctcaaactcctgtcctcaggtaatccgcctgcctcggcctcccaaagtgctgggattacaggcatgagctaccacgcctggcctgttttttttgttttttttttttatgtggagtctataactgtcatccaggctggagtgcagtgctgtgatcttggctcactgcaacctccgcctcctgggttcaagcaattctcctgcctcagcctcccaagtagctgagattagaggcccgcaccaccaccacgccccgctaatttttgttatttttagtagggacggggtttcaccatgttggtcagactggtctcaggcctcaagtaatcttcccacctcggcctcccaaagtgctgggattacaggagtgagccgccgtgctggcctcagtttatgaagaaattatttaatagttttgtggtatcagttgcttctgttgaaaagtctcaaccagcctaggcaaaatagtgagacccccatctctgaaaaaatgagatgggaggatcgcttgagctcaagaggtggagaatgcagtgagccatggttgtgcccctgcactccagcctgagtgacggagcaaaaccctgtctcaaaaaacaaaaaaaaatgaaaaaaatttaaggtttagaatttaattggataatttgtgttaggattatgtggtgtactgttactaagtatgcatttttaaaaaattagtattaaagaatagtaaacttacagtcccttgctttaaaaactcagatattaaaaacaatcctcctgtgacccggtgacatgactaaaagatgcaatatatgtatgccctgattgcccaaatactggagtgtatgtactgcattgcatcagggaaatttgaaaccagaatgatgtaagctgttattaatattttgatttctaactgcagccatgtataaattattgcaactggagaacagcatacataaacatagccccaatatctttttcctgcattatgctttaccttcctaaaccagattatacgctttagaacattctcatgcctattgtatttctggtagtagagcccttgccattgatgttttattcagtgctttatgcagggcaccatgctaagcatttgacatatattctcttacatgaccctcacaactatttttggcagatcatattgtccgcattttcaggtaaagaaattgaggttcaaataggtcaaataatttgcttaagatctctagctgaccctgaatttttcaaaatcagattttattctacagcttatgcttctaactcaggctaggttgctttctactttcaaactcttagtcatcttgtttagcccctgcactatggagaggaggtgcggtataaaatgcgctcttggccaggcactgtaatcccagcattttgggaggccaaagctggtagatggcttgagcccaggagttcaaggccagcctgggcaacataaggagaccccatctctacaaaaaatacaaaaattagctgggcgtgttggcatgtgcctgtagtcccaggtactcgggaggctgaggtgggaagatggtttgagcctgggaggttgaggctgcagtgagccgtgattgtgccactgagctccagcctgggcgacagagtgagaacctgtctcttaaagaaaaaaaaggtgctccttattattttaattttttttttttaatctgagatggagtctcactgtcacccagtctggagtgcaatggtgcaatctcagctcactgcagcctccccctcctgggttcaagcagttctcctgcctcagcctcctgagtagatgggattacaggcgcacaccaccatgcccggctaatttttttagcatttttagtagagaggggttttcgccatgttggtcagtctggtctcgaactcctgacctcatgatccacccgcctcggcctcccaaagtgctgggactcaggcgtgagccactgcgccccgcctattttaatttaaaatttttttcagagcagcttaatttttaatatttatttatttatttatttatttattttttgagatggagtttcacttttgtcgcccaggctggagtgcgatggcgcaatctcagctcactgcaacctccgcctcccaggtttaagcaattctcctgcctcagcctcccaagtagctgggattacaggcatgtgctaccatgcccagctaattttttctatttttagtagggatggggtttctccatgttggtcaggctggtctcgaactcctgacctcaggtgatccacccgcctcagcctcccaaagtgctgggatgacaggcgtgagccactgcacccggctaatttttaagatttttttttggctgggcgcggtggctcacgcctgtcatcccagcactttgggaggccaaggcaggaggatcacaaggtcaagagatcgagactatcctggccaacatgctgaaacgctgtttctactaaaaatacaaaaattagctgggcatggtggcacgcacctctagtcccagcttctcaggaggctgagggaggagaatcacttgaacccaggaggtggaggctacagtgagtcaagatcacaccactgcattccagcctggcaacagagcaagactccgtctcaaaaaaaaaaaaaaaaaaaaagtttttttttttgtttgtttgttttccttttgcagagatggggtcttactgtgttgcccaagctggtctcaaactcctggactcgagcaatcctcctgctttggccttccaaagtgctaggtttacaggcaagagccactgtggctggccctaatttttaaattgttttactaattgaaatctttagcagagctgcttacaagtagccaaactcattgagttttccttttttataacttacttttccatccacaagtggtaacaaaaacatatgatataaaagatgacagagggctgggtacagtggctcacgcctgtaatcccagcactttgggaggctggcggatcacctgaggtcaggagttggagaccagcctggcttacatggtgaaagcccatctctgctaaaaatacaaaaattagccaggcgtgatggtgtgcgcctgtagtcccagctactcgggaggctgaggcaggagaatcgcttgaacccaggaggcggaggttgcagcagtgagccaagatcacaccactgcactccagcctgggcaacagagtgagactgcgtctcaaaaaaaaaaaaaaaaaaaaaagaagtaaataattgtaaacataattactaaacatggggtccttgaactgtataatttttttttttttttgagagtcttgctctgtcacccaggctggagtggagtggtacgatctccgctcactgcaacctccacctcccgggttcaagtgattgacctgcctcagcctcccgagtagttgggaccacaggcatgtgccaccacgcccagctagtttttgtatttttagtagagatggagtttcaccatcgtggccaggctggtcttgaactcttgacctcaagtgatccacctacctcagcctcccaaagtgttggaattacaggcgtgagccatggcccccagcctacattttaaataaattgatatgactgtatcatctttgaagaatcaactgtacctattattttgtagttttaatgtaccttatctttttgcctctcagaagattggacagatttaatcttgatgtgctcaagatactctgtgcttaacattcaacaaaaattacatgatctaagcccatcattaccatgtaaagacaaatcaggcaattataaaattgggaattgtatcttgttttgcagaacaagggaaaactaaaggatttggacttgtgtgagtgagctaagtgtgtcccaagtatggtgaacagctttaggtcaaggaagaaagcaaagaggagagaaagcctatagctgagtgtaaaagtttgaggatttcaggagggaagatgatgatgaatcaggatctgtcagttctgatggaatatactaacagtggctgggtttaaatcctggctccagggccgggcacagtggctcatgcctgtaatcccagcactggaaggctgagatgggcggatcatgaagtcaggagattgagaccatcctggctaacggtgaaacccgtcgctactaaaaatacaaaaaattagccaggcgtggtggcaggcgcctgttgtcccaggtactcgggtggctgaggcaggagaatggcgtgaacccgggaggcggagcttgcagtgagctgagattgtgccactgcactccagcctgggcgacaaagctagactcggtctcaaaataaaaataaaagtgaaaataaatgctggctctactactgacttaacctctttgagccttacatttctcacttgtagaatgtgaatacaaatatttccttatagggttgatgtgagtatgacattgagacaaaatgtataatgtacttagtgtgactggcacgtgatggctcagtaagtgatgattactattattgctgctattttgcaatgacctctgtgaagttttttccagatgtatttgaatctcttagtgcatacttttcagatttatttgaaccccttagtgtgtgcttctctgttggcacttcacctaggcacaaaatacttacttagtaattattatttcattaattttgataaatccttaaggacagcaactcttggtatcccctgtgcaacttatacctagcatcttgccttgtgagagaaaaaagtaattggtaaattcgtgactgaaattgataaataatagatcgtattcagtctgagttcttctgttcttctgttggcagcaagctgataaacaaatttccattccaggttatatgagcttcagcttctcctacagtatcacttttacttgtttattttttaattgctgatacagatgcatccataataaatatttggtttttgtgatgctgaaacacagtcccaattacaaggcaacttagaagttaaaactgaaactgaaatataaacagcttaacaccagaaggaagcaaaactatatatgtctttttgcaacagcagttccgaaattgtttttatacactgtaacaacaaaggtaccaacttccttatttcacaaatttaagtttggtttatatattttattgacatggttactcaatgtccacatcattccatctgcatcgtcttcctacaaacagtttttcttctactattcggttatttctcctttttttgtttcctatttcagaatcaaatttattttacttgcaaagtcagtggaatatggtttggaaccagtagggcctctaacttaagcccagaacctgtcaaagagaagtgcagtatcattgctaagacttgaacagtttatctctcagaatcttcagttcctttgaatttctcagctcttagtgtaatctgttttatgtgtttgttgtagacttccattatggatagatttccaaaataatttgggtaatcaactggtattttagcattctggtaactaacatgtttaaaaatctaaggctctttttcatgcaaaggagactgatttttgctttcaaaagcataggcaggaaaccttaggttcaaaggtagtaaataatgatgagcaaattgctagtgatgatacagctgcagcttccgttgtgtatttgtttggctcaggtactctagaaatgagaattcttagaattacatagcagaagtgatatgttgcctggataccacactaccagaggaataaaaatgtagttagagtaaggggttttatattttacaatgagacagtgttagtgtaagaagcattccaaatacgccagttctcttaaacccatagcagacatttatatgttaattcctcaatgtctcatttcccaccttttttagaggaagaaaatactcaggctaaaactttcacccaagcataaactcctggggactttacaagaattttgttttttgcactatgtgacgacacgattgtgagaattaaatataggagtgaaaaaccagagaaatggggcaaaatcccagattagtctttcctctttaagcatctgcttcccattttagaaacatgctttcatcaccacattcagcatcaatttttttctttcctctaacctgctcttcttttaaaaagtattctgggccgggcatggtggctcacacctgtaatcctagcactttgtggggccgaggtgggtggatcacctgaggtcaggcgttttgagaccagcctggtcaacatggcgaaaccccatctctactaaaaatacaaaaattagctgtacgtggtggcgcacacctataatccaagctacttgggggactgaggaaggagaatcgcttgaactcgggaggtggaggtcgcagtgagccgagatacgccactgcactccagcctgcgtgatgagagcaagactgcatctcaaaaaaaaaagtattctgagccaggtgcagtggcttccagcactgtgggaggccaagggtgggtaggtcacttgaggtcaggagcttgagacaagcctggccaacatggagaaaccctgtctctatcagaactccaaaaattagctgggtgtgatggcaggcacctgtaataccagcgactcaggaggacaaggcaggagaatcacttgaacccaagaggcggacgctgcagtgagctgagatggtgccactgcactccagcctgggcaacagagcgagacttcgtctcaaaaaaaaaaaagttttctactctcccagaggtgatcagttgacatttgtgctagggtccttgaagagctgattcaggtccagcatttgtgctgtaggtatcaagagtaatcaaaactattaaaaaggcaagttattgtattgcaggctgctgttttctttatttctcaaacatctttcttctcccattcatcaactcttcagcagctatcctggtgagttatttttgctaaatctttccaagatacaactaaaatgttagcaggcactagctcagccctctcctgccacccactacttattctcatctcttccctaaatattagtacccttttcttccagcccagagctagacttctggatgctgagcctgggaaaatactgaatttctctcatttttcacttttaggaggg

SEQ ID NO: 1103 - DNA, 135014 bp, Homo sapiens
tggcaacccctggacacagttctgaaccaaatgaagaggatctggaaggcaaagcactaagatcatagtgaagacttgcctcccccttctccttgtgtcccaccagcctccctgctggcctgaccaggccccatactccagtctccccagagaccccaagctgaagattctgtgggtctgccccattgctgggcacagcagagcctggatggaggcttgttgtcttctgcagttgccccaaaggttgctcttgctgggggcagccgccctgactgcaactgctttggagacaggtaagtatcagggggcttggttggggcacccagaagacttgggcccccaccatccttagagactatgtttccccagtcagcactcatcctgctgggctgagaccttttgagctgggggaggctgggaaactgtgtctggtcttgcttggcatccccaaatccaacccaaagccttctggaaggcttggatctgccagtcacctagaagcaggagtctgggagtgggcaggacagccctcagggcctgctttgcaaaactctgtaggcttcggattcagagaagctgcatttacacactctgccacttcttatgtttgtacctttgagatcattgtttcaactctctgaatttctttggcagtaaaatgaaaataataggcccttgccccttaagggactatgattattggcatataagatgagataagtcatgcaaggcacttcataatacctggcacataaaaggtgccaaattcccggctgggcgcagtggctcacgcctgtaatcccagcactctgtgatgccgaggcgggcggatcatgaggtcacgagatcaagaccatcctggccaacatggtgaaaccacatctctactaaaaatacaaaaattagctgggcatggtggcatgtgcctgtaatcccagctacttgggaggctgaggcaggagaatcgcttgaaccagggagtcggaggctgcagtgagccgagattgcgccactgcactccagcctggcaacagagagagactccgtctcaaagaaataaaaaaaaaaaagggtgcccaattcccttactctctaaactccatgcctgccctgtgtaccttcagggtaggctctggctttagcagagaaataccaaatattggaaagtgctcccacatcctgagctctgatgaaggattttttcctcaaagacccacatcctggctggtcctcaagtacccactggtccctatcttgcaccagaaaacccacctcctctttcctctctgtgcttacagaaatcagggctactttgagtacttgcacatcttctcatttaatcctcacaacaaccctgtaccagtgaggatgttttgggctgtaagtaacagataacaaactaaatggggcttaaatggtaggatatttgctatttcagttaagagtggtcataggtgattccagagatggttaactcaacggctcaacaatgtcactgttcctctgaaatgctctgacctcatctttgcaaaatggctgctgcagctctggacatcccatcctcatcctcagtcagcagctttcaaaagcaggaagaaaaggggctccttatcacacagctctccccctccccttttttttttttggtgacggagtctcgctgtgttacccaggctggagtgcagtggcttgatctcagctcactgcaacctccgcctccagagttcacgcgattctcatcctcagcctctcgattagttgggattacaggtgcgcaccaccatgcccggctaattttttgtattttagtagagatggggtttcaccatgttggccaggctggtctcgaactcctgacctcaggtgatccacctgccttggcctccaaagtgctgggattacaggcgtgagccactgcgctcggccccgcatcttagggtttcgaataagggattgtagatttgaattaaattaaattaaatcatttaatccttacaatcattctgagattgattaatcatccccattttaccgatgaggaaaatgaggctcagagagggcgagtaactcgcttgggatcacacagcgggcaggggacagagtagagttcggggtcgcgccgcgcggctccagtttccgtgccttccgctgcagccgacctggcggaactgtgcgggcagacgtggcagggggacgggctgctgctgcgctcgcacgccgcatcgcgcaggttctacttcgtggctccggacaccgactgcgggctctgggtgcaggcggcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctctttccgtctgggtgagctggggctgaaggccgggacgggaccctctgcagaggccatgcgggactggggccacagtgggggccccggtgagggccgctgccgacaggggaatggcaggggtgcccgaagcacaagatggcagggactgggtccaacgggagggaagaaggtggtggctagtggcagagtcacaataagggacctcccggatcctaagagccaaccatataaatctggctaccatggatgtgtgcgtcagactgtcctaccagccccagtgcgcacacacatccacacacatccacacacaacttcctccccacacacattcacacacaactcccacacgttcacacctcacactctgacatccacacccatgtcacatacgcacaacccacgcacctcatcgcccccacacactccacactcatgcctctcactgcagcacacgcctcacactgcacactcaccatcacacacctcatatgcacacagtaccgccttgcacacttacacacagctcacatgctctcatgccacatgctggctgctctgcgctgggtcagcccttcagatgtttgcagaagggtgtgcttaggactcgccaggcctgtaggcagcagaaaccaactcaagccaggaaagggccctcttggaactgaaattaataatactcgcccaactgggcgccgtggctttcgcctgtaatcccagcactttgggaggccaagtcatgaggatcacttgagctcaggaattcaagaccagcctgggtgacagagagagacctgcctaaaacaacaacaaaaaataatttaaaaaatataataattaaaaaataataaaattaataacagtacttgccccataggggtattgtgaggcctcaatgggccaggatgtgtagtatttacggctgtgcatggcacagaagaggaagtcagtacatgttagctgccatcctccaccctcctccccatgaaacactcatccatgttctcatctgcatgcatgagggcagctctctcctgcccacacccccacactgtcaccatgggggccacacatcctgctgtgtcgtgggctggaccggaatcctcacctcaggcttctgcttctggcctcaggaccttgtggtgcctacttccgctgccagaatggcaggtgcatcccctcaagcctcgtgtgtgacccctggggcatggacaactgtggcgatggcagtgaccagggctcctggtcaccagctgactgcagaggtcagtgcggggtgtggactgggccctactgaacagctggagggaagcctggccctaactccccttccctagggcagggccccgatggggaggcaggagagaggaaagcggaagtgtggaatcggcttaggccaagggctggaggggcagagcagtcagggccagaactatgctgcagatgatctcatccggcggattccaaatgatgctttagtggtggaaacttttgctaaatgggacctggcatggaggcccaagacattcaaaggagatatcctctgcttaactggatggtgggcctggggccctggctgcctgatgtctctctgagggccctgagtgtcaccctcaagacatactttgaaaaccatcaatccagtctgattcccacactttacagatcaggaaactgaggcctagagagaagtgacttgcccaaggtcataaagccagtgagtaaaatgagcaggaatgatctctgtagacaggggagtgggataggagggctagggttggtggaagggaccagaacaaatcacccaggaataaccttcctggggatctaaagatgtcccacctgcccaccacacccaattaggagtgggatggaggtagggctgccatgtacagttgaacaggggtgaaatgcagtttcccagaaccccacacacttaccttccccatcccccgctcagccttttttgcaggttcctggtcatttccctgatgctgtatgctttgtgccatgagacccaggtcctatgtccccttgtcctccatccaggctcattcccttgtgggtctcatttatatcgtatcacctgtgggacttgtctttgaacttcagccacataacctcctccctgctcagcatctctgcgtggatgtataggcgaaatctcaaacttaacttgccccatactggactccttgtccacagccctccctgcatcctgcttccctctcgctgagcagcgacttcacattccagctgcccaggcctcactgagtcatcttttactccccgcttaacccatagcctataacccataaccaagccagtgacaagtcctttgaaagctctccagactctgacccttctcacacctgctctgccatcacctggtctgagccaccaccagctctcgtctgggttgttctaataacttctgaactggtctccctccttctgtcctttgcctctgacaacacaggaagaaggaagcctgggggagccttctttttctttttctttttttcaaatgaacttacttatttattgttttgagataggttctcattctgttatccaggctggagtgcagtggcgccatctcggctcactgcaacctctgcttcctgggctcaggtgatcctcccacctcagcccccagagtagctgggaccacacatgcaccaccatgcccagctaatttttgtgttttctgtagagatgaggtctcactgtattgcaagggctagtctcgaactcctggactcaagatcttcccaccttggcctcccaaagtgctgggattgcatgaacttcattttttagggcagttttagatttacaaaaaaattgagaagatagtacagaaaattctcatatacccagcactcagtttgggtgctattactgacattttacattagtatgagacatttgttttaattaatgaagtaatattattaactaaagtccacagtttgttcagttttccctagtttttacctcatgtcctttttctgtcccgggatcccactcagcatctcatgttacatttatttatttatttattttattactttttttcagatagagtcttgctctgtcgcctaggctagacagactgcagtggcgtgatctcggctcactgcaacctctgcctccctggttcaagcgattctcctgcctcagcctccggtgtagctgggattacaggtgcacaccaccacgctcagctaatttttgtatttttagtagagacgggatttctccatgttggacaggctggtctcaaactcctgacctcaagtgatccacccgccttggcctcccaaagtgctgggattacaggtgcacaccaccacgctcagctaatttttgtatttttagtagagacgggatttctccatgttggacaggctggtctcaaactcctgacctcaagtgatccacccgccttggcctcccaaagtgctgggattacaggcgtgagcctccgcacccggcctcatgttacattcattaatagtcatcatgcctctttaggctccccttggctgtggcagtttctcaggatttccttgtttttaatgatcttgacagttgtgagtactgctcagggattttgtaggatgccccactattgggatttatttgatacttttctcatgaaaagactagagttacagttcacagaggtgaaatgccatcttcatcacatcacatcacaccaaacatgactttggtgttgggtgtttggtgttggacggtggttgacgctgaccttgaccgcctggctgatgtctgcctcatttctccaccgttacttttggtcccatctttccccactgtattcttgggaagtcactatgtatagcccacttgagtggggagttatgcttccccgccagaggtaccttttaaaacagtaaatcaggttatgtcactatcctgctcaaaaccctcatcacattcagcaaaggcaaagcctcgcccgggctcaaaggccctgcacgatctggccctgccccttctttcctggcctcgcctcttccttcctggccccgccccccgccccacccctccctggccccgcctcctccctgccccaccccctccctggccccgcctcccctccacactccagctttgttctggcctttgcagtagctgtgtcctctaccagaagacttttcttctgagatctgcattgcaagctcgttcctttgcttcctggtgggtctctttaagttcttccctgactcctttatataaaaatagcaaccctggccaggtgcggtggctcacgcctgtaatcccagcactttgggaggccgaggtgggcggatcacctgtagtcgggagttcgagaccaacctgaccaacatggagaaaccccatctgtactaaaaatacaaaattagctgggcgtggtggcatatgcctgtagtcccagctacttgggaggctaaggcaggagaatcacttgaacccgggaggcataggttgcggtgagccgagatcgcacggttgcactccagcttgagcaacaagagcgaaactgtctcaaaaaaaaagttattattagtaacttattattatattctaatatgtatattagatatgcttcctgtacagcctgcagaactgagacaattaaacctcttttctttataaattacctttataaatttataaatttataaattacctttctttataaatttataagaaaattataaattttctttataagcatatacatatgtatattagaatagtcaaaatcacagagacaggaagtagagccatggtcactaggggctgggggggtggggacaaggaggatatggagttaatggaattgacggagttgatggagtttccgtttgggcagatacaaagttctggagatggatggcggtgatggctgcacaatgtgagtgcgtattagtccattctcgcattgctataaaaaaacacctgagactgggtactttataaagaaaagaggtttaattatctcacagttctgcaggctatacaggaagcatgatgctggcatctgctcagcttcaggggatgcctcaagaaacttacaatcttggcagaaggcgaggggagcaggcacagccagagtaggagcaagagagagtgagtggggaggcactgcacacttttaaacaaccagatcttgagagaactcactatcttgagaacagcaccaaacggatggtgctaaactattcatgagaaatccacccccatgatctaatcacttcctaccaggccccacctccaacactgggaattacaatttgacctgagatttgggtgggaacacagatccaaactctatcagaatatatttaatgccactgaactgtacccctaaccatggttaaatggtaaacgttatgtgctttgccacagtaagaaaagcggcagcccgctgggcgcggtggctcacgcctgtaatcccagcactttgggaggcagaggcgggaggatcacgaggtcaggagatcgagaccacagtgaaaccccgtctctactaaaaatacaaaaaattagctgggcgcagtggcgggcacctgtagtcccggctactcgggaggctgaggcaggagaatggcgtgaacccggaaggcggagcttgcagtgagccgagatcctgccactgcactccagcctgggcgacagagcgagactccgtctcaaaaaaaaaaaaaaaaaaagaaaagaaaagaaaagcggcagccctgcccccaccaacatgcgtaatttttctcactagcatctatctcctttagacataaattctattcatgtgttttgtttctccccacactaaactcccagtgccatgaagacatatttgtcatgtgctcatggttgtatcccccagttgctagagccatgcctgggggcataggagatgctcaagaaatactagtcaaatgaatggaagaaggaacctctatgcctcagtttccttatctgtgaaatggggataaacctcacccttcagagttgttgtaaactgtgagtggcatacataggtaacgggcccagcacagagtgtggtgcttgatgcacagaaaatgctcatggccgggcatggtggctcacgcctggaatcccagcattttgggaggctgaggcaggtggattgcttgagctcaggagtcgagaccagcttgggcaacatagtgagatcccgtctctacaaaaaatagaaaaattagccaggcatggtggcacgtgctggtagtcccagctactcgggaggctgaggtaggaggatcacttgagcctgggaggcagaagttgcagtgagtggtgattgcgccactggactccagcctgggcgacagagtgagaccctgcctcaatgctcagtacatgtacaccctcttccttgggaagtagctccactcatagaccttaggccctggagccagaccatgtgagttcaagtcctcctatcacttccagctaattgaactcggcaagtgacaacctctctgtaaaatggaaacacagagtgacaaactcagggaagtcttgtgaggattgaatgaaacacacaagtgtcccagaaagggcagttctcagtgtgctagttctgttctttcccatgcaggtccctctccggtgcccagccagacaggaagtacagatgcccatacctccagatccctgactccctccccagctctcgggtctgcaggatccctctggattgcagctgagaggagttccccagcaggcagggaccccacgagacaagacgcagctttggaaggttacaccttgctcctactcttcccaccaaaatcatacctgtccctctctaggtgatggggacggggcagaggacccaggccgaggcctgagtggactttctcttcccacaggcccccagctctgaggggtggcgctggcctcctcgatgctcctggcctctgctggcctcctcctgggcctcctctggtgctgttgctctcccagctggctggcctggcaacctggtgcccgtggcctctgcctccactgcagcacagcctgtaccacgtgctacccatgtcccagccaggtctccccagggggctgcagttgagtggcccagccttataggatcagggaggccatccctagaggggcttcgggcacatgggaatgatactaggctctggggtcagactctttgggttctaaccccctggctctctgtctgatgttggacaggccccctaaccctctgagactcagctgcccctctagaaaataggacaattcctgcctcacagggttgggggcctgggggcctcgctgatcccaagccagcttgcttcacccccagatctcacctgccctgctctgccccatccacaggctccactgagtgaagccctcatcaaagactcaggaggcccctggcggggatagcaccgtttattaagaaaaatcaagacaaagaccacaggagggtcccttctaggacacagaggccaggcgtcccaaccccacagtctgggggccactggcaggatggcacttgagctggatcttcaggctcctgcagatggggcagggtggtcatatccccctcctctctctctcagtcgtgagtcctgccttcccccacctaaggcactagctcttcctgagcaccagcggcatccgtccgtccgttgtctgttggaggagtccctgggccttcacttccagatgggtggggatgtggcctggggtgggcggggcccggtgggcggggccctatcagtgctgggctctgcctgtagcagctcctggtaagagttggggtgggccttcccttacagcccctgagggagggaccccaggctgtgtgctggcaggagggggtgggaatgcaggccaggaggacgtggtaggagggggagtctgccagaggaggtgccaggggctgggtggaggtgggtgggggtgctgaaaaacgagctggtggggatggggaccgcctgcccaggggtgagctgccttttgctccacagccggcactaaagacaattcccaatcctgagtgggtggcagagactcctgcgatgcccgtctcaggtagctgtggggcaccagcccacaagccgaggttggctctcctaggagtgagaactgcccaagggctgcagaaacaggccacccagctctatctgggggctccatcggtgggtagggggacagtgggggcagttctgggcccacccagccactgttcctgaccccaagtcctggtgactttctgaggtgcccactcccatccaacctgccttgctggccagccttgtggctttgcccagctgtgtgtgtgagggtggcatgcccacctccagtccagcccagggcggtagcagcaaagcgtggcatcgcctcggtttcttacaaaaattcataataatattaataataatatactcgacattgtcgggctggggcgtggcccgggagtccgtgtggggcaggcaggtgcctacgaggggcaggggcgtgtgttggccccggcctgggcgcggtgctgcaggtccaggggctgtgggggcggggcgccgggtcgggccgagtgcagcaccaggttcttgacacagcctgtgatgcctgaggagaatctgcccccggtcagcgtggccacgtcaggggctccgcctgccgggaggtgagaggacagggcctgtgggctccagcagcccaggaggcgaggaaggctgggcgagctctagccctaagggagtgccgttcctgcccctgccctgagaaggagccccagacttaccgatgtagacgctgcccttggcgttgactgccacgttgggacctggggaccggccgctgaccagctcctcaccgtcgacttggatggaacctctgcggccctccctgcagtggaactgggtcaggcccctttccacaaacttcctggtcctccccggccccacgacagagtcccctccctctgatatcgagactccagactcagaagtctgtccctgtttcccaagctctttctttcccccgctgaacgagagatcgggccccacaaacacagcttcctcatttctgcacccaggtttcctcccactcctggggcactcgcctgcccccagcggagttcagtccgagatggaagcccgagccctggctggtgggttctcccctcccctggcttcaagttctgtctccacagagctcaatacctgcctctctgcccatggtagggggcgtcctgccccactccagaacgctgggccccatcccgagtgcccggcagggtcccttaccgcagtgctgtcacccggtgccactcgccgtcattgatggggtcctcagagaccaggcgggcctccccactacccagctggtacctgcagtcatccaggcccaagaagtatgagctggggcaggaccggggggtggggtgctgggaccagggaagggagaggaagggccaggtgccaggacctacctgaagacaaggtgcccgtcttgaagcccgaggctgatgaagtccttgccttggccggcctctcccacctcctgccagggaagcacagggtctctggggtccccagcctggagagcagaggctgccgaggccagggggctctgctttcccctccccccaccactccggccaccaggaagccagcttcctgccccaggagccccaagagcccagccggatacccacactcaccacaccctgccagagcaggaggccactggctgtgctggtccgaacctccagctcgatggtctcgggcacctcgggcaggctgcggaggaagagcgggtgaggggacagaagtcccagattcccatcctccccattaggcccatgggcccttccaatgccagtctcacctcctggagaagacatggccagggaaggcgaggaagccatcatcgtggaaataggctccgtactgcccaggggcatctgtgggagagaggagggtggtgccatacctgctgcatcaggcatcaaaatcccccgtcagttcccctgacccccacctccacgccaacatgcaggactagggggctccgagcctgcagtccctggggacccacgggggctgccaacagaattcagggagcctatgaccttggatgggaaagcattacacctcaatttcactcacttctcactgaaattgagcagttctttcaatgagatgtaggcaagaaaccaaagtagcagtggtaggacctgcaactttgttactagtatttgcttatcacatgacagtagctgcaaatatttcaaaatatcatttacacatattgctgctttgaaattgtggtagctactgagatcaccagatcttgttatttgatgtgttaataaagaagcacatatatagcaagtcaggaaacttaaaacatgttttgattactttacttcagcataattgctttccttaaatcaatgtattttattttattttattttgtgtagtcaacaggatccgtgtcgggtgacccgccattctacttgccaaattctgtctggctttagccctgaaagtcccacatcccaagaaacccctcagtccggagctactgggaccgttggtcaccttggactgtggcaataaatggttcagagccttggtgttctctccatcttacagaagagcaggcaggcttgggcgagtgactggcccaggatgtccatactgtgtgtggctccacacccccccagccctatctgctcatgacccatcccacaggccggcactggccacagtagctctggcaggggacaagagtaggggaccctctgctaccctccaccaaatgatgaggagaacggctgacatttacctaacacctatgatgtggctgtgcggggagcgtcccatccagctacagacaccactgcatttaactcaatccttacaacaaccctatgaatgaatattatatatagataatttttattttatttatttatttttgagatggagtctcgctccgtggcccaggctggagtgcagtggcacaatcttggttcactacaacccccacctcccaggttcaagcaattctcctgccttggcctcccgagtagctgggactacaggtgtgcaccaccacacctggctaatttttgtatttttagtagagatggggtttcgccatgttggccaggctggtctcgaactgatctcaggtgatccacccaccttgtcctcccaaagtgctgggatgacaggtgtgagccaccgcacccagccttattttttatttttttgagacagggtctcagtctgttgcccaggctagagtgcagtgacacaattgtagctcactacagcctcgacctcctgggctcaagtgatccttctgcctcagctgggaccatagccatgtgccaccacacccagctaattcttaaatttcttgtagagatgaggtctccctgtgttgcccaggttgatcttgaactcctgggctcaagcaatcctcctgcctgtctcctgagtagctgggaccatagatgagcaccaccatgcccagctactttttgtatttttttgtagagacaggatttcgccttgttgcccaggctggtctggaactcctgggctcaagcaatctgcccgccacagcctcccaaagtgctgggattataggcgtgagtcaccatacccagctgaatatagtatttttttttgagagggagtttcgctcttgttgcccaggctggagtgcaatggtgcatgcaatcttggctcatggcaacctccacctcccaggttcaagcgattctcctgcctcagcctccggagtagctgggattataggcatgtgccaccacgcccagctaattttgtatttttagtagagatggggtttctccatgttggtcaggctggtctcaaattcccaacctcaggtgatctgcccgcttcagcttcctaaagtgctgggattacaggcgtgagccagtgtgcccggccagctgaacataatattaacaacagctaacattctgtactgactctgtaccacacattgttctaggcatttaaaatgcactaagtggccgggcgcggtggcttatgcctgtaatccagcactttaggacggtggcttacgcctgtaatccagcactttaggaagccaaggggggcggatcacctgaggtcaggagttagagacaggcctggccaacatggtgaaaccccatccctacaaaaaatacaaaaattagcggggtgtggtggcaggcacctgtaatcccagctactcaggaagctgaggcagcagaatcgcttgagtctgggaggcgggggttgcagtgagccgagattgtgccactgcactccagcctgggtgaaagagcaagactccaccttaaaaaaaaatgcactaagtaattttactctcacataaaattttatccaaatctttagggaaagatgttactcatctccattttatatgaggcacagagaggttaagcgactcacccaaagttccacagctagtaagtgggagagctaggatttgaacccaagcaggctggctccaagtctatactcttacccactataccactgcctcgcctattatattagtgatacataagaagagatgtgtctgtaaaggggttagcacagtgtccgtaaacattcaatcagcattcactcttcactgtttccttagcttttcagtagacggtggaattcttgggaatgagggtcttgctttatgcatcttatatttactgctctcagggcaaggatgggcaacaatagtttgttgactgaatacatgaatacagaggaggaaactgaggtcagagtggtttcaaaggcctgcccaaggtcacccagccagtaagtgtggggcaggccctagctccacatggctgtggtcttcattctgtctctctgcccagcaagctcctcatataaagctgttttgcttgcaggccagaattgagggtgtggggtaactggaagagtgagctgagctgaagctggggaggaggccatggcaagtactcaccattgcccccgctgccttcaagatgccagtcggactctgctatgccatgtccagagcctatggagaagggcagggtccagttggtgggcatagacacccgtgggtactatgtcgagctccggggccccaagacagagatgaagtggagagaagccaggcctgggtaccttgttggcagcgtgggccagagaagccagggaggcagaggcagcgggtgccctggcaggtgcccccatgcagacagggttcacggagctggcaggggttctcctcgtgctcacacaggtctcctgtgggccagggcagaggcgagtgggtgggtgggcatgggctggaggtgtcgctgaccacctgtgcccctcccctccggtgccctgggcaggctttcccacctttgaatccatctcgacacaggcactggaactcatactcgccagcgggcatgcacgtggcaccatgttggcaaggctggcgctcacatggggagctatcatagcattgcccgatgccctggctgcctaggaaactgtaggtgaggtccagccgtttgccattcactgacacctgtggggacagggacaccgagggactaaaggggcctgggaggcagagacccaggtgtaccagcagggagaagaatgcagcagaggggagctgggagcccacattgggccctgagtggtagcatggattctcggtgtggggagggaggcgcaggagttgagtgcctactgtgtgctagaaacattcatccgtcagtgcagacaatcctctgcccaacctttcaaagtaggtgtgatcatgcccattttacagaggaggaaactgaggctcagaggtacagtgtcctggcccagggcccgtgggtggctgcaggtggaggggcccaatgccaaggtgcttggagagccgagggggacacaaggcttggcacccctcccctcccgcttgtcccgaggaggctgctcttacctcgcccacacagccgcggaagtgagcgctcatgttggtggccggggacagtggcacggaaggctccacaccccccaggtagagcagggtgtgcaggttgaggccctggctcttgccgggcgaggagcgcagcacagggcgtccaccattcacccgcaggctgccgtccttgttgagacgctctgcagacacacggtgccagcggcccagggccagcggctcggcgctccgcagaacggccagccctggggaggatgccaggcagggttgggcacatgggggcacacggggctccctgccctctccaccacaaacagggccctgagcagatggggaatgccctacagccttctgtattccagatgaggagcccatggctcagagagggctagggattggcctcaagtgacacagagacgaaatgcacaggaagaggggacttgccctgatccctgcatttatcctcccatgcctccctggggcttgaagagccgaggggggcacaaggcttggtgtgcagagccccgcatttggtgctgggtgcttacctgaccccaactcatagcggaactccaggtggccgcccaccatcgccagggacacgaagtcctccacaggcccgctcttccccccgctgaacagcaggaccccgtcaggggcgagtggcttgaactccacgtccaggcgtagctcgtggtgtgtgttggtgagggcgggcagtgccaggtaggagccagcacccgacagcgagggggtggtcactgtcacacctgcagcagccacagctcagctgaggcagtggggatcctggaccctcgggtggggtccagctactctgccttcctctgggacccttgcctgcctcactctccaggcccagaggctcaggaccagttggcaccagctgcagtggcacaggagcccccctgcccttgcacacggggctgggaggagctccaatatgacaggggtcctctttgggggccctcactcaataaggggctcaggctgggcagacatgtggccaggtgacttcgagatcctctggcttgggaatcgttttatcatccgtagggcccatcatggcctcagagtgccccacccagcctccccagctgacactaggaccctgggggtctcaggcctggctcccctcaccttcctcacaccgcaaccccgagcggcccaggtggcagcggcaggtgtagcctcgaccgtcaggccggttcacacaggtggcgtcgggcccacaggcctctggggggcacataggccagtgaaaagacacggaggtgactctggagggaggggggtcctgatgccagaggtctgcccatcacaccccggggggctgggctagtgagggccaggccagcctcctgggaggccttggaggagggaactgagcagagcaaggcgggagccagaagaggccacagggaggactgcaggggaagcagtcgagggactctgtgtgtctgcaggttcttcagagactggacagtgttggagggggagcacctggtggcgggtaatggggtgggcacctgggtaataagatgggactgggggccgggcgtgggggctcatgcctgtaatcccagcactttgggaggccgaggtgggtggatcacctgaggtcaggagttcaagaccagccatggccaacgtagtgaaaccccgcctctactaaaaatgcaaaaaatttagccaggggtggtggcagacacttgtattcccagctactcaggaggctgaggcaggagaatcgcttgaacccgggaggtggaagttgcagtgagctgagatcgtgccactgcactccagcctgggcaacaagagcgaaacttcgtctcaaaaaaaaaaaaaaaaaaaaaagatgggctgggggtgggggagtgcctgggtggcggggtagtggtaagaatttggtcagcagggctggaggaggggaagcagcagtgatggggtgagggccttcgggtagcagagatgggggatgggtacatgggaggagtggagagtgctcaggtgagagtggggggtgtggaagtgccccagtggttgagatggtggtggatatggggaggcagcaaagggaagaggcaggccctggggcgacagcgactggcggtcggggtgcgtacctggatggcagtgcagggcctgcgagtgctcacagcggctcccggtgaagccagctgggcagacgcacacgtagctgctgctctcagagtcatggcactgaccgccattctgcaaagcagcccccagaagtaaggccgagaacattcagtaccccccataatccccacaggggccagccatggctaggggtggaggccacggcagccaggtggtgtgtggggtgtggggtcacctggcagggccggtcccgacaggtggggcagtgggagatgccgtgcgccgtgaggttgaggtcatggaagacgatctcctcgccctggatgcgcagctcccggacacagcctgggaggtgagtgggcaggatgagcacagggcagggtgtcccagcccataccctgaggtgccctcccaggctctccagggctcttccagccagccaggtaaggcccagcctcagctggaggtggggagggggctcacctatgaagccgctgctcagccccgccttggggatggcaccatagtcaggatagccacccaggtagagttcctcgttcagatccaggccctggaacttgccctggggaggtggggaagtcaggaatggcaacagaggctgggcaagggcgggatgagggctggaagtagcagtatggggttgggtctcacctgggaggtcccattgaccggggccaggtcacccacaatcagggagccctgggtgaggctgcgcagcagggtcacggtgtggaaatggcccagggccagtggtgtgggatggcggatggtggccatgcctgagcctgcatcgaacctgctccgtggggcaggccggggcaggagagagtggatagggggtttgtaagaagggctaggggcccagttgggtagaggggtcccagaggagggatgtcaccacttcctgcagtcccagccctggggctgttcccgttcctgtccctgtcttgtcgtccctccccgtgacccatcccctggatcttctctccccacatccttttgctgggagctttcccagagcagcccacagggaccccaggctcagcgccctgcagcctagcacctggcctccttgttcctctgaggactcctctctccctgtgatcaccttgtttctctgtttatggcttgtttattcttccccagtgagaatacacctcttcccacaagagccagaatttggtctgttttgttttacctgtatcagtgcctggcacacatggggtggtcagcaaataactgatgcatgcatgcatgaatgaatgaatgaatgaatgaatcctggcctgcagcagtcccaagtctgaggttgcaccctcctccacctgactggcatactattcctactctagcagattgggtggtcaccaagggtaacggccacattttctccttcctccagatctcctttgtataatggagcccagggtagcacttgccagaccaaagccctgtgtccagtccccctgtaggtggggaggctgggggtctcaccggaactcgggccttccccccacgaggccgaaggagatgaagtcgggctgccggttggccaggttggtggggctccctgggactcgcttctgcccattgtacagcagcatccctgggtgggcaccactgtgtaaggggcccccttccagccacaggctccctgtcctcccccaccctagaaaccacccaagctcttgagcctgtccactctcggaacctgtccctccctctggcactcctcacacagccagggccttctcactatctcagggctggtgccccaaacgcaagggccttactgagcgcccctagaaagaaactgaatttgcttcacacacactggagtctccctcaagggggagagggaggcagagactcacccgagtagagaaggaggcctggacagtgaaagtcagagacccgtaagagacgagagaaagagaggaggaaagggtgagatggaggcagaggagggaggaaggagcagagatggggaaaggaagctgggacaggaggactgggggtgatgccccggtggcagaggagccacgaggaggctggagatatcacagaggcagggatggagaagccgggaggcacaagagaaggcacaccagggtggaggcccagaggtctgggggcttctggagagggagggctgagggattggggcaggactgaggggcagccagggctcctgccatgatggcagttactccacgaggtccctcaacccaggccagcccaccccgcaaattaaccctcctgctcaccatcggctgagtcgggccggaaggtgatcttgatctcgaacttcctgtaggcatccttgatggtgggcagcggtaggaaggagtagggggtctgcgtgaagtagggcaccacccgctctgccagcagagagcacagctgaagaccctgccagtcagggagtgggcagggcactgccaattcttaggggtggtgtcttacctggcacctgcaggtgggcaaaggctttgaccttgccctggcggttagtggcggtgcagacgtaggtacctgcgtcctggggtcggactgagggcagcatcagcatgttgttctccaggcggctgtcaggtggcaggctgccatccagctgcaaatgcactagcactgagggccctggccttggcccacggctccaggggcccacctcccatctgtgcctcaggcccaccttccaacattgagcgtttgctcttggccaagcctgtgccacatcctggggacactgagacgcttcagatctgttcccagcccccaagtcatgcccgctggttccctctccagcacttaccttgctccagctgatgtcaggagtggggtagcctgaggctatgcaggggaagacagctgcagaaccagcaggcacacggacttcttggggcattgagatctggggcaaggctgagaggcatggaagagacataggccatcaacatgacagtcacagatatgtgcccagcctgcaccctgattcatttcatcttcacaccaccccttgaaggaagccactacattccatttcacagatgaggaaattatggctcagaggggaaaagcggctgtttgctcctggtcgggcagagtcagggttcagggccagatccatttcactccacagcctgagacctcttcaacatgcctgggcaaaaaattgtgcagccctttggggacctgagaagtgcacactaggggcagtataggtaaggaagtttggaggcaagtcacagggcttggggtaaaaaggaattgcctttaaagaacacacagtgtttgtgtctgccctgcatctgttgtccttgttttactctctattaggtctgtttgttgactgggttatgtctctgccctcagactatgctgcaggtctctcccagcagagcaggcactccctgcagatgaggacaaggtttcttttttcttcttgatgctctatggcctagctctctccctgtacattccaggctgccctgggggaatctcacttttatcccctgctgctgccacctgttatgaaacctgccccttaaacacacacaatggaaaatgtcccaagtgaacagaaaggaagagcagagcgggcaggcagaagatggcagcaggagaagcccctgccccactcactgtcccccaacaaaagtccccactggccttcaccttgcacaagcagcaggacgtgggattgtgtggtgccagctgcgttggtggcagtgcagcgatactgtcccgcatcagccagctctacgtgggcgatcctgacgacacctccgctctgcacaatgcctggccgcaggtgccctccaactttgctccatgtcacctgaggcttggggtcacccagtgccaggcattcgaactccacggcgtggccaaccaccacggtctgcacagaggtccggatgttgatgagcaccgagggcagggctggggaggagggaggcagaggtccagtgagatcagtcactgcaggcctggcccgagggaggccatagactgcccaaggaaaggtgagcactgaagctccagcattcattcactcctcattcactttttcatgcattcactcacaaacacactcacttgtcaggtcttatgcatttactcactcacgtgtccacttcttttttttttttagacaaagggtcttggttgtattcacaggtgtgatcacggctcaccacagcctagaattcatgcgctcaagcaatgctcccagcttagcctcctgagtaggtgggactacaggtgcgttccaccatgcccggttcacactgattcaatcttcatcggttcatctgagcactcacacactccatccatatccttcttccctcccttgaaatatgtatcaagccccttttactctatgctagacacaagcaaggcaaaatggaataattctctttattctgacacatttagggggattcctagggaacagggtctgggccttgtgcctctctgcctttctcatctctgttccctgctcttagcagaggcctgaagccaccctcctaccttggataaccagctgggcactggcctgggccttcccccaaggtccatgggcctggcatatatacgtcccttggcagctctggtccaagttctggattctataaagaaaaaataataagacatcagggagttgaaaacaactgatagaatgctttgcaattgggctgggcgtggtggctcacgcctgtaatcccagcactttgggaggctgaggcaggcgcatcacttgagatcaggagcttgagaccagcctggccaacatggtgaaaccctgtttctactaaacatacaaaaattagccaggcgtggtggcacacgcctgtaatcccagatacttgggagactgaggcacgagaaacgcttgaacccgggaggcggaggttgcagtaagccgagattgcgccactgcactccagcgtgggtgacagagtaagattccatctcaaaaaaaaaaaaaaaaaaaagaatgctttgcaattgtgtgggcattaaaaactgatgtagaacagcacgcagtgttgcattctagtttcccaataaccactagaggtaggcaggcaggttggggggcaccacactcattttagacaaagaccttatggtctagggctcaagattacacagttatcaagtagcagagctgagatctggggtcatttgtgtatttctggccccagggcctgttctctttcctccgctaataataaatatgaatgggccactgtttactgaaggccttccaagcaccaagcactgtgcaagtgcttcagacaatctcctttcagtcttttttctttttgagatggagttttgctcttgtcacccaggttggagtgcaatggtgcgatcttggctcactgcaacttccgcctcctgggttcaagtgattctcctgcctcagcctccagcgtagttgggattacaggtgcccaccaccacacccagttaattttttgtatttttagtagaggcagggtttcaccatgttggccaggctggtctcaaactcctgacctcaggtgatctgcccgcctcagcctcccaaagtgctgggattacaggcatgagccaccgtgcctggacctcattcagtcttatataacccactgtacagctgagaacactgaggctcagagaggtaaagtgatgtgtccaaggacagtgcttcatgttgcgccccctggggcaggtgctttaactctgctcactgtgagccctgggctatgctgcccaagtccagtcctgcccccggccccactcaccggagcaccccatcctgcacgctgtgacccggaggcagctgacccccttccttgaaccaacggagctgggtaccccggtcgctgggcacagcacagtggaactcaacgctggccccaatgctcttggtctctagctgaggcgtgacctgcacggtgggcgtggaccctgctgggatggaggtggcagggagagagccgggagggcctgcggggacatgtatgaggttctgcaggtatatgtgtgtgtgatgtccctgatgcccctccagggacccaggaaacccccagcccaacattcaaggaatgttctcctgatagcctctctgaccagggaaaaaagaccgttcagtggcagattcattcatctgcacacacagctgccattccaccaacatggataagggcctgtggagcgctgggctctgtttccacagctcctcgcttctgggtggggagggcaggccacgaaaagagtgggagggactcaatactttttttgagacggagtctcgctctgttcccaggctggagtgcagtggcacgatctcagctcactgcaacgtccacctcccgggttcaagcgattctcctgcctcagcctcccgagtagctgagactacaggtgcgccaccgtgcctggctaattttttttttttttttgtattttagtagagacggggtttcaccatgttgcccaggctggtctcaaactcctgagctcaggcaatctgcctgcctcggcctcccaaggtgctaggattacaggcgtgagccaccgcgcccggccatactcagacattttaaggaaggacagcaaagcctattctgcctgcagtttaaataagagaatccagggacttggccatggcaaagacacctacacatgcaggggacagatgggaggcgggggctgatgcatactgtccccatttactaagtgcctactgcgagccacagttttacatctgtgtttacctctgtgtacctttccaactcagcctacatggttggcattgttctctccactttacagataaagaaactgaggctcaggacgagtgcagtggctcacgccggtaatcccagcactttgggaggctgaggtgggtggatcacatgaggtcaggagttcgagaccagcctggccaacatggcgaatccccttctctactaaaaacacaaaaattagccaagcgtggtggcgcgtgcctgtagtgccagctactcgggaggctgaggcacgagaaaggcttgaactcgggagatggaggttgcagtgaaccgagatcatgccactgcactccagcctgggtgaaagagtgagattctgtctcaaaaaaaaaaaaaaaaaaaaaaagaaagaaactgaggctcaaaaaggttcagtgacttggccaaggttgcacagccagcaaatggccaagctgtgctttgaacccaggtctgagtccacagtccaggctcttgaccagtgggctacatgctgtgctgctttaagtttggggcccaaaagccctcatttgtatcattgatgcaggaggccatggaaatgctgggctctctgaagatccactgaagccctgggcgtgctggggtgggtgctcctgtcactcattcactgttgtccctgtcaagcatttacccagcccatcctgggccttgttgccctcaattaagcccagggctgctgagatgcctgggtccaggccctgccctgagcattctcactgcctggcaggggaggcaggctggggtgcttatgtacacagaatggtttcctttggcagtgccagggctgtgccaaaggtggggagcagccgtgagagctagaggagctgagcacacatgatggagggcttcctggaggtggcaagcctgcctcgggccctggagagtaggggagatgagggcattccaggtggggttatggagggaggccttcccacccgagtctgcctagctgggtcatcaaagggccaggaggaaaggtgatccccttccacgcagagccggggctgcttaccttggacgagcagctgggcaaaggcctcggctgagcccaccttgttggtgacccggcagcggtagcggcctgagtcctcaggggctgcacgctcaaagtgcagcagctcgttcctggcggtcgccctcccaggaaggctgctgcccacgcggctccactggaaggtgagtgggggtgtcccgtgagccaggcactggagctgcaccgtctcccctgcctgcaccgaagcgtgctctgggaccgtggtggcatatggtgggcctgagtggggggacacagaggtcaggattggggagggcaaaggtcagaatggcagcaggtcgttggatccagtgtccagggaagctgaatggtgagcccagaggactggggataaggaaagcaaaggtcccaggccagggtgtgggtgtcgggcagggcaggctccaggaccctgcagcgcctggagacctctggatggggttcctggggttctgtgtggggtggagcctagtcggggggctcagatctccatttggtgcagacaaagaagggatgaggccttactctccacgtgcaggatgatggtggcctcagcgtgcccagcagggctagtggcattgcagatgtactggcccgagtcctgctgggctacccggggtatgatgagtgtgtcaccttccagccggtgctgccagggcagtggggaacgcagcttggaccagtggatggtgggcgcggggctgcctgtggagtcgagtggaagatgacagaagtcactgggctacctcagggacccgcagagggtggccatggtgaggaagggccctgggtgatcctgtccctctatggggaccccagttgggttcctcggccatcactgggggatgctagcaacacggtctccccgtactccccacccctgggcatgacatcatctctagatcacatgtgtctacatttcagaccccagggcatccctgccctgccagccctatgtgccagcccttggtcacacctgtggctgagcagcgcaaggtggccgtgtgtccagcctccacagtcagctcagcttcttcagcttggacctgaggggcccctggggccatggcgcccgtgtccacgatcacctccacctgcttctgtgctgtgcctagtgcattctgagcaaggcacacataagtgcccgcatctgatggtttagctgatgaaatctgggagaaagcaaggaggctggttatgtggggactcagtggggacgctgatgtcagccccagctctggcttggtcttccctatttcctctaccctgccttggtatctatttatttacttatttatatatttattttttgagacagggtcttactctgtcgcacaggttggagtgcagtggcaccatctggctcattgcaacctctgcctcctgggctcaagcaatcctctcgcctcagcctcctgaatagctgggactacaggtatgtgccaccacactcagctaattttgtttgtttgtttgttttttgagggtcttgctctgtcacccaggctgcagtgctgtggcacgatctctgctcactgaaagctctacctcccaggttcacatcattctcctgcctcagcctcctgagtagctgggactataggcacccgccatcacgcctggctaatttttttgtatttttagtagagacggggtttcaccatgttagccaggatggtctcaatctcctgaccttgtgatccgcccgcctcagcctcccaaattgctaggattacaggtgtgagccactgcacccagcctaattttgtatttttagtagagacggggtttcaccatattggccagggtggtctcgaactcctgacctcaggtgatccacccactttggcctcccaggctggtctcaaactcttgggctcaagtgatcttcctgcctcagcctctccaagtgctgggattacaggcacgtgccaccatgcctggccctttccttggtttttagctgtcccatctggttgcttgagggctcaccctcatgacaccccattagtccatccatccacttggccttcgacccaccctcccactcattctttcttccttctcctaccttccttctctcttccctctcatcttccagtctattcgtcatccacccatcccatcccattcctcccttcctctctccatccactcatcaccacctgcccatccactactatctcctccaagcacccgctcaaggctgggccatggactgggcctcagacccagagaggcagccccggcttcacctgcagcaccgcgtggctgtccatgagcccatatgtccgctgctccaacttggcaggggtgctgctgatccgggtccaacgagcagaggagcggggctccccggcactgacacactccagggtgacagcctttcccactttcacccacacggggccctcggggagcacggacactgtagggggccctgtgcggaggaatgacaaccactgacacacaggcagggctctgctgctcacccacactgccatggcctccagcttagtaactgctgggtgggcacctgtctccccactgcactgaggtggaaactgaggctcagagagggagaatgcccaagacagagtcaatggtggaaggaggatttaaacttggaggctctgagctgagaatcagggctggaaacagggcagagccccacagggtcaacgtcccctcaccgtgcacactgaggttcaccacactctgggccacaccgtaggcattggaggccacgcagcggtaggtaccgtggttgctgggccgggtgcccacgatggtgatgatggagccattgggactgatgtggacgttgtctgtgaggttgcatgggggagggtgagagaggattgacctggtccttctcgtgtcttggtgctgccagcctgtgcccctgggcccacttccccaatccctccggcctgggtgtgtctagctcatggagtcgcagatagcagaaagtaacaaaggccttggaaactcctgggtccagcgctcttgccatacagagacgggaagggccttactcagggccacaccatgaatgtggggcgtccagacttctgccccacccttgcacagtggggatgacggcacccccatgcctgcccccagcttgcccacctgcccaccagcctggctcaccctccagctcctggttccgggtcttccactcgaggctgatgggggctgccccgtcatggatgaggcacttgaagctggcatcctggccctgctgcacggtgctgctgggcgggtcgatggagatgaccgggctcctaaggcctggggccaaaggggcagagggctgggctcagcaggggtgggcttagcttcagggccctcccttccccccttgcccatggcatctgccatactcacggtaggaagacccctcactgggcgggacggtgactgtgaaggaggcttcttgctcagggcctgggccgctggctgcacgacacacatactcgcctgagtcggcaggggagacgaggtggagccgcagctgggagccatgggtctgtcagagcagcgaggggacagttatcagggcaaagtccccaggacaaggaatgtccccaagcccaactgtgccggtacccaagagttctctcggaagctcagggtctcagctggtagggctggtggaagcttcattcacagaatcctagaggtccaacccactcactttacagtggaggaaactgaggcccaggaaaggattcagctgcagagccaagagaaaaacccaggtctcctgatttgcaggctggtgaactcgtcccgcaaacgtattttatcccctggggtccccaagcaggctggtgtttgcatgaggtttgggtacagaaagcaactgcaggtctaaccttgcctgacctggaatcctccccatcctggcccctgtacctggtgccgggcggggaggctgcccccgcgcttgtaccacgtgacctgggcatgggcctgcccgggcaccacacagttcagatccagagtctgcccttcagtcacgtgtgaagaggaggcctcgatgtagatgggctgggccagtcctggagctgtgggcacagggggtgggtgagagaggccaggctccggggatcaaggcaggggctgaaggtggtggcagtgaagaccagctccagttgatcctgggggcgcggtggcttgagagtggctgatataacctaagaagggtctcctttccctggggactcaagggtcctcctgaaactcagggctggggtccccctggttgaggggacgggaccattgtcagacttgggaacacctgggttggcttgatcctccgtggtaggaaaccccgcctgcaggcaacaataagtgcccggctgggagagaggagaggagcagagctgggaaggagccccgcgcctgtgctctggcatcgcccactgctccctatcactcaccaggaatgggtcctgggctggagggctcaattgtgaccaggacagatgcctccagggtgcctgagcttccggtcacttggcacgagtactcgccagagtcagccggggacacctggttcagcctcagcagtgggccgtggacctggccaaggtggggtgagagcggggagggtgagctgggagccttcagatgcccaggcctctggtacccacaccctgggactgccatgcacagatatgtaggcgcatcctgttggaggcgacccctttgacagtccgcattgtggagggcatgtttattatgatggtttctccggcaggaggaagtcaagagccttgagtaacaggtgtccttttcttttttttttgagacagtgtctcgctctgtcatccaggctggagtgcagtggtgcaatctcggctcaccgcaacctctgcctcctgggttcaagtgattctcctgcctcagcctcctgagtagctgggattacaggcatctgccaccatgcctggccaatttttgtgtttttcgtttcgccatgttggccgggctggctttgaactcctgacctcaagtgatccacctgcctcggcctcccaaagtgctgggattatagacatgagccactgcgcccagccagagatgtccttttctattttgcaccaaggtgctgtggggctggtggtggccctgctgtgcccagcccgctctcaacttcctgattccattgacctcctgctgccatttcccacaagccccagttgctgaggccactttcccttcaacgctggattcaggcaggaccactgcaggtgtggaggatgcatgcatccttctccagctcctttacctggtgccgggcagggaggtttcctccacgcttgtgccacgtgacctgggcgtgggcctgcccgggcaccacgcacttcagatccagggtctgcccttctgccactcgggaggaggagggctcgatgcggatgggtggggctccacctggggctggggcacaggggagaggtcagtgagctgagatgccaccctgatgccctcagcccttcccctggggcccagatactaggaccagaggccatttgggacatggcttctttcccttcccgttccattgaggcctggagcagctgggctagcctgggaggtggaggcacttctcattcccccagccccgcccccaggcaatggccccaccatctcctcctcctcccatgctcccagcaccagtggggccagggctgaggtctagacacttccacacagaccactagaccactaatgtttggcagactcagatagaatgtggctaagaacccagactctggggccagactgcctgggttcaaatcccagctctgccattgattagttgtatgacctttggaaaacaacttcacctctctgagtctcagtttccccatctgtaaaatggagagaacaatgccatctacctcaaagggctgttgtgaggataaaatgaactaatatgtgtaaatatgatagggtccaacacctaagaagtgctggatcatgtttactgcttagcaatctgtgtccccttatcatgatttctgcatagcatgtgccccctgtgctattaattactggacattttcctttcaactgattcactttaaaaaagccttaactacacactgggcgcggtggctcacgcctgtaatcccagcactttgggaggccgggctgggcggatcatgaggtcaggagttcgagaccagcctgaccaacatggtgaaaccccgtctctactaaaaatacaaaaattagctgggcgtggtggagcacacctgtaatcccagctactcaggaggctgaggcaggagaatcgcttgaaccccagaggtggagattgcagtgagccgaggtcatgccactgcactccagcctgggcgacagagcaagactccgtctcaaaacaaaacaaaacaaaaaaaaccttaactacttagccccattgtaagcaaagatttccaagaaataaggacaggcttgatgtgtttttttgtcccttatatgccaccagtactaataaagatgtttatttatttatttatttatttttggagacagagtctcactttgttgcccaggctggagtgcagtggtgcaatcttggctcactgcaacctctgcctcctgggttcaagtgattcttgtgcttcagcctctcgagtagttaggactaacggtaggcgccaccacacccaggtaattttttgtatttttagtagagatggggtttcaccatgttacccagactggtctcgaactcatgagctcaggcaatctgcccacctcggcctcccaaagtgctgggattcaggtgggagctaccacaccggctctaataaagatgtgtaaatcaccctccaatactcgcagaggtgcagtcccaggcttttgggaactctataattagatagtagagtacaagagtactactaccccttctttacagataagggacagtgacaggtggaaagctgaggtcccttgtgcaacatctccaagtgtggccagaggaactgggactcatgcacagatgagcatagtccaaagcctatgctcgcaagccgtggagagggacaggaaccactccacctgagccggctccttggtcctgggaccgtgtgggtggcgggaggtgaagtctggaatcagagcggcagttctcgccgagtgccagaaagtgtttccttctgccagttctgccccctggtctctgtcccttcctccctcccccggccttcccgtcccactgcagggaccctcaccggggacgtggacagcacttgagccagaggcttcgatggtgaccaggactgaggcctccagggggccagagctgcccatcacccggcacacgtattcacccgagtcggccggggacacatggtgcagccgcagccgtgagccgcgggtctgaataggggacaggacagaggaacagagtcaggtgccagtctggaactgttgaaggcctggggccagggtctaacctctgacacaggggggtactgcaccccacgggggctcctaggtctccctcttggcaaagctagccagggcccccacatccagcggctctcccaccatttcctgccagctgcatacctgatggtgactggggaggctgcccccacgcttgtgccaagtgacctgggcatgggcctgcccggggaccacgcagttcagatccagggtctccccttcggccacgtgtgaggaggatgactcaattctgatgggcatggagctgccaggggctgggggaacagagatcagtgagtcggcacagccgttgtcagatttgggaacagggttggtgggaccctctgccatagaaaatctcaccccccagagtaacactaatagttaacacttggccgggcatggtggctcatgcctgtaatcccagcactttgggaggctgaggtgggtggatgacctgaggtcaggagtttgagactagcctgaccaatatggtgaaatcctgtctctactaaaaatacaaaaattagccgggcacggtggcatgtgcctgtagtctcagctactcgggaagctgagacaggagaatcgcttgaacctggaaggcggaagttgcagtgagttgagatcgcgccactgcactccagcctgggtgacagagcgagactccctctcaaaaaaaaaaaaatgataataatagttaacacttataaagcacttctggcatgccaggcacgctctaagcacattacatgcactaactcacttaaccctcacaaaattcgtaaacttcctgtgatgatggaaatgctttttatctgcacaggccaagtcagtggctgcaagccacacgtggctattgagaatttgaaatgttagaaatggggtagccgtagccactgaacccacgcatctttccgctggcccttgcctgagtaccaccaggtctgaggactctgacctgaaagttccttctccccagggaacactgttgcctgcatccctcgtccctttcctaggcagactcaccggaggggctgccggcgctaggggagacggagatgacgatggaggcctccagggcatcgatgttgttgttggcccggcacacatactcgcccgagtcagccacagacatttggtgcaaccgcaggtgggagccatgggtctggacgtgcggatggggaaggagagggagagggagtggagggacgctggggtcaccagctggctcaggccttcctgctcagcctgttgaggctgctatcggtctacccagggcccaatccgtgagacagggagcctgctctgctcaccccaggagaccatggttccacccccgctgctgtggctccactctgtacctggtgtcgggagggaaggctgcccccacgcttgtaccatgtgatgatagcctggggctgcctggcgaccacgcagttcagatccaaggtctgcccttccaccaccgtgggggaagacgactcgatcctgatcggtggggagacgctgggcactggggacagacgggtgtggaccacgcagccagagtgagataacagtgatggcaccggggacctctctgccaccctctgcgccacttgtctgtaccccctgccctctctgctctcaccgtgggaggaaccgctgccctggatggtgacgatgagcgaggtctcccgggagcctgcaccgttactgacgtgacacacgtactcgcccgagtctgccggagtcacctgagggatccgcagccgggagcccacgatctgcaggaagcagatggcaggaggtatggcagtaggtgtgggcagctcctccacatcttgggcactgctgccgctgcccctggactctgggggcctccctgccttgcctcctcagtggccttcgtgaagctcccagcatggcatgtggcctgtctctgggctggggtggacgtctagccttttgtcacccctccagaaagcctgttaaggccctccggagtgttgacacagtatcctgctggggctcccacagcctgcgagctgcctgagagcaggcaactgtctcattccatctggaatcttcagtgtcaggcacaggacatggcccggagcagcttttcagtgagatttggtgcagaagtggatctccctgaggtcagggagccttatttctgtattctcagcactggtctaggacccatccagcaaggatactcaatgtttgttgaatgactgaatgagcacagagtgaggtgctgagagtcccccctcttcccattgggggctggtgtgccctgcttttgccctccccacctgctggccctgtacctggtgccggctgggtaagctgcctccacgcttataccaggtgatggtgtggggagcctggctggcaaccaggcagttgaggtccagggtgtgtccattggccagggaggctgaggaggactcgatgcggacggggtacgccacaccctgggctgggagggtgagatgtaaggcagggtgtgggagctgctgagggtgcagtcggggtcccccagccctccaccatttgcatgacccccgagacactcacagtgggagccactaaggcgctgctggatggtgacaaggactgaggcttcctgggtacctgagctgccgaccacacggcacacgtactcccctgaatcagctggggtcacctggagcaggcgtagcctcgagccatgcacctgggagggtcaggagggaggaggcaggctcagagctgggcactgcggctcacgccaagctcctgttcccttccctggtgccactcccagcccagccagctggaactcgatggaaactcttccagggaaaaccaccttctcccttcctatctaccgccccagtgtcaggactgggtctagcgtcccacctcacccatgccagggacgactgagacttggcaccagagaaaagtggggaccagtgtttgttgacatgctacaggggagatgaggtaggcagcatgagcccatttggcccctcactctgacccccaaggcctggccatcagctctggatcactgtccctgtccttcacatggggaagggggactcttgtccagcagcggggtggtagaccagaggagccccagtgagctgggtacacactcacaccacatcccatcaattctagacacacatttcagtgtctccaaaatcaagatgcatctacaatgaataaccttacaaatggaagctttttcttagaggtacataaaatcataggacactgagggtcagagaatcaagtgacaagtgactggcctaaagtcacacagcatgcaagtagcggaacagtgtctgaactcgaacatgcctgagttcaaagcctgtggttttttttttttgagacggagtcttgctctgtcgcccaggctggagtgcaacggcacgatctcggctcactgcaacctccgcctcctgggttcaggcgattctcctgcctcagcctcccgagtagctgggattacaggcgcgcaccaccacgcccggctaatttgtggattttcagtagagatggggtttcattatgttggtcaggctggtctcaaactcctgacctcgtgatcttcctgccttggcctcccaaagtgccgggattacaggcgtgagccactgcgcccggtcaagcctatgctcttgtactgcagctacagggtccttcaggcttcctgagctcctgcctcctacctggtgccgggccgggaggctgcccccgcgcttgtgccacgtgacctgggcatgggcctgaccagcaacgaggcagttcaggtccagggtctgcccctcggccacttgcgaagacgatgactcgatccggaccgtgggggtgaccccaagtgctggggacagagggcaaagggtcaatagccggctaggaggtgagatgagatggggctcctggtctcaaggcaggtgcagtctgcggcttggcctcctgatcctgccgttgcaagagtggggggcctcccaccctgggtccccagccctgccctccctgagagctactcaccaggcactgagcccgcaggctcaatggtgaccaggacagaggcctctagaggcacggagctgcccaacactcggcacacgtactcgcccgagtcggcgggggacgcttggtagagtctcagcagggagccgtgggtctggccagaatgggggtgagtcagagggagccctcaggagacccctgttcctataacctgcaaccctgcctcactctgacccccaaggcctggccatcagctctggatcagtttccctgtccttcacatggggaagggggactcttgtccagcagcggggtggtagaccagaggagccccagtgagctgggtacacactcacaccacatcccatcaattctagacacacatttcgatgtctccaaaatcaagatgcatctacaatgaataaccttacaaatagaagctttttcttagaggtacataaaatcatagcggatctcgcaatcagtggtatcctaaattctacaaaatatggtaacaacaatagctaatggcattatagtaaaatattaacagcttagagtactttctgtgagcctaagctctgaggattttgcatatattttaatctttaagataattctgtgaggtacttttttttttttttttgagactgagtctcgctctgttgcccaggctggagtgcaatggcgtgatcttggctcactgcagcctccgcctcctgggttcaagcgattctcctgcctcagcttcccgagtagctgggattacaggcgcctgccactatgcccggctaatttttatatttttaatagagatggggtttcaccatactggccaggctggtctcgaactcccgacctcaggcgattcgcccacctcggcctcccaaagtgctgggattacaggcgtaagccaccgtgcccggctggtacgtaccattgttaccattttataggccctgaaactatagcacagagaggttaagtaacttgtccgaggtcacaagctaagtggtggagccagaattcacacccaggttagtcagtcctagattctggtttctaaccactgcactatacatctgtgcaatggggtccagggcttcctgatctcaggggagcctctagccctcccccaataacctccgccacccagggacccgcttcctcttcttggcctgtctgtcctccagtcccatacctggtgccggacagggaggctgcccccacgcttgtgccacgtgacctgggcatgggactgcccgggcaccacgcagttcagatccagggtctgcccttccgccacttgcgaggaggagggctcgatgcggatgggctgggtgctgccggcagctgagggataagatggtcaccggtcactcctgttctctgaagccactccagcctgttctctgcatcccagcccagcctggtggccccactcacggtaggctaagttggccccctgggtcccagttactgtgaccgtgatggaggcctccatgccgttgctggcccggcagacgtactgtcccgcatcggcaggtgaggcctggaagatgtacaggcgggagccacgaacctgggcagccgtgggcagaggtgtgaggggggcttcccggaggccagcaaatgccccaccgctgtccccccgatctaggaagtgccagcccctcagcctaggggccaggatcctgcaacccactgtccatggccccgtcccacattcttggtgccctgtacctggtgccgggcagggaggctgcccccacgcttgtaccatgtgacctgggcgtgggcctgccctgccaccacgcagctcagatccagggtctggccctcggccactgtggaggatgaagactcgatcctgacaggtgggatgggtcctgcagcagtggggatgggagtgagagttgtagatgctcctgagatgagagggcaggggttgcccaccctgcagctagctcagcccagggtttcaaggccagatccagcttttcaggcatctgggggcctggacttgatgccctcagctcagcaaccctgatgggaggaccagggcatgggccacgccttgcagaggggagtgaggaagtgagagagatgagggcagagatgagttggagagaggaagaggaggtgggaggggacgcctgaggagtcatgtggccaaagcaaagtgtgacgggaaggcggtggttactctgacaggtggagtcggcctgggcagggccctgcagccagctccggtgtgggccttctgccctgtcagcaagaggggtcccttggatctcaccaccccggaggcctctctgcctcctccagctttccatgtcactgggagtcactcaccagggatgacagaggcttcgatggtgaccaggactgaggcctctagggggccggaggtgcccaccacatggcacacatactcgcctgagtcggccggggtcacctggtgcagccgcagcagcgagccgtgggtctgtgtgcaaatggggtgggttgggagggggctggaacagtcccatccagcccctccagcaaggtggtcccggggggctgccatacctggtgccgggcagggaggctgcccccacgcttgtgccacgtgacctgggcgtgggcctgcccgggcaccacgcagttcagatccagggtctgcccttccgccacgtgtgaggaggagggctcgatgcggatgggccgggtgctgccgggcactggacacagagcggctgctcagaggcctgaactcttgggctgtaacctgtagccctggggcagaaggctctgggctgtgaccaggccctagtggggacggccgacaggtggcctttctgggactagggccacacccttctgcctccacatggccagccgaatatggcttcttccctccccagcctctaaccacaagctggaggcccattgacccacccatgacttcttgatgatgagctcctctggcccatagggaaccagcaagctttactacccaggctgcgcccaaggatgcggatgacagtgagacacctcccttctacaggacgtcttccgtgtgctcacaagtactttccatagacactgtctcatttaaaccacaccatgactggccaggcgcggtggctcatgcctataatcccagcactttgggaggctgagacggtcggatcacgaggtcaggagatcgagaccatcctggctaacacggtgaaaccccgtctctactaaaaaaaatacaaaaaattagccggcctggtggcgggtgtgcctgtagtcctagctactcagaaggctgaggcaggagaatggtgtgaacccggaaggcggagcttgcagtgagccgagatcacgcgccactgcactccagcctgggtgacagagcgagactctctctcaaaaaaataaaataaaataaaataaaataaaataaaataaaataaaataataaaaaaaccacaccatgaccaagcaggtgggcagtactgctccatttcatagatgaatctgaggccccaaaagttaaaagctagttcaaggttgctaaggggcagatctgggatttgaaccaggtcagccgactcccagcttagtattcaacctggacattctgctgcttcctgacaaattctgaaacagtcactcatagggagcccaggtaagctggaccagccttaacctccctcccgtccactcaacctccttctctctctgagcaggcgctgaagggtcaaagcctgcctggaatgcccccctgtcctggtcccactgaagaagccacaggcatcttccttgggagctcctagggctcagccccggcccagccacacctggctcctcacctggggtgtagctggggccagaatgggtgccgtggagcacagacacagtaatggaggcctccttggggcccgatccattctccacacggcacacatattctccagaatcagctggtgagacctgggggagccgcagacgggagccgtgcacctgggccaggaggagccagaggtacgtgaggacagggacgggggctattgtcaccactccctcagcctcagtgattcattcaaactctcactggctctgctccgagccatcccatgctagaaactgggagggagggagatgaggcctggcttctgctggtggaacgtgtggggcagtgtgccgcctcccccgcccagcgtacaggccccgcctccgccacagcccctgcaccctgggtcccctgccataggctcagggcccacatacctgggtgtggggaggcaggctaccccctcgcctgtaccaggtgacctgggcatgggctgaccctgccaccacacagttgaggtcgagtgtttgcccttctgtcacagaaggcgatgaggactcaatcttgaccggcggtgggctggcatctgaggctggggccagagtaggggtcagcaggccccaggggagccctggcttgccctccccacccctccattcccagagagtccgtacctgaaaggacaaccacttggatccgggcctgggcagtgcctgcagggctggtggccacgcagaggtagaagccggcgtcagcagtcgtgatggctgggatgagcagtgtcgcgatgtctgtgcgctctgaccgggcctgccgtgggtgagatgggtcagctgccccagaggcagctggacaacggctggccagggggacagatagggcataaaagggagaggcaggtgcagggccaatattagggcccagtggggcatgaaggaggacaaacgccaggcagccaagaggacggcaggggctccctgctgggatgcaggggcaggagaccaccatcttggaggtgaagggagccacagaggaggaggtggggtggggcgtgaagggggagggaaggtggctgggactctctgcagagcctgtgggcctcctcctcctgggtgggcccatctcctcacctgtggtgggaggctgcccccttccttcctccaggtgatggtggcgctaggcacgcctgcagccctgcagtacagcctgacggtgcggcctgcgtggacctgggtcctctctgggctcacttggactctgggcccaccgccccctgcagacagagtcctgtgagaacacgccctgggctgagcacactcccggcccccaccctgagcccggcctctcaccatgcacgtggagcacagccctggccacctgctgcccagcgctgctgtgggctcggcacaagtactgggcctgatccgtgggctcgacagctggcaggcgcaggatgccgccgtggatttgtgccttcgcagggagctggccgccggggccccctgacgagtagacgtggggtcagcacccaccaagcctgctcagagtcctgcccctcccctcccacacccaggagagtcaggccttgaatgtcattcccatcacggcctcacctgtccactcgagggtgggcgtggggctccctgtggcgctgcagcggaactccgccagttgcccgggctgcactgtgagctgtggcggatggatggagaccacgggggcggacaaggtgcccgaggctgacaagggaggaaaaggaacatgcactcagggtggggagtgtcgtctgactcacacaacagtcctgctgcctactttctctgcttccaggctagccctccacggccatctgtgcacacaggagccagagggagcttgggaaatgtcaacaggaccttgtgacctcccaccttgagacctgtccatgactccctgttgcttttagaataaaatccaaaattcctaccctgatccaccacatactccatgctctcccgtctgcccacacccgtcctccctcccacagccccagccacgtggtctctgctgttcctcaaacatagcaacgtgctcctgcctcagggccttgccatgtgctgctccctctgccaagaacactctgccaactctctaacttgctcaatgcctacctttccttcaggtctcagcttaggtgtcacctcctcagagaggccctccctgactgccctatctagagtagcccttgcctctcccaccttgttttattttatttatttttctgagatggattcttgctctgtcacccaggctggagtgcagtggcgcgatctcggctcactgcaacctaagcctcccgggttcaagcgattctcctgcctcagcctcctgagtagctgggattataggcacctgccaccacacccagctagtttttgtatttttagtagagacagggtttcacctgttggccaggctggtctggaactcctgacctcaagtgatccacctgcctcagcctcccaaagtgctgggcttacaggtgtgagccaccgctcctggccttctcccaccttgtttcttgctttctcatcattcctagcctggcactcatcgccatgtgtagttatcttgcttgttcatttattcccatgcttatggtctccctgcctaggacgtgtacttcaggaggaccgagatactgtacatgcttctctcccctgcttctgcagagcctagaccaggaccaggcatgcagcaggtgctcagaaatgatcagcagaatgaagaaatgctgtgctaattctggtgggaatgggggagagacaggaggggagaatcaggtatagatgggaggtgtaccctgcacatgtagagtggctgtgccctggtccatggcaaacatgttggagccggtgcacacgtaggtgcctgcatcactcagctggacgttgcgaatggtcaggatgccattgaaatccatggctcgggtgggcagtttcccgttgtgcaggcgggtccacaccagggtataggctggggactgcagggcaaggcgaaagggggtcatgggtggggctcagagaccccagaagacagacttcctccatccccactccctgacctgcacaccttgcttttggctgtgcagatgaaggtgacgtcagctccggggcgcacgctctggctccgctgctcctccacagtcactgtgatgggcttgcttggagcctctgcagggacgggaagcccccctgtgagccggtgctggctaggccccggtcctgtggccactttgtctttctccataacctctaggcatcacttccttcctggtccagcctagctctcattctaccccctggcacctccctcccccattctggctgaaccccaccatccccaccctccttgccagcacagagtggccacaggatgtggttggggaacatcacaccatgggtccacttggctccagttcctgatcacagaccacaatgagctcctgacacatcacaccccactccaactgggtttctccgtctggtttgagtttctatcccccaaaaacaactatttcacacctcctcccatctcctccagcctctccaaccacccttccactttcttagctagtggcgctgacacacacttatggagaaaatagaaacgacaagtcaggagttttcccagcctctcaaatctaccagctctctagatactggtccctgaaggacaggccccttctcctgccctcaccccatcccactgctgcgcctgagtgccacccctccccggggcttcttctgctctcgcaacatcagcgtctcctccttctcatgcgatcacttcggtccagagtgcattctaggatttcccatttccgaaaactcccccttgacctcatgctctcgcagtcaatgacccacttcctggcctcccttcagagccaagactcttgcaggagttgtccacactcgctgccttcccacccatgtgtcgcctccttccaatctggtttctatcccttctctccactgaaaaccgctcttgtcaaagcatgacctccaagggctatttctctgcccttatgtgacttcccagcagggaggctgccctgaaagcccttttccctctgattcccatgatgccccctgtctcttcctgcctcatggctgcactctctcaggctcttcctgcccttcctcttccatttgacatgttcacactggagctcctcaggactctgggctggggccctgtcctcgggccacactctccctaggtgacttcatcctgtcccatagctttgaacaccatccctgtgccaacagcaaccatactcatttctctggctggggcctcttactggagttcagactcacatacccaaatgcctgcctggtggactcaatgagatatcttcccaaacatctcagactctaacacgtccaaaacaaacttgcgattctctctgacctgtttgtagcctgtgctgctggtggcctagccacgcttcccaccccccgtgcccacctgcctgacttctgccagccactgcacttctttgcattgagggctttctcaggccactggagcccacagtgcacacccatgggtgggacagatgtgcaggggacttgatgctcccagaataggtctcagtcaatgactgacagaagctggcctagacatactgcagctccttggaccccagggcagggtgactttgaggtgcgtgttttacaccggctccctttaaaagcttcctcggttgtactaagcaacaactgctcacggtggcaatctgcttggtgacacagcctttatggacgccctcccatccctgtctcacttttccctggacgacagggcagggtgactctgaggtgcattattattattatttttttaagacagagtcttgctctgttgcccaggctggagtgcagtggcgcaatcttggctcactgcaacctccacctcccgggttcaagcaattctcctgcctcagttctcccgagtagctgggattataggtgtgtaccaccatgcccagctaattttttcatttgtactagagacagggttttacgacgttggccaggctggtctcgaactcctgacctcatgatctgcccaccttggcctcccaaagtgttgggattatagacgtgacccaccgtgcccggcccacccttttcttttgccctcaccgaccagtcaagtcctgctgatcctacctctaaaatgagtcttgaatctgccacctctcctcatctccatggctgctgaccttgttcgggcaaccactgccccctcccagcaggtgaatgcaccatctgcctgaatctgcagcctgcagcccagcccaggacaggcagtcttggttacagggggcgtagggactcaccagtgaccagcagctctgcccggctggtattggattggtggagattacggcaggtgcaaatgtagaccccagcatccgagggctggacgctggggaagtggagctcggagcctggtggggaggagacaagagcttgttggtgcagatacactctttctcacatccagccccatgcacaaggacagcatcccactagggcagggacaggcccctgcctcccctcccactgggatggctcttggggctgaggagcctagggccatgggtaccttgatgtcgctgctgggtgccgctgggcacaggccgcccatcctcacgggaccaatagaagtagtggggtgggctcccactgacctgacaccgcagggagtgggagccaccttggggcactatgcttcgagcaggatggacctcgaccaccagtggggcttggtttgctgggggtgggggccgggacaggaagggcctttcagcattgtcttcaatatctctgctctcccaaaagctggggtaccccaccctcagccctgtccccagacccagtatcccccaaattcccagggctccctgccttgcccatcgtccccatcctgggccatggtcccacttactctctggcaggcactggcccccttgcacactggggttacccacgtaacctgggccacacctgtaagggggaacaagggccggcaatgtcaggcctcaagggccccagtgcctcatggtggacttggggagccagaagctcagcaggccacccaatgtcaggtgaggaggctcggagctctggaagcactttggggaccagacaggccccaacgcagggtgctggtgaactgagaaaggggagtgtaagggagtgttagcaggttgggtgatgagagaggtaaggtctctattctccagagaaattcattcagcaaacgtccatttttttttttgagacagattctcgctctgtcacccaggctcgagtgcagtggtgcgatctcggctcactgcaaactccgtctccggggttcacaccattctcctgcctcagcctcccaattagctgggactgcaggggtgcgccaccacacccagctaattttttgtatttttagtagaggcaggatgtgctagccaggatggtctcgatctcctgacctcatgatccgcccacctcagcctcccaaagtgctgggattataggcatgagccaccacgcctggccagcaaatgtccattaagcaatgactgaatgccaggcatgtgctataggtgttggaaatacaacaatgaatgtgataaagtccctggtctgtgggacttactagttgggaacccaacatggaaattctacatgaaaatgagagtgcaggaagcatatcagggctgtgcgggtgcagaggagggcactggcccagcctggagagccagggaggcttccaagaggatgggacttctcgtattacctcagagcaggctgtacttttctttcagataacttaacatggtttgtaaatacacatttgcacaattactttttccctgtcttatctcccattagggctgatctcttattaggtggcagactccgtaagggctggggtggaatctgttctgttcactccattatctccaacacctcagcacacagcatggtacacaggagctgcttgataaaaatttgctgaatgagtgaatgaagctgggtctgaaggctaaggggaagttagccaggaacgggtggtttaggggtgaagactgttccatgcagagggaacagcataagcaaggcctgaacatcaagaattcaaaaagtggctgggcatggtggctcacgcctgtaatgccagcactgaggcaggaggactgcttgagcccaggagtttaagaccagcctgggcaacacagtgagaccctgtctcagtttaaaaaaaaaaaaagaaagaaaaagcatttaaaaagttaagcccagctaaagtacagagttgggtgtcagaagtgggatgagactgctacagtaaagctgcctaaggagggtgggcttgtcccaagagcaatgaggtgtcttagaagtgtttgaggcagggaaggagcataatcctagaagagacttttctgagcaacaccctttaaggctctcacttgggagtccaccatttgtcctccaccctccccctacttctgtttacaaacttactgctcacagtactggccagtgtagccgggttcgcaggccgtgcagcggtacccgccggctcccaggctctcacaggtgcgggaaaacctgggatcggggaggcaaaggtcaggtcatgggaagcccaatctccatcttgctcccttcacttctgccccaaaagccagtgcaacgccttccactcattccccagtggaagtgtgtccttgggccttgagctagggtacccacatgttctctgggttggtcagtgggcaggcacagggctggcagtcctcaggcgtcccggctgtggcatctccgtagtagccaggggcacaaagctcgcagaactcccctgcggcgttgtgctggcattgctgcagggcacaaggagggcaggcaccagccattaggccaaatttaccagaagcctttcagggttgcaatcccttgatctagaaattccaagtttgtgaactcatcttaaagaaagaatcatggaagggcacaaagatttcattacaaggacactcatctccgtggtgtttataaaaagcaaaatgggctgggcacagtgactcatgcctgtaatcccagcactctgggaggccgaggcgggtggatcacctgaggtcaggagttcaaggccaactggctgacacggtgaaaccccatctctactaacaaatacaaaaattagctgggtatggtggtgtgcgtctgtagtcccagctactcaggaggctgaggcaggagagttgcttgaatccaggaggtggaggttggagtgagccgagattgcaccactgcactccagcctgggcaacagagcgagactccatctcaaaaaaaaaaaaaagaaaaaagcaaaaaaagctagaaacaaacctaaacatccatgaatagggaattggataaattaaaaagtacatccatccaaatagctgtcaaaaagggtgatgctaattctattttctccctaagtacctgtgatagcaaaggaaaggtatacactcaggtatttgggggcagagcattaaaaatgtgtattgtcagccgggcacagtggctcacgcctgtaatctcaggacgtgggtggatcacctgagatcaggagttagagaccagcctgccaacatggtgaaatcccatctctactaaaaatacaaaaattcgccaggcatggtggcaggtgcctgtaatcccagctactccagaggctgaggcaggagaatggcgtgaacccaggaggcggagcttgcagtgagccgagattgtgccattgcactccagcctgggtgacaaaagcgagactccatctcaaaaaaaaaaaaaaaaaaaaaaaaaaaagaggctgggtgtggtggctcacacctgtaatcccagcactttgggaggccaaggcgggtggatcacaaggtcaggagatcgagaccatcctggctgacacaggtgaaaccccgcctctactaaaaacacaaaaaattagccgggtgtggtagcgggcgcctgtagtcccagctactcgggaggctgaggcaggagaatggcgtgaacccaggaggtggagcttgcagtgagcccagatggcgccactgcactccagcctgggtgacggagcgagactgtcttgaaaaaaaaaagaaaaagaaaagaaaaagaaaatacgtgcatcctcataaaaacatgtgggttacagattctcctccaaagagattcacgtttgtggtatcaacaatagggtgttccttgctccaagtttaggttatggctgtcaaccacctgccccttcactgcgtaccctggggggctatatacatgctactctgaaaagtcaaggtataaaaaatatatgtaatgaggccaggcacagtggctcatgtctgtagtcccagctactcgggaggctgaggcatgagattcacttgaacccaggaggcagaacgagactgagaccctgtctcaaaaaaaaaaaaaaagtaaaaaggccaggtgtggtggctcacgcctgtaatcccagcactctgggaggccgaggcgggtgggttgcttgagctcaggagtttaagaccttctgagcaacaaagtgagaccccatctgtattagataaaaaaaatttttttaagaaaaagaaaaaaatagtaaagaaccaaagttttctttacacagaaggatgttattccatagctctggccaccccaccatccccggtgacctggcctgctgacccaggtgctttgaaccacaggccatgccccatgatcctgatcccctggattgatgcctgccttgtccagccctggtcccccacccaggcccagctgagctgaccccctgtcctggcctcgcttgcagctcaccgagcaggccccagtctctgggtggcacaggtctgagtggccattgcattcacatagctcgcagtggccgaggtagagcccactcccggtgcgcgtgtagccgggggcacagtcctaggggcagagaggaaggttggcctctgttcccaacgtgccccacccacagccagcagacccagaacccctccctccagtgtcctcccaggggtgaccctggaacatcacaggccggcgcccctccttccccacttctgctcagtctgtcctcccacccacggccctctcccagtccacactgttcacctctgggaggcatctctatgctgtgctttgggccggagtaatctgtgtttctgaattggctccctgtctctggtgggccccctcaagggcatgaactgggttttaacccccggagagtgtggcccaaacgtgaggctgcactgcccagtggttaggacatgctaggctttggagtcaatcagacccaggttcaaattagtttctgccacacattagccgtgtgcccttgggacacactcacccctcagcacctctatttttttacctgttaaaggggataatgatatgtaactcagggctgtcgggaggaatacatgcagggcccagatgcaggggtcattatagttatgatggtaatcaaggctgcggcgacgccggctgatttgcttgctgatgcctctgtgcctgtgcagaggtggtggagctggccacacactcacctggcaggacagaccgatgtagcctggcgggcagcggcactcctccacctcgagggcgcggggtctgtttgagggccccggctgggcgacctccaggctgactgcgctgatgctggccgccagcggcacggaggagaacgtggcccggatcaggagctcatccaggtcggccagtgccatcaggaggtgctcgcgtgtggccggctgcccatcgggccggcgccagaattcctgggttgggggtggcaacgtgggcgggggcagtgggctttgtgggctgctcctacagttaccaccccccaaatcctgccttacaggcactgactgagggctgccaggtgaaggttggggagcgagagacagggtgggtatcaaagccaggctctgagtcagggtggagggtggggtggggttagacacagcatggccaggtgccccttacctctcggaacatgatctcgtagctcctcctctcagggccctgcagcgctggctgggaggccactagcatgatgttgttgccctggaaagacaccagcaggattggaaggggagccgaggggtccctggggtgccagggtgtcctccaccagtcctagattctctgtaacccccagcctcccacctctctgctctcccaagctcatgcgcccaaaggagtcaggcacatgcccactgcccccttctcccagcagcaggatcctctgcttgggtagtgtccaaccaggcagggatgtgggggcatgggcctaactcccccagcctgtgccagaaaactgagtgctggatggaaaggacaaaggacaaatgccgagggtgcccctggcttccatcctgcccttctgcccacccagcatggtgtccaaatgctcaccgtgatctgcacatcggggtcagagagtgggctgccctgtgggcctgctgtgtaggagagggtgtatcgcaacttcccaccgtaggccgccacctgcaaagaggcaagcccagaggtcacaggctgaccttggggtgtgagtgttggaccatataggtgagggatggagcatctggcggcctttttgcacctgtgccacactcccccacccccctccctgcccaaaccaagaggccagggtgcatggttgcctgggaaacaggacatttctcagttcctctgtagccccagacatggtggtgatgatgctgagcagcctctttgctctgcaaggttctctattccccattgcctgacggtgccggcgaacaaactccaggtctgctttcatttacaggaatttcccataaggcagacaagtgtaatgacaatgaccaccatggggaggctgcggaagcttcaaaagttctcagccatgggggtggggctgacggcagcccctcggaggccttgcctcctaggcaggtggtttttgtttgcccagtatccagttcctgctttctagaaactaaaccgtggttttctataaagaacaactgtctccgcacatgcagaccatgtggtctgagggccctgatcccctcctcctctatagtggagacatgagccaggcctggccaatctgcataacctaccactgccctttgccaccccatcagggatagacaagtaacccgtgcacttatgctctttctaccaggccagagaaagtcccttctgcagtcagatgagaagctggagaaccaagataaagccctaatgagcccctggataaggccatgcctgacaccatacatgcttagactctgcagttgcatgagccgatagattctttgttgcagacaagcccactggacttgggcactgtgttgctcatgactggggagtccttacttctgctgcagaggaccttcacgtggacagctgaggctccccagctctgtcccacaggactttgctttctctcctctgccaccagggcagacattcatctcaataccaaactgcatcaagcctacctctttgttcatttgtgtgttcactcagctaaccagcatttatcaaacacctgctgattacacacacggccctgggctacatggctacagggatattctccatgagctcaaggcatggtaaggaattttggagtggaaccaaataaccataaaataactggtttcctgcttgctttgaatgccagaaagttcacagccatttctgggactgactttctggcaagttgcaggtgtgtacagcacagtgatttttaaaaattttttattttttttttcaccttttttttttaaatagagatggggtcgccctatgttgctcaggcacttttttttttttttaaatagagatggggtctccctatgttgctcaggctggtctcaaactcctggactcaagcgattgtcctgcctcagcctcccaaaatgctgggattacaggaatgagccaccatgcccggccgatttatttttttagagacagcatttcgctatgttgcttaagctggtctcaactcctggcctgaagcgatttttcagcctcagtctcccaaagtgctgggattataggtgtgagccattgtacccagatccagcatagtgattaaaacggcagactccacagtctgaatgacctgggttcaaactctagctctactggctatacagccttggacaagtcgcttcacctctctgagccctactttcctcacatggaaatggaagtaaaagtaatacccactttgaagggtatcatgaggattaagtaatataggacacaaatggtgatgtactccacacagtttgagaatgcatatcacgcttgataaccctgcagtactccagctccaccctcggctccagcagattgcttcttatcctcacccctcaacctccctgtctcacttctctgaatgtaccttgtgactgcctattcttttttttgtttgttttttgagatggagtttcactcttgttgcccagctggagtacagtgctgcaatctcagctcactgtaatctctgcctcccgggttcaagtgattctcccccttcagcctcccaagcagtaggattacaggtgcctgccaacacacccggctagtttttgtatttttagtagagacagggtttccccatgttggccaggctggtctcaaactcctgtcctcaggtgttctgcctgccccagtctcccaaagtgctgcgattataggcatgagccaccgcacccagccaggaagctgaattttttttttttctttgagatggagtcttgctctgttgcccaggctggagtgaagtggcatgatctaggctcactgcaacctccgcctcccaggttcaagcaattctacagcctcagtctcctaagtagctgagattacaggcacccgccaccacgcccagctaatttttgttattttagtagagacagggtttcaccatgttggccaggctggtctcgaactcctgacctcaggtgttcgcctgccccagtctcccaaagtgttgggattacaggtgtgagccaccacgcccagcctgctatgtgtattcttaagaggtacttgaaattgttggaacaaaatagaggcaatatgaatactcatctaaggccaatgccagcactcatgatgataataataatgatactgatggtgacaggaatgataatgggatggacagggagctctgggaggccagggcccactcggcctgtacacgacgcagcacacagtaaataattaatgcttcttgaatgactgagtgaagtaccaaaaactaggccagcatctagacacaaggtcaaggaagcccagagaaaaggcactagagaaaccctcccaggcgagacagctcctctgacaggggtcaggggccaggggtcaggggtcagggcccgctgaaggacaggggcagagctgagttcagtctcagctgtgctctgacctgaacatgagaccccaggcaagtctctacccaccgtgagcctcggtctccccatttgtgtcataaagggccttgacaaagggccctctgatattttgggattctatgacacccctataatccccccaaatccttgttaccttgtcccccaggaaggcccggggcagctgccagtaatagaggcttccaggaagcagagagaagccttcgtaggagagagagaactaggagggaagggcaggtggtaagagccgaggggagcaggggtgggggtgggagggcggaggtggttccggcaggggtggaccgtcatgggagggaggcctggtggcagggcagagagacagagccccccactcccacccgacagtgcgggtcctggccttgctctttggacgactttcttcccaatcccggcccaggtccccagctgctctctctgggcgtggcctgggtcggcttctcctcccatctggtgggtctcttttgtggaccaacgtttacacagcacatcagtaaacaatttcaatgggatggctcctttcatatgtatttgaaagagagtaaccagcctgagttggtacatgattgatttaagagaaaattggaaagaaataatagtccaagtagttcacagaaattggtgaagttggttcagaaatgactgaagtctagaaagcatggtgggtggggatcccttgatgggcaccttggcacatacctgagagcctggtgagaaagacagagaagctgaggaagaggaggaggaggaggaagaagaaggaggaggtgctgctcgcagagcagctgcaggctggggatgaggagagagcccctggggagggggttggggttgggcagcaaagctggacaggagctgccagatctcagcatccatccgtctctgagcctcgtccacctgggggaccaggagccgaagagcggcagaagggagcagagagggacagaaaggacgtccgtgaggcttcacctccccacgggcccagccagccacccgctctgcactgtctgctcacaagtgctgatacctggcactctggcccttgtacccactgccctcttgttcctcctgagctaggcggggatatcccgggatgggtttggctgcctatgggccgtgactgatgggagaagccctacaaagggtgcccagcaagggaggggcagaagtgctggaggcagccccaggggcatctggacggggttgttgctcctcggcctgactctctttgtgtgccctggcaacagcccaagccattcatggttctggaatgtttcccaggggagacaccagagcagaccaggcatcaggctggggcctggcctggcataggggaaatggcccaggaaagctggagtcttcgctcaggtgcctgcctggactcagctctctggtctcctcgctgtggccctaggtacaacctgtcctagccaggtcctcagttacctgtgatgcccgctgtgcccagtccctgccctctgggggctctgggatcctcccagctgtcacggctgcccgcaactgctcctctgagagggatgtgcggttctgatgaaatggagggagcaggcgagctaagacctcccaaagtcctggagctagagccatgggcagggtcctctacccacggacatggtagtcagaaaggcccacactaattaggaagaaagatgcatgccccccctctccaggctggcacccaagggttaactccaggccgcccacatgcacacagagggttcatggtggttgcttgagaggcaaggccaggggaacccggggggctagatacagtcatgtggattagcatcgggttagtctccttgctacctcagttgccattctgacttcagacagttggcaccaggaccagaccacacagcaggtgaggcaaggtgaggcacataccctcctggctccaaccctggggtcatgggacaccgcctggattcatgcagacccccaatgccttgggcactgcgcatctccccacgcagggctgggagcacccgagaaggcaccacgccccaccacaccaacttcacaccacgcacgtcctgggcctacctggtgagcccggcgcatccgcgcaaagtacgcctccccctgtggggcgcagggaaatgccaggacaggagacagagataggtctgagaattgcaggacagggcagcagggaggccaggagatagcgaaccccagaagggagaggggagaagggaccagaaggcagccagccccgggagaagcctggagtacctggctgtgtccaacgaacagggatagggcaaccccaaccccagagcgtgggtgccaccggatgcccgtgctgctcaagaacacatttgggcaggttgtcccagagcccacccctgagcccctgccccccacaacaccatcacaccatcgccaccaccatcatcaccacctttccaccagaccctgttctggagtagcaaagacaggttcacctctgactggcagagtatttgtttttttttttttttttttgagacagggtcttactctgtcacccaggctggagtgcaatggtgcaattatggctcactgcaacctccccatcctgggtaccagcgatcctcccacctcagcctccctaaatagctgggactacaggcatgcaccaacacgcccagctaattttttgtactttttgtagagacggggtttcgtcacattgcccaggctggtctcaaactcctgagctcaagtggtcctcccgcctcagccttccaaagtgctggaattacaggtgtgggctctggcctttggcagagcatttgaagggcagcctctgacctgggtttggatcccggcattcccacctcccagctgcggggctttgggtaagttaccaagcccctcttgccttatttatgaaatggggcagtagcaggacctgtctcacacagttgtgatttgtgatttgtaaaggatgctgcctagcacatagtgagagctcaacacacatgacctatcatgagaattactgtgtccaacacaagcacagagccagcagtgtggatgagtgaagtcggagcgggcacgtgaatgacactgaaactgtgtctcacttgtctttatatttcccggcctctcccagatctgtttgtagaataactgcatgaaagctaaaagtcatgaacagctgagcacttattatgtgccaggcacgatctccaatcccctcagccaccatgaagttgaggtttatcaaatggtgtctggctggcaagcggcagagctggggttcagaccaatgtctatgggactgcaaaagccacgtgcctaaccacgatatggccatgcaggtggcaggtgcctgcctgctgagagacggcgcagaggtgaactcatgtctgagtcacggctgaccctggtgcttggctggggcccaccttgtctccctggtatgtctccggcagctgccagtagaaggactcatggccgagttgggcaaagttgccaaaagagagctgggcaccctcgggcacgggttccacagtgaattctcctgtcaggcggctgtttcgctgtgggttcaccagggcaaagccttggaagtccccaggggcaaagtgggtggagatctggcaggggaaaaaggagggggcgtcagcctgagcaccggggtgccttggtgggggatggggcacgggagggtgttaaggtgcggaatggggtcctgttgagatcaggactgcgagagaaataatgggggcatgtgagggtactgaggcggggatgagggtcgctgggctcagtgctcagatggacagtaacaggcagcaggtggcaacaccgcctggggctgggcagcacaggctctcaccaggtggcgtgtgtaggcagagctggcgcactgctgggtgatgcccatacagaagcagggcaggcagccgtctgggttgctggcactcaggtggaagtggtggggccggcagtggctgcaagtgaggccttccacctgggcctgggtagacggatggaaggaggcaggcaggggactcagtgggtctcctgcacccccagcagcctgaggccagcctccctggccacttccagcagccccgggcagcccctgccctgtcccccatgccctgccccccatgcccaggtctcggcttccaccagatgctgcctgatttccccgcagggtctgggcagcggggcagagcaggccccgcagggacagggattcggactgaccttgcactggcactgaccagcagcatcacactggctgctgacgctgccttgggggtcacagttgcagcctatgggccctggcacctggctgtctcctgaggtggaagaaagccatggctggagccccaaacccgccacccagcacccctcttccctccactctgctcaccactgagcgggagctctgatttctgatgtgagtactcaacactctcacgacagccctcggaggtggtggggccttctcctatccccattttacagatgaagaaacaggctcggacaggcaaagccaaaggggagtaaaggcttctgtcctagctccgccctagggactctgggtaacccgaccccaatgacctccccaatcctactcactctggcatggctggccctggctggggttgccatagtagccaggggcgcacctgcagagagaaaaagcctctgatgaattttggatgaagggaagcagaaccccagggctgggctgagggccccatattgaattcaatggcctcatgcactggaagaaaagaagagcctgactcgcccatgttacggggaaactgggcagagaagagcagggacgtgccctggaccgcacagccagtgaattggggcaggtaggaacccaggagtttcagaaagaagcaggggttttgtgggaagactctggcctggctggggcagggggccagggggctgaaggtgaaccgcaggctaggatgtgtgtctgagggtcttgaattctgggctagaggttgagtctcccgaggaggggagctgactgtcttctggggcctgtgcgaggttaagagcgagaggcatccctgattcctctgggttgggagcgctgggccctgcctgaggattccagggacaccccctgtgcgcatccccccaccctctccaccccctgcctcacctctcacagtgacgcccactgtggcctggggagcacgcatcacaggtggggtggccgtctgtgtccagaaaacaagtgtgggcagccctgagtgtgggggcagatttctagtcaggaacgcagtggctccttcctctcccccgatcctccttcaggaccaggggagaggggaggggaagaacaggcatgtgaactcatgtgtcctcagtgccactgcatgcctggcactgtgctaagagttccacatgcatagcctcattcaactctcacacaaggggctgaggagggtggactaccccatttcacagatgaggcagctgaggccctgaaagtgaagtgtatctcacaccaagtgacactgagcaggcagtaaggccaggatttaaccactgcctctcagaagggccctggatgaagcgggtgtgggagcgggtggtagacatttcagggaagggcaggtgcaggcagggactggacgcactggccggcagcagggtctccgtagcaggggcacagctggcagtcctgtggtgtcccccgctgggcgtccccgtagtatcctggctggcactgctcacaccgagggccctccgtgtgatgctggcagccctggaggagcaggatgtgagttgaggctgggcctccagaggccacagattgctggggtgggcggaaggagggcgggacttacctggcaggcacctgtttctggctcgcaggcctctgagtggccatggcagctgcagcgttcacaggtacccaggtagaggccactgggcgtgcgtgtgtagcctgtgtcacagtcctgggggcagaaagatggcagtgggagggacttccgaacacggcccattcaggtaggggcactggatggccagggctggggaggtgtggagggctcatggagaaggagcgggaagcaccatggagggggctggctgggctggcgtggggcccaggactcacctggcaggacggcccacggtacccgggtgggcaggagcactgttccacttccagcgcggggtcctggccggtttcctcgggcacagccacgtccatgctgatgccagagaccctgggcgtgacaagacccagcgtgaataggagtgctggctctgtgccaggcacgcctggagtcctccactggcagggtcttattagtcctcccgacagccctgtcacagtgctgctggggccctgtccagatctccagaggctgcgaggaccgtggcaaacagctgttacctgcaacttactccaaaccatcacccttcctcacctggagaggttataccacctcgttcccctggggtccccaatgacaggctgatacaggctacaagagcccacgggcctgaaagaacgatcactctccggcgaatgactctccagagctccctgtgggctgaggctggggctagacttgacctgaaaccatatccctgcatggcccctcccccctcctgcgtccctctccttgtgaatcacatgcaccccaatccccgtctcaggcttctttctagggagcctggccccagaccagcctgtatgggagacattgttaagactctccgttttacagacagggaaagtgaggcacaaaagggtcacacagtctgtaagtggctgtgctgtactgcaccgcttagatggagcccctccccaagcccatgctggtcctcctgccccggctccagacacctgctctcagcgggctgctgggcgtaggatgctcggatcaggagggtgtcgatgcctgccagtgccatcagcaggtgctcccgtgtggctggctgcccatcgggccgctgccatgcttgctgccaaggagaggacacatgtgctcagcccctgacgtcctggagtattgaatgccggagaggcaggagcaagggcctgcccgcacccctacccccaggggacagtattgctcacctcccggaaaggcacaatgaaggtgctgggctggccggggctgggctcctgggccacatggtgctctaggatgatgttgttaccttgcagcaccaccaacggctgcccgtgcaggggtgtggagcccggctgggacctctgggtcactgtgaagcgcagctctcctccataggaggtcacctgggaccagggttagacaggagcttgcggaggcctgaattcgggccctgtcactgctccagccaccttttccatgcagtgtatctcactattctcccaaggcaccacgaccctcccgcctccaagcctttgcctgcgctgttcctgctgcctggagtttcctttgcctttccacccactacccaccttgtcccccaggaagcgtgaagggaggctccagaagtagggtccagataagagtctgtggaaggaggagaatcccagttccccgggcgtgggggagaagatgccctcgttggtggtgtgggtgcttgcggcgttggtcaggctgaagtgaccaggctcctcagaggccccatgcaactgggaggaggagaaagggctgggatgggggccgtggcctgggactggcgcttggtccatccggcccagggcttggcggtcctgcccgcccaccttgcagaggtacctgggcacggctccatgaagagctggtgcagtggcgactgacacccatgcagaagcacttgaggcagccatcggggtttcgggtactcaggtggaaagagccgtcagcacattcattgcacaagcgccccaccacattgttctgcaggcacagagttggagctgaaggacagcccatgggagaggctgcctggagctctggccgaatccaccctcagtccagataagaacccaagacccaggggagccactgaaagagcacatgtggctgggcgcggtggctcacgcctgtaatcccagcactttgggaggccaaggcgggtggatcacctcaggtcaggagttcaagaccagcctggccaacatggcaaaaccctgtctctattaaaaatacaaaaattagcctggcgtggtggcacacagctgtaatcccagctactcaggaggctgaggaaggagaattgtttgaaaccgggaggtggaggttgcagtgagccgagatcgcgccactgcaatccagcctacgcgatgggagcgagactccatctcaaaaaaaaaaaaaaaaagaaaagaaaagaaaagaaagagcacatgtatgaggcgtcattgccatctgaatagtaattcccacttaacaagcacttaggcaagcatttttcccttttctctttggctgccagggggttcaccaataaatttagacttgaaatacagcgacttgattgaaataattgctgcttctatttatggagtgtttcacgcactgttctgctttccattcgacatcacctcatttaactcccctaaggaccttgagaggtaggtgataccttcatccttcacatgaggaaacagaggctcagggatgtgaaatgacttgcacaaagttactcagcttgcccatccactctgggatttaagaccaggagtgcctgactccagaatccatccattcttttttacaccgacacttgatactcacattctttttttttttttttttttgagacggagtttcagtcttgttgcctacaatggagtacagtggtgcggtctcagctcactgcaaccctgcttcccaggttcaagtgattctcctgcctcagcctcctgagtagctgggattataggcgcccgccaccacgcctggctaatttttgcatttttagtagagatggggtttcaccatgttggccaggctggtcttgaactcctgacctcaagtgatccacccacctcagcctcccaaagtgctgggattacaggcgtgagccactgcgcccggccgatgctcccattcctaacgcaagtgacctcccttctctgagcctccatttcctcattcacaaattggggacactaatatctatatcattgtatcaatgtgacaatggacaaagtatggcaaaagcaaaggtacaatgcagatacaaaggctgcataaagaatgactgggacttgaactgtggtcacctgactccctaaccagtgctccttcccaacgccaggccacctgtcctggtacggaaggccggtgggccaggtccaccagcctctgactgggttaccacccactggccaaggatctatggagaggacggagcttccttcttcctcctcccagctgtggtgctgggcccaaggcccctgggtgggtggcagatggcacgcgtaccttacagcggcaggcctccccggaggtccccatgctgccacgctcgtcacagcgcacaatctcctggtctgggacacaaaacgagtgttggcagggcaggtgggaatgggatatacgtggtccgggcagatagaggaacagtggctccccaaggttcatgagctggggcagggagggagggtgcctggtgtgcagcccaggttgggttgggaggtgggtgtcaggggatggtggcagccatactcactgacgggcctgcacttcccgccgggctggatggggttgccctcgtatccgggggcacagctaggggagagagggggccgccatcagcacttccatgaccccacccaggagcccccttcctgcagcccccaaggctctccctcacctctcacagcggcggccagtgtagcctggggcacaggcgtcacatgtggcttggccatccgtgtccaggaagcaagtgtctgagaatctgcaggtatcaagtggacagggcatggggcagggctggggtcaggctttctcctcccaccctgggaaatgactgctgtctacacagacacagtgtgccacgaggcatgacgccatctccctgcccggcagcctcacagcaactgtaggaagtcagggggcccattatacagaaaaggaaacagaggcctagagaggtccaggagcatgggataacttagtgatcaggtagagatctgaatccaagtctcctgcctccctgcccagaatattctctggcctgttgcactgtccccagccaaaccccccctgacccggagctggggctgacctgcgggaggcatcgatgtatgggcaagggcagggccggcaggaagtggccgtggccttcatggcgtccccaaagaagccagccttgcacttgttgcactgtggcccctccgtgttgtgctggcaattctagaagaaggaggagggtatggctcaacttctagagcagaactgggccagatgctgcgggggaccttggaggctgtctagctcagcctccccatcacgctggaggcacagctttgcagacaggggagcatcaactgcaaccacttatagatgatggggagctcatcatcttacacggcagcctgtcccatagatggttccaaatgcctgctttttattgacctaaacctgccaccctcttccaatctgcacccactggccagttctgctctccagagtctgtttcttctacccgacacctttgcagggatttggagatgacaatgctgccctgcttgagccttttcttctgtcagctccacaatcccagctctcgccactattcctaagaaataaggtcccaccccaagggctcttccccctagagttgccctctgcaggccatgcttcttcatttggcactctccaggattagtctgatgagggtggagaggagggccaacacctcccttgtctggatgctgtatctctgggttgttttttttttctgagactgagtcttgctctgttgcccaggctggagtgcaggggcacggtcttggcctactgtaacctccacctcccgggttcaagcgattttcctgcctcagcctcctgagtagctgggattacaggcgtacgccaccacgcctggctaatttttgtatttttagtagaaatggggtttcaccatgttggccaggctggtctcaaactcctgacctcaagtgatccacccatctaggcttcccaaagtgctgggattacaggcatgagccactgcgcctgacctatatttctgttattgcatccagaggtcatgatagttcatctggcagtcatgacagtcattctggaggcttgtgctgagctcatgaacacagggaatctcacacattgtcccttctcctattttagtgttcaagtgtctgctggcactactcaccaggcagtggccatacacagggtcacaggagctggcatggccattgcaattgcaaccagagcaggtgcccaggtagggcccaccaggcacccgagtgaagtgggcatcacagctctcgcaggacaagccagaatagccaatggggcatctgtggggacaggaccaaaagagtcgctgcaaggacggtgaggccctgccgtttctcctctatccttgctagggtctctgtggttcccagccctgccggctcaggcacctgcactcctccacactgtgggcacggccatggctggtggcatgggtgacggtggtatccatggcgatgtcgctaagtcccacgctggccatcttggtgttgtacacggtctggatgagcacggcctccaggctctgcagcacctgcagcagctccgcgcgctgcaccggccggccagactcatggacccagtgctcctgggtatgggtgaaggtggcaggggtcacacatcagtgcctacccagcctaaatccccctttgctcccagccctaagggctcaggcgccacccacctcagagaactggacctggcgctggttcagagcaccaggttgggtgggtgtgtggcctcgggagaggaggcggtacccggcacccatgaggaccacgtccggccgctgcactggctccagcatgccacgggccaactcgtagcgcacgttgtaacgcagggagccgccataggagtccacctggcacaacagggtggatcagcacgggcagctgtgggcacacttgacacctcgtgcctatgaggtgcctatagtcttccagctcctccctcactctgcctacctgagacttactgtgtgccaggcactgagctaggcacagggaaaccgagatgggcgagactcaggccctgactctagggtgtttggtccatggcagggtgtggaatcatgcagtgcacagggtacccagggaagccagtgcggaggcacagaacccagcccaggcatgggggagtggtcagggagggctcccgggaggaggggaggccagctcttcttcccaagccaacagtgcaggggagaggtcctgccctgaatggatgagccgctgccacagggggctgcatcggggcatggtaacacctttccctccaagtctgccttgttgtccaccaactgcagaaggagcagagcccacaggaattctttccccacccagggtggcagcccaggcccctcaccttgttgcccaggaactgttcaggcagagcccagaaggagtcgtggacgaggaagcggcgggacaggtcgactagctggaactcgtgcagggatgggtcgatctgcagctgcgtggaggagaggggtggcgtgccgggctgcgcaggcattgtcacattcacacctgtgggtggcaagggggaggctgagggctgcagcctgggcctgcctgatacacccatcttgaggggcagcaatccagaaaggtgggaaagttctagtggaaatttgatttcgagaaaactttgatctctcttccaaagtgaagaaaatgcagttttttgccgggtgtggtggctcacgcctataatgccagcactttgagaggctgaggcgggcagatcacttgaggccaggagttcatgaccagccttcccaacatggtgaaacctcgtctctactaaaaataaaaaaactagacaggcatggtggtgcacgcctgtagtcccagctactcaggaggctgagacagcagaatcacttgaacccgggaggcggaggctgcagcgagctgagatcacaccagtgtactccagcttgggtgacagagcaagactctgtctcaaaaaaaaaaaaaaaaaaaaaagaaagaaaagaaaaagaaaatgcagttttttcctccttcccaaatactggagcagcatttcccaaagcatgctctgggaaagtcaatgccatggaatgatagctgggaaccatttgggaaccacagggtaaagaaaggacaaggggattctttgcagccagacttctcagggtctttcttgctaagagacccacagactttcagggctggaacaaccctgcaggcaggagagctacacagggctgaggaacaggagaccaagtccaggtgtgttgtaagcctgggcaagggcctcagtttccttatctgtaagatggtgcttaaagtagcctgcctcctagaggtataagctaaaatgagcacattgatataaaatggctagctcttattgttgctgttgttatgatgggtcgtctagtccaaccctcttctatgtacacacacacacacacacacacacacacacacacacacacacagtcaccctacatgggaattcccttgacagcatcctcccagatctctaggacagctccatcctagagaactttcggtggagtgaaaatatcctgtacctacactcttcattacggtagctgttaggttggtgaaaaagtaattgctggtttggttttgccattaaaagtaatggtaccagcaacatgtggccactgagcactggagacatgtcttgtgctgctcaggaatgaatcattgtatttcaatttaaagagccacacagggccagtgactgccacattggatggtgcagccgtcatggatggagagcgtacaacctccaaaggccgtccctcccggctctggacaactttgactcttagcaagttcttccttatacagagtccacatctgtctgccaatagcttctccccctcatcctgaattaaccccctgcaaccacaggggaatccagctcctcacccgcagaatgaccgagcacagccccgggtctaggttactcaatcctctttcctccctgccttccggggatgtcttcaggcctcctccctcctggtcaccatccacacacaggccacctgctcaccctggaattcccaccactccctcccctggaccacccagattccaatcagacagccctgggttcagctccccctctaaactgctgtgtgaacccagggaagccccacaacatctcagagccctggggctctcatcttaaaactgtgaaatcagccctgaccttgcaagggtttttggcagttcgttgactgtcacgtcaagccacagggccaactgcctgctcaccaaatggtggccacggccattagcattgtaaatatactgggggacaactttgggaagtaactaagttttgttttgtttttagggatggggtctcactctgttgtccaggctggagtgcaatggtgtgatcatggctcactgcagcctcaacctcctaggctcaacagatcctcctgcctcagcctctcaagtagctgggactacaggtgcaagccaccatgcctggctagattttttgtttttaattatttgtagagatggggtctctctgtgttacccaggctggtcttgaactcctggccacaagcaatcctccctccccagcctcccaaagtacttggattacaggcataagccaccatgcctggccaggtaactaagttttatacaagtcatttttaggttcctcaaccaacaaaagggcataaaatgtgttgagtgctttggagctaactctctacatgcatttaatcctctgcaacgaagaagtgagactcagcagggtgagggctgcttgatgccacgtggaaaacgacagagctgggacctgagccccagtccaggcagtgcctgggctcatgccctcagccatcctgccattctgcctctcagtgccagaaagaactgagtccatctgcctgcctctatctttgggaaaataggaccagggaggccaagagacttgcccaaagacacagcggcagtaagtggtatagctggaggccaccctcaggccaaggagatgccaaagcctgggctcctataatctgggtacactggcacctctgtctctcagaatgaggacaatgactgtgacgttagcaaatacctcctgggtgctgaaaatgcgctgagcacaattctgagaggcttacatacgtgactccactaagtccttaccaacccctaggaggtagttattattccacaccccccgactttacagatgacgaaacagacacgagatagtgggtaacttgacccaggacacaggtggacagcgtccacgtcaggatctgaagctggaagctggctccagggcccgtcctcgccgtaacctgaagcaggtaggtagcaaggggggatttggctcttcctaaacatcttggttttccccccgaaatgcttttttgacagggctcagtgtttcttcagcgactcacattccttcccgaaacctggccccctctgtccgcatctatcctctgtgccccctgggtacagaggtacccacctcccacctcccgcagcgctcacccgcccgccaacgcacccttgaagtcatcgggttggtcaaagcgcagcctgatctggtcccggaagcggcgggtgctctggcacacgctggtgatgccaaagcagaagcagggcaggcaggcggcgctgtgctccaggtagaagtggccgtcagggcaggggcctgctgggcggcatgggcgggggctgcagccggctgtggtgggcagcccggctctgcccccacacccggtgacacctgccctccggcagtacctcgttgtgggacgagctcaaggacaccgtcaggaatgccaaacaccatgccccgggcgttcatggcctcacaggtgtaggcaccctggtctgactccttcacatcacggatgatcagtgtgccacggccaccctcgctggtcactgtcaccctggtgagccccaagacaagtggtaggatctggcctagggctctggaccagctgcccctcattcccaccccaccacctgggcccagagccgcacctgggatgagaggggatgtggccccagttgagcctccaattgatgatgggggtggggacgccaatggccacgcaggtgaaggtcactgtctggccccgggaagcctggatggactcccggggaggtgtcaccacctgggggggcactgaggagaccagggcaggagtgaggggtcgggggcaaaggaaggaggagcggaaggagggctccgaggggctaggagggagaagggtggaggctgaggctgtggacagaacccctagaacccagcccagggcccgcatctcgaccccagctccctgctcactgcagccaaactcgtcgctccggtcaggacagtcgctctcctcgtcacagtggaagctggctgggatgcacatgttggtagagacgcatcggaactgtgtgggcccgcacacttcctcaggacgcttggtggctggggacaaagccaggtggttcccaatagcccaccccgtccatcctccctgggcatccccagggccactctctcatcttgcccacataacccacagcggccctcgccatgcctagcccctgctgcacaacactgtccaactcacagccagcatgatgcggccaccagctgtcatcgaaccactcatcacattacccggcccccacccctcactccacctgcattccccatgccagttatggctggcacatcactgtcacaaccacagcatcacccagccacgctcagaggcacagaagcgctatcttgctcacatggacaagacccatgtcaaaggcaccaccagtggggctggcatctctgggcgccagcaatgccccgcccacccttctctaccagaatgcctggcacagtgtggtcccctgaggggctcgacggtctgtgctcccactgacaggccctctatggagtggccagaggctggaagtggcccgggacaagggctgggccctgctaggcctctctagtggctggtgaccaatgttcttcctcagggagatggagcttgagagagacacagacagggacagagaagtcacagccatgcaggagcggaagccgcgcatccacagagcaggtgcgagaggagaccaggaggtagccgtgggcgcagctcaggcgcttctgttccccacactctcaggagcccacgaggccattcagctttcatgttctctgtttctgtgctgtccacaaggacctgtccttcctttgacttccccaggagaggcccctgagaagggccttccaactaaagcccccaattactttatctctcccaaggggctggtgctatcaggcaagcttagagccacagaaaggcgttcgcaaactctgccagtctgtggcatggtgcagcctctcccccggggcttgctgtggagtgggcaggggaaggaaggcaaggagaagctggacaagctcacagcaggaacatggacacgcgcccagacacaccacccaggaccacagagaagagcctgaagattatccttaatcttgcactaacaagcatcaggcttcttgcgggacaggacatacaggataccacctgatgtggtcgctgcctctccagcctccccctcctatttaactgtcaggatgcccgtaatgtccatgactggaaaagatggataccacaagggtggggaagtgggaggctggaaggatggatgggagggaagaaggacgacagatggatgggtggatagatggatgaagggctgggtggatggataatgggtgtataggtgggtgcatgggtggctggggagttggacagatgggtgggtaaggctctgacttgcatacatacaccaaggacccatcaccaagggaccttggcacatagaaccctcctagccattcatccgacccacatacaaaacaaagagaagcttcatggtaacaaaaataaaggaaagaaatgacgagacacgaaccacaggcaggctaaccacacagcttcaccaaaggccagctcagggccaaggggccttacggctctggttagagataaaccttggggtgtgtctccagggccttccgcactcagccagggagagcaaacaaacaggcttgggggactggggaggggggaaagcggaggggcagggtaggggcggggcaggagtggaaggcggggcaggagcaagcggcctgggcagggcaagggggcctcagctggaccctcggatactcacggcagttggcttcatcagttcggtcctcacagtcaaagtcaccatcgcagcgccacagcttgagggcacaatgtccattcccgcaggggaactcgttgggctcacagggtggcggggggcctaggagaccgggcaggggtcagcagcatcctcccgggccagcttcctgctccccgcacccacctgcacccctgccggtgcgcaccacagtctagctcatcgctgccgtcctcgcagtcctcctgtccgtcgcagaggtagtctctggggatgcagtgcccattgcggcatgcggcctcctggggcccacagggcaggggcctgacggaaccgggaagcaggggctgaggagcgtgggtgactggtggctgtcgcatgatggttgtctctggccggggcggtaaagatgtcgtctccacaaggagagagaatgtggggctgatacccaggactggctcctctgtggatagattccgcttggcatttggcagaagcagatggctcctcacctgctccttgtccccaaccctccccaggcccaccctgtactccccaacaccactccctgccaccccctgcctggctctgtcatcacccttcctatgcccccatcctctgcctgcaccaaaccctcatagtccttgatgggctccaagacccaggtgtaggaccctggccctcccctggcacccaaaccactcgtggccccggacatcccctcaccacaattgagctcatcagacatgtccctgcagtcgggccgccggtcacagcgatactccagggccacacactcattgtagctgtggcaggcaaactcggcctccgtgcaggctcttgggaactggggcactgcaggtggaaaggaagcagactggagtcagaggcggcaggaggcaggtgcgggaagctgtaggtgctgtgtggctggagtgggctccagggccctgtgtcaggcagctcggtttctggcaggcacaacgagggcaagcagcacacactagacacatccacagcacacgtggggcatgggacatgcggcagtggcctcccccatctctaaaacagaccccacacacagttgacatgccacacgcatgcaaccaccacaccacacacatgcaggccacagcctggcccagtgaggacaaagaaggaggggagaagggagtgcccagctgtcttgggctgtgcccagccagccatcttgcccacacccttctttcctctccatcctttaaaaaatttttttctctcttcttttttatttttttagagacagggtcttgctacgttgcccaagctggtctcgaactctttgcctcaagcaatcctcccgtcttggcctcccaaagtgctggggttacaggcgtgagcccctgcacccggcctcctctccaaccttaacttctctaggaacctggctgggcctcggcctggcttacactctcacctggtgtcactgcgaccgccacagcggccggcgggggtgggggggtctgtgctggaaaggaagatgtgatcagtggctgttccacctgggagccgggagctgagggctgcagggctgggccacattccaccatccctagccaggaggacttattgaaaagtgagagaggagggctggacccccagcagtctttagacctgggcctgatgatgcagaagagcaagcttgatctctgggtgcaataattaagggtttttgtttgtttgtcttgttttagaggcagggttttgctctgtcgcccaggctggagtgcagtggcatgatcctagctcactgcagcctcaaactcctgggctccggtgatcctcctgcctcagcctcctgagtagctaggactacaggcgcgcaccaccacgcttggctttaattgaggtgcggaacaagggaggtgatggtttcactgtcttttcctaattgggctacaccatagtaggggatggagtttgttccattctgagttccactgagtcagggtcttcccagagacagggaactgagatggagacagggccgagaaccacacctgtgaaggatgaactagggctgttcggtctagagaaaaaaaagagactcaggaggttaaaacaggagaccaaaggcacagtagaaggaaatctgggctgacccagagtacaaaggccaggattctgcacctaaccgctgtgtggctttggaccagtttcctagtctctctgtgcctcagtttctcctgcttctgtcatcacaggttctggcaagactgtcacagacaccgagtttgtttgaaatcctcgccttttcactatctgcccatctgattctggacaaatttagattttcctttctgggcctcagttccctcgtctctgaaacaggaggaataacatctccttcataggaattgctgtgaagactgacccggaggctggaaataaaggcagtcagtgctcagtaaacagttgctcattattattaagtactaatgtgttttggacttggaagtacaggataaataaaggcctgattacctattgtcaatgtgcagaggtctagaaggaaggagcagaactcgggtctaacgggtatgtgctagaggaaacagtctgtgctctaccaagccaagattgtgtaaagatcgatggggcagactcaggagtagtgagctccctgtttctagtggtgtgcaagcccaagttgggagcctatggcagagacactgaaaggggaccccacgagtctggaggaggcgatcccagacaccaggataggctcacctgtgcccaggcgtcggaactggaatccctggggagaggtgacgtaggaggccacagagccgctggagatgaccctgagcagcatctcctgaatctgagccccatccgcattcccttccgagcccacatccagctccacaaaaacccagccatccagctccctggggatggagacaggcaggagaggagggtcagcgagacacctgtgttctcagctcctccatgaggctcccgccccgacgctcaggccctgttccgggacagcctgtacccaaagaagggcaactaaaggtcccaatgatcccccgaccaattcctgaatttccacccacagcgactcatcccataggcctttccgcggtgccaggcttccttcccatcctcatcagccccctccaggttacccgctcaagtcccccagcagcccccagggagccccttctcacttgatgaacaccacactgacaacctggtctccgggaattttcaagtactccgactccagctggggagggacacagtgccatcagccccagaggccttcaccccatcctcggtcctgccccgccacacccgcgagcttcccaaacccccttcacctcaccgtgtctaccacagcctcggacacctctcggaactctctggagcctgcatcctccagctgagggctgtactcgatggagcgagtgaaattcaccagggctcggaaataaactggaaaatcgaaggaggatcattttgagagccccagcctggcatctagtggccttaggcagttggaccattcaggcagagttggggggatggcccccagaggcctccctcgaggctgacacctgtgtgcccactgctacacccaggactgcctgtaggtatacatgctcaggggtcaatgccaaggccccaacttgactgaggggctttaactaacaggggaaatggcctgatccagaaaccaagtgctagtgcaaaagaggagacccccacagttcagaggaaggctggacaagaaggggtggctcccagagggagttggcctggcacagggattacctgcgtgtgactgggaaaggctctgccagccttcctcggtcagttcctactcattcctcaggacttggctcagccattgtctcctgatcttcctgatctgccctggctggggtagagaccgctcccctgggctcccacagtgccctgctttccctagcagagcaccttccaccgtgtactgcatagattctgccaggtttcacatcacagtaacaattgtgagttctaaggtcagccatgcctcaggcactgacctcggctctgagtttctgtttcctaatggggatattgactgcatgtaccacctgggttgctgcgaggagtgcatgacattgtgctcacatgcaccaggcccttgtactcagatgcatcacctggcacacagcaaaccgcccaagaatcgaagctgctgtggtcctctctccaccaccagactctaggcttgatggaggggaacctgggatttcattcacgcccgcatccccagtgcctgccgcgtgcctggtacacagcgggttccttgaaagtgatggctgaataaattcatctcagactggtgtgaacatacacatgcatctgttgtttcttttttttttaggcagggtcttgctctgtcacccacgctggagtgcggtagcaaaatcacagctcactgcagcctcaaactctaaggctcaagctatcctcccactgcagcctcctgagtagctgggattacaggtgcatgccaccatgcccagctaatgttttgacttttgatagagatggggtcttgctatgttgcccaggctggtctcaaactcctgggctcaagcaatcctctcactttggcctcccaaagtacatctatcgtttcttaagcaccgactatatatgagacattttatgctcattacgtttcacaatatttgtgaattcatgtatgtgatagatatgaatgaataagagtgacaaatgagtcatatacaagccaagcatccctaatccaaaaatctgaaatccggtgtgtaggtggcagagcagggagtggcactgtctgtgctactgccaggcccatcctcctcccgctttactctgtccatcaggcccgcaggtgcacaggacattcttgctctgtggctcaggtgaagaaagccctggcgctgcctgccctgaaccgctgggctaggctcctgggtgccgggtgggcggggctctgtgggctggagtgtgggggccatggctcagccacagaggccccttgtgagccagcacagaggcccattgagagtccccccacccaagcccctggcctcagccccacggcccagcgcgggcgaggaggccgggcctctgcccaggaatgtgcccgctcctggggaaggggactggagctccacaaagcccctttctactagggcctgggaagggcacaggcccttcagcctgaccccaccccgcttcgttcttcgagaccaagggcaggtctgggtgaacacctcccatctcccaccctgcagctggtgcctgagcactggggcagaaggtgaggccacctctatttcaagaaccagcccccgggctgggtgcagtggctcacgcctgtaatcccagcactttgggaggccgaggccggcagatcacttgaggtcaggagttcaagaccaggctggccaacatggtgaaaatacaaaaattaaccaggcgtggtagtgcatgcctgtaatcccagctactcgggaggctgaggcaggaggattgcttgaatcagggaggcagaggttgcagtgagccgagattgtgccactgtactgccttccagcctgggtgacagagtgagactccatctcaaaaaaaaaaaaaaaaaagaaaagaaaaggaaaaaagaaccagcctccagagccaaggacactggtgcagccagcaggggcgaggctgccttggaataggggtgctctctggccagtcctctccctcctctcaccctatctggtgagttcccttggagccagaggccgggagagggagacagctgccctgcactcagggtagaagtgggggctgcacacctgactagccctggccccggagcaggctactcaccaactcctgattcccatccctgctcaacagaactctctgcaacacacccaggcccccgaactccagccctgggtccctgtgggtccctcgggtgggcccaggattggcctgtgctggggtggacacaagtggcctctggaatgcagggcctggtccctgcagggctgctgcacccatctctgcccgtcaacaccccatggggaagaacgcccgccagggttccagcccactgtgtttagatctgtgggcccagggtgggcctggctgtgtcctgggcaggggcagtggctggcctagcccctggactctgcagggaggtgcctctgagcctcttgtgtgactcgcagcaaagtgcaggttggggaggaagagaacagggagaaaggagagaaaaggaagagtggggagagaggatggggagggaggcagagggagagcagcgctcccacctggccagggcctgggtcacttactgagaggggactcctcatcaggctccgagaccatcatgccagccacgggcgggcggcccaggggctgccctgagcctgcagagtagagacagagaaggaggcaagaagggacattgacagcgagggagacgagatggagagaagcagagagagaggcagagacattgcaagagagagggagacacaaagagacagaaagacagagacagagataaagaaagtggggcgggggagaatgagagagaaaaggtaagacaaaggtgaagaaaaaggcagagggaaaaagaaaaaaaaaaaagaacaggcagaggggagagagggaaagacagagggcgacagaagcagagatggtgagccagagagagggagaagaacaggatgaggcagagggaggaggcgcagagacagacactcaaggagtggggaagagggcccagggcagggaggacaggggacacacacagacatgccgacaagggtcagagcaggacacacgggcatgggggaagacagaaagagacaggtcagaacatggaaagaaactgggggaggagacgtgggaaggggtcctagggaggggaggctatcagggacgggtcttgacacacagggggctggagctgagccagggagccacagccatgcccagggggaggaggggaagagccatctcaggggctggagtccagggtctgggactgggccagaggctaggcatggccccatgacaggcaggatggctctggctcatgggcgcagtgggggcactgcccttggtcaagtctgagtgggcaccctgggaccccaggatcagggaggcacacctgctgcctccctgactggcattcagcccagctgcctggacctgccccaagggcagctggcaggagccagggtttggcctggagggtctgaggccccacctgttcccacttgcgaggaaaggcacctaccctggtcttgggccccctacagctgctgtgccctgttccccacctcttccccctctggcctcgtctgccctcacagctgcttctcaggaagggcaggtgggctggccaggactgcccagctggggcagagctgctgcagtgggcagcccccggggaggggctggagatggttcatgaatggacagggtgatctcagaggcaagcctggcttggccagaggcagctccagggacacattagcataggccattccaggacgggacgtgccatgtgtgcctggggcccacctgacactccctctcccaagccccacccagctcccaggcatcctgcagcctcgtggagacctacacatggaaatggaaaaccttcaggcagagccccaagtccaggctctgggaggtcacagtcaggaccaggttacccagtgacctaccctcctgtctacactgacccagttaggatgctacccactggcatttgaaggccccggatatgtcagctaaagggaggtgactccacccctgaagtaggcccaggccagatttggccaaggcctgcctagggtgaaggcagccctggatgccacgggatggcccagtagttggtctgacctgagcacctgctccatccttggccctggtcacagattgtcccaggagctgcctcccagagagggcagtaggaaccataaagagccacagggccttgtcctggggtaggtccttctccacccagtatcccagagtggaaggaagcagggactataagtccccatcccagtgctgggccagtctgaccagggtgggggctgactctcctccctccaagagcctagccttgcctccctaagctaggaacccttgcttcccagccgatgacccaccttaaggcaaggttctctcccaagcctagcgtcaggctcgatctgtgctctgcatgccctgctgcctgcctgaatgcccgattccacagagcccctctgttccacttgtctttgcctgggatccccagctctgtgcccccaggagggctctggggaaggactcaacagctgagctgccctgggaggtgagaactttgctttgaatgtgaaacagctgactggctgtcagtccccagcagaactgggctttacctgcccagtgccctgatacctgtgcctgtggcatgggcaagcacaggacctggccacaccagccttgcagggacctgccaatcagtctgcacaactgtcactcagcaggttaagagatcacacccacttcttcttgctttgtaccccagggcaggcccaaggagccctcagcccaggagactggctctggggcttccctgggggacaggagggagacctgcaggaggcctgcagcaacttacccatctggaagtccccgctgcccaggtccccactgcccaggtcgtctataagcaaaaaagagatgtaatcagcaacaacaagtatttgttgagtacctactgggtgtcaggcactgttctgggcacctagtatacagtgggacagggttgagaaagctcggaatggtcggtcaccctcctcccccatgccagtgggaagaagcacagtctcaccccccacccctctgctcccagccttggatccttggctcacctcctgagatgctgtcagccagcatgtcctcatcatcagaaaggtacgaatgtgtccagcgcatttggcttgctgtgacggtctctatgtcctcaggcagagacaagccatcgtatgccctcagcccatgggtcacctgtaagcaaacgagagctgattgagtcactctctccagctcccactgagccccacggtccttcccctcacttccagggggacccagaatcccaccttcaggccccttagtggttaaatttgacttagtatggctcagtgagccaggctggggctgaacccttttgattcagtttccccaagtcccattagcccctggaggcttcagagcccaaccctgctatttccgaatgaatcctcaaataaagcagacaataaaatgtaaatcactttggtaagtaaagactccttttcctttggagaaggcaagggacacccaggacatgagtgagtggatggggggatgcgggcgggtaaaggggtggcctcgggcagcgcagatggggggcacaggcaggtggaaggctggccagggtcagcatgggtggggacacaggcagaagtcaagggcgagctgctcaaagccgttgcctccccaggcagctcctccccaggccatttggctcctcttcctgcctcactctggcctgcccgtctccaggctgcagggaacacattccactgtgttggagaattagctttggcacatgcagccacactgacaggctcatccctgggcccagcagcgcggaggcagagctcagtatctgggctgaatggggacaggcgtggtgtcaactccacgtgacctcaggctgctgccgagcccaggataagctccaccttggggcctgcaaactatgtgggccggagcagaagggccccagcagccataacacctgccttctcaggtgtgggtccgggcaatgagtgcctcttccccctagacaagatccggatgattccaaagcagttttaccaaataacttagaggaaaacaaacccaggggagcccaagggaaccccgtggccctcaagtgtgcagattcacgatggctggaccccagattccacaagcacaagtatgcacagactggcaatggcctggcatgagggcctcaggccctgccctggccttaagccagaaggaaatggtctcgcttttgaaaaccaaacccacaagggctagacaaggtagtgaggtccaagccagagcaaaggccaaggaggagaaaaaaacaaagagccagccaggcccccttccctccccacccctactgctcccacagtccatatctctcacgccgggccctctgctggaatgcccttcctctctttgtttctcaggcgaactccaatgcatcctccaaaatcaacttaaataccacctcctccacctactcaggaataaggaggatcaaaccactgattgataggtgtggatctgaaagaagccagacacacaagactacaaactatacgattccatttatatgaacccttaggggtgaaagtctaatccatagtgacagaaagatcagtagtcacttgggaccaagggcaggctgggggtgactgggaagggggcacaagagacacttctggggtgatggttccctgggcatacatatctcattactgactgtaccctgaaaatgggtatattttgttgtgtgtatttatgcctaaataaggatgactagaaagaaactctctttgtcccgactccttgctgttcacagtgacctcaaccccagtctggttctgggctcacaaggttattgtctgtacctccgttggaatggaagcaccttgaaggcaagggctgtgatgaattcatctccaccttttctgcaccctgtgctcaataaatacttgaatgaatgaataaatgaacggacaaaaacggaattcatcacctatgaattccagtcactctgtgaagatgacttgctttggggaggcactacctacctctgtgcaatctataagcatctcctgtcctaggctgtgagctccctggatgggggagtggctgggtgccatttgttcatctttgtgtttgcggtgctctcagaccttggggaaggtctgagttgtccacatcttattcctgctttggcctaaagcccttacccccaacaatccagcggcaaatgttgcctcctgttccttctcctctccctgccctctccctgtcctcctgagtgctggcctgtggacttctaggctgtgcccgtgggatgcgcattcaggagtgtgctttagaacgtccaggagctggtgagaaatgcagattcctgggctccttctcagagacagtgagtcaggtttttccatcccaggagggtggtcttagttgtgcatgtccaggggattcccacagtccctggttagaaccgtaagaccagcccctaccaggcgctctgcctccttccctgggtggggtaaagggcagtgttcccactggctggagcaggcctgactgacccaacgtgggtatgaggctggggctggtgcaggggcactgactctggttagaggagatttgaggggtcccctcaacctggtggggggctctgtcaatgccaatccccctctcattgcaaccaaggttatggagggcatgcctggagcactgcgactcccagcatctcctagacactgccgtctggaaaggaaaacctagcggtgaatgatgagcaaggtccagagcttttcccagggagcagggagctggtcagcgggtggcggcgggggtggccttgggaccagacaggaaatagcaaagtgagattcaacatggaaagaaagccaggaacacacatctgcagggagaggggaaagagaggccagagcacgtcgggacttggacagaagtgccccacactccaccagaggactccagagcacgggtccctccatctgccagtctgctgttgcttgcagcccccaccctagggtctgaggatccagggtcagataagggcccatagcaaggaataagtcagcaagagcagagacttcatttgtaaaaagctgaagatcaaaaggttccaggagctctgtatttcacatctgggagagcagatggaaccagacaggaaagaggctcccagaaagagccaaaaggaacttgggacttgaccatagaaggaccttggacccagaaagggaaagaccaggatctgcttgaagaataataacagctaacatttattgagcacttactatgcaccaggcactcctaaaccaggttataggtcttatggggctccactgagaaagggggcaaagagagcagagaaagtcaggttacccgtggaaactggcatgtggcagggctgagatttgaaccctggtggtcgggctccaatacctaagcagctaccactgtgctatatcacctctgtgaccaggggtatgcaatgaagcagatatgagatcactgggagtcactcttgcaaagcctctcagccacactgcatgccactttgcaatgcatttcctcagcctagtatcacctgagttgacagtgacccttggaggaggctgaggaggtatgaatgctccccttccccagtgagccccgggagacgtgtctgcccagaccacaggtgaggagctggcatcccaccccaagccttctgctcaccaggaaatgaggcagggctggacctctgggctggccatgaggcctaagcagagagcaataccagggagcccagggttggccagtccctgtccccaacctgaccagctctcagaatggccccatgggatgcctgagctggcagtggcctgggactgtgcagcatgtgcctcaggtcccaaggagggccattagcagctccaaggtcagaaatagaacccaggtttcctgccctccagcccgtctccggcggtgagggagcccggcttcctcccagaggaacccagcacttcaggcatgtgttggagccagacgggcagctggagaggaggggtctaggggtcagacctcggccagagaggaaggagctaagcagagagggggattttccagaccctgcagttcctggtttggcggtgtgcaggcagctgactcaaccgggcccaggccagagaattgttctaacaggctgagaacaattgcttggggctgggatgcaggcagggtgacccccagtgggcaggcattccttgaacactggcaggactgtgggcgagggcttctgggaggcacccaatcccagaggtgggctatgtccaggccctcctggtgagaacgagggtcacatggaactccaggtccaagttgtgtcattagggacaatgaatgcaggctggatcctcctctcctggcctgggtgaggataaagaggcagacaaggctgcctaggaaaggactaagaacggaggagaaaactacaggagtggggcacagaatggagagaaggagggagaggtacagatacggagagcaggtacagatcacttgaggccagaagttcgagaccagcctggcctacagggtgaaaccccatctctactaaaaatacaaaaattagcccagcgcggtggtgcatgcctatagtcccaactactcgggaggctgaggtaggagaattgcttgaacccaggaggcggaggttgcagtgaaccgagattgcaccactgtactccagcctgggcgacagagcaagactctgttaaaaaaaaaagtttatagcaagctcattgggtgccaagccctgaactgaaccgacatgaagctattcagagtgtgttcactccactcagagggaagagtcctgtgtttcactgtagcaatattaccgttgtttgatcatggggtgtgacccccagactccaatggggatgtcacatgccggctgggcacatgctctatgtcaccttctcaaacttgaaaaattctgaattccagaacacatctgactctgaggctttcggtcaagaaactgtgagcttgtgttattattatttccgttttctggatgaagaaactgaggctcagagagaatcggctgggtaaatgggatcaagcaggtaaggcacttagtgaggcgtttacttatacagtaagtgcttaataagcactagaattacttatacagtaagtgcttaataagcattaggattagtatcatgcagagggtgcatggtaggggtgaggggtaggtgtggttgaggggtgatgcatgcggagtgtgaggtgtgggctcaggcctggggtcgcctccagatctgggatgaagggaggagcctggctgagtgggcaggaccctagcaaggggtgggcaatagaattgggtcctatggctcaaagttgtctgcctgctcagaggctgactctgggaccaacccagggctttgggcttctccagacacattgttcacatgccttcagcagccagtccaccccaccctccttgtagcccaagcctgggactgagcccccgactgcccccgcagctaggcaggaaggtctgagcactgcacagtccccagggcggctgcagctgcccagggccaggctccaggcatgtggggatggagtgagctcaccccatcaaaatccagagacagtgcaggggcggggggacaaaagagctcctgcctgcccacctgcctccctgccacggtcaccacaggctctgcctcagtgccccttcccctgcccactgccaaggaaccagcagacaatgtgacccatggtccccaaatctctggggagggacatgaacccagacaaggtccccatccccctctgccaggatgcaggctcctaggtaaccccaaaacaagtgcttcccctactcggctgcaacccaggccccagacacaggatcaaggtgccctgccccacccccaggccacccagtgccctgtccacaggcgacagacagcacacaggaaggaatctgtcggggcagcactttgttgtacaaactgccaggggctcagagcccgacacaaaggccaaaaggcctttaatcccctggcagtctgagaggggcgccgggccggaagggaggtggccacagcctcctctggcatgcttgtgctgcccgtgccactcgggaggcctgccagcttctcacacaggggcccccaaggtggcaggaacttcaccagccagtcagccaggagaaatacggacgcccccaaacaaggagagggtccaacacgcatccagggcttctttgtgccaggggctgagctaaggtcttcacaagacttacgtcactcagatccaccacaacctcacgagggagacactggaggcacactcatttgatagataaggaaaccaggctcagagaggtacagttacctgctccaggtcacacagcaaaggcaatgggaacggagtctgaaaccaggactcccctctgctgggttcatgcttctgtatttggctagctcagaggcacagctgccagcagggccctgcttctgacctctgaccccttgccctctgtaagctcatatcaaggcctgcaacctggaaaagctgcattccatccagggcttctcgggagcgctggggcaggtcagggccttcagcggaggcccagagggcaggaagctggggtctggagtttctagtcccagcttagccccgcactcaccacgttgccttggacaagcccctgcctcctttaccttttagctaactttagtgagtctctactgtatgcactgggcatccacacccaccatctcagtccatgtgaacaacacgtggaaggcagtgactttgatctgttttgagcattgctgcaactccacaacagaaaacacacagtaggtactaataaatctgcggactcacggacaaaccaaatgaatgaacctgcccaacagccctgaggtggaaattaacccacctgacagaagaaagctaacttcagaaggagacttgcccaagattacacagcttgaaagtgccagaattacctctagtcctcagttcccattaatacgacagaggccataacacttcatcctaagggaaagaggggactaggtcacacgggccctgaaatccgttccaagacacccctgtccctgcagaacaatccctccaagaattagttctctccgctatgaaatgggagcaaaaggccgggcatggtggctcacgcctgtagtccccgcactttgggaggcagaggcaggcggatcacctgaggtcaggagttcgagactagcctggccaacatggtgaaaccccatctctactaaaaatacaaaaattatctgggcgtggtggcgtgcgcctgtaatcccagctaccctggaggctgaggcaggagaatcgtttaacccaggaggcagaggttgcagtgagccaagattgcgccactgcactccagcctggtcaacaagagcaaaactccatctcaaaaaataaataaataaaataaaataaaaataaataaaatggaagcaaaaaaaggtccccgctttgcctccttcctggggctactgggagaggcatgtggaatgaggcggtgatctctttgagaggcacagtcccaatctctgaatctgcctggcccttctccaggcaggccccatgtggtctctgccttggaggctcctatgacatagctaggggtgggcacccaacccggtctggcactgaccaggcaggggactggcgagaacacttgaccaccagccggtggggcagagcaggctgtgctgtcagacacctccaagtccgggccaccctggccatattctagctagggggcttcagcttcctcatccttaaaaaaagtagaatcgatcagatctgtcccatttggttcaattcaagtcacttcaacctcgacttacggggtacctactatgtgctgggcccgggggacaaaatgtgaaatggacacagaactccatgttcctgggggacacaggccacggaaccacgtgctggcaacaccgtgcgaagagagtgctgaaggggaaggaagggggccggcagagcccaggggagggtcccctcacttagggaggtggctgggaggctggggaagatttccagaagaaatgctaactcagctgggcctgagagatgacttcacctaagcaaagcagagaaggggaagagtgcggaccaggtggagggaagggcacacgctgaggccagggctggagagggcacggcacgttcgcggggtgggaggaagcctggtgcagcgggacacgcgtgtgagtggcagaggagtcaaagggcggcacgagtgggcttttccatttaaaagggccgcccctcagttgtgctgctgacccggtgctagtcacagaggccaagtctcccctgtacccccagagtccctgcactctcctccgtcccccacagacaccccaagattaggtctcccctggtggctgaatgagctgcctgccagcttacagggaaccaggaagccaccgggaaatgcccttgcctcacccatgtgccaggtgtggccaaggcggtgggggtggcctaagcgggaacagcttctggactgggctgcccagcaagaaggtccctgggggtcgaacactatctgccaggcaccacggctgccggcaacacctgcagcgttcacgtgccagcctcctgcatgcagcctggcttggttctcaggttctccggctcccagctgccctgctgccctggcaggtctgtggggcttcaagggcacaccaacctggttgggcctgcccataccctcctgggtcactgcccacagatttcatgaatgatgccccttgcacagtgccaggactatggaaggatgggcggaatgttccacaaagttatgttgccatgagacaccactaacaaccacggccgcttcctgaacctgtcgggttaggccttcccacgactcctgactcaccaacgggtgagaggaaaagcccttatcatggccaaccaggttctatgtaatctgtctacacacacacccaccacccacccacacacacacacacacacacacacacacacaatcatggtcaaccaggttctatgtaatctgtctacacacacacccacccacacacacccacacacacacacacacacgccacgctccaacctcttttgctactgtgctcccccaactccctgccttctaaaatagccacatgcatcctctcaatagtcgtcaaacacaccaagccccctgcctgggacactgtccccacatattccatcactcgctccacttcttccagtttttgctccaatgtcacctttcagccgcgcatggtcggtgcctcacgcctataatcccagcacattgggaggccgaggcgggtggatcacctgaggtcaggagttcgagagcagcctggccaacatggtgaaaccccatctctactaaaaatacaaaacttagcctggtgtggtggcaggcgcctgtaatcccagctacttgggaggctgaggcaggagaatcacttgaacccaggaggcagaggttgcagtgagccaagactgtgccattgcactccagcctgggcaataagagtgaaaatccatctaaaaaaataaattgttgaattaattaatgaaggctgagacaggaggattacttgaggccaggcgttcaagaccagcctggacaacatagtgagactctgtctctacaaaaaaattaaaaatcagcccgttgtggtggtgcacacctgtagtcccagctacttaggaggctgaggcaggaggactgcttgagccaggagctcgaggctgcagtgagctatgattgcaccactgtactccagtccggataaaagagtgagaccctgtctctaaaaacaattaattagttaattaattaatggggtttataagtgaggagcctgaggctcagagagctaacttgcccatagtcacagggttggaagaaccaagacttgaacctaagacccctggctccacacctggaaggaactccataccacctggtcccgccgatgatgcctgggactttcctgctgggaagcccatctctggggtgacaagaggctgcccatagtcactgaagagcatcccggaggggtgggtgggggcctcggaggcgagcaggggccagaactctggctccagggccttgcgcaacacagccagacagccaggcctcagtgactgtactcagcgcttgttcccgtgggcatcggcaacaggaaaaaacaggctggaacagcccggcagctgtggccaaggaggtcggctccccctgcccccaggctgggctttcctcatctgctgtaaggaagaagaggaaggggcaggcagggccaggcccatggctgagataggcctgtggagagcagagctggaaatcagagcaaggggtcctcgtcctgaagcgccccatgtctgctttcttcatgtcctttcctggacacagaaactctcggatgggaataggcgcgggggagacaaacacatctgggaaaggctggttacacaaagctgagctgcctccctaagtcctaaatgactgaagcaacatgatgggactggggggtgggggggggtcacgtgcaactatttggtgtttcccaagttgcttaacttggaaccttttatgtatgcaaggctcactagactagggttccacagaacacactttgggaacaccaccccaaccatcccgcctttccctcaagttagccttaagtaagattttagacgtaagatatgctccccagtacccaggggctctgtaaaggaggctcttgaagataagaaaagccgcaaggccccatggaaggaaaagcgggctggcggccggctagctggtagtaggaggggtgtgttctctctcctcagggtgattgacacctgtcacctgagaaatccagacacagcctgagccttccctccctggccatcagtctgctctctcagggggtgactcctgtcggaggtgaaagagaaggtggcccagcacccagtcattcctggtccgcttggaccctccagaaagtctggaggtacctgtgccccagagagaaagagagcttcgttcagctgctgagtgcagagaccggggcaggggctcactcccagggccggcgaccatgcaggtaagggggtgctggtgctcttcagggcagcgactgagaacagggctcccaaccagctctgctcgctggtcccttcccttctctgggcctcagactcccctctgtccgatgatgaagcagccctaggtcatggctctccagtccatcctcagcagcctcagggccactctggacaggagtgaggtggaagcggggcaccgttagagtttgggccccttcccaaacactcactttcatcaaaacacatccaatttttttttaacagggttctgctctgtcgcccaggctggagggcagtgggcctcctcagagcctcctaggctcaagatatcctcctgcctcagccttccaagtagctgggagtataggtgtacatcactacatctggctaatttattttttgtagagatgaggtctcgctatgttgcccaggctggtctcgaactcctggtttcaagcgatcctcctgcctcggcctcctaaagtgctgggattacaggcatgagccactgtgcccggctacaaatccacctctttcctttctatattctcacctacataaatatctggttcagcccttggttagctgtgaggccatgagcaagtcatttctcctctctgtgcctccgtttcctcatgtgtaaaatgggcacgatcattcatagtaataatatctatctcatacggctgttgtgagggttaaatacagatgtaaaatgctacagataacacagcacatggtgaatgttctataagtgtttgctgcctttcggccggaaccgccatcttccagtaattcgccaaaatgacgaacacaaagggaaagaggagaggcacccaatagatgttctccaggccttttagaaaacatggagttgttcctttggccacgtatatgcgaatctataagaaaggtgatattgtagacatcaagggaatgggtactgttcaaaaaggaacgccccacaagtgttaccatggcaaaactggaagagtctacaatgttatccagtatgctgctagcattgttgtaaacaaacaagttaagggcaagattcttgccaagagaattaatgtgcgtattgagcacattaagcactctgagagccgagatagcttcctgaaacgcgtgaaggagaatgatcagaaaaagagagaagccaaagagaaaggtacctgggttcaactaaagcgccagcctgctccacccagcaaagcacactttgtgagaaccaatgggaaggagcctgagctgctggaacctattctctatgaattcacggcataataggtatttaaaaaaaaaaaaagacctctgggctgttaaaaaaaaaaaagtgtttgctgtgattatctttgttattttgattaaaataagggtctcactgcttaatgagtttgaaagccatcaacttaaacgaccccaaagcttcctctggttttgatattttagagcactgacactctaaaacattaggattctaaaattctaggctgtgtcccacctgcaaaaggaacagggctaaaggaggggattacaaagtcaggacaggctgggtgcggtggctcacgcctataattccagcactttgggactggtggtcaggagttcgagaccagcctgaccaacatggtgaaaccccgtctctactaaaaaatacaaaaattagccgggcatggtggcacatgcctgtaatcccagctacttgggaggctgaggcaggagaatcgcttgaacccgggaggtggaggttgcagtgggccaagatggcgccattgcactccagcctgggcgacagagtgagactccatctcaaaaaacaaaaacagaaacaatgtcaggacagagccagaaggagtcaggctgcagagacccgctgagcaaagggtcatcatcaccatcatcctcatcattcatttatacctcccctcttgccctgttccaaaaaggctgcagacagcttacaaagatgcacacttaacagccaagagaatattaactaaagaaatataagaaaaactcaggcagggcaggcagatggagcctggagtgaggcaagcagacagagagcacatgctgaatcccagagatctaggaaagggacaactcatgtggccctgagcttgccagcagccaatgggaagaaggaaacctgaccagtccctagattccatgtctcacaatgtaaaaacaaaccagttgcttagaaaaagcacaactatccctgatactgagagcagggaatgtcccaagggacaggcttgtctggcacccttctctgcctcatcagtggggctggcatcccctcagagtctgctgaccatgaccctttgaagctgaagccaggggcagaggctacagtgatcaaagattcagggagctggaatggcagtccagtcagtaccccaccaacctcaccccagcagccttggtctaggcaggattacccatcactccccaaacccgaacacagccagtgcccaaaatagctagagcaggagagggtgccaagaggccctggcaagggcctgggctaggcccacctacaggagggcccagtgggccaatgcacacatacctctggtgcacaaagaggcaccttcagtcaggcacagagccgtccctgggagtcccccacccaccaggctcccccctcagctgcacgttgctcacgcagaacttgagctgctgctccacccttcccacaaagcaggccttcctgcctgagccagactagaaaagccttccacagaaatgccaccgcaccatatagggaagtgcctgaagacctccccgccccacctccagaatctgccagaatcagccccctcaggatcctccatggcgatgttggttcctccctgggtcccccagctgcagaccaacacaatgggggctattctgggctgcacggggtatttaaagctctgactgggcctcctccctggggaacaaaaggccttgccctccgtaagaccttcctgaaattgttcctgcccagactgtggtggctgcatcctgtactgttccccacctcccctgccaggccctgaggccctgtaagattcagcacaaaatgcctcctccaggaagcccacagggctgcctcctgtgctcagcagcactgcctgagaccctcagaaaagctgggtcctggctcaactctgccatcgatcttctctgggtcccagttttctcatctgcaaaatatggatgtgaatcccagtgtgtgaaagcactccagaggcttccatggttaggatgagtagtgtctctccagccactttgtgaagcagaatataagcaggaacgggaattggtctgttttgtcgctgccctttttctagcacctggcacacagtaggtgccaaataaatatttactgactgatacaaatatttaaagaatgtgtctgtagcctccatagaaccacccagaatgccaggcacacaggtggttaataccctcgatggtaacgttgccagctctcagcttgagcacaaagaacacatcaagccttatgctaagtacctgatgttaattatctgatttaatttgctcaacagtcccaagaggtcggtaccattatcttatttcacaagcaagaaaacgggagttccagtccaggtggttaagcagctcgcctgaggtcgcaaatggccaagctgggagtcaagcccaggagccctgaagcccctggcatcctgcgccaaatgcacattgaagaaaggcagtcggagagcactgggtggggagccaggagcctgaagtcagccactaagctgtgtgacttcaagcaagttgcttggcctctctgaatcagttttctcttccataaaaacaagggcatgaattcctcttcttcaggtcgttggtaggatcaaaggaaccaaagatgtgactctgtctcccacactagccccagcccctccccaagggcagcagctgtgaaggatggtgggaagatgtactgggaggagggggctacccagagctggccccagaacaaagctccacagctgctgacaacagctggggagagctctgggcctggcccaagcagggggagaatgggcaggctgggaagtcacctctggccctcctctgtcacccttccctgctgacagctgctgaggcctcagggccaagggccccagagcaggcagggagtgggggtgtggagggggtgggcgggctggctggggtcatcttagtcctcatgctgtcaactgctcaagcctcagggtgcctggcctcgctgtcccatagcacagccctttacccagttccctgggaagcctgggtggagaggccggagcaaaggtctggggctgaacatgccttaactggagcctggcctgctccagggcccccgtggggaggtgcagggccgggagggagggagtcctgaagaggcttgcaatttccctggtgcacagccccactgcaggcccttcaggaaacgtccctggaggctgtgagcttggcccaccccagcccatctcagccccctcagctgccggccagcccagctccactcccagttcggtgccaagcctttccagcccgctccagcccacgcagctctctctcctctgaactctcacatacccataattacaactgaccatattttccaaagcagaaatcaagaaaccactaaataaaggatttctgggctacttctgagtgtcagaggcagcctgggaggtgaagtttggatgcagaggtattcaaatctctgagacacgttgatagttttttgcgatgactactatatctatcatattttattaataagtcaaagccatcctaggaaatgtgtgttgggcacatgccaccccataccactgttaactgttgactggacactttagcctggcagtttcctagctgtgtggccctgggcaaatcacttgacctctctgagcctctgtgtcttcatctgtaaaatgggaataaaaatgaccccctcacaaggctgccgtcagaattcaacaggacaacctaagtgctagtatcaggcacttacgaggtgtaagtaccacttcttccttctctcccagtcctatccaccccagagctcacacaccaagtgagtgagctctccaaagacccccggggagaatgagacacaagagaaacctgcctgcaaaaggttccaatgcattcctggatcctgtactgtccaagctgggagggatcacctagccaacaccctcacttatcagatggggaaaccaaatcccaaagaagggaagtgagcatgttatggggaaccaaccagacttggagggcctgggttcaatcccatctctgacacttccggctgctggggaactttatcactttgagcctcatttttgtgcctcccatacccccataatgttggattaataattattgctgggcgcagtggcttgtgtctgtaaccccagcaatttgggaggccgaggcaggcggattacttaagatcaggagtttgataccagcctggccaacacggtgaaacctcatctccactaaaaatataaaaattagcacagcatggtggcatgtgcctataatctcagctacctggggagctgaggcaggagaatcacttgaacccgggaggcggaggttgcagtgagctgagattgcaccactgcactccagcctgggcgaaagagtgaggctctagctcaaaaaaaaaaaaaaagctggattatgtatacagagtgttaagaatggtgcttttgggcagccgtgagaagagagaggagcctcccagcaactcgattggcagaggcagatccaggacccagcctcttggttcctaacaaagggtcatttacctttcacgaagccacctcctcctctccttggggcaaggattctcaaaggccaggataaggggctacacagatgaggcctctgggagggtggcaatgggctaggtctttgtgggggtgctaatcagggccagagccctcagtctcaacctctggcacccagagctggtccctccagcctgtcttcaagccccagtcagacaggcccagcctaggaaatggcaggaagggctggcaagggagggatgccgtgtccttggcaaagagaatgcgacatcccagggactcgggttaccggaaatggtaaatctccccgctgcctgtcaccttcgaccaggaatgtctgctgccccagggaacatcctgtccacctgccctcagacagcccacggacagccaggaacctggacccactctctgctccctgcccaacccccaggccttaggttagctgctgggtccccccagccaaagggtacctgtcattctggggcagtgagcccggctgtaactaactgaccaatcccagggaaggagccatcctaggaaatgtgtgctgggcacagggaaggaggagaaggctagaaggggaacccccaaaagattgagagctacccccaaatctgatccatccaatcccatcatacgtggattctgagtccccagtttggatgaaggctctgatctcataaacccaacacaagaggcagtacagtgtgagttctgggtgggactaacccagccggaggcatggctctgccgcttgccagctgggtggctctgggtaaggcactgcagtgccttccgccctcaattctaatacaaaagtgacagcagcctgtgacaggaacctgtgaaatttgtggcgctaagctgtgagtcatttagcccaggatctggtgtgtagagagggcccagtaaacagtggctattaggtattgggaagtattagaaagagaagggggaaaaaacagtaatcattataggagcaggtactatgagccacacaatgttctctgcccttgctggtgctgaccgtctacttggagaccgatggaccataaattaataccccaaatatacatgtcaaatggtgagagtgctgaaaaggaaatacagcagggtgaggggacggggagtggcctgttgagggttgctatttccctgggtatggagggtgatgctgacagagcaagtcaggtgcatacttagaggaagagcacccaggcaccaggagcagcatctataaagaccccagaggcaggaggagcctcagaatgttttggaaaacagccaggaggccggttatctaacccccatgactgccctgagagctaggtgtaattgtctctatcccccggaggagaatctggcagggccaggatctgaccctccatagccaggtgtccagggacgactggcttcacaactcccatggggaggagcagaaaggtagaaaagcgcaggtgtctgagtccaagctctgattcttccagggattggccatgtgatctcagaccagctgcagctccttgcagggcctcaatgtccttgtcactcatgggctagagatgcctgttccatccacttcgcagatgactttctcctccccaaaaggaaggggaggagaaaggatggtgctgggaggtgaccttgagcttctctggcatctcaggccaaagctcctccccgggcaggtgtgaatgccaggtgcagaccctgcccacctgaactgcccagagcaaccacctgcctgacccccaaaagctcacatcctgcctatgcctgcctgggccttgtcccactcagcacccagagcccagccacagccacggcctctgtcctgcactctggttctgggtgtcagacgtccctcacccccagggcccagcccaggaccggctccttatgttcctgaccaggcggagggtccatgattggcctttgttacctttgttaccaagggtgccagcgggccagccctcacgggcacccggccagatcgtgaggcccagccaagtgcaaacagcacacttggcgccctgatacgggcgcgttagagcgggcagggtgcccccgtcacaacaaaccatcatctctacaccgctaaggggcccaggcagccggcacctctgctgggagctggggactagggactgccaggggaggcctcctccccttctcccactgggaatgggtagtgggaatttcggagcccggacatggagattccagatgccagcagctgaaagggcagatatgcagacaggctgcagggagcacgtgggaaaataacaggggcagaggagctggatgaaggcaagtcatggagtttttcacattatgggtgtggtcaggcaaagggagagtgagaggctgccgagaagaaagcaggaagagcccagcagagagaggagcagcaagaagaaccaatgagagctggaacggttccaatatgggacagggaaccagggataatgaccacagcaactccttccagcaatacccagcacttaacatacacagcgcttccgacagaactttctggtgcaatggaaatgttgcgtgcctgcactcatccaataagatagctactaagcgcttcaaatgaggctagtaccatcaagaaactgaattttttgccgggcatggtggctcacgcctataatcccagcactttgggaggccgaggtgggcggatcacctgaggtcaggagttcgagaccagcctggccaacatggtaaaaccacatctctactaaaaataaaaaaaattagctgggcgtggtggtgtgtgcctgtaatcccagctactcgggaggctgaggaaggagaattgcttgaacctgggaggcagaggttgcagtaagccgagatcacaccactgcatgccagcctgggtgacagagcaagactccatctcaaaaaagaaaagaagaagaagaaaaaaaaaaaaaggcctggcacggtgactcacgcctgtaatcccagcactttgggaggctgaggcgggcagatcatgaggtcaggagttggagaccagtctggccaacatagtgaaactccatctctactaaaaatacaaaaaatttggttgggtgcggtggctcacgcctgtaatcccagcactttgggagaccgaggcgggtggatcatgaggtcaggagatcgagaccatcctggctaacacggtgaaaccctgtctctattagtaatacaaaaacacaattagtcaggcgtggtggcgtgcacctgtagtgccagatactcgggaggaggaggcaggagaatggcatgaatcctggaggcaaagctcgcggtgaaccgagattgtgtcactgcactccggcctgggcaacagagcgagactctgtcttaaaaaaaataaaaataaataaataaataacacaaaaaaaattgccagtgtggtggtgtgtgcctgtaatccccgttactccagaggctgaggcaggagaattgcgtgaacccaggaggcagaggttgcagtgagccgagattgcgccattgcactccagcccaggcgacagtgcgagactccatctcaaaaaaaaaaaaaagaaactgaatttttatttaaaactttatttaattttaaattttgcattaaatagtcacgtgtgactagcagttaccatatcagacagtgcagattataccatcattgatccttaggccaaggctggagatggagctatctccattttacaaaggaggaaactgaggtttgccaaggctgcacagctgtaggctgcagaggcaaaatcggaaccaggcctggctctgccacagggctccccacccatggttattgtcaaggctggaaacggctaacggaaatcgaacatgtgtggtgataaggctgcctcgttaatcaagatatcaagtctgtctgcttttggcctgaattctgtcagctacaccagttatcacacgctgaccagaagttctgaccgcctgtttacaaaggtctttgattttttcacactaagaaagggcagaatggctgggcgcggtggcacatgcctgtaatcctagctcttcgggaggctgagacaggtggattgcttgagcccaagaagtttgggaccagactcagcaacatggcgagaccccgtctctatgaaaaatacaaaaatcagccaagtgtggtggtgtgtgcttatggtcccagctactcgggaggctgagatgggaggatcacttgagcccaggaggtcgaggctgcagtgggccatgatcgtgccactgcattccagcctgggtgacagagcaagaccctgtctcaaaagtaaataaataaataaataaataaataaataaataaataaataaataaaaataaaagacagggcagaatggggatggaacagtcccagttggtcgagaagccatgtctttaagaacactgagaatcttcaatggcaaaaaagctgggcttggacttctccacccatcagccccctgaggctcctaagaactggacgacacccactcagggtaacacagggcacatttgcctgcctctaggcctttagtcatgtggttccctcttcttggaatgctgttcccatgcccttcgagctaatctattcatccatccttcaaggcccactcaatcaccacctccactctaaagactttttggaacccctataaagacatccttctccctacaaatatgtggacttaatttctacctcagaacactagagattcagtcttaattataatcacttgagttactgtctcttctctcctgctggaaccaaagctccttggggacagacaccaagtttttttttttcatcttttaaacatatgtatatattcaacctttagatacttcctaatgtccagcagctaggggataataaacaaatacttactatgttgaactgaattataatattggcttataagtttgaggactcaatttcttatggctcttcccgagcctcctgtgatcccagcagaggagtccagacccttccctgcactgaacttcaatgtgtacctctgtaaaatgggacaacaggccgtgtgcagttgctcacgtctgtaatctcagcactttgggaggccgaggcaggcggatcacctgaggtcaggagttcgagaccagcctggccaacatagtaaaaccctgtctctactaaaaatacaaaaattagcagggtgtggtggcgcacacctgtagtcccagcttcttgggaggctgaggcaggagaatcacttgaacctggaaggcagaggttgcagtgagccaagatggcgccactgcactccagcatgggcaacaaagtgagactctgtgggaataaaaaaaaaaaaaaggaggggtgggacaataatagtacctgccttattgggagattatttgtacttactatatttatttaacactatgtgccatatacttgacaaacattgagttatcttcccaacagccccacaagatcggtattattattaccaccctcattctatagaggagggaagtgatggtgaaattaaatagatcaaagagctaatgcaactcaagtgctcagtatagtgtgtggcacatgctacatactaaataaattgtattaacagttgtggagctttatttctgaataataaagggtctacagaattaggggaaattgaggatacttccccagggctgggcacatagtcagcgttctccaaatatttgctcctagaccgtctcagtcccagatgtaccagtgatagatgggagaaccctaactaagtccagggccacccctctctgattcccctccccactgggctcctccccctctcctctgatctatagggcagtggctgctgctgcccgccctacaggccatgtcagtagagaaccgctttcctgcccccatctttccccaaaggcaggcagcatggaatgactttggggaaatgacctttgtccagctgtgccgagcctgcaggtgaatggaaacaagagagtctgattaagtctcaaaggggctgggcgcagtggctcaggcctgtaatcccagcactttgagcaaccaaggctggcggatcacttgaggtcgggagtttgagaccagcctggccaacatggtgaaaccccgtctctactaaaaatacaaaaattagctgggtgtggtggtgtgcacctgtaatcccagctacttgggaggctgaggcaggagaatcgcttgaactcaggaggcggaggttgcagtgagccaagattgtgccactgcactccagcctgggtgacagagcaagaccctgtctcaaaaaaaaaaaaaaaaagtctcaaaagcaagtaatactctcaactttcttcagtcctgtcaggggctttgacaccctattcttcactgaacccccacctggaccaaagaaagggaagaagggaagaatctgggaagagtatgagcattgatggagtttctatggcagtcatctctccaggggtggttttcaggatgaaatgagacagcagacggaaagcagcccttctccagctttaacgagcacatgagtcacttggagatcttgtcggcgtgcagattctgagtcagtaggtccaagggggcctgaaactctgcatttctgacaagctcccagttgaggcccgggctgctagtgcctggaccatcctcggagttataagaacataaagggattactgcacacagtaggccctccgtaaaagtgagctatgcctttgtttcttgtgatttgatctataagaaattctcctaagggactggaactgttttttcttttttgagacagagtctcgctctgttgcccaggctggagtgcagtggcacaatcttggctcattgcaactgccgcctcccgggttcaagcgattctactgcttcagcctcccaggtagctgggattacaggcatgcaccaccacacccagctaattttcatatttttagcagagatgaggtttcaccatgttggccaggctggtctcgaactcctggcctcgagtgatccgccagccttggcctcccaaagtgctgggattacaggcgtgagccaccgtgcgtggctggaactgtttttccactgctgctaatactgaggtccactgaggttgaggggtttgcccaagcacagaaggctagaaagaggcagaggcaggattcaaggccaagtctgccaagtcacccttctcatgcatcaccccaccctaaaccccacccgcctcgagtagcagccacaggcgtggagctgaagacaccccagctctgcccctcaggccagtcaccggctccttgctgggtcagccaggcctccgggcagaggcccaggctccctaaaaagaggcgctgggccatcactttcactccactagcagcagcttccagtggttccccccacatcgccttataaagtggtccaagctgctcttttccaggctgcagtttaatgttatatggagtgaactgaccgtactctctctgcaacctcagcctgcctgcttcacacattcctgttggagcaacattacctaatttaaccatagcccctgctctccggggctctcaaaatagcagctgccagtaggggaaaatgccctaatgttatcaaaataaaacagttctccctcctcccccactcctggacttcgccagcagcaggacccagcccagggaggaatccaggctgagaggtctgaggtgggcctagcgtggctgagatctctgctaagcccctgttctcttcatccttccagccctttcctacatgccctcttcaaacatgtgtctgggatctgcctatgcctcctcccccgggcagatcttccagctcatccccaacggccattgtcaccctggttacccaagacgaagattcaatttccctttctcctaataacaaaaactataacagtaatataacaattgctgccattccccaggtattaattgtgaactaaatacctccctcccagtggctcgctgccattgcaaagtagggattagcattctcttctttcagataagaaagcagccactcagaaaggtaaagtgacttgcccaaggtcatacagcccagaactggcagagttgggggttggaagccaagctcagctgccccaaagccctaatcatcaggactcctgtgcagggtctgagcctgggagaggaggagtgcaggattttctgtgctagaagcggcttccttgccttgtgtattattgcaggatctgttcatacagctgccaccaaaccacagggcctgttactataccagagttcacattgcacctagaccctgtgggccctaagactgtctccgggaccccaggtgcacaagctacctgtcaatatgtgactccaagcccctgcttccctgccccgcataccccagagcaggctgccacattaaagcagggaacaccggactactgacatacctcgggtgcaaccagtggttaaggggctgggagggtcccctctgctgctctcctgctcactcagagtaatcattaaccagcgcagagccagtgtggaaagcaggcagaagcccgggctgcggcacccccagcatccgctcctccctactgagtgtgtcctggggccacttctgttaagcccagctggcctggtgaggcctctggcagtggagagggaaagcttggaccaccagctgtccaggaaggctcaacctgctatccctagggaaggtccctgagagcatttacagagccttcggccccctgcactcacactccttcccaccttgctcccctcccaacattatgaagatcccataagaaaagagtgttggaggagaggatggactctgggacttagggccttcccatagcgggggtgaggtggcaggtggggttgcagggggacgacacaatagaactgagacccagaggtttatctaggaccaagtaccaggggctctctcgaaggaggaaagataaaatcacaaaataatagttcccgttatttatcaactgcccattccagctgtaggctatttatatgatctctaatcttcaccaaaaccctgcagtgtaggaattgccattcccacctgacagaggaggctcagagaggcgaactcacccgcccagggtcacacagcaatcagtgatgaagctaggataggcctcagggctatgcctcctgcctatgacactgtcccaaagtgcaacctgcagaatgaaacggtgcggaattgatggacgggagctaacagccacagcaaggcggctctgggctcttttctgggcggtctgaagcctttcagctccttagccagggtcctcctggtctttctaaaaccaagtgtcctgggcttagaaacccaaactatgagagggcagtggagggagcaggagagagtcctgttgctagagagggtgcatccccccaccacttgaagtatgaagtaaaggtggcccctggggcttctagtacctgtcagggcacaaggtgggtcttctgggagatgaggtggaggtgtggggggaaggaggaagcacctgaagccaacgtaaggtggagcctcttggaggaaggtggccctgcctaaaacccccctgcctaggaggccacagtcctcccagctagagaattcccttcaattgctcaggtgaaaccagaggtggggcccaggccggctgaaagctttgatcttatcacacattcctgccctagccatcccagtaccccctcctcgacccctaccagggaggtgggaagccagactgacttaattaaccctttcctcccatttcctcaagtcgaatccaggcttgagctgatgtttcccccatcccgcccccaccccgaccccagaaggcggggagggaaaaaagagggaggaaagtgaaaagcaggcaccccaagactgcgcccttcatttaacccactcaatgccagggaaccccaaacctgggctctgttggcagcttccatttctcctaaatgaaaataaccagactcagccgggcacggtggctcacacctgtaatcccagcactttgggaggccaagggaggcggatcacctgaggtcagaagttcgagaccagcctgactaacatggtgaaaccccatctctactaaaaatacaaaaattagctgggcataatggcgggcgcctgtaatcccagctactcgggaggctgaggcaggagaatcgcttgaaccaggaagcggaggctgcagtgagccgagatcatgccattgcaccccagcctgggcgacagagcaagactccgtctcaaaaaaaaaaataaaataaaataaccagactcaacataaatagccctcgctattttgcacatccatgagctcatctgagactcacgataaaatcggcctgcccttctctctgctgctgtgggccctccccctgccctcacccaggggagctggctcccaggtcctctcctcccacaggctcactgcaagggaaacagactcacaaatgagtgctgagaccaagtcacaaagactcaagagatctcccagaggtctggtggccctgaaatcctgctatagtcctcgagtgtcttccttgaatgtagcctccttctccctactcctttaccagctggcccaccactcagcctctctcccctatcagaccacaagctccataagcccacggtggtgtttagatccaacacaaggcctcgcataccgctgtcactccgagaatgtttgccgaatgaatgaacggtcccattttgcttctggggaaaattaagctcaaagaagttcaatggcttgggatcacgtaagagtttaggaatcttgtgactcctagtcacactttctaaacagacatttacaatgaatgcccctgatgtcagcttagcagcaggtacccaagagcagaggtgaactgacatggacagagcacggcaggagagattctggggctacacaagaagacaggacaggcttcaaggtctagggcacaggggccatctccttcatctgcttccctagcccagagcctggcacttgggagctggggttatgcctccatttcccagatgagaagtagctcatggagcagggaatagccaggcgcagaggaaggtggaagctgcctccagcgtcaccagacatcctggaagaaattggaggcatggtccctactctccggatgccttggatcttgttggagaggcaggactcgtaagctataagtgcccaacacaactcaaagtccagaaaataacagtgtcaggggaaggaatcaatagcgtcaatgaaggaagacatgggattggtgatatggtgggctccttgaggtgcctaccaccctcaggccccagagaatggaacaccaccaacttttggggggtagtgagcagttttctccaagaactcagggtccctttcttctgcttggaagacggccaacaaacaagaaaggagcccatcttgtgagtaggaaaactgaggcccggggaggagagatggtagctgactggtgaccaagtggaggcccaggccttaacctcttgcctccctggtctgaccagcaatgaatgtcacctcagctatcttggggacttcctcttattctttcccaaccttaacgactctggcagcaagcgagtgtcttcctgctcttgcacatgcaacaacaatgtggacaatgtgagtccagggacaatggggacaactcctggacccctgccacaatgctttcctcctctaccagccaaatcagacttgctctttaagccccatttcctctagaaagtctttccagataactcatgcccaatcagtcttttccttcccctgacactctgctattgtctggactttgagttgtgttgggcacttatagcttacgagtcctgcctctccaacaagatccaaggcatccggagagtagggaccatgcctccaatttcttccaggaggtctggtgacgctgaaggcagcctctaccttcctctgcgcctgactattccctgctctctgagctacttctcatctgggaaatggaggcataaccccagatgtacagggggattgataacacagatcaaacaatgagcgcgatgtcaggcgcacagcaggtcctcaggcagcactagctgaatatgtgaacaaatgagtggacagagggatggatggaaggattcttgaagcttccactgcacagggctgttgaaacaacacaacgcgggacctggatgtagatttcatctcgcagctgagccatgtgcttctctgccttgcatttcacccaagcccccagtatgagggggacacagggctggctcagagcaggccccgctcagcaaaactcactgaactcccaacagggcaaaacctgcaggccccacagggagcttgggacctgactgagaagaatcagggttcccaggggtctcagtcacagggaaggtcacatccatctctctggggaacattatcactgggttgaaatggaagccaaagggtaaaaagacacccgagtctgtgaagcaggaactggcaaagcccatgtggcagacatgcagcctcctataaccctctgccaaggccagcctggacccaccttctccacacagccctcccagacttcctctgtctggacacaacaggacccactgaggaaaacaatgatgacttgggagtctgacaacctgggctccattcccaggtgtggcacgtactggatggatgaagggccagccattccctctatttttttatttttatttttttttttgagacagtcttggctcactgcagcctccgcctcccgggttgaagcaattctcctgccttagcctcccaagcagctggcactacaggcatgagccaccacgcccggctaatttttgtattttcagtagagatggggttttaccatgttggccaggctgctctcgaactcctagcctcaagcaatctgccctcctaggcctcccaaagtgctgggattacaagtgagaatctggcccccaactccccctcctgatgcctcagtttcctgccctgcaaaatggagatataatgccaacttcaaaagattgctgtgagtattatatgcgataatgcctggcaagagcccagtgggaggcctggctctaaagagggtggcagttttaatgagaaggtgtcagcactcagggaacattgactggtgacctatgtgactgaggccactggggaggagaacctgcaggtcccaggacagggaagagactggtctgtccccaggaaactcctgggtttctgttcctctggcctaagggtcatagcaaggcaaaaggcaggaaagggtgaagagccgtgaaagtgatagaggctgctgggcgtggtggctcacacctgcaatcccagcactttgggaggctgaggcatgtggatcacctgaggtcagaagtttgagaccagcctggccaacctggtgaaagcctgtctctactaaaaatacaaaaattagccaggcgtggtagtgcatgcctgtaatccataatccctgctaccagggaggctgaggcaaaagaatcgctattgaatccgagaggcagaggttgcagtgagccgagatcgcaccactacacttcaggctgggagacagagtgagactcagtctcaaaaaaaaaaaaaaaaaaaaaaaaaaagagagaaagaaaatgatagagtagaggccactagggctgggatttatcaggccagaatttcaatccatccagcccagtaagggatccaagaagaggcatgatcccagttcccaactatttgaaaattggaaacgccaaacaaggagagggttgagtcagctggggttagttaggagggggaggccaggaccaggaggtgggggccggagccggcttcctgggagagagccatgggcaggcgcagggagtggggaggtggtggcagggacccggaggtgggctgggaaggggccagaggcagctgggaatcccagccccacccgtggagaagcatctgtggagtgacccgaggccacctctgaagtcctccccaggctcaggccccagccaggcctccccttccccaccgactgggatgggagaaagatggggaaagaggccaaatgttacaaaacacctaggtgtgacccgcctgatggggaggggggacacatctctacccaacagcccaagcccaaagcatagggtggggtggggtgagatccccaggcctgtgtgtctctctctcctgagtcctgctgtttctctgaggccacgggagccagatttagagtcgagcagccccacatcccaccaagtaaggaccaactgcaggttggcccagagctccccaggcaaggtcctgcctcctccagtgtaggccagggggggacagggctaggatggggtcccaggacatcccccaccccccccactgtcactaccctcaggatgcacgaacatcctttctgcacccatgggagcccctggccacacctcctgttgctcagagcccaccaactgcacacatctgggaaggggacaaggcgtccaaagactccagcctttcccaggccacaccctggggtgtgcccccctccttctcccagtccaggaaggagcaatcagggtggaaggatggactctgtcctacagctgcggcctcggtaggcgaaggaggggcagtgacagatcagaggcagttacacccggagctctgagactgcgaaagaggcccagggaatggacaatccccttacacagccattcattcaacaagcccagtacaggacctgggtcatagagaaggcgtgcccggctgtgccctgggaaccctgcctcagatattccaccggccttgtctttagcaggaacgagacttagtgcaatcacggattgtcaaatacctgccacattccaggcactgagcaaggtgcatccacctggttacttcataaccaccaggaagcaggcctccccatttcacatttgactgaggctcagagaggtaaagcaacttgcccaaggtcacagagccagtcagggctgggccaagacttgaaggcagggccttttgagcccacatctttcccttgaccacagtgcccagggaagtggctctgagaccaatgaggacacagacaagtcaaaaagggcagagtggacatcccagcttgtcccacatcttctggggccctgcagagagcatggctgggcaggcagctcccaagtgcaggggccagagcacgcccctttccaatctcagcaaggagcctgggccttcttggcctgctggcttcctcaaagccattaatttgctcacttgaatttgtttgtttgtttgtagttttgagacagagtctcgcaatgacgcccaggcttgagtgcaatggcatgatctcagctcactgcaacctccgcttcccaggttcaagcgattctcctacctcagcctcctgagtagctgagactacagtcatgcaccaccacacccggctaacttttttgtatttttagtagagacggggtttcaccatcttggccaggctggtctcgaactcctgacctcaagtatctgctcacctcagcctcccaaagtgctgggattacaggcgtgagccaccgcgcccatcctttattcacttgattttttttttttgagatggagttttgttcttgttgctcaggctggagtgcaatggcgcgatctcagctcaccacaacctccgcctcccgggttcaagtgattctcctgcctcagcctccctgagtagctgggattacaggcatgtgccaccatgcttagctgatttttttattattattattttcagtagagacgaggtttctccatggtggtcaggctggtctcgaactcccaacctcaggtgatccgcccgccttggcctcccaaagtgctgggattacaggttgtgagccactgtgcccagcctcacttgaagttttaatgtgttcacctactatctgcctagcaccaggcaaacagcaatgaacaaagccaagtccctgccctcatgcagcttccactctagatgagggggtaagaataaatctacaagccatgagctccggctgtggagttctaaggcagagtctgcaactccacaaatgaacactcagcaagatcccctccgcctacaccataagccaatgcagaggccccagcttgggtggggacgggggagctcctggctggagatgggtagggggatgactgccaggcatgtgagccagtccaacccccacccatgctgtcccctccatcacttgccattcttttttcttttttttttttaagagacaggatcgcgttctatcacccaggctggagcgcagtggcaagatcatggttcactgcaacctccacctcctgggctcaagtgatcctcctaccttggtctcccaaagtgtggggattacaggtgtgagccaccactcctggcccacctgccggtttttttttttttttttttaggaatttttattgtccaaacaagagatcgtaagagaagacacaaataaattaactgttctgagaattctggactccacctcctgcccactcctcctggaactttcccatctcaggtagtggcagctccatccttcgggatgctgaagccaaagactgtggaggcatcccggactcttctctttctgtcccgccccacatccaacccactagcaaatcctggtgacccatcttcaaaatgtactggggattcaaccatctcccacctccgtggtcctagcttgagctcccatcgtctgtcctgggtcacggcctccttgcctttgctctggaccctccccgtgctcctctccacacagcagccaaagcaatcctatggaacaccgggccccttcagtgacttctcaattcactcagacgcaaatccaaggtccttcccatggccaaagctctgctgatcaccctctgccacccccctgcctgctgcatccaccatgctccccctcactgatgctgctccagccccacgggcctccttgcttttccacagacatgccaaggacactcccacctctgggcctctgcactagctgtgccctctgcctggaatgccctttccattgatatctgcgaggctcacccgctcacttacttcaggtctccttcagttcaaatttatcttatcagaggcttttcctaccaccccaccctacctaccccgcctcatcactcactgccctcttccctgttttattttttcttctgagcacttatcaccacctgatgtatttcatttattgtctgtcttcctgcactagctataacgcaagtgacatgagaggaaggaatctgacatttttattctctgcggtaacctcaagatctagaacagggcgggtgcagtggctcacgcctgtaatcccagtgctttgggaggccaagatgggtggatcacttgaggtcaggagttcaagaccaacctggccaacatggtggaactccatctctactaaaaatacaaaaattagctggacgtggtggcgtgttcctgtaatcccagctacttgggaggctaaggcaggagaatctcttgaacctggggggcagagattgcagtgcggcgagatcataccactgcactctagcctgggtaacagatcaagactccatctcaaaaaaaaaaaaaagatctagaacacagtcagatacatagaagatgctccacagatatttgtgaaatgaattttaaaaaacgcttaatcacatacatcatttgttcattcattcattcaacacactctgcaaggctttgcgcaccagatactcccctaaaacccagagcaacaggacaccctccttcatggctcagggaatgggccctggtcaggagctaggagctggtcctaaggctatctcaggatgccacagatgcctccagggatgctctgaggttcctgcaggcctggcacagatgagcatcatggaagggaagggagagtggttctgggggcagcaagactcaaaggcctcacattcccaggcctcaaagagccaccttgttctcagggctttcatgacagcacccccgacccggccaccccagcagccacgagccacacccctctcaaggctgctattgacacagccctgacgccaccaggctgggcagtgaggccggcggctccccgcgaagtgagttccacacatacttctgggtttcagtcagccagctctgggtgctggggcagctggccccgggagcaggagggggtggcagggccaaagaggccaaggcccaggcggaagcaacattccagcagggccgggaccctcggcgcagcctccctcttcttggcaggagcaggagcgagaggagaaaaaggccagggtaggccctgggacagggagaggtaggcccagcagatacttgggaagctgccggggaaccaagtcatattcacttcctcctccagtctgacccctcatagctgggactggattgggtgaaggggaggggggcaacaggccagggctgggaacccttcccatataccccaagtagtctgagggtgcagagcccacacctctggcctccaagtggcctctgaatcattgctccagatctttccatagcctgggcaggccctcctgccctccctcctgagcctctcaccccaaggccaggcagcccttgaagctctgcagactcaccctaaaccttgagcccccagggaacagccagaaaaaaacagcgcaggctccacacaggacaaccaggagggtgttcttccccttcccccactagcagcatggcaggggcaggggcccctgacctcccacactgggcagggccagcctggcccactcaggcctaaaagtccctggataaattcaactgcctgtagagtcccaggaaatatctgatgagaacattaatgaattaacaaacctaaaaatgaccaccctagagttcctaggcttcccctccaggcacaggcgtccctaggagaccccacggacactgaggcatacccaacctaagagcttctgtccccgagccaatccctgatattccttgcctgaggtagcccctgtactacttgggaccagagttcttaatcaacatctgtgacaagttgtagcaatatctactgactgcccacgacaagcacatggggcagtacgtggcgtgattaggagagcttcgtctggattcaaaacttggcttgcagcatctctgagtgtgtggatatgtaagtcactgggcaagttacgtaacctctcagtgcctcaatgtcctctgcttagagaatggggatcaggctagtagctacagcttaaaacattcgacaaagatattcactaagcacttactacctgccaggtgctaagcatacagcagtgaacaaaaacaaatgaggtcctgctctcgtagaacttaaactgagcaggaggaagcagataaacacataaacaaatacagacaaatacaggccagacaattgtgagaacaaaaataaagcagtttaaggagacagccattatgggaagagtggtaaggaccagaaagagggagagggtcatatggatattacggggacaaatgtcccaggcagaaggaacagcagacgcagagaccctaaggtgggagtgtgtttcacatgctcaagaaacaaagccttggtcaggcgaggtggcccatgcctataatcctagcacttcagaaggctgaggtgggaggatagcttgagttaaagagtttgggaccagcctgggcaatacaacaagatcccatctctatttgttttaaatttttatattcattagaaaagaaaaggctgggtgcagtggctcacgcctataatcctagcactttgggaggccgaagggggtggatcatttgagcccaggagttcgagacctgcctgggggaacatggcaaaaccctgtctctataaaaaatacaaaaattagccaggtgtagaggagggtgtctgtagtcccagctactcagggggctgaggtgggaggatcacctgagcgtgggaggttgaggcagcggtgagctgtgattgtgccactgcactccagcctgggtgacagtgtgagaccctgtctcaaaaaaaaaaaaaagaaaagaaaaagaaacaaagactggtatagctggaggagtttgagaggagcaggtggcaggaggccgggtgttgcagggcctcgtaggctatattaagtcaggggctgggacctaattctgagcaccgcagggaggtggtgagcaggaaacacaggtgaatgggaggattcactgagaaactcagagcagacagtgggtactgggtaagtctgaagtacccgtattactgtgtcatcatccagcctggcaccccaagagctccttcccctccactttgctcacccgtcttccgggccctgaacccagtcacctcctgccaccttctttccaccgtctcccgggcagggcttcagacccacagatcctaacttgtctgcgctcagcctgagagcaggcccgggccaagccaggcaggggccacaactccccagacagggggaaatgggcctaagggatgggggggtggtccatctctgccccttccagcttctaccctgcagacagacctgcagcctgccctccttccctccgggaatgtccagggcacactcaaaaccccatcctgtgccggctgcaggtacggaacaagtaggctagtgtcaggtgacagagcagctggctgcgtggaggagggctgagggaccgccaggaaggggaggctcctgcagttcagctggcagcctccccagtgaggaaatccagctgaggcaggaaacaggtatctcagcgacttccctcctaggccctggaaaacaccttaatcaccaccgaggctccctcaagacgcctgtcccctgcagggccgccctaaaggggtcagcaggccaaggcctgccgagtcacccaggcccagccccctcctccagcaagcctcctcacctcccaacagctgaaattacacccacacttaatcacagatcagcttcctgtggtcctgtcccccgtcccggggaagcctggagctccctaaggcccatctcaccctgctgctgtgcccaacccttccccataagccactggctccggaccaaactgaagggcagatgagagcaagggtagcaggcaaagagggtccaaggtgtgctgggagcctgggctaggaattgatctcatttttgacttgcaacaaactcctcaaccccattgtacagatttggaaactaaggctcagagagaggaactcgccccagatcacacagccagaaaccgcagcccagagactcatacttgggtctgtaagacttcagagacaggccaggcatgatggcttatgcctgtcatcccaacactttaggagaccgaggcgagaggatcgcttgaggccaggagtttgagaccagcctgggcaacaaagtgtgatgccctctttttttttttttgagacagagtcttgctctgtcgcccaggctggagtgcagtggcgcgatctcggctcactgcaagctccgcctcccgggttaacgccattctcctgcctcagcctccggagtagctgggactacaggtacgtgccaccatgcctggctaactttttgcatttttagtagagacagggtttcactatgctggccaggctgatcttgaactcctgacctcatgatccgctcgcctcggcctcccaaagtcctgggattactggcgtgtgccaccgcgcctggccccgaaaaactttttattgtttgtttgttttgaggcggagtctcactctgtcacccaggctggagtgcaatggtgtggtctcagctcactgcaacctccgcctcctgggttcaagcgattctcctgcctcagcctcccgagtagttgggattacaagcatgcgccaccacacccgtctaatttttgtattttcagtacagatggggtttcactatgttggccaggctggtctcaaactcctgacctcgtgatccgcccaccgtggcctcccaaagtgctgggattacaggcatgagccaccgcgcctggcctgaaaaactttttaaaaagaattttataaagagacttcaggggccaagctctttccagcccaccaccagcagcctggggtgggacagcgaccctccatgtgttgctgagaaggctctctaatcccacaggattggagctgcctgtttatttgtctaaattaccgcccaccagcctgtgagtgctgggaaggcacagacagggcctgtccttgctggtccaacccaccccagcccctagcaccacacgaggttcactggttcactggcacacagtaggtgcatggcaaatatctgcccaaagaatgaacctctgtactcccagtgactgccatggaatgtcgctcagtgatgatctgttgaatgaacaagtgaatgagatgatctgccacggtccaggaatgtctgtggaaattcctcatgcacacagcaaacaactccacccaccgccatcctaccgcacccgggcatggaggagcccctcatcgggggcagagctgggggaaggtcaggaaagactgttgggcctcggaaaacatcccacgtgctaggttggtgcgttgggaaaagtaaaagtcagtgccaggagtgcaagttcaggtcaagactagggagctactggatggccctgctgaatattttggggtgagaggctgaaacaggaggacgacagaggaggctgcccagagtggggatgggggaggagaagtgctgggtgggtggggcaagagcagtgaggagccaggtctgggtgggggcttgacgagtgactcaggagggtagaggtgcgatgaagccaggaaggtgaggccaggcaggcagttcctgggtaaacaccagcctggttagaaaagtccctctcttggctcagagaacagggaggcaggtatggggactgcctaggagcacctcggagagagtgggggtggctctgtggctccccacggtaggctcggctccccagatgtgcccccacccacatctgccactagctccctgcccaccgaccccacccagtcctcctcaagttcactcaggtcctcagggcctctgctggccaagtgccttctaagcctcgggattcctgaccgtagaattcccttttcctccacctaagctcagagtaggggactagactgcaagggcaggcctctccctgcctcttggagacctgggaagaggaaagctggggaactcgggtcccccaagggtgcactgcatccccgcaccacgcactttgcagctcattccacgcagtccagcaacgccctgcagctatgcattttgaggccgtgcattttgagttcccttgacccacgtggggctggcctcagagaggttaactagcgtgccccaggtcacacagttactcagtgaaaggcagggattgattcaactcttcggctgtatgactccaaggcccgtgggtgttccacacaagcttcagttctgtcccaaaagttttgcttgtgcctacctgggtccaagctccccaaggtgatagacggtgtggtaaagtttcagcgagactcatagggtccccatcaccactgagtggccgttctgccaagctggcgcagaagggttccctcgtcctgccaagttcccaccctgctcaaagtttcccctcctggtccccaggaatggtaggccggaccatgcccagcgagactccagcactcggcaacgtggccgagagacccacgggctcccacacgggccagccccgcccccagccccacgaagggtcctgactggtggcccccctggattagccccatgccgcagggtggcgccggcccggggtccccggcgggcgccgccgtcccgggccagagtccccgccgcgcagccttgggcgccccagccaagttggcgggaggcggcgagcgggaccggggcgcccctagcccctccgcccccgccccccgcccctctgccccgcacactcaccgccagcagccgcccgtgcagcagcagcgccagcagcagcgcgcccgccgcccgccaccccatggcccggcccgcgccgctctctcgctcgctcgctccgcgccgcccgctccgcgccgcccgcagccgcccgctcgccggccagctcgggacagcgcggccctctccccaccgccccctttcctccccgcccgccccgcccccgcagcgccggccccgcccccgaaccgcccctccccggagcgccaggccccgcccacggaccgcccccgggccgcgggctctgctcgccccagccggccgcgcagcctactaggcctttgtctgggcccccagccccctccgcgcgggccgcggcccggcccggctccccgccaaacccggcctggagtatgggatgggacggggcgggggaccgggggcccgggcccgggcatgggatggggccgccgggccaggcgctctcgcctccccgatccccggctcccccgcttccccgcgcgcgccgccgacttccacgcccctgcacgccccgcacggccgactccactcgcgcagcttttgaagatcccgggatctccttcccacgctcacacgcacgcagctgccgctccgcgccacacgtgcacgccaacttccacacccaagaacaccttcacaccataactttactgcacgaacacacttgtgcgctacccgggaacactttcacactctggacccaactctgaagtaccaacaatcctcaccggctcacatgcacacttaactcgcttccaaactctcacctccaccagggacacaggagacagccctcacaccacactcagcccctcactcacgcatacatcccaacaagtcacggagcgggaggacgccttttcacatagattcctcgcaggcacgcacatttcacacacaggcccacatcattgcctacatgcttaccagcttgtttttttttttttttttttttttgagaaggagtctcgctctgtccccaggctggagtgcggtggtgggatcttggctcactgcaacctccgcctccgggttcaagcaattctccggcctcagcctcctgaatagctgggattacaggcgtgccaccacgcctggctaatttttgtatttttaatagagatggggtttttaccatgttggccaggctggtctcgaactcctgaccttgtgatctgcccgccttgccctcccaaagtgatgggattacaggcattgagccaccgcacccagcctcagcctgtatcttttacctgttctcacccactaatcacagtgcctcatagtgggcactgggtactgaactgagctgcccaccccacctgcaccattttccatgtaaatcactcacacaccaactttgagtcacataaatcacagccccagagccagaaccacaccaactcacacactcaggcccagacagacagaccctgccaaagccccatcacagatgctcgggtgggtggtaaaatcacagccccatgatctgtctctgacccaaccgcaggcagcaaacagcaccaagcccccagacctattcactgcctactcttcagctcccctcttctgcctgaaatttccagggcagcccgaggctgatgggtggagaggaaaactatgtgtgtgtagctttgaggaaaaccttttgagtaatgatagaggaggagaataaaactgaagtttccattgtttcctgtgagagttgctaggttccagaaactcatggctgggtttgcagccaggagtgaggtgagctgtggacagaaggaaatgcccagctcactgggcggcaccaggcctggctccggaagctatgttccctgtgataggggtccgcaggctcccaagcacattggggcctctcatccaggcatctgggggattgaaaaaacactggcatcctgacccccatcccagatagatcccctatctccaaaagatatctccaaaatatgccctgtggggcatatttctgtgggaccagctcagagttgtaaagaacagaaattgcatccacggtagtcaggccaactgcctggccccaacccaggctccaggcacagcactgaataaggtctatctctgatccgcacagggagataggggtggacagaggagggacgcccaatcttggccctcagtaaactcttaatctgatagaggtgtggggaagaatagtccctgtccgggtattgttctcagtctgatagagaatcctgcctccaccacctagccgtgcaatcttgagcacatgattcaacttccatgtctcagtctctgcatgtagaaaatgagaataacgttaagacgtctctcttagtgttgttatgagaattaagataaattaatatatttcttttaaaaaacacagccatttcagacacttggtaagcatgaaataagtggtagccatttctcttattactatttctggtgtgctcccaatctaaagagagagacatgacttggcccttggggagctgaggtctgatagaggagcagcctccacagccaccccagggacctcccatttgaggggagagtacaccaggtttgcacttggaaactccctgtccgatgagaaaggcttcaaaactccactgacttcagagctggcaggtggccagccctagtggcaggatttttccaaggccttgcctgtccatggatttgtcagcatccgtgacaaatcgcatttcatgagctgcctcagtgtctgttccctacctcgggccctttaagtaccagagctttggcttcttggatgatttgctcatgagcaaagggggaaaaaaagggaaacaagcaaccctttgtagatgtttggtcaagactaacccagagctataagtcttccttcctcaaaggggttgaggaaagagatggtaaggccgactagggactggaaggagctgggctgacacgcagaaagcaggaatatatggcatgttgagaaagtcttccagggcggctccagcagcggaggattggtcatccacctatttattctgtgtcctctccttcccactaagggatttgcctgggtctgttttagtttgcagtccttgatatctttagcaaatgctctcaagttgctttgtctagagcctggctatctcctcatatggctaagaagaggagcaggcacaaggccttctgggcttggcaaaaccttggaggcgcccataatctcactgtatgtacacagagttcagggtgctggtcacactcgaggagagaaacaactcaagtctcatacaaggttccctgggcacggagagactacaacagcttggataggcagaaatagtcaaacagcttgacttctgagaataggtgttgggggttctggaaccagcagctggagtttgtggcttacctgtccactcctccaaattcagtaggactcatcttctggcttccactcccattccaaatcttttctctgcctgagagcttatcattcatcttaatcacattcctttgtccattcattcattcattcagggctgcagtggacagttgcgcaggttgttcactgaacaaaggtgtgcagccaagtgggtaaataggaactgtaatgggccctgttgtggggctacatctgcccagaatgggtacttttttttttctttttgagacagaatcttgctctgttgcccaggttggagtgcagtggcacgatctcaactcactgcaacctctgcctcctgggttcaagcgattctcctgcctcagcctcccaagtagctgggattacaggcacatgccaccacacctggctaattttttgtatttttagtagagacagggtttcatcatgttggccaggctggtctcgaactcctgacctcaagtgatccacccgtctcggcctcccaaagtgctgggattacaggcgtgagccactgcacccggcccagaatgggtactttttgctgatatgagtgaaggcactgtaaggctagctgtggccctatattcattcaatagtgaaactaaacactgcccacgagagtttctatgtccatgtgggaaaacaaatgctaatagagtaacaatatgtccttgggtgaaaatgaagagtcagaaattggtgtgaaagagaattgagatggaggagaaaaaacaagaagatagtactgaagaagaggaggaagaggaggcaggaggtgggtctaagcaggcagcaaaagttcccatggagagggcggggaccccacaaggcctggcatgatctagtcctgcccatcaatccagccacagcccttccccaccatagtctttgcagatgctgttccctctcctaagtgcttttcccagttaacacccatcccccttcactctactctcccttaagattgagtccaaacatcacatgaccacagaaatcttctctgacctcccaagcgaggtcgtgttccccaccacactttcccacagcgccccccccgccatgcttttcttgtagcatttttgaccattgtaattatttggaagatcatttaatattatgaggcataatgaaggcagagggcatgaaggtcttgtttctgtcttggtcccaattatatcccctgtgaagagcacagtgtgtggcacagagttggcatttggataattgttacttaaatgaaagaacaagacattagttcaaacgtggcacacagtgtaaatgtccctgttctggtttgtgcttggaacaaagataaaccctggggagcaggcaaggcagtacattttattattcccctccctttccagctgggaaaactgaggcccaggggatgaagtggcttgcccaggtcatgcagtcagtaagaggtagaaccaggattcatgtccatgtcggtctgattctacaaactcccattctcaaccacacccattctgcctccctgtgggctgttctcaactctggccaggcacaagtgcgcttctcccagctcaggcagaagcgtgaatcttctgaaagctcttgtatttgaccccctgccccaacttgatgtttccccactacccttcatcattatcaattgctttcttggactggggtcccaggcccaaggcagggttcccacactgtgcctcatgggtcacctgcaatctgagatgctctttgaaaaagaggttctttggccaaagaagtttgggtaccctgcactctttcccacactttgaccacctcaagggacaccaaagcaggaagggttttgaataggcctccagtgaagtcgcctgtgcaactgtgtttaatccagccttcctcaacctctttgagaacggaacccagtggtttttatggaaaatccttttaaaatcttatagggctgaggtttctcataacactttgcgaatgctgccccagagcctggctcctgagctgaccatagatggtctttataatttgaatttgcactcatggctctccactcccacccctcccctccagccaggctggaattcttacggctccgtacacactctcacattcctgcctactagcccctacttcagctatagaagacttctctgccaggctcgtggttagagctccataaatgctcctttcccttccctcgtcagtgtagacattacgcatttgatctcactgtgtatatttccacgcatatgtacgatttcatgtcttgcttttctcaccgaacattttttttttagtcggagtctcgctgtgtctcccaggctggagtgcagtggcgtgatcttggctcactgcaggctccgcttcccgggttcatgccattcgccattctcctgcctcagcctcccgagtagctgggactacaggcacctgccaacaagcccggctaatttttttgtatttttagtagagacagggtttcaccgtgttagccaggatagtctcgatctcttgaccacgtgatccacccgcctcagcctcccaaagtgctaagattacaggcgtgagtcaccgtgcccggcctttctcactgaacattttttagataaacacgttctatgtgtcaggaaggaacagagctacttaaaaatgagcctgtggtgccagcccccaaactgtttattaccagtctgagatgagataaagagcttgctccaggtgtaaatcaactgtttcaataagcacagcttagtgacggtttagctcagttgaaattttttttttcctggccattcttgtcccatattggaagcagcacatagatttatattctggtgcaagctctttgtgacggatggtgccatgaacaattcctgggccagctactttgaatagcattgacattgcctttgcgatggctcatgcctgtaattccagcactttgggagtccgaggcaggcggatcacctgaggtcaggcattcgagaccagcctggctaacatggtgaaaccccatttctactaaaaatataaaaaattagccggatgtggtggcaggcgcctgtaatcccagttgctcgggaggctgagaaaagagaatcacttgaatccgggaggcaggggttgcagtgagccgagatcgtgccattgcactccagcttgggcaacaagagcgaaactcagtctcaaaacaaacaaacaaacaaacaaaaaaagacattgcctttgcacacaatatttctttctttcttttttttttttttttttgagatggagtttcgctcttgttgcccaggctggagtgcaatggcgtgatctcagcttaccacaacctctgcctcccaggttcaagcaattctcctgcctcagcctcccgagtagctgggattacaggcatgcacgaccatgcctggctaatttttgtatttttagtagcgacggggtttctccatgttgaggctggtcgcaaactcctgacctcaggtgatctgcccgcctcggcctcccaaagtgctgggattacaggcgtgaaccaccgcgcccggcctgcacacaatatttttgataatcatttggtatcatgtcttatcaacacactgccattcattatgtgaatgatggaaatgttggatatttgggctgtttccaggtctttgttattcacaagggcattgctatgaatggctgtgtgtgggtccgtgtgttcactttgcagctccctcagtttttaaggaccacaaatccaaggctagggaggtggaatggcctccgcagggatacaagtggcagagaaaggcctcccacccaggcctcctgaccacccccagtcccttgttccttccttcagcctgcactgcccttcctcccagacggattttccgtccctttcatgattttctttgcttggccgtgagctttctgcagtgttcccgcatgttgtcttttggagcttgagagaaatccttttggaatgtcctgtgccttctctctccgagttcccggctttgttcaattgttcaccagaaattcctgccctgttgggaggggcctgggaggctgttaaagagtttgccaaaaatggtggtacccgctcaggcacagcacatggccgagcctctttgctgctcctgcagatttcagctgagagagggcagtgcgggtgcattttgaggtgcgggagggttgccactcaggcctcctttttatgtttcttaggtagagcaagcaggaccagtcctgtgtagacagaagaggcagtaagggataaaggagggcccaggaatggggtgagggacggggagggctgaggcttaggagagttaggcccatgaggaaagatgtggggtggagtgagaatgaggaatagcatgagcgtctctctctggcacacacaccttggtaataaaaaagctgcatttcttttcattttcttttttcttttctttttttttttttttatgagacagggcctcactttgtctcccaggctggagtgcagtagcataatctcagctcactgcagcctcgacctcccaggctcaagcaatcctcctacctcagcctcccaagtagatgggacgaaaggcgcacgccaccacgcccagccagtttttgtattttcagtagagacgggatttcgccatgtcacccagactggttctgaactcctgagctcaagcaatcctcccgccttggcctccaaaagtgctgggattacaggcttgagccaccacgcccagccaaaaagctgcatttattttctagagtcacagaagtgacatcaaactgtctgtttgaaaaggaccacaccagatttgtttaaatatacaaaaaaatttaatttcatgcagctatacccaatgataccaaaggatgcagagaccattggactgggcaactgataccatagatgacctttgaggaaatttctccctttgcttactatttactggaaagagcatgttccaggtttactctgccctgtttagaacactggtattgtggggcagcccaaactcatgttaaataccatccttgcttttcctaatttactacatattttggagaccaagatttactcctctttctcttggaatttgtttaataaatagtaagaaagaaactgggccaggtgcggtggctcacacctgtaatcccagcactttgggaggctgaggcaggtggatcatctgaggtcaggagttcaagaccatcctggtcaacatggcgaaaccccatctctactaaaaaatacaaaaattagccaggcgtggtggtggatgcctgtatttacagctacttgggaggctgaggcaggagaatcgcttgaacctggggggcagaggttgcagtgagccaagatcacaccattgccctccagcctgggcaacagagcaagattctgtctcaaaaaaaaaaaaaaaaaagaagaagaagaagaagaagaaaaagaaaaaagaaaagaaactgcactttgaccatgcaatactactcagccatgaaaaggaatgaaataatggcattcacagcaacttggatggagttggagaccattattctaagtgaagtaactcaggaatggaaaaatcaaacatcatatgttttcacttataagtgggagctggccgggcatggtggctcatgcctgtaatcccagcactttgggaggccgaggcaggcggatcgcctgaggtcaggagtttgagaccagcctggccaacatcatgaaaccccatctctactaaaaatacaaaaattagccaggtgtggtggcaaacacctgtaatcccagctactggggaggctgaggcaggagaatcgcttgaacccgggaggcggaggttgcagtgagctgagatcgcgccattgcactccagcctgggcgacaagagtgagacttcatctcaaaaaaaaaaaaagtgggagctaagctgtgaggatacaaaggcataagaatgacataatggactttggggacttggtagggggaaggatgggaggggggtgagggataaaagactacacactgagtacagcgtacactgctcaggtgatgagtgcaccaaaatctcataaatcaccactaaagaacttatgcagctaagcaaacaccacctcttccccaaaactattgaaataaaaataaataaataaaaagaagctgtactttggatgaaaaggacactggccgagagttagaaccctgggttgaaatcccagctctgcaatcagctgcaggcgcttgggcagtcacttcctctcactaagcctcagtttccccctcttcaaaatggggcactgaaacctagcctggcaagctggggagggttgagagcctgcgtttcaggcctcggcagcatgcctggcacacagcgtgagtgctcaatgagcgacgtacttctgcaagtgtgaaagactttcctcggccactcccagccacggggacaccaaggccactcctgaacacaagggggacagtacagcaggctgtggcattgtctgcagccagcatgctgcttcctgtttacatggaccctgcagatgcatggcttgaactgtagacctgggaggcttcctgtggcctctgcatggccaggtggagcagaggaccttccctaacaggcttattttccctgaactctggctgaataacttgtggaagggatttgtgaacagtaagtatctatcctgagaagca
